United States Patent 9,029,636 (ISOLATED NOVEL NUCLEIC ACID AND PROTEIN MOLECULES FROM SOY AND METHODS OF USING THOSE MOLECULES TO GENERATE TRANSGENIC PLANTS WITH ENHANCED AGRONOMIC TRAITS) - sequence listing, part 27

SEQ ID NO: 110209 - DNA, 267 bp, Glycine max
  Peptide Sequence Number=SeqID_226987
atgtcgttttcgtttttcaaggctttgaggcctaaaacgccgcaagaggtggccaagtccatcaaggagagtctcatggccctcgataccaaaaccgttgttgaagttaaagcccttgagaagttttgttcgagaaaaacaaccgtggcggaattatacttaacagaagagatttccaacctggactccgatgctcaagtcagtgtttgtgggagaagaggactgtgtaaatttagggagagtgtacctgatgcctgtatggcctaa

SEQ ID NO: 110210 - DNA, 318 bp, Glycine max
  Peptide Sequence Number=SeqID_226988
atggattcaaatgcttgtctaccacacttgctagtgttagcaataacattggtattggttagtcatgcaatgggagattcagctcaagacaaacagaaatgtgcagaatccctgacagctgttgcaacgtgtctgccatatttgggtgctgacgcgaaagcacccacagcagattgttgcagtggtctcacacaagccatgaagaccaacaagaagtgtgtctgccttattctcaaagacagggatgatcctgatcttggcttgaagactaacatgacaattgctgttggtcttcccaaagttaggggacagagatag

SEQ ID NO: 110211 - DNA, 162 bp, Glycine max
  Peptide Sequence Number=SeqID_226989
atgaggatgaggaaatggaggaaggaattggagtatcctgagcctcggagtgctattggcttctacttgaagaacccttgtgcttcttttatgaaatacgaattgggaacgagggtttcgcgagagaaatggaggttctggttcgtgaattctgaaatttga

SEQ ID NO: 110212 - DNA, 801 bp, Glycine max
  Peptide Sequence Number=SeqID_226990
atggtcgatgatcgtgagggggtcccaatttgcaattcaacgtcatcgcgaaaagaaaagatgtttgagccacaacagctatacactcgcgcgaagaccgaggaattcgacctcgaatcaggagaaaccctctacccagggctgagcgtcggcgagaaccagctccgatggggtttcatccgcaaggtctacggcatcctctccgcgcagatcgtcctcaccaccctcgtctccgtcaccaccgttttctatactccaatcaatgacctcctcaagggcaattccaccctcctcctcatcctcctcttccttcccttcatctttttgattcccctgttgaagtaccagcagaagcatcctcataattacatcttgcttgcactcttcaccgtgtcgatcagttccaccatcggagtcacctgtgccaacaccgacgggaaaattgtgcttgaggctttgattttgacctccgctgtggtttcatctcttactggctatgccttttgggcgtccaagaagggcaaggattttagcttccttggcccaatattgttcacctccctcattactctcatcctcactggcatgatgcagatgttcttccctcttggacctactgcccatgctatctatggtgcaattggtgctatgatattctctggctacattgtgtatgacactgacaacctgatcaagcgtttcacttatgatgagtacattggagcctctgttactctttatcttgacatactcaacctcttcctttccatcttaaggatcctcagggaggcaaataattag

SEQ ID NO: 110213 - DNA, 267 bp, Glycine max
  Peptide Sequence Number=SeqID_226991
atggaggaagagttccctcggtaccgaacaagcctagcaaacgtttgcgggtgctctcaaaatcaatccaaaaggattgagctggatgtacataaggagaatgtgtgtgatgaaacgaaaggaatggatcttgcagaaatgattgatggtggatggctgtgtggagaggataccatggaaagagatggtttggtgggtggtgtgggctggcatggcagtcatggaaggcacccattggagctcaatgaaagcaccaaaatgttatga

SEQ ID NO: 110214 - DNA, 1410 bp, Glycine max
  Peptide Sequence Number=SeqID_226992
atgaactttttcaagtccgtcttcgccgacgagcccgacgagcccgactctcctccggccgaatcggacaaccccgatccgcctcagagccaccacgactccgcgtggagcttcggcggcctcatccaaaccctcgcctcgaaatccgagtccgtcctcgagaactaccgtcgcgatctcgaggaattcgggtccggtttgaggaaggaaacggcggtgatacgcgaagccgcctcacgcgccgtccaagacctgccggcgtcgctggacgtcggtgcgtcggtggcgcaggagtcgcttgagtccgtcggccaagccatcgatgacattggcagcaccgtttggaactcgacagcgcagattatctctcacggtagggactctctcttagcctctgatttcgattccgattctttcgattcgagcaattacgataataacaatgctagcaagaaactgttgagcggtagtggtagcagtgatcgtggtttggatttgaaacggtatagtaggtttgatacgctggtgcgtgcgcttcagtgtgatgtgaatacctatttggaagagcctgaggatttggggaatttcaatgagtggaaattagggtttgaggtgaatgagaagagtgaggagattcggaatttgattgaagagaatgaagttgttgatgagatttatgagaaggttgtgcctagtaggattgatgatgagagtttctggagcaggtatttttataggctggataagctgaggcaagctgaggatacgagggctaagctcgtgaagcgtgcaatttccggggatgaagaggaggatttgacctgggattttgatgatgatgatgaaggtggtaatgatgggtatgagcctttaggtgatacccgtagcgtttcagaggtgaaggagggaaaatctggtgacggtgccatggatggtggtgatgttgagaatgttcaggctgggaagaaggatgatggcaaggttgttgagaatgttcagattaggaagaaggatttggagatagaggatgatggaaagagtgtttctgctcctgaattgaaaactgatgttgatgataagtcggagaatgtgtcatctaatgtacctgagaatgtaagtagcagtggagataagttggatgttaaatgtgaagagaaagaggcatcagaagggaagacagataacgataacaatggttcgtgcaaagacagtgatatttcagttgtttcaagccagccttcaatgcctggggaagaagacattggctgggatgaaattgaagatattgaaagcaatgatgagagtaaaggggccacaagtaggattgatttgcggaagagattgagtgtggcagacgaagatgaggatctgagttgggatattgaagatgatgatgaggctgccaaataa

SEQ ID NO: 110215 - DNA, 459 bp, Glycine max
  Peptide Sequence Number=SeqID_226993
atggaaagcaattttcacgtagatgttgaggattctagcagcagaggagacattgtgggacagcttgtaacaccacttcactctgccttgcctcttgagagcataaacaacttccattgcgataacagtcttcctcctctcgtgctcgaggtagggaaccatgccgacgagaaagccccttgtgacaccgtggaggaacttgtccttttgggtacgctagagttgtcgtccaaggtgccccctctgccgatgacacaagttgcggcgcaagtggttttgttgtcgttgcgaccagtatcggtgccagagttcttgtccaagctgccccctctggtgacgaaacacgttggggcacaagtggttttgccggaggtgtttcacactgtccaccaacattaccgccatggccactgcaacatgatctcctacggcagcgtcatcctgcacggcggccgctaa

SEQ ID NO: 110216 - DNA, 2289 bp, Glycine max
  Peptide Sequence Number=SeqID_226994
atgattgtgaaggatcattttgttggtactgaactggcaatgagtaatacttgtgtggaggagggaatagatttctcttgtgacccatacatagggttagaatttgatacagctgatgaagcacttaagtattacacttcatatgccaatcgaacagggtttaaagttcggattggtcagctttatcgatcaagaactgatgggtcagtttcttctcgaagatttgtgtgctcgaaggagggacatcaacttagttcaagaactgactgtccagcattcataagggtacaactaaatggttctggaaagtgggtggttgatcattttcataaggaccataatcaccatcttgaaatcagtggtgaaaattgcactccaacattgcaaccgaagggtgctggtgctacagttatcaactctcttactgagtttcctcgcaggacgaggaagaaattgcttgaagaagccaatgatgagtcctcttgtccctttggcattattgatttcaagcgtctgagaaaggaagaacttgaaggacagtccaggactgaaccatatgtgggtcaagagttcagttcacctaacgaagcctaccaattttatcatgcatatgcagcgcatttgggttttggagttcgaattggtcaattgtttcgttctaagaatgatgggtcgatcacatcccgcagatttgtttgctctaaagaggggttccagcacccttcaagagttggttgtggggcttatttaaggattaagagacagccatcgggaaagtggatagtggaccgcctccgaaaagatcataaccatgatctggactctgaaaaggtgggcagggcaaaaagtcttcctgcttctaatattttggctgaagaggtagatactggattgttaaatggtgacttatttagaatagataactaccctgtccctagaggaggtaggcaaaatcacattagaagtgagtggtatggcattcttttagagtattttcaatcaagacaagcagaagatactggattcttttatgccatggaagttgacaatggaaattgcatgaacatattttgggcagatggaagatctagatattcatgtagtcactttggtgatgtccttgtcttagacacatcataccgaaaaactgtctatttggtaccatttgctacttttgttggagtcaaccatcacaagcaacctgtgcttcttggatgtgctctaattgctgatgaatctgaagaatctttcacttggttgtttcagacatggcttagggcaatgtctggccggctgcctctgacagttatcgcagatcaagacattgcaatccagagggcaatagcaaaagtctttcctgtaacccatcatcgcttttctttgtggcaaattaaggcaaaggaacaagagaacatgggtctgatgggtaatggctttacaaaagattatgaaaagtgtgtttaccagagtcagacagttgatgaatttgacgccacatggaatgtcctactcaacaaatatggattgaaggacgatgcttggctaaaagaaatgtatcagaagcgtgcatcttgggttccattatatttaaagggcacattttttgctggcattcccatgaatgagagccttgattcattctttggtgcacttttaaatgcccagacacctctcatggagttcattcctcggtatgaaaggggtctcgagcgacgccgtgaagaagaaagaaaagaggattttaacacttctaattttcaacccattttgcaaactaaagaaccagtagaagaacaatgtagaaggctttacactcttactgttttcaaaatatttcagaaagagcttttgcagtgctttagctatcttgggtttaaaatatttgaggaagggggtctgagcagatatatggtgcgtagatgtggaaatgatatggagaagcatgtagttacatttaatgcatcaaatctcagcattagttgtagctgtcagatgtttgaatatgaaggtgttctttgtagacacgtgttgagggttttccagatattgcaattaagagaagtcccttctcgctacatcttacaccgatggacaagaaatgccgaggatggtgtttttcctgacatggaatcatggagtagctctcaggaactaaaaaatttgatgctatggagtctaagagaaactgcatctaaatacatagatgctggtgcaacatcctttgaaaagtataaacttgcctttgaaattttgcgcgagggtgggagaaagctttgttggcacaggtga

SEQ ID NO: 110217 - DNA, 483 bp, Glycine max
  Peptide Sequence Number=SeqID_226995
atggttgctcaagggtacaatcaactagaagagattgactatgaggaaacctttacaccagtagcaagacttgaagttatcagaatactcttagcctatgcaacacacaaagacatcaaattgtatcagatggatgtcaagagtgcatttttgaatgggttcatatatgaagagttcttcctagggcttcaaatcattcagaaagatcatgggatattcatctaccaagagaaatacacaaaggacctactgatgaagttcagaatggatgaagctagacctatgactacccctatgtatccttccataaccattgattgggatgagaaaggctattgtgatgctaattttatcggtgataaagtagaaaggaagagcaccagtgatgcctatcaattcattgtaaaatcagtggtttcttggccatctaagaaatatatcataattaccctatcaatctcaacaactgcttgttgctcttaa

SEQ ID NO: 110218 - DNA, 597 bp, Glycine max
  Peptide Sequence Number=SeqID_226996
atgggtcgacagtgtcgtgctgaggccttgtggccgctattgttcttaacgttcatgttcataattgttctgattacgatagaccatgcgtcaactgggatttttatatttttgggttccatattgggtttgttcctatggtattggttaggatcgcttgtattagatcgtgacaactgggataactcacacgacgtggatgatgagagaacgagagagtttcaaaacattgagtcgtctaatgctagtgatccgcagaattctctccctctcacaaggactcgcattgtgatcgcgagtgtaagggctcgaagggaaccttggcaagatgtacaaccattttcttttgccccaagagcacatgctgctaggctatccatgagagccttgccccccgctatatgttttcagggtgatgacgaatcccaacgtgattgtcctatttgcatggaagatttcaagaatggagagttaattcaaccttttggagtttgtgtccatgagtttcatttgtcatgcgttaactcttggttactcggtggtggaaagactacttgtccggtttgtcgcaaggatttatcaattagtgtagactag

SEQ ID NO: 110219 - DNA, 249 bp, Glycine max
  Peptide Sequence Number=SeqID_226997
atggatttggctgcttcaattgatgagggacatgttcaaaagtttactagagtagtgaaggagtttagtagcataaccccattggtatacttctatatacaaataagagagctttcacaaggggcaagtggtaatgagaatgaacaactcaccagtgacgacgacgttggggtgatactctggcaaaaggcggcgagggagctgaggctagggttccacggcggcggcggaggttctttgaacctttaa

SEQ ID NO: 110220 - DNA, 399 bp, Glycine max
  Peptide Sequence Number=SeqID_226998
atgatcatcatcaaaacaccaaaggcaattgcatctacacaaactccatctgaaacagtttgggagcaacaagacaagaaagctgaggctgatttgcaagttggagaaaacaatggaatagacaaagtggttcaaaagaatgatggagactacgagaaaagcctcaatgaagccctaaatcacatacaacttcttaagagggagttagcaggaaaggatgcaaagtttgtaaagaagtcttatcataattccgaagctaagtactgggaaaccgatgagcaaatcaaacaattgcaagacagagtttccattcttcaagatgactttggagaaggtgttgctattgaagatgatcaaggtcatcgtttgatggcaaaagctgctcttaaatcattttaa

SEQ ID NO: 110221 - DNA, 2643 bp, Glycine max
  Peptide Sequence Number=SeqID_226999
atggattctccaggaccttccaagaacaacaatggcagttcctcttctgcttccactctcaacaacaacaacaacgatgctgcttcatcggaatcccctcaagtacaagaatccccctttcttagatttgtaaagactttatctccaatacccaccaaggcttctcatacgacacaaggttgtctaaggctcagttctccaccccttgtattcaagtctcctcgaattagtcaccgtgaaacgcagctcacagaaaggccccaaggcactcggtcactcggtggagtaattcttcaaagtgtaaatgaaggcaacatgcttggtgaagctcctggagattccaggacatcaaattctcagcagtcactgccagagaggtttataaatgacactcagcaggtttttgactccaagaatgatgaaaatactcagtactacagttctccatcatgcattgataaatatttggtggatcctggggatattgatcaaatgtattcagctggtcaggatgtggaacaacaatctacagatccagctgaagcatcactaagtgaccaaattcacccaaagaataatatattaaattttgacaggcaagacggtcctggtgataaagtagaagaatctttgcctttgtcagaaggttttaacaagtttcatcaagaaaatgcagcatatggtgaagaacctgaagagatggaagtggagaataatgatgttcaatggtcttctcaagagcccgcaaagttagagtccattttagctgcagatgtttttgagaaacgatacagtcatgatacacttcctcagcttcagcttgtcgaaaattatcgatgggatcataaaaattgtacacctcagtggatgcctgatcctctgcagggtgttaaaggatgtgaagattacaatgagatggtgccaacctcacatgtaactgcagagaatatcttgcaagatggttctaaggctactctaaagtaccatggcattcgtagacgttgcctacaatttggggaagctgcctcaaatgctcttggaagtaatgtgaaactaaatgcaacttcaaacaaaataataatggtcaagccgtctgaacttgtcacttccttgtgtcctcagcgaggtagtggaaacttccctttgacaggtcccaagccaacaggtattgggttgcatataaatcgcatcatgaatgctattccaactggtcaggctgcaactatgggtgtgagattatcagatggttcacaggggatgaaatccacatcttcaataaggttacaaagaatagagaatgtaaagagatccatactttcgtctaatgttgatgggcgatcattagttaatacaagaactgagagccatgaaattgatgatacaggaaattctgaggacttcaacataccttctagcccctgccagaaaaagaagaaaatatcagagactgctgatgacgatggctgtaaacattgcaactgtaagaagagtagatgtttaaaactttactgtcattgttttgctgctggtacgtactgtaccgacccttgtgcttgccaaggctgcttaaacagaccagaatatgcagagacagttgtcgagactaaacaactaattgaatcccgtgatccatctgcatttgatcccaagattgtactgcctaccactgatatttcttcacatatggatgatgaaaatctgacgacaccgtcatcggcaaggcacaaaagaggttgcaattgcaaaagtggatgtcgatgtgagggatgcaagaatgtctatggcaagaaagaagattatgttgcatttgaacatacttcgagcaaagaaagggagagcagtattgttgaagaaggatcagactacacttttcacaagaaactggaaagggtggctagcaagactgtttatggtctacactgcctctcacctataacgccatcattgcaatgctctgagcaaggcaaggaggctgctaaatccataattatttctggaaactatctaccatcccctgaatctgatgtcaatatgtttgcatcttgtgcaaactacactaaatcttctgaaaatttgcacagcagtcaagcacttctgggcacaaatgagatgttgggaagtaccccctatgattcacaaattgaatgcagccatgctgccttacttcagcttactcctcctctgtctaatcctgagctgtgtggcacttcatcattctcatctatagcaaatgagtggagaaatatttctcaatcccaacccacccacggatgtattagccagttacccagtggctctctttgttggcgtagttctccacttaccccaagcaatagagtaggtgaagcacaatattttcagtgttctgaatcagatagcaggctctttgacattctagaaaatgaaacccctgatgtactgaaggaagcttcaactcctatgacgtctgtcaaaataaattccccaacccaaaaacgagtttctccacctcagagtcgtcattttgagattggatcaagctcctctggaggtttgagaagtgacaggaaatttatatttgaatctgtaccttctttcccttcattgtctccttgtgttaattcgaaaagcaatggtgatgatgatgaggaggatatctcatga

SEQ ID NO: 110222 - DNA, 198 bp, Glycine max
  Peptide Sequence Number=SeqID_227000
atggggtttatacattcgcaagggtggatattcgtcgatagtgggaatgaaatggagcatgaaacattccttgcaacttggttcgcagagattgatttctctcccaatggcttgagattctcaaatttgcaaccacaccctaggttgatcaaccatgaaaaacctatgctatgtaggtggcaccggctaaatccctag

SEQ ID NO: 110223 - DNA, 270 bp, Glycine max
  Peptide Sequence Number=SeqID_227001
atggtaggaatgaaagtggtaaccctcacgattaaagataggtggtctattgtcgcaacctacccttcggagggagggcgacgcgagactcaagggtgtgtcttccaagaaaggaaaatgcacagagtcaccaccaacgtttatttgaggaaaacgtcggaaaaaccgaaaaggtgtggtctacgaactttaagtgtgaaaggttcaggagttatatttacacacggggaagatattagcactccacgtgtccgtcacaagggacggtag

SEQ ID NO: 110224 - DNA, 189 bp, Glycine max
  Peptide Sequence Number=SeqID_227002
atgggcgtcatcaagtacatgaccatggatgaattaaagctcctaagcttcccctcaaaaatgcttaaattctttaaccactctagtttcccacacaagggacatccaacaaggaaaatcagcatgcaacaaggacatgcatatattctcgttgctaggttccctgaccctaactatggtgtcaaaacg

SEQ ID NO: 110225 - DNA, 378 bp, Glycine max
  Peptide Sequence Number=SeqID_227003
atggccggcattagcgttcaggtccatcctcacatgttgcgacattcctgcggttacgcccttgcggataaagggatcgatacgcgtttgattcaggattatttagggcacaaaaacatccagaatacggtgatttacaccgcgaccaacatgggagaggcagcccggcacgtcatcaacggcctactcagcaatattttaacgccgagctgcttttcatgcatcggcgccagggataggccacactggttcgctgtcattcttcacctgcagcttacgcatggcgctgcatttatgcgcgctgatcgtcttgatgctgcgccgttgcaactcggcgatttgccgcaggctcattccgttgaacaaaaaggccaagac

SEQ ID NO: 110226 - DNA, 261 bp, Glycine max
  Peptide Sequence Number=SeqID_227004
atggtgagcggaatgaccataatttgtcttcgcatgtcatcgggctcgccgcctctggatgacaaaagggtgcagaatgaccataatttgtctctttgtgccatcggacacaattgtctccgaatggcgaaaagaatgaccataatttgtctccgcatgtcatcgggctcgccgcctctggatgacaaaagggcacagcatgaccataatttgtctctgcgagccatcagacacgattgtctccgaatggcaaaaaggtga

SEQ ID NO: 110227 - DNA, 273 bp, Glycine max
  Peptide Sequence Number=SeqID_227005
atgcggggaagttggctgaggaatgtgaacattgtgatcctcatcaacaaagaaagcatgaagaataattttgaaggtgcgcagatcatgcaccacctcgtccacgacccatattcccatgctagacgcgcccagaaaatcaaaaacctcctcgtgcatgcattaattcttcaccaaacccacataagagatgaggccctcacgttttcctctagcaccaagctcacctccactcttcaaagtgataaaaataaaaagggtcagggctactga

SEQ ID NO: 110228 - DNA, 999 bp, Glycine max
  Peptide Sequence Number=SeqID_227006
atggctctatatgaattagcagtttttgatccctctgaccctgttcttgacccaatgtggagacagggtatgttcgttatacctttcatgactcgtttaggaataaccaattcgtggggcggttggaatatcacaggagggactataacgaatccgggtatttggagttacgaaggattgtatggtcctggaatatgggtgtccgatccttatggactaactggaaggatacaatccgtaaatcccgcgtggggcgtggaaggtcttttccatcttagtgtgcgtccaccccaacgtctatataaaggattacggatgggaaatattgaaactgtcctttccagcagtattgctgctgtcttttttgcagcttttgtcgttgctggaactatgtggtatggttcagcaacaacccctattgaattattcggtcctactcgttatcaatgggatcagggatactttcagcaagaaatatatcgaagagttggtgctggactagccgaaaatcaaagttcaatggacaatggagatggaatagccgtcggttggttaggacatcctgtctttagagataaagaggggcatgaactttttgtacgtcgtatgcctactttttttgaaacatttccggttgttttggtagatggggatggaattgttagggccgatgttccttttcgaagggcagaatctaaatatagtgtggaacaagtaggtgtaattgttgagttctatggtggcgagcttaatggagtcagttatagcgatcccgctactgtgaaaaaatatgctagacgtgctcaattgggtgaaatttttgaattagatcgtgctactttgaaatcagatggtgtttttcgtagcagtccgaggggttggtttacttttggacatgcttcttttgctctgctattctttttcgggcacatttggcatggtgctagaactttattcagagatgtttttgctggtatcgacccagatttagacgctcaa

SEQ ID NO: 110229 - DNA, 183 bp, Glycine max
  Peptide Sequence Number=SeqID_227007
atggtggtgctcggtctagatccggttaaggccactacaaacgatcaaagtgattttgaatctgggtttgctttgattttgattcatggtatagtaactccggcagcgcagcaaccattcttagccaaggtggttcatagggtgaggggagaagaagaggaacggagaaggaatatagtgtag

SEQ ID NO: 110230 - DNA, 402 bp, Glycine max
  Peptide Sequence Number=SeqID_227008
atggagttttatgttgttgctggagttttgtatgcttttcttcactattttggagagagtgagactttggacaatgttgcggaaaacaacatggggttgaaaaagcactgcacctctgactctacttggatcatcgtccatggccatatgaacgggagtaggtgcaagaagaggaccaatgatgaagagggaattttttgggggcttgcagaagggcaattcggggaacatggttttgatgagagggggagaaagagagatgtaaggagagagaaaaaggaatcgcacgaagacagtaaaaatggaggcttcaatcccttctccgtctctctgacctttgggaactctatcggtatcggagcagtcggaggaaaaactggaggaatctcagggaaccgctag

SEQ ID NO: 110231 - DNA, 180 bp, Glycine max
  Peptide Sequence Number=SeqID_227009
atgaaagatgaagctgaagtgaatggaatagattttgaggagatcaaagtcgatttatccaaacgtcagcagttatctcccgaattccgagaggataaccctttaaggaaagtctctgctattgttgatgaaaggttcaagctatttgagagtcatcttattcccatcaacaaatcataa

SEQ ID NO: 110232 - DNA, 1164 bp, Glycine max
  Peptide Sequence Number=SeqID_227010
atgacgaaagggggtgaggagagcaaggaagagaacggtggtgcagcggtaaagttgtgccttggtgacttgttggtcatgggttcgaatccggaaacagtctctttgcatatgcaagacactaggttgagggaattaaatcggagaaaggctaaggttgcaattggaaatgtaaatgctatcaagcaggcttcagttatagacttgtccaactctcttgctgaagaagggaataggaagatgggttatgatgattctattgatccaaaggttaactctaaatctgaaccccatgtagcgcatacacaattatccttccctgttatggatgacaatgcctttcctatgtgtgaggttctagatcagaactttgtggatgtaaatgatttgtctaagttggagaaggttggatttattggtgcttgtgaagccttgcaacattatggtgtgagcgttggagttgtggcctgcttgctgaaaggggaggttaagaagtgtaaggaggaggctgctggtttgtctaatagactctttgtttgtaagaagtgtgttgctcaagttgaggaaatggagcaatccttggtctatgtgaagaagtggagaaatgcaaaatcagagtgtgttgtgaaggattctgctacatttgatgatcatgtagatggctttaacagggacttggtacatgttgttgccctttaccctgatgtggacttttttggcattgagctttataaagatgtggttgatgggaaggtgattgattcgtcctttcctcctagaactcctactcccgaagatggagtgttcttagagttagcacctccttgcctttttgctcctaaagtcttcattgttgactgtctgccttgtgtgtatggggaaagattgaagactcttggtgatgagaatgtgtatccatgtactagtgttgtgtgcttgtcctcccgttgttatagtgccttcctcattggtagatcgtctttgtgtcaaactggcctgcgcttccgtgactgcaaccacattgtggagatcgtgtttgtggagatagtctttgccacttatcgattgagttcgtgtttgtctcaaactgggctgtgcttccgtgactgcaaccacattgtcgagttcgcatttgtggagttcgtgtctgcacttccatcgaag

SEQ ID NO: 110233 - DNA, 1968 bp, Glycine max
  Peptide Sequence Number=SeqID_227011
atggcacagattttggctccctctacgcaatggcagatgagaatctcaaaatcctctcccaatgcaactcccattacatcaaacatgtggagttctttattgtggaaacaaaataagaaagtttcacctaccagttctgctaaatttagagtgctggcaattaagtctgacaatagcaccatcaacaggctcgagggtctacttaatttggatatcactccattcactgacaagataattgctgagtacatttggattggggggacaggaattgatgtgcgcagtaaatcaagaacaatatcaaagcctgttgaagatccctctgagctccctaaatggaactatgatggatctagcactggacaggcacctggtgatgatagtgaagtcatttgcgattcttacaccccacaaggtgagcctatccctacaaacaagagacacagagctgctgaaattttcagtaacccaaaggtccaagctgaagttccatggtatggaatagaacaagagtacaccttacttcaaacaaatgtgaaatggccattaggatggccggttggtggctatcccggtcctcagggtccttattattgcagtgctggggcagataagtcatttggacgtgacatatctgatgctcattacaaggcttgcttatatgctggaattaacatcagtggcaccaatggggaggttatgcctgggcagtgggagtaccaagttggtcctagtgtaggtattgaggctggtgatcatatctgggcttcaaggtacatcctcgagagaattactgagcaagctggtgttgtgctctctcttgatccaaaaccaatagagggtgactggaatggagcaggatgccacaccaattacagcatgagggaagatggaggctttgaggtaataaagaaggcaattttgaatctatcgctacgccacaaggatcacatcagtgcatatggagaaggaaatgagagaaggttgacaggaaagcatgagacagcaagcattaacacattttcttggggagtggctaaccgtggttgctcaatccgtgtgggaagagacacagagaagaatggcaaaggttacttggaagacaggcgaccggcttcaaacatggatccatatgttgtgacatcattacttgcagagactacactattgtgggagccaactctggaggctgaagctcttgcagctcagaagttagcattgaaggaccccacccacctcatgaactgtaaccatgccgccaccaccttcctttcgctcgctctcccaccaccgccaagttccgcgcttttcccaaaacgcccttccgcaatcctcaggccgtaccaaacccttttgtccagcaacaccaggctcggactcagagttagagcttcaaatggtgatagtaacgttcaaccagcaaattggtcccagtggatccctgcaggatctttcgccgccgataaagttttcaggttaatccccggtgccaccgccagtccgattggccagtttgttccgtcccccgccacgtttcttcactccatcgaccctcgagtcaaattggatcaactgggaagagtttatttgctatctgaattattattcataacatcaggattgggttcagatggtgtgcctgcaattgttcagttgagaacaccaccacctgcaatgatggggcttcctaatcttccagtatctttaacaggttatgcatatacaatcatgaagttaggtccattaacctttaccaggaaaggcctatctgtagcaagcactgttgcatgtttgacttttacagtatttcaaagtgcaagtccctgcctcactgctacatcccctgaacagttagcatttgcattgcgatggtttatgctccctctgaaatacataggtgtttctgtgtcagaaattgtgcttacacttttactgtcattgaggtttatcagtcttgtttttgatgag

SEQ ID NO: 110234 - DNA, 333 bp, Glycine max
  Peptide Sequence Number=SeqID_227012
atggtggataataagaataagaggatgaagagcattgggcacatatcaacatccccaaaaatgaaatcaaagaaggagaaagagcctacaaagggtggcctttcaaatagaggtaaacatcttgcacattcgcccttaccaccaccatatccaaagcccactttatggtttgtagaggagcactacgaggtgtcctacaagtttagttatgcaaagaaagagcaaattcaacccaaaagcaagcttcatgatgaatcaagattgattcaaggagttttgatgataacaaagatgatgacaaaaagctcaaaagtcaagaacacttcatgttaa

SEQ ID NO: 110235 - DNA, 402 bp, Glycine max
  Peptide Sequence Number=SeqID_227013
atggaatgtattatacgccaccgacattttctcagtatccttcgcagatgtatcaagtatcctttcgaaggtcatgacactgatatgtctgcaagcgaacattcgtttagtggtgttgcggaaacacatcctcatttttcatggccgaccatgaccccttcgcagcaacatgatgccccaatggcaacacctaatgccccattagttccgcaatggaatgtacccggagcaataactgatatgggtgacttattaggtgttgatttgcgtcacgagttttctgctgaggctgagcaacaagggcggagacagcgcgcaagaagaaatcttgatcgtgaagcccgaaggtggaatcgaccatgtggcacatcctcacaccatcacggacaccataatgactga

SEQ ID NO: 110236 - DNA, 687 bp, Glycine max
  Peptide Sequence Number=SeqID_227014
atggtttcaacggaaggacgtggaggtatagtgaaaattctgttgataaaaaacagccgtggggatgttcttcaatgcagccattacatgcctatagtcagtcctgatggaaagcctctgccatgtgtgatatattgccatggaaacagtggatgcagggttgatgccagtgaagctgctctaattttacttccttcaaatattacagtttttactctggatttctcgggatcaggaatctctggaggagagcatgtcactctaggttggaatgaatgctttattatagtgaaagttgcctattggacattgaagcagcaagaagagccaaagaagaaaaaaagcatagcagggattgaggtggatgagtgcagtgacatacaaaaatgggagtttttgaaagttagagtagcacctattaagaagaagctgacaaaagcttacccagggtggtttgatcataaggatgatctgagggcagtggtcaactatctgcgggcagatggaaatgtctctctgattggcttatggggacgctcaatgggtgctgtgactagccttatgtatggagctgaggatccttcaatcgcaggaatggttttagacagtcccttctctgatttggttgatttaatgatggaacttgtagatacatatagagtccgtctgccaaaattcacagcttag

SEQ ID NO: 110237 - DNA, 824 bp, Glycine max
  Peptide Sequence Number=SeqID_227015
aaacatcaacaagcagtactgtggaagacattaagcacgtccgttcaaaaaaaccaatgagtaggatggaggttccatcacatatttcttcaaaagatgcacatctcgactgtgaggcacagaaatgtgatgatctttcctcatcatcttctacaatgattagttttgaattatcaaatggtcgtctctatagtcccctcgttccaaccgatctagatgatgaccactttgtggaatttcaacttgatgactttacaggctgtccatctagtgcaaagaaagaacaaaaaatgttcacggaagcagtgatagattcattgaaagaccgggaaatacgaattccagaggtagaacaaccacctgttaggagtgctagtagtaccatgtctatagagccatcggataagaatgactcacatgcttctaattcacatgagatttccaaacctgtggagacagaatcttctttactcaaccacagtgataaaacaatttccacttcatctgatgcattggagcccttgaaaactgagtcaaattccatttcagtgattccaagtcctgtaacaagtctttcatcaagcaaaataccatcatcaccactaccaccattggacacttcatcggtcaccgagtctggcgatacagaaagtgcttctactggtaatgatagttctgctagcttacaaagttcatcagacactgacatttcacacaatacaaaagccacattaactgttattaagaatccaacaggtcatgtcttgaacggcttactgcgacgttgggatttcaagtttttcagaaacagtcagaatcgataa

SEQ ID NO: 110238 - DNA, 2493 bp, Glycine max
  Peptide Sequence Number=SeqID_227016
atggatcgtagactttctgtgaaaatagaaggagagggaagtgttcatatacaagttgctgaactccacaggctaagcgagacaagcaaaaccagcacaatgtttgagcctcgtggactcagcagcattgagaagagagacagtgatgcagctgataactactctttctcttcagcaacggctagagcaccagaaaagaagctgaccctcttcgctcttcgtcttgcggtgcttgaaaaagcagccactagccttggaactcttggtttcatatgggcaaccgttgtccttcttggcggttttgccatcactttggacaaaaccgatttctggttcatcaccatcatactgttgattgaagggacaaggattttcagtaggagccatgagcttgagtggcagcatcaagccacatggtctataactgaagttggaatcaacagtttcaggatgctaaggtcctccccaaacttgcttcttcaaagtatcaagagccttttcaggccaattgtaatcaagaagcaaaggagagacatggtggaggctaatgttaccccgaggcatagtgataatcataataccattagcataaggacaccaactcgcatgtggattagttcagatgttccacttcttccatatgctagatggtttttcctttcaaggcatatcagcaagcttttgtattggcttcagcttttttcggccatggcttgtgtggttctttcgtcgatgaagctcatcaagcataattatggggaggttgccaagggagacactgacaagaggaaccgcgagtcagctttgaatatcttctatgcattggctttggctgaggctttgcttttcttgatggaaaaggcttactgggaatggaagatcagctactgcaaactgttggatgaggttaacaaggagtgtgggttggggccatcggggatggtgtcgattagaaggttcttttatgattcctattctaggtgtgtcaatgggagcatatttgatgggttgaaaatggacattgtctgttttgctatggatctcttggcgtcaaactcacccgatgagcagctcatcggaggaagaattcttcgccaatttgcggtgagtgaacggttttctgatgatacccttcagaagcttggaatttccatttctgtagtggagaggctagttgagatgttgaattggacagaccacaaggaggaagagattaggctctcagctgcagagattttatcagcactagctggcaagaagcagaattctctccgcatagctgggataccaggcgctatggaatcgatatcatctcttctccaaactaacaggaattgcatacatgcagctgatgaaattggagaaaagaaactcatatttgatcatcccaattatggctactggacatttaaccatttgggactcctcattctgaagaaacttgcccgtgatcacgacaactgtggaaagattggaaacacaagaggcctgctcccaaagatcatagacttcacacatgctgaagaggggttgttgaagaatgagaatgttacaccatctcaaattctgacggtgaagagatctctgcagctggtgaagatgttgactagcacaacaggcacctatgggaaacatcttcgaagggagatttcggagatagttttcacaataagcaacattagagatattctaaggcatggagagaaacaccccttgttacagaaactgagcatagaaattttaaccagtctggcattggaagaggaggcaacagaaaggattggaggcacaggtggagtacttaaagaattgtttaacatatttttcaaagattgcattgctgaaaatcagaaagatgtaaccactgttgctggggaggccctagcaatgctggcattggaaagcaagaacaactgtcataggattttgaagttgaaagttttggaaaggctgatagaggcattgaaatttccactgcttcgtgtcaatgccgctagaattctaagaaatttatgcacctacagtggatcagaaggcttcaaacagttaatgggggttacagctgcagcacccacagcaatcatgtcacaagaaaacaagctccaagaagtgatgattggactagcggcaagtgttttcacattcatgacttcctctgaatcaagcactgtatttgaagaatctgggatcactgaggctgaactggcaaataaattaatccatattctcaagaaacaccgatatcctccaactaaggtcccgaggataaggaggtttgtgatagagctggcaatttggatgatgaaagaaagagaagaaaacattcatactttcaaggatttgggaatggaggaggtgctggaaggtgtcttagagaccacttcagagcttgaaagctttaatgttttctctggtaccgtgggactgaaccggcacaatctaacaattcactcactggttgagacagcattgaagttgctggaagataggtaa

SEQ ID NO: 110239 - DNA, 183 bp, Glycine max
  Peptide Sequence Number=SeqID_227017
atgaggagcttagagggcacgtttatattgaggcgtgttggggaaagagtgacgccaagcttcactatcttgccgtctattttcgaagatgtcgttggtttttgcttttttagcaatcttagtaacgtgtggaaggacatggagaggaatggaagctctggcactggcagtaaggagaagtaa

SEQ ID NO: 110240 - DNA, 324 bp, Glycine max
  Peptide Sequence Number=SeqID_227018
atggttctacggcaagcaaagacggctcatggcggtcaccggggagaaggaaaggaggaagaagatggtcgtttcatgctgttgggcatatttgaagcccgcaacactcgcccagggtgttacagacctgactcacccacctggcttcaatcaaaagaatcaaacaaggttgcttcaaaggataagcattgctttaagattaatacaaggttgcttcaacaaacaaagccttgcttcaagattaactcaagatcaagtcttgcctcaaagcaaagtgtttccaagacatccaaggctctggtagtcgattaccaggcagtgtaa

SEQ ID NO: 110241 - DNA, 291 bp, Glycine max
  Peptide Sequence Number=SeqID_227019
atgttctgtttgttccagcatatcacaagatgtttctactctacagcagttggaggattaagatgctatgagaatccaaagaataagattactgcagtacctgccgaggaagagcaaatttggggtgcattcttcaagaacagagaatcagtgattagtcccaacagtaatataaggttaatgtcagttgagactgcattaggtacaaagggaaaatgtgaggtaatcttagagcttaagaagttagagttgaatatcccttacgtaactaggattgccagttgcaactag

SEQ ID NO: 110242 - DNA, 210 bp, Glycine max
  Peptide Sequence Number=SeqID_227020
atgaatattgtgatgggtccattgtgggaaaccgacgagttgaatcattttgaggcgcgacaggaatgtgataattcactctccttgtgtttgtgtttggatcatgtgataatttcgaaccttgtgttcgtggaggagatgactaggtggattgctttagggaacctcgtgttggaggacatcgaaacacaatgctttgatagaatgtga

SEQ ID NO: 110243 - DNA, 126 bp, Glycine max
  Peptide Sequence Number=SeqID_227021
atggggtgcttatcaggaccgtgggagagacataagtgtgcatgcaaatgctacccagacttccaatggaggaacgattttgccagcgatggatacagacaagggcgggttgacaggaacctctaa

SEQ ID NO: 110244 - DNA, 314 bp, Glycine max
  Peptide Sequence Number=SeqID_227022
taagtgaagataaggacactaatttcattctagcgatcttgccatctgatcgaccactagcggaaacccaagtactgaaacctatcaaaagaaggaatgtaagaggcatcagagcggaagacatcgatagtcttcgcaagacaatagactttgatagtcttggaaacgtaaagaagaatgtgatagtctttgaaacaaaagactctgatagttttggaaaagtaaagaagactgtgataatttttgaaacaaaagactttgatagtcttggaaatgtaaagaagactgagatagtcttgacaaaagacatttaa

SEQ ID NO: 110245 - DNA, 450 bp, Glycine max
  Peptide Sequence Number=SeqID_227023
atgaagcttcacgagctcgcgactttaccaagtggatcaaaaggaaatgcaaatccaaagggtaaagacaatacctgttgggtacaagtacccaagcagacacagggcagacctgattacacatcggatacccatgaggatcagactgcgcgtcatcgctcggtgtcagctgatcgagaagaccatacacaatctcggcagagaggaataagctattgcacgaaaatggaaactgtggaggtggaaggagttgtggcacgtgacccgaatgtgactgagggagattttaaaattggattgggctttgctacccacacccccactgaagcaatagaacaacatttctttagcccacaaaccaacaaagctgatccaactagtgcctggcaagtatactcgcgaaaaagggttacaaaaagcaacttgacatgggctgtgcagatggcgtaa

SEQ ID NO: 110246 - DNA, 324 bp, Glycine max
  Peptide Sequence Number=SeqID_227024
atggtcacttgggatgacttagacagtgataagagtagcagttcagacgatgaacaagccaacatctgtcttttggcaaatacaagtgataaggtcaagtgtaaaaagtttaaagaaaaattcaaagtttcttcttctaaaaacattgaattaaggaaatcaaatgagtttttagaaaaggaaaacaaaaaaaagactctagaagagactctaaaagagagtttgagcctggctagtaagactaatgaaacttccattgttgaaaaactaagagaagaagtagcatatcttactaatgactttggaaagttcctgaaaagttaa

SEQ ID NO: 110247 - DNA, 663 bp, Glycine max
  Peptide Sequence Number=SeqID_227025
atggggaccttccctcgcttcgacccaatcaccacccaagaccggtccaaccagaccgtggcctccgaccttgacggcaccctcctcgtctcccggagcgccttcccctactacctcctcgttgccctcgaagccggcagcgtcctccgcgccctcctcctcctaacctccgccccctttgtctactttacctacctcgtcctctccgaaaccctcgccatcaagacgttaatcttcataaccttcgcaggtctcaaactaaaagacgtcgagctcgtgtcccgctcggtgctaccgaggttctacgccgaggacgtgcaccccgccacgtggcgcattttcaacgcgttcggagggaggcggtgcattgtcacggcgagcccccgggtgatggtggagccgttcgcgaagacgtttcttggcgcggatacggtgctcgggacggagctggcagtgacggcgtcggggagggtgacggggttcgctaaggaacctggtgtgcttgttggtgttcagaagaaggaggtggttttgaaggagtttgggagcaacttgccggatttgggactcggagacagtgtaacggacatggacttcatgtcaatctgcaaggttggtataactgtaatatgcatatacttctctctccctctaaattattaa

SEQ ID NO: 110248 - DNA, 177 bp, Glycine max
  Peptide Sequence Number=SeqID_227026
atgtgggtgcaagccattggtctgtttgctcaagcgacctgtgctcgtgagtttggacttccaagaccgttcaatcagagattactcgtcttgcacgttggtggggagagaagtgagttatcaagaataggatgttggataaatggcctcagttaccttaagaaaaaggggggttga

SEQ ID NO: 110249 - DNA, 507 bp, Glycine max
  Peptide Sequence Number=SeqID_227027
atggtgaatcacctcaagggcctagggaaagaatttaaggtagaagagttgaatttgaagattttaaagtccctcaatacaacttggcaattgaaggtcacgacaatcttccactccaaagatcttacatcaatcactcatgctaaactatttgaaaagttaagggaatacaagatggacatgactaggatggccgaagagggagctaaagagaagaaaagtagaggattagcactgaaatcctcaataccatctagtgatgaagaaaatgcaaaaggttatgacaacgagaatctaacactacttgttagaaagtttaaaaagttcttaaccaagaagaaccccaagggaataacctttcaacacaaaaagaactttaagaagaatgacttatccttctctatttttactttttttaagcgtcgcaagctaggtcagataaaatctgaatgctccatctttctaaagaaacaacaacaagaaggctacacattagacaagaaataa

SEQ ID NO: 110250 - DNA, 219 bp, Glycine max
  Peptide Sequence Number=SeqID_227028
atggaaccacaatgccaggatgagacttccccacctaaaactaggattcaagctgtgatcaacatgataacaggaggattcgtaggtgtcagaagctcaaactcaatgcacaaaccccatgtccataaccttaagtctgtaaactctgtagcaactaaaaagaaggcagtaaaaagcctaacccttattactttcacatatgagggttttgagggatag

SEQ ID NO: 110251 - DNA, 432 bp, Glycine max
  Peptide Sequence Number=SeqID_227029
atgtacccggaagagcgccacatgaagatcttaaaagggtataccaagaatctacatcgtccaaaagcatctattgttgaaagctggaggcagtgctatgcattcatcagagaagctattgatgaaaagacaaaacttggccccaaaaggagaaaagctattgatgaaaaggcaaagaaacttttgaatgcaggattcatcagagaagtacaatacaccacatggttagctaacatgatgatggtaaagaactctaatgagaagttgaggatgagaaccaactacacagacttatacaaagcctgccctatagactcgtatccgcttccaagtaaagattttctagttgatgaagcttccaaattttccatcctcagcttttcatatgcatacttcgagtataacaacaatacctatgttctagtaggatga

SEQ ID NO: 110252 - DNA, 306 bp, Glycine max
  Peptide Sequence Number=SeqID_227030
atgaaaaggggttacaagagggtaaatgaaatgaccgaagacgaagtggagaacaaaaagaagagggggagaaaggaaagaatgaggatgtttagttggctaggggaaaagtcgattgacaacaatatcggtgtgcagaccgatgatttagggtttatgttaatagatcttaagaaactcgcttaccagagtgatcctttcatcatggctgatggctacaccacccagctcctcccctcttattcttcttcttcttcttcttcttcctcctcctcctcctactgctactactatatcatgcactga

SEQ ID NO: 110253 - DNA, 558 bp, Glycine max
  Peptide Sequence Number=SeqID_227031
atggccaatttagactaccaatccatcaagaaggctcaaaccgagaagaccaaggctaaaaaagccaaagctaaggctaataaagggaaacaaaatgagcatgtggaggatgatttggttcctcctcctcccatcagtcatgttgcttctaagaggaaaaaccgtggtccatctcaacatgaagctgcagcgaaaaggccaaaggtggagtcagtgtctagttctactccttcccctacggagatcgaccctcaactctccatggacttcattgctaattttctggcaaggtcttgttggatgcacgaactctgggtcgatgaattcgaaaatgatgagtccaagaaggctcaagttggtaaagctatgagacaaacccgggaagaggctttgaaggccaaactgaccacgtctaaggactttttcaaagatctccaagaagaggaatctaacctctccatcttcgacattgacaaggatgtgaaccatgaaggggagttggttcctgaagttcaagtagagggtgtcattgaaaagcctactaagcctgtaacttaa

SEQ ID NO: 110254 - DNA, 615 bp, Glycine max
  Peptide Sequence Number=SeqID_227032
atgccagtctataatacattgttctggtcatcatacagggggatttgtgggctctcattcgcaaacaagggatgtcttcttcacattgttggacataatggggtagcatacggggttaatactgaaacaggagagcttttaaaggaatttaaaatcacaaaaaagtctattacttctctggctttctcgcatgatgaaaaatatttagctattgtcagctctagaccacgggatataagctgggaaattggggaagagattctgaagttccctaatgatttgggaaatgtagagcatatttctatatcgagtgatgccaaaaatttagttacatcagattttgacgatcaacatgaggctgctgaaggagtccttcttcatgatgatttgaatgagccaaaaatgggagagaaacttgctagtctaagtgttctggatgggaacaaatcaaggagtgatatagagcaagaatcttatgtcctagcaaagcctccaagtgcagactttgtacatgttttgcttaagcaagcattaaatgctgatgatcgcacctttctgctagattgcttgtttacacaaaatgagaaggttctctttctctcctatttctattga

SEQ ID NO: 110255 - DNA, 456 bp, Glycine max
  Peptide Sequence Number=SeqID_227033
atgtcatacttggagaaatttaaaagtgagtcagaaaggctaaatgcaactaggacaaagagctttcaaccatcttatgggcttaccgctgcacttcatagtcgacagcaaggaaaattttatggagaaaaaaatgatgaaatgcttagtgaaacactcaacttggttgttgagaccattaaagaagtctacatgaaagacgaatggtaccaaagaagagccaagaaaagatataatagtcaggtcaagccgagaaactttcaggcaagtgacttggtatggagaaagtgtgaggaggccctaaaagatgctaaaaagggaaaactttctagaaggacttgctacattagagttgttgaagtgcttcgaaacagagcctaccgactagagcacatatccgaaaaggtgattccaaggacttggaatgcttctgacctcaaattctattacggttaa

SEQ ID NO: 110256 - DNA, 333 bp, Glycine max
  Peptide Sequence Number=SeqID_227034
atggtagaaccaggggattgcggtgctattgtggctcactggtgccgttttaggcttggtttggtgcctcattctggttggctacactgcttttggctcgtcatagtagcttattggtctggtgaacaacacgagttggagtgttggtgttggcatgttgtggtggtttacaagtatgatggtggagttgatgatgctttggtgaggagggtgatatgtgaggggctgtgcaatccagattgggacaatgtagcaacattgaaagatgctaccatcttatgttctagattgaaaagtgcaatcatctataggacaacaaatccaccagattag

SEQ ID NO: 110257 - DNA, 714 bp, Glycine max
  Peptide Sequence Number=SeqID_227035
atgttgtgtaggtataacctcaaaagtcttatacatacgatagttggtgtaggtaagcaagttcacactccaaattccatttcgaaacttcaccagcttcaacgctcgagcaaaagcctcaaagaaggagaaaggctcgtgggcccaatgagacggcccgacgaaaccctctgcaagcccattcgaatccgcgccggctacacccctcaagacgaagtcaccatttaccaacccaaaggagcactcttgaaaaaggagatgggctccgttgggcctcccgggtacgaaccagacgctgattccaagcccaagaccaagtccgttaagaggaacgagagaaagaaggaaaagcgcattcaggctgcgcttgaaaaggaaaagaatgtgagtgaagttgaagatagtggaaagcaggaatctctggaggcattgacctcgcagataagtgacatggttgctattgcaaaaattatgaaagccactttggtttttcctacattggatcatgattccttttggacaaattctagtgattttaagcaaatttttgactggaagaacttcactgaagttttaaaagatgatgttcaaatagtggaatctctatcaccagaatttgcaacaattaagccagttttgaaggctccggcaggttataacgcaggggaggtgctgcaattattgaagaaacacaaagtgatcaaatttacctga

SEQ ID NO: 110258 - DNA, 948 bp, Glycine max
  Peptide Sequence Number=SeqID_227036
atgcagcgggcgccagcagcgcggcggcgttcctctcatggttcgtcagcaactatcagcagggctggctgcacattgactgctctgcgacctatcgcaaaaacgcggtcgatcagtggtctgccggtgcgactggccttggcgctgcaacctgccgtcttttttggaagcctatcccttatgagtaaccgtcttgaagaggtgctgaagctggcggccaccgagcctgcgcaccgtccggaattttttcagctattgctggaggccgatgtctgggtgccgggcgaaagtcccgcggagcagtttgatgccacctcgccggtagaattacagcactgggagaaagagggtggcggcagcgtgatccctttctttacctcagaagcagcgatgagcgaagccatccagggtgagcagccgtacctgcgtttaccgacgcgcacgctgtttgaaatgacgctgggcgaaacgctgttcctcaatccgaaactgccggccggcaaagagttttcacccggcgagatcgcgcatctgctgggcgaagagggcagtgcgctgagccagcaaacggtgctggagggcggtcatgcattgctgctgtccgaagtggccgagccgccagcgcagatgatcgattcgctgacccagctgtttgcgaaatacaaacaggtgcgtcgcgcctacgttgccagcattcgtgagcgtgccgatgaacaggcgaatctgttgattgggattgaagccgacagcgatattgatgcgattattcaggcggccggcagcgtggcgaccgatacgctgcccgatgacgcgccaattgatatctgtgaagtggtcagcaacgagcagggtgtcagccatttcttcaccgcgcacattacgccgttttatgagcgccgctggggcagtttcctgcgcgatttcaaaggcagccagcggattatctag

SEQ ID NO: 110259 - DNA, 201 bp, Glycine max
  Peptide Sequence Number=SeqID_227037
atgctacaagatagattgaatgaactagctatgttatctattgagaataagaaaactctcaagactgacacagttccaaagtttgagttgttcaacagaggtcaattggaggggtggaagactcttcagcttgtgggattcagaggcgtccaagattttaagtttttccaagagctcagcagaatagtggattgtagataa

SEQ ID NO: 110260 - DNA, 303 bp, Glycine max
  Peptide Sequence Number=SeqID_227038
atggaaggtgctatcagggaaacacgggaggaagccaatgttgacgtggaagtgatttctccctttgctcaattggatattcctttaattggccaatatgttgaggatatgaaggaaggaggaaagcctaaattccattatgttaccattatcaaaaggacaggatttcagaagatgacaaaagaagatgcactttctcttgacaacattgaaggtggtgtatgtgctgagtacaccaatgtcggtgtttatggaagacgaaactctggatcaaacaaggaagcgttcgaaatgggagaataa

SEQ ID NO: 110261 - DNA, 198 bp, Glycine max
  Peptide Sequence Number=SeqID_227039
atgacgaaggaagtgatccacagtcacaactctgcagtgccttgggtccacttttccttttcttcttcttcttcttcttcatttttctctggtttcaggctgctggggaaactcacctcggcaagctacttggttagggctaaaggtattggctcacccgagccagctggagctcacctgggcgagtggcttgcttag

SEQ ID NO: 110262 - DNA, 873 bp, Glycine max
  Peptide Sequence Number=SeqID_227040
atgcagaaccccaaccacaacgatgatgatgatttgctcactttgtctctctcatgcaatcgtccaaagagagcgagaaactctcccccatcaaaccctcctccccaaaccatgcatacgcaaatgcaaattccattccctaatcctatgtttgtgccctacccttctgcttctaaccacaacagcatgcagcaggaagaatatcgttttaacgtgcgtgtgaatgctcttgcacccgccgtgtcacgacgacgttctcgccgtcgccgccaccgttcccaatcagagaagagcgaaaccgttcctccaccctttccttgggccacggaccggcgcgccaccgtgcacagccgcaagtacctcttggagaacaatattgtgtccatcacagggattttggagtgcaagaggtgcaagaacgagttcgagatggttcttgatctggagagcaagttttctgaattgtggaactttattcggagggagaaagagagcatgcatgatagggcacccgaggcttggatgaatcctgtgctgccacaatgccaacactgcggaaaagaaaacagtgcccaacccttccttgcagggacaaagaaaagggccattaattggttgttcttgctgctaggtcaaatgatcggttgctgcacgctcgatcatctcaaatattttctcaagcactccaacatccatcgaactggctccaaagatcaccttctttattctacctacattggcctttgcaaccagctagttcctgaatggttgtataggttttggatagatggtccgttgctcatttacatgctggataatctccctctggctaatttggctggaaacaaacaaagtgttagaaaaagaagataa

SEQ ID NO: 110263 - DNA, 216 bp, Glycine max
  Peptide Sequence Number=SeqID_227041
atggtaccgaaaggggacatagtaagccaggttgtttgcgatggtcatattaagtttgctggcaatcaacgcaggtcctggaagaacatgaaattaggagtgacaaaggatcaagccgatgttttgatgatgccaaaagatcacatgcgtctcaaagctttattcaagacaaagcaattaaagatattcaagatggatgatcaagacagtctatag

SEQ ID NO: 110264 - DNA, 252 bp, Glycine max
  Peptide Sequence Number=SeqID_227042
atgtcaggatttacaagcgattctcctcaaatttcagccagcctgcatcaattagaccttgcaccttatgcttcagagccctacaatgctcaatggaacgccccgaggcttctccgtgacaagcacacgttgcgttcgagtcgtattctcggagaaatggaggttgatgaaccttggctagggttatggctaccattgaattatcaagtggtgttcatcattggaagtgcggtagacagactttgtggttga

SEQ ID NO: 110265 - DNA, 738 bp, Glycine max
  Peptide Sequence Number=SeqID_227043
atgcagagccccaaccccaatgatgatgatgatgatttgttcactctctctctctcttggaatccaactagagcatcaaaccttcctaccctaatcatgcaaccgcaaccgcaaaatccattcattaaccctaggttggcaccctacactgcttctaaccacaacaacatgaatgctggtgttgatcacgtgcaagcaaatgctcatgtaccctcttctttgtcgcgttctcgccgccgcgatggaaggagcgaaaccatccctccgcccttcccctgggccacgaaccgccgcgccacggtccagacccgaaagtacctcttggagaacaagattctgaaaatcaggggggacatggagtgcaggatgtgcaagagaaagtacgtgatgattcttgatctggagagcaaattttcggaattgtggagcttcattcagaaggaaaaggagagcatgcatgatagggcacccaacgtttggctgaaacctgtgcttccaagatgctatcactgcggacaaaaaaacagcgtccaaccctcccttgcagagactaagaaaaaggccattaattggttgttcttgctgctaggtcaaatgctcggttgctgcactctcaatcatctcaaatatttcctcaagcacaccaaccgtcatcgaactggagccaaggatcgaaatctttattctacctacatgggcctctgccagcagctagttcctgagtgcttcagttcttga

SEQ ID NO: 110266 - DNA, 1017 bp, Glycine max
  Peptide Sequence Number=SeqID_227044
atggctaatggtttcacagagggcacggaggtgttgacgatggtgatgcacggtggttcctcggttgcgactggggttgatttcagtcaacaatgggttcctccacgcggccctctcctctgtctcgctcacgctgagatcgctgccatttgtgtcgtctccgtgggtttcacagccgctacacgtcccttatcttccgtgttactcaaggcaacttcagtatccactaactatccctggttgcaactagtgactcatcaacagcatattctagccatgtcaagtcctcagtgttttgagaatccaccaaaccttaactcggacatccatggagcaggaactgtccaagaacttggaggacttaattcctacgtcactggatcttccgattccaaattggcactcatcctggtttctgatgtttttggtaacaaacccatctccaatttcttatctttcaacttgaaacttgcggacaaagtagcagcagctggattcttggttgttgttcctgatcttctgtatggtgattacattgttgaccttaataatcctcaatttgatcgagagtcatggcgaaaggctcatggaaaggataaggcatgtgaagacaccaaacctctaatttctgctctaaagagtaaaggtgttaaatccgtaggggctgcaggtttttgctggggaggggttgtggttgtgaaacttgcaatttccactgatattcaggctgcagttattctgcatcctggtctaatcgcagataatgaatttaatgaggtcaggattcctattgctatactgggagctgaaatcgaccatcttttcccaccagaaaggttgaagcaaattgaagaaatgttgtctgtaaaagctgagtttgagagctttgtgaaactataccctggtgttagtcatggatggactttgcggtacaatgatgatgatgaagcaactgttaagagtgcaaaagaggcgcatcaagacatgttgaattggtttatcaagcacgtcaagtga

SEQ ID NO: 110267 - DNA, 210 bp, Glycine max
  Peptide Sequence Number=SeqID_227045
atgtgggacttgggaacaccccctcacacgcatagcggaagcgaggaggtaccaggaacaaaaccaattggtctccaaggagtgaggcagccgatgtgggacttaaaaacaccccctcatgcgcgcaacggaaacaaggtcccaggaacagaatctgactctgatatcatgttacatttcatcttaaaaccaattgacattaagcattaa

SEQ ID NO: 110268 - DNA, 674 bp, Glycine max
  Peptide Sequence Number=SeqID_227046
tccgcaagcatcaaaatagtagccccaaaacgaacgagagtgcagtagcagttctgaacaaatcgaaacaaaaatacaaacacctaaacgatgtaatagcgaaaccgagcaagcaagatccagaaacgataaagagagaatcgaaccctgcacttcatggcggtgatgacgaggaagcgccggcgcatgatggaggaagccgcggcggcggtgaccgcaatcctgccggaggatctgatgatcgagatccttgccaggtactggatccccaattcgtgaagaagcatttgcacacatcgttctcggacatcacggatctcgcgtccaaagccatggaggacatgaacgcgtttcaattgcagctcaattacgcccctgccttggcagaaccagaagaagaagaagaagaagaagaagaagaagaagaagaaaatgaagaagaagaagaagaagaagaaggagaggaagaggaagaggaagaagcgcgttcgatggtgaacgagttggctcagttggataacatgttggtggtgattcgatccctgaaaggaaccttggaaacgattaaggttgacgttcaagcgatcaaggagagagtgaagtgtctccagagttttctgcagatttatctcaagacagcaacagcttcttcctcctcctcacactccatgtga

SEQ ID NO: 110269 - DNA, 3933 bp, Glycine max
  Peptide Sequence Number=SeqID_227047
atgacgaaggtggcgcagcagaaggggagtgatcctctgctttgggccgttcagatgtattccaatttgaactccgccggagagtctctaccctccctccaactcgccgagtttttggtctcttacatttgctgggataacaatgtccctattctatggaagtttctcgaaaaggcattgacgcttcagatcgttcctcctatgcttctcctcgctctcctttctgtcagggttattccatgtagacatgtccaacctgcagcgtataggctatatttggaacttgtcaaaagacatgcttttgaacttaaatctcagataaacaggccagattatcaaaaggtcatgaaatctatagatgctgttcttcatctttccaacatatttggcatgccacaaagtgagcctggcattctggtggttgaatttattttttcaattgtctggcagttgcttgatgcatcattggatgatgaaggtttactggaatttactcctgacaaaaagtctagatgggctacactatatcatgacatggaactggataggcatgataattatagtgaacaaaggactgaacatcatgagaaattgcaaaatgcaaatacacttatggctgttgagatgattgggcagtttttgcaggataaaatatcttcaaggcttctttacttggctcgccaaaatttgcctgcacattggcttagttttactcagaggctgcagctgctgggtgcaaattcattagcattgagaaaatcaagaactctaagtcccgaggcacttctgcaattgacttcagattcttgtatggtcttgtctcgggaatgcaaaacaaattcacagaaaaagttccaaacagttatgtcttctgaatatctttcttcttctgcctcactatgtcatggtgcaagtcattctgctctctggattcctcttgatctggtgctagaggattccatggatggctatcaagttagtgcaacaagtgccattgaaacaattagcggtttgataaagaccctgcgagcaataaatggcacctcttggcatgacacatttttaggcctttggttggcaactcttcgtcttgttcaaagggaaagagatcctattgatggcccaatgcctcatcttgaaactcgcttatgcatgctcttgtgtatcatacctcttgttgttggcgatcttattgaggaggaggaggaaaggacaccggttgatgaaaaagacaatggtcctacaggtttctggaaagagaaaaaggttgcaggaaaatgtcgtgatgatttagtctcaagtctccaggtattgggtgattatcaaagcttgctcactccacctcaacctgttcttgctgctgcaaatcaagctgctgcaaaagcaatgctatttgtttctggcatcacaatagggagtgcatattttgactgtctcaacatgacagagatgccagttgactgttctggaaacatgcgtcatctgatagttgaggcttgtattgcccgcaatctactggacacatccgcatacctatggccaggttatgtaaacggacgtatcaatcaaatacctcagtgtatgccagctcaagtacctggctggtcatcatttatgaagggaaccccacttacttcagtgatggttaatgctttggtttcaagtcctgctacaagcttagcagaactggagaagatttttgaaattgcaattgagggatcagaagatgaaaagatatctgctgctgccattctttgcggggcatccctaatttgtggatggaatatacaggaacacactgtacatttcattcttaggttgttatctccaccagttcctgcagaaaacactgaaggaaacaactatttgattaattatgctccaatactgaatgtactctttgttggaattgcatctgttgattgtgtgcaaatattttcactccatggcttggttccacagcttgcatgttcattgatgccaatctgtgaagtttttgggtcatgtgtaccgaatatctcatggacactaacatcaggggaagaaatatctgcccatgctgtgttttcaaatgcatttattcttcttttaaagctatggagatttaaccggcctccacttgaatatggaattggagatgtacccacagttggttctcaattaactcctgaatacttactattagtacgtaattcccacttaatgtcagctggtaacatccacaaagatcgcaacaggaggagactctcagaaatagcaagtttatcatcgcctaattctgtatttgttgactcctttccaaaattaaaagtgtggtatcggcagcatcaagcatgtatagcttcaacactctctggtcttgtccatggaaccccatttcatcagattgttgaggggcttcttaacatgatgttcagaaagattaatagaggaagccagactactattacatctggaagcagtagctcttctggacctgcaaatgaagatgcctctataggtccaaagttgcctgcttgggatattcttgaagccattccctttgtggttgatgctgctcttacagcctgtgctcatggaagactgtctccacgtgagttggcaacagggcttaaagatttagctgattttcttcctgcatctctggcaaccataataagttacttctctgctgaagtaactagaggagtttggaaacctgtatttatgaatggaacagattggcctagccccgctgcgaatctactgaatgttgagggacagatcaggaaaattttggctgcgactggtgtagatgtgcctagccttgcttcaggagacagctgtcccgcaacacttccattgcccttggctgccttcacaagccttaccataacctacaaagttgataaggcatcagagcgttttcttaatttggctggccaaacattggagagcctcgctgcaggttgtccatggccttgcatgccaattgtagcttccttgtggaccctaaaggcaaaacgttggagtgacttccttatcttctcagcatctagaactgtcttcctccacaacagtgatgcagcagttcaacttctaaagagctgcttcacagctacccttggcatgaatagctctcctatctcaagcagtggtggtgttggagccctacttggacatggatttaagtaccacttatgtggagggctttgccctgttgctccaggaattctctatttacgtgcgtatgggtcaatcagagatgttgttttcttgacggaagaaattgtttccatcttgatgcactctgtgagggaaattgtatgcagtggcctgccaagggatcgattggaaaagttgaaagcaaacaaagatggcataaaatatggacaggtttccctcgctgcttcaatgactcgggtgaagcttgctgctgccctcggggcctctttagtatggatatcaggagggttgatgctggttcaattattaataaaagaaactttgccatcctggtttatatctgttcagagattagaccaagaagaaaagtctggtggaatggttgcaatgcttggtggatatgcacttgcttactttgcagttctttgtggtgcttttgcttggggggttgattcatcatcatcagcttcaaagcgacgtccgaaggttttaggtacccacatggagtttctggcaagtgcacttgatggtaagatatcactaggatgtgattcagctacttggcgtgcctatgtgtcaggttttgtgagcttgatggtaggttgcacacctaactgggtgctggaagttgatgtgcacgtgttgaagagactgagcaatgggttgaggcagttgaacgaagaggagcttgctcttgctttgttgggtgttggtggagtaggtacaatggatgctgcagctgagctcatcatagacactgaaatataa

SEQ ID NO: 110270 - DNA, 931 bp, Glycine max
  Peptide Sequence Number=SeqID_227048
ggctaaacaagttgatgaggcacgcaaggagacaaaatattttcaatggtacttggctatccctaaattctatgagcttgcttcaagtttgaagcttccattagagacacctttcatttatgatcatgccgaagtacttaattgtgaaatcatgaagacatatttaatctatttaggcattctgattggtgcgaatcataggaaagcctctacgtgggagcttattgttcaaaagttcgaaagcaatttgtcaaggtggaagcaaagatcactatccattggtggaaggattccaacttgtgttgtaaatgaacttgttcatttacaatgtgagtttttgtggagaggggaggaaggaaggaggaaaatagcttggggaaatgaagatggagggtatatagtggtcataattgcctttggcaacaagtgttatgttctaaatatagctaaggggcgtgcgaggaagagacacatgaccaatggtccgacaaaaatttatgttggagggtgggtgatggaaggtaaatccaattttggaagcaaccatggatggaaaaattacaagcttgaggataggtatgggagggtgtttatgaacttgaaccaaaaggatgaggtgataaaggtgatgaggtcatgggttgatggggcgagtttggtggcggatgggcaagattcattggtgtggaaattggccttaagtgggtgttactcagttaaagacacatacttgtttctaattggaaatacaaatcctgttgatccccttttcaacaggtcattttggaagcttgtcatcccccacaatgttgctatctttgtgtggaaactgtcaaaggacagattacctattaggaaaaatctgcaatccacatggcatggtggtgccaatacccctttccccataagggccaatgaagctgctaactga

SEQ ID NO: 110271 - DNA, 597 bp, Glycine max
  Peptide Sequence Number=SeqID_227049
atgcctagaccggtgaccgggccggttttcacaacactggttagctggaaagaagatgttgatgaggatggtccatctcccagtctaggcccctcatggttcagaaaacaatattctcctaaaggctctggaaggcacaggaatgacaatcaaagatcaaagcatcaatttagaagaaatcatgaattttgcaaagatgattttgacgttgaaaccgttttccgctctgcctttggtggcaatcgatctttttattggtcctttataaatgaggaaaatcctcagtggaggaagtcaggaggcttttctaatcatgggaaatcttggaattggagacgttggagtgaaaatggatataatggcacatcaaccgagtcagattgttcgcaatcagatttaatttcagatagattagcccttggaatgagtgcttctggccctttgaaacttgaagatgtgaaaaatgcgtaccggatatgtgccttaaagtggcatccagatcgtcatgatggctcttttaaggttatagcagaggaaaagttcaagcattgcagtgctgcttatcaatccttgtgtgataagctggccttggattag

SEQ ID NO: 110272 - DNA, 549 bp, Glycine max
  Peptide Sequence Number=SeqID_227050
atggcttttcaagttctgctcacaggccaattctttcttaaattatccaaatgcactttcactcaaagacaggtcgaatacctggggcacttggtctctcagaatggagttcaacctgtcccaactaaggttgaagccattcaacaatggcccacacctcgttccacctgggccttgagaggatttctaggcttgttgggtttttatcaaagattcattaaagccaatgataagttccactggtcgttagatgcccagaaggcatttgacacgttgaaggaagccatttgtcaggcccttgttctctggttgccagatttttcattacccttcgtcgtagaaattgatgcctcaggggtgggtatggacaccattctctctcaacaaaatcaccctattgcatttttcagcaagcccttttgtcccaaacttcttcactcctcaacctatgttcgagaactcaccaccatcacttcgataatgaagaagtggcgtcaatattgttggacaagtggtctcagatatcttaagaagggggggttgaattaa

SEQ ID NO: 110273 - DNA, 615 bp, Glycine max
  Peptide Sequence Number=SeqID_227051
atggctgaatcaacttgttcgaaatccaacatggagcgtattgaagaagcaattgccaaattagctttcaatcatctccatgtcaccagcaaacttgatgagctcattcaacgtgtcttggcccttgaagctcgcttttcttcttcacaatacgaggatcctatcggtatcctctttaaactcacccaatgcggctctgtagctgattatttgtcgcagttcgagtctttcactaacaggatcgtggggttacccaccccgttccttcttagctgcttcatctcggggttggcactagacattcgccatgaagttcaagctgtccatcccttgaccttgactcatgccacggccctagcacgtctgcaagaagagaagctcgctaaccatcattgtgccttccgcagacggtttgtggcaaacccaccctcctcatttccaactaccacacctcttgctttgctcccaccaccagcgaaacctcctccccttcctcttaaacgcttgtcaccggaggaaatggtggttcgccccaaaaagggctttgctttaattgcgatgagaagttctctcggggacaccagtgttcctccaagttcttccttctcaccatag

SEQ ID NO: 110274 - DNA, 195 bp, Glycine max
  Peptide Sequence Number=SeqID_227052
atggcattcaaggccctgcagtcaatgcaaaatcgccatgatcaatcacttttcttgactaacaataccgaggaggagaagggacttgtgttgggggtaacggtagggtcacacattgacaagcttagaattagggagttggatggaatgattggtgctacgagatggaggcagggtagttggagtttgaaataa

SEQ ID NO: 110275 - DNA, 408 bp, Glycine max
  Peptide Sequence Number=SeqID_227053
atggcagacagaatgtgcttgagggccaatagaattctgccatgtcagcaccccttgttggggttagttacacaaaatctttcaggtattgtggcttggtcaccaccctctttggcctttgattcatgtctgctaggtgtgattctgcttgttgtgcttctgatgaagaaccctaacagagcaatcagaggaggagctctagagcgcaccagagacgtcacaattgctaacggagaacgattgaggaactacgtcgaggagggagaggccctgacggactcttcggagtgtaggccttgggggtcatccgatttgagtgctcctataagcctgtgccgatcccacatggttggagcattcttcgcaaaacagtgtgaccctgactggtctccctatgatttcacttag

SEQ ID NO: 110276 - DNA, 984 bp, Glycine max
  Peptide Sequence Number=SeqID_227054
atgggcactctagtaggacacgtagctccaggcatgggtttcatgctaatagggctatggcacctcttcaaccacataaagctccatgccctaaacccaacctcctacacatcaccaccatggttcccaacctccaaacacaagtacctggagctcctcctcatcatgttaggctcagcagcctccatctccatggaactcttcatcggccccaaccgccaccagcccttggaccctgacctcaccatcccctccaaccacctccacaacttcgaacactcttccatctccctcgccttcctcctctacgccgccttcgccctcgtcctcgaccgcctcccctcccccgccaaacgtgccctaacacaactcctcggctccatcgccttcgcccagcaactcctcctcttccacctccactcggccgaccaccacggccccgaaggacagtaccacttgctacttcagctccttatcttaatctccctctcaactaccctcttgggaatccccttccccaaaagcttcttagttagcttcgttcgttctctaagcattttctttcagggtttatggcttgtgcttatggggtacatgctttggacgccggggcttatccctaaaggctgcttcatcaacgaagaagaaggccaccaagttgttagatgctccgaccatgattctctccaccgcgccatatcgctggttaacattctcttcagctggttcatcattggtgtcaccgtttttggtgttgcttgttatttgggtttggttaagttttacggtgaaaaagttgactatgttgcgttgagggacgaggaaattagtgacgatgttgagtcgcaaaagagaagcatacttggcaaccccacgagttttattcgtgttggcaaaaactttttgcctcttgacatagaaagtgggtgcgtgtacagtgggattaatggtaatagtatattagcgtggtggggtcctttgtaa

SEQ ID NO: 110277 - DNA, 421 bp, Glycine max
  Peptide Sequence Number=SeqID_227055
caacctgttaggtgctgggtttgtggttgctgctttcgagggtccagcacctccagaagaagaagataagaagaagacaagctcatggtatgctggcttcaccactcttctcttggtctcttcttctctttgcacctttgctgctggtgcttcctctattttctgggattataagcttgctcgtatcacaaccttccttaagttgatgggaatagaagaagaagagggatggatagaggaggagaaggggataatggatatagaaagtgggtttttcctatttgagatacttaggctattagagagctttgagtctcggcttagtgggtatgacaatgatcacgcacttagcacgggattcgcgctaagcttgtgctggccgctaagcgagttgatgtgttgggtctgtcttgtgtgctaa

SEQ ID NO: 110278 - DNA, 858 bp, Glycine max
  Peptide Sequence Number=SeqID_227056
atggtgccaaggatcaagtgtgagccactaccaagaaacaagcttctaagcccaataattttccacgagggccgtttagttcaaaggccaactcctctagtggccctcttgaccttcctatggatgccaattggcataatcctctcaatcctaagggtctacctcaacatccctctgccagaaagacttgcttggtacaactacaagcttcttggaataagggtcattaggaagggtacccctccacccccaccaaagaagggccaaagtggagtcctatttgtatgtaaccacaggacagttttagaccctgtggttacagctgttgcattagggaggaaaatcagctgtgtgacatatagcataagcaagttcactgaaataatttctcctatcaaagctgtagcactctctagggaaagagagaaagatgctgccaacatcaagaagttgcttgaggaaggggatttggtgatctgccctgaaggcaccacttgtagggagcaattccttttgaggttcagtgccctctttgccgagctaaccgataggattgtcccggtcgccatcaacacgaagcaaagcgtgttctatgggacatcggttcgcggccacaagctgctggacccttattttgtgttcatgaatcccatgccaacttatgagatcactttcttgaaccagttgccaacagaactcacctgcatgggaggcaaatctgccatcgaagtcgccaattatattcagagggttcttgcagggactctcgggtttgagtgcaccaatttgactaggaaggacaagtatgccatacttgcaggaacagatggaactgttccatctatgaagagtgcttga

SEQ ID NO: 110279 - DNA, 252 bp, Glycine max
  Peptide Sequence Number=SeqID_227057
atggaagaagatgaaggagaatgtcttctccagcctcttagccctatttttctctgtttttcacatagcaacaacttggcaggactttggttgttgttgctgacctctgcgagcttgggcgcgctaagcgcgagaagggacaacgtccttgctgggcaggctggttgcacgctgagcgcgcagatctttgacttatcctcttctagggttttccatccgctaagcgagctggttgccttgctaagcgaataa

SEQ ID NO: 110280 - DNA, 433 bp, Glycine max
  Peptide Sequence Number=SeqID_227058
aagtgctaaagttgatgtctcactaagtgagttcaatgcgcttagcgagtgtcatccgctaagcgaggcatcaacgcgcttagcggataggaggaatctggaagggaatttgtcacgcaggcacgtgctcagcacatcatcagcttgctcagcaagacgtttgtcaccttccaggcttaacgcgagtttagcgttgagcgaaaatttacttactcgcgttaagcgcaagaattgtgctaagcgtaacgtcaaggtcagtgagccctttttaaagcctggaatagcagaaagaaaagagagagcgttgaatagttgtgagagaacgctgaatagccgtaagagcttgaagagtgaaataaacagaggcaaagaacagagcaagaagccaagttttgatcttttaggaagattgaacttgatagagcaggattag

SEQ ID NO: 110281 - DNA, 159 bp, Glycine max
  Peptide Sequence Number=SeqID_227059
atggtggtggcggtgacaaaggcaaggtgcgatggttatggcggtgacagtggtgatggtggtagaatgatggagttgatagtggcggcagcggcggcggttgtggtggaatggtgtgacactggtggtggtggtgttggtgtagtgatggtggtttga

SEQ ID NO: 110282 - DNA, 405 bp, Glycine max
  Peptide Sequence Number=SeqID_227060
atggaggtgatggagaaaaagaaggcaaccaaattggaaggagggggaggagggtgtgggggaaatgctggcagggataggggttttaatatggcaagttcgtcatcttctaattattattatgatgtgacatcgggaccattagaggatggtttattgtggatgaaaaaaaatcatatatcgcagcatatttggaattgtgttaatgaaaggatgttaaaaatccgacgaactacattaatcatagagaagcaccgtccgacaaagcaacgatttcatagtgcaaatgaaacggaggaagagagattttatagggaagaaggaagtgtcaagctggccactactagtggtcgcgcttggcagaccaccacttcctccccctgccccaactcccctatcacctaa

SEQ ID NO: 110283 - DNA, 249 bp, Glycine max
  Peptide Sequence Number=SeqID_227061
atggattgtcataaaggagcttggtgttacatcgaagacctcaatgctatttttggtgctcatgagaataggggaggctccaccccctccacttcttccattattgattttagagtctggtctaattcttgcaatttatatcatattcccaccaaaggtgcccctttcacttggtacaatcgtaggcaaagcacgacctctatattgagacgaggttggataaatcggtttgcaatgatgcattcctaa

SEQ ID NO: 110284 - DNA, 393 bp, Glycine max
  Peptide Sequence Number=SeqID_227062
atgttgagaacaactgaaaaggtgtgctatactcctgattttaacgagaaaccaatcatgtttctcaaccaaacaactgttggtgttggtggtggtggtggaaacaagaagagggtcacaggaacttggactttcagatttcaaaaagaccctaaattttcacctgttagattcttgcagcaactaggagcaaaagtggcaagtgctataagagttgtttccatgagaaggaggtcctctaggaaggtttcttcatcctctttggtcagaacacgttcggtgtcagaccccactgattcacatcgtgccaaagctgtggaggattgcattgagttcttacattcttcttcatctagggagagacccagttcagtttctgaaagttctctctag

SEQ ID NO: 110285 - DNA, 729 bp, Glycine max
  Peptide Sequence Number=SeqID_227063
atggatagggcgaggctagtttatggtctggtgacaaagatggacatggatgtgggctcgttcatctatggacagatatctcagatggcccagtccaactcctccaagctcggcttccatgctttgatcaccgccttatgcatcgcccggggagttgttccagattcactgactttcgagtcccttagccctgccattaatttgtcttacattagaaagaactattggaaccctgatgatcccatgatcaccttttcggggacccacaagactaaggctaggggacctgacacttatgctccttccttctctgctcctactgctccagctcctacacccacacttgcaccagcactagttcctcctccagcacccaccacaacctctgacacctccatgcagacaccatatagttttcatgaccaggctcagcagaggcccattatgagtgtgaaggcctttatggcccaggtggtctggccaggagttcagctttcttcttcaggaggagaggccgagggtgaagctgaggagatgccagaggacacccctgttgccacaccaattgaggccactgaggaaggagacggtgctatagatgccgattacgttgcagatatggcaacagcacagagcacttgggatccctggcccactccagctctggatacatcattgccagttcagcatgctccctcctcacctcatgatgaccctacaccggcatag

SEQ ID NO: 110286 - DNA, 1206 bp, Glycine max
  Peptide Sequence Number=SeqID_227064
atgactatagcagaggatagtttgttgcaggtggtggaggaggaagagggtcctcctgattttgctttgcttgatcctgaggacaattctaggcctcgtagaattgctctcttcgttgagccttctccttttgcatatgtctcaggatacaaaaaccgtttccagaattttataaaataccttcgtgaaatgggagatgaggtacccctctctttggcacttagtccaagaataatttctgctgttgctgagtttaagcctgacataatacatgcatcatcaccaggcataatggtttttggtgcccttatcattgcaaagcttctgagtgttcctattgtgaagaaagtaggagatacattccaagatacacctttagctggctggtgcaacccatgtgaatttctgcatagagcagctgatcttacactggtgccatcagctgccattgcaaaagatcttgaagaagctagagtaacagcagcgaacaagatttgtctttggaacaagggtgttgattctgaaagtttccatccgcgattcaagtcccatgaaatgcgattaagactgagcaatggtgaacctgagaagcccttgatagttcatgttggacggcttggagttgagaagagtttagattttctcaaaagtctcatggataggcttcctgaagcacgaattgcctttatcggagatggaccttacagagaggaactagagaaaatgtttgaaggcatgccagcagtgttcacaggaatgttaggaggggaagaactatctcaagcctatgcaagtggagatgtctttgtgatgccgtcagagtcagagacacttggccttgttgttctggaggccatgtcatcaggaatccctgtggtgggagcgcgtgccggtggcgttccagacataattccagaagaccaagatggcaaaattggttacctctatacaccaggtgatcttgaagattgcctgagcaaactaaagccgcttttggatgacaaagagttgagagaaaccatgggagaagctgcacgtttggagatggagaagtatgattggagagcagccactcagaagattcgcaatgaaaactacaatgctgccatttggttctggcgcaagaaaagggctcaactcttgagaccctttcaatggttggctcaacgtattttccaatctccagatccagaagccaacacatag

SEQ ID NO: 110287 - DNA, 168 bp, Glycine max
  Peptide Sequence Number=SeqID_227065
atgcaggtcgctagtgttgggagcgatgcagtcggatacgttgtgtttgctgaactacagagggattcactcaatgattttctctacctaaatcaaaatgatgttgaaataatgaactttgattggtttcagagcgtattcataaaggatttgaactataagaattga

SEQ ID NO: 110288 - DNA, 399 bp, Glycine max
  Peptide Sequence Number=SeqID_227066
atgacgttttcagactttaaccttaagcttaagatttcagctgggaaaggttctagaaaggatgcatccaatctttaccatgaaatcgcacgaacaagcctcggtgctagcccttcagctcaccctcttcccaaaccaaggtttttgaataggaataacaacacaccaacaacccttgttcgcgagtccatgccttgtacgatagccttgtatgctcacgattgctacgactttgaattggggtcgccaacggaagctagtcacgaacgacctctcgtgcctgttctcgtcgacgacgggtttgttaggaatgtgatggagcctttggctttgggtgaggtagatggtcgggtgtctggtggtgacagagtgggactagagattcagattggggtgtga

SEQ ID NO: 110289 - DNA, 1425 bp, Glycine max
  Peptide Sequence Number=SeqID_227067
atgccttcttcttccaccaccatagtctccaaatgcgtgatccaccccgaccagaaatcaaacatgaaacccttgagactctctgtttctgaccttccaatgttgtcgtgtcactacatccaaaagggcgtgttactaaccgctccgccctcgtctttcgaggatatgatactctcttttaaacactctctttctatcgcgctctctcactttccggctcttgcgggaaggttagagacagattctcatggttatgttaatattgtctgtaacgacgctggcgtggattttatccatgctaaagcaaaacacctgactctgaacgccgtcgtttcaccgtctctcgttgatgttcacccttgctttaaggaggagtttttcgcttacgacatgacaatctcctacgccggccacaacacccccctcgccgccgtccaggtgacggaactcgccgacggcgtcttcgtcggctgcaccgtcaaccactccgtcaccgacggcacctcgttctggcacttcttcaacacgttcgccgccgtcaccaaaggcgggtccgccaagaaactcctccgcgcgccggacttcacgagggaaaccgtcttcaactccgccgccgtcctccccgtcccctccggcggccccaccgtcaccttcgacgccaacgagcctctccgggaacgcgtcttccacttctcccgcgaagccattcagaaactcaaacaacgagccaacaacactgtcaacaacaaggaactaacggaagttatgggaaaacatgtaaatgacggttggaaagtcgttaacggtaacggtaacggtaactgtaacggaatgattaacggtaacggaagaaacgagatctcgtcgtttcagtcgttatctgctcagctctggagagcggtgacacgtgcgaggaaattcaacgacccggccaaaacgtcgacgtttcggatggcggtgaattgccgccaccgtctggagccgaagatggacgcgttctacttcggcaatgcgattcagagcatcccgacggtcgcgaccgtcggagacattctctcgcgcgatctgcgcttctgcgcagatcttctgcaccgtaacgtcgtcgctcatgatgacgctacggtgcgccgcggaattgaggactgggagagtgcgccaaggctgtttcctctcggaaactttgacggcgcgatgatcaccatgggaagctctccgcggtttcccatgtacgaaaacgacttcggctggggcagacccgttgcgattcggagtgggaaagcgaacaagttcgacggaaagatctccgcgtttccggggagagagggaaacggcagcgtcgatttggaggtcgttttggccccggcgaccatggcggggctcgaaaacgacatggagtttatgcaatacgtaacgcaattcgtttga

SEQ ID NO: 110290 - DNA, 348 bp, Glycine max
  Peptide Sequence Number=SeqID_227068
atgttgcaaggccaaccaactttgggaatcaaccagccgctacccaaggaggggggcatgaggttgcacaagagagcaaaagtaaagaccagatggagaaatgatcaaggccatgtttgtctactagccactaagccaaatagccaacctagcactttttttacccttgtcacccattttgagcctaagtatctttttttgttgatgaatcctgagcctaaaagaaaaatcattactacccttgactttagggaaaaggagataaaatgtcttagaatactgcaagattctaagtttggagtgagcaatctatacccaccaagggaaaaccaagtccagtatctatag

SEQ ID NO: 110291 - DNA, 345 bp, Glycine max
  Peptide Sequence Number=SeqID_227069
atggagttggtgatggatcctagccatgagaatctcttgtataaaaggtctttctggggatggaggttaggcagcatgtcccatggccatgaaatagtggagagtgcattagatactcgtgaattgaaaataacttctgcttgggggagactcacacttgaagggcacttgagggggacattgttggattactggtatgaggtgaagtcttacattaggactcattggtataaatctcctcagttttacccctcatatgcacaacaactagtaagggatggatgggtggagcgaggtcaaggggcaccagagaaaccaagtgaaggatgggcaatcagaggctag

SEQ ID NO: 110292 - DNA, 825 bp, Glycine max
  Peptide Sequence Number=SeqID_227070
atggggattgtgtatgcattggagaagtttagctcatatctggtggggtccaaaattgtagtctacacagaccattcaactattcgattccttattaccaaagcagattccaagccacgccaaccatctttcacatttggcgaggaggtcaccattcataagagggagctccataaggagttttcagatgagaagatgatggctttgagaaccttagttgacaagttccattggtttactgccatggctaacttcaaagccataaggaaagcaccattagaccttaagtcatatgaaagaaagaatttctttcaagaagccaacaggtatgtatgggatgaccttcacatattcaaaattggggttgataatctattgcgtagtttggtttctattggtcaactctgttcaaagacacttatgcacctgctcaagggtgcgacaagtgccaaagaaccgaaaacatctctaggagacatcaatgtcattacaatctatgttggagtagactatgtctcaaagtgggtgttagcagtggccactcccaccaatgatgcgaagacaacaatcaagttcttcatgaagaacatctttgccaggaaagctgaggttttcaacagggagattaagcgcattctggagaagacagctcttgcctttccaaatggtgtatggaaaggcatgccacctcctggtgcagttggaacaccaagccttctaggctctcaagagaagactatggcctaccatgacaagaagattttgaagagttcaagccaggacaacaagtgttactctacaactctcgacttagactatttttag

SEQ ID NO: 110293 - DNA, 564 bp, Glycine max
  Peptide Sequence Number=SeqID_227071
atgactaacatcatttcagggcagaagactggtggacaatatttggttggtggacttgattgtacagtgcatataaatttctttggtagccaggcagagcttttagtgccagagcttgtctccaaggaaggaggtcctgaatcattttgtggaatttttattcatgcccctgcaattcttgaagcagggccaaaagttcaagtgctggctgattatcctgtaccttctagcaaattgttgagttttgattcctctattgaagaccaaacacatgttgctggaagtaagtatttgctctggttatgttcttttctaggaaatgttcctcggatgattagttccctcaatgaagaattagcatactttgtgtcgcaacgtgcccttcgcgggcgagcgagggcgaggctcacgggtgcgctttccaaaggaggaaagatgcgcagattcgccaccaacgaaggtattagcatctcttacgtcgaaaaaagcggggcttttgctcctacgtaccctcctttggagaggaaatcagacctacgtagttctttcttatgcgtgaatcaa

SEQ ID NO: 110294 - DNA, 342 bp, Glycine max
  Peptide Sequence Number=SeqID_227072
atgaacaaggccatcttcaccagattctttcactccactcctctcttggaacgcaaatcccgcacttttggggaatctagatgcaacaattactccaaaagattccgaaaactccgtgccaaacaaacgctgcttcacgatgtcaatgcctacgcacaattcatgtgtcagggtgcggtgatatttttcatctttaactgcttagcattaaatagggaaaatgagctattgtgtaaggttgttgtggtgccccttcctctacaatcagaaatggataatggtgtgtttttggggctgcagaactcaatccagagtcttaacaatggctctagaggattttaa

SEQ ID NO: 110295 - DNA, 201 bp, Glycine max
  Peptide Sequence Number=SeqID_227073
atggttttgaaggacttggtcatggtggtcgaggaggatgtgatagggaacatcttcgacactcatatttattttcttcgaattaaggtagctcagtcaaaggcaagcattgctatatctcaaaggaaatggatattttggatgagactgatattggaggttgattgggaagttgaattacctaaccatgatgaggcctga

SEQ ID NO: 110296 - DNA, 180 bp, Glycine max
  Peptide Sequence Number=SeqID_227074
atgagggggtttagtggatctgcagctagcccaggtgagttgttgcttcaacctgaagtaaccttgctcgcccaggtaagtaaagataaggacactaatttcatcccaacgatcttgttatccgaccggcaactggcgaaaaccaaagcagtgaaacctgtcaaaagaataaatgtatga

SEQ ID NO: 110297 - DNA, 566 bp, Glycine max
  Peptide Sequence Number=SeqID_227075
acatcatcagttttggtcagggatattaccagcaggtgaatgggagcttgttgcctgcggctgtggtttctctttactgtgcttatgtgtgctacacagggctttctagcgaacctcatgactatgagtgcaatggtctcaacaagtccagagcggtcagcacaggcacactcgttcttggcatgctaacaacagtgctatcggtgctgtattctgctcttcgggctggatcttcaaccacattcttatctccaccatcttcacctagattgggtgggagcaaacctcttcttgaagaagcagaagaaggaaaggcaaagaaggaggaaaaggaagcacgccctgttagctactcgtattcattcttccacctaatatttgccctggctagcatgtattcagccatgcttctttctggatggaccagcacatctgagagctcagatctcatagatgttggttggacctcagtctgggttcgaatcggcactgagtgggtcactgctgggttgtatatctggagtctattggctcctttgctattccctgatcgtgaatttgtttga

SEQ ID NO: 110298 - DNA, 294 bp, Glycine max
  Peptide Sequence Number=SeqID_227076
atggtacattggataggtggcacatccgataccaacacaacggaatggtatcaagcacaagcggttcttcgagtgagcttgggaaatttcttgttctttggtatcttagcccttattatgattggtgtgaaggaccagaatgatagacgcgattcatggcatcatggtggttggactgcaaaaattgtgatctggcttttgcttgtggtccttgcattcttccttccagatgccataatattagtatatgactctggatttggagaagaagcactcatgaacagcttagcttag

SEQ ID NO: 110299 - DNA, 450 bp, Glycine max
  Peptide Sequence Number=SeqID_227077
atgcaaaatacatgggaatttctccaagaggggtgctccaacttctctgaggatccacgaaacgacgagagagacaccgaagagaccacagtaaccgattctagcggatttttgggagatgcaagatgcagtggaggtgcagagaccacagataattcctcttctttacactttctctctcctttcaccgtgttgatcgagttaacaggcactgcttctgtgcatagcttgctcgtgtcgtttgacaacttcccttcgtcgtttaaggaaacacttgtcgcattcttatccactccgaaacatttcattattccacaacagaaattgatattctcgcgatcaaattttttatttttttactttatccttttacccgccttttttttatacagtaaaaatgaaggggagagagaaaaactttacgccatgaaaaaattaaacgtcaggtaa

SEQ ID NO: 110300 - DNA, 654 bp, Glycine max
  Peptide Sequence Number=SeqID_227078
atggctccaaagaagcttctctctaagagggcaaggaagcaccccgcgagagaaggatctagtgcggctccacaagcggacatagaatttgacggacactgctttcgaagtgaggaacaccaacaccgctttgaagcgatcaagagttggtctttcctcaaagaaagacggcatgaccaccttgacacagatctagatggcattgcttctagcaacatcctccacagcaatcataattctaatcttcccctgccaaaatgccaactgttctatgtcatcttgacccagggatcacacctccaagacacccagtggacccagaaaagtccaacagagcactggattttcggccttgatcataggtctctgccagttctatggggcacaataactggggcaggaccaacagcagcagccagccatagatgtaccattgccacctctacaacagccaccatccctagagtccatctctcctcacatgtagaggatggaactctatccgatcccaatccttacgcgtggcctactcctgagcagttagaggccacagttgcatggcttggagacagacccaattttcaggcagttgcaggacccagaagggccccaagagatgaagatggagcttttgaagatgatgacatggctgat

SEQ ID NO: 110301 - DNA, 177 bp, Glycine max
  Peptide Sequence Number=SeqID_227079
atgaggcacaagaaagaggatcagaaaagggtgggaggagctcgtggagaagcaaaatgctcccaacaactggttgccgcaaccttacaagaagatcatggtgggtcacctgagcggtgcaccagtaaccttgagaaccatttaaataagccttacaattgcagtttggaaaactga

SEQ ID NO: 110302 - DNA, 660 bp, Glycine max
  Peptide Sequence Number=SeqID_227080
agcgaacgaacgacgatgaacgtggtgagcgcgttaatggtgactcggaaccaactcggagcacctgaaggcatacccttcggatcggtatggttgttcgtctacgccgggatctccttttccctcgtcatcttcgccggaatcatgtcaggtctaaccctaggtctcatgtctctcggcctcgttgaccttgagattcttcaaagcagctcggttatacttccggtggttcaaaagcaacaccagctgctagtgactctgcttctgtgtaatgctgctgccatggagatagttccatcagatatgcctctttacgatatactgaatgagtttcaaaagggaagcagccacatggctgctgttgttagggctaggaagcagaatgagatgtcagaaaatgttgttgccaacattgacaagttttcaaggcctccaagcattaacaagtcaactggtttgcaacgtagtgattcccggacaaatggttccttttcagataatattgaagatgaagtgattggtgttatcactttagaagatgtatttgaagaacttttgcaagaggagattgtggatgagacagatgaatatgttgatgttcataagagcacgggctccatcaatccgaagattgactgtccaaaagggagctgtaagtga

SEQ ID NO: 110303 - DNA, 231 bp, Glycine max
  Peptide Sequence Number=SeqID_227081
atgaagctttggatctctgatttcccttttaggtgttgcacgatggtggtgtgtggcacgatcgatagtgctattttgatccgtggtttttgtaatgatgagtggtatgtggtgcaatgggatcaaagtttgaagctggtgcaatggtggacgatgacattactagaggatattggagagcagggaggagggtggcataaggtggtgtggaggatcaacacacattattag

SEQ ID NO: 110304 - DNA, 1860 bp, Glycine max
  Peptide Sequence Number=SeqID_227082
atggacttgaattatgtgctgagaatcccatggaacacttctgcttgccacaacttccaacaaactttggcggctaaaaatggaaccgatgcaaacacttgttgcatatctctcttgtccctcttcggcataggacttgcacagcatctcaaggagacttctcagttccaactcccaaaccttgccacctccctttcgtgcatccaagacttccaattaaagctctcttccctctctctccccagcaacctcgctgacacctgctttgacccacttcagtttgtgatctccccaaacatctgtgctggaattcaaaccatccctgattggaccaaaaagcttggtcagtccacaccactcaacactgcttgcaaatcagatctgactgatatctctctctgtgatgtgtgtctgcaagctggcttacaggccaagcaggtgcttatttctattgatggtaatgcttcacattccattgactgtttttactttgccattctctatgctgctggggttgtcaatgagtttggacctgaaagcaatggtgctgtcagttgcatttttagcatatcggtttattcacaagggggctctgggggaaagggtcaccaggctcttgtgtttggtttgacaggtgccgggattgctttgttggtcatgtcttcctttttggggatttatgcatggtatgacaggaagcataggagaaaaaagcttgagacttttcagtttgattttgaccctgaggaacaaggctctaggcctagattgagacccaataccgggtcaatttggttcaaaattgaggaacttgagaaggctactgataacttttcatctaagaacttcattggccgaggtgggtttgggatggtcttcaagggaaccttgtctgatggaactgtggtgggggttaaaaggatcttggaatctgattttcaaggggatgctgagttttgtaatgaggtggagatcattagcaacctcaagcaccggaatctggtgccccttaggggctgttgtgtggctgaggagaatgagaattatgatgaaaggggaagccaaaggtatcttgtgtatgattacatgccaaatgggaacctggaggaccatctctttttatcaacggactctcagaaagcaaaagggtcattgacttggcctcagaggaaaagcataatcttggatgtggcaaaggggttggcctatttgcactatggagttaaacctgctatttttcacagagatatcaaggccaccaatatactacttgatgcagatatgagggcaagagttgctgattttggacttgccaaacaaagtagggagggccagtctcatctcacaactagagtggctggaactcatggatatctagcaccagaatatgcactctatggtcaactcactgagaagagtgatgtgtatagttttggtgtggttgctttggagataatgtgtgggaggaaggctcttgacttgtcttcatcaggatcaccaagggcattcttgatcacagattgggcttggtcattggtgaaggctgggaagatagaagaggctcttgatgctttcctggtgaaggatgagaactttcctagttcaaatccaaagagcataatggagaggtttttgctggtgggaattctgtgctcccatgtgatggttgctttgaggccaacaattgctgatgctttgaagatgttggaaggtgacattgaggttccacaaatccctgatcgccctatgccacttggccatccttcgttttataataataataataatgatggcagtacttttagcatatccccagcattaagcggccccaaattgcaaactggagacatgctcaggtaa

SEQ ID NO: 110305 - DNA, 591 bp, Glycine max
  Peptide Sequence Number=SeqID_227083
ggataccaaggaagcgcttggaggagagggcagaagcttgggcagatcaaggagacgatcgacgctgttcttgcttatcattatagcaaggaaaacccaatcatcgttgtcttggacgatgcatatgacacattcgacctaagatgcgaaaagagtagcgtgaggattgtctattgcacacccgctctttatgtgtggtatggtagaagcatccgtttagttggttcccccgatggaaagaaggagggaccagagtgttgtgctcaattgaaggattcccaaacaaaagataaggagcttcggggaagtagcaacggtgtcatcgatagctatcataagtggttgaaggctaggatgcaagggataatttggctcccaaagctaaaaggtccaagtggggaagaagttgaagcccctgaggaaagtgaagaagtgcaagccttgaaaatagagcttgaaagaatgagagtggttaaggaaaagctaaagatagttgtcactagggtcaagaagaagtgtaataagctaagggatgtcaacatgactatggccgaagcggcaacaacatggaggaagtgcaagagtagatga

SEQ ID NO: 110306 - DNA, 156 bp, Glycine max
  Peptide Sequence Number=SeqID_227084
atggggtctgtgaattttagaataagggttcaggagttgtttacgcatggggaaggaaatgagggggttggtggatatgcaacgcgcccaggcaagttgttgcttcaacccgaagtaaccttgctcgcccaagcgagctggttacttcacccctaa

SEQ ID NO: 110307 - DNA, 435 bp, Glycine max
  Peptide Sequence Number=SeqID_227085
atggcaccccatgtgaatccaagggcaaaagagtatggcatagggctgaaagggtcaggcagaatccaaatagtgtttccaaacggaagtaacgcaatatatatggatgcccacatcaaagaaggggacgtgttcttcattccaaggtactttgctttctgccaaatagcatcaaagaacgaaccacttgagttctttggcttcaccacctcggctcagaagaacaggccacaatttctggtcggtgccacgtcactcatgaggaccatggtgggacccgagcttgctgctgcatttggtgtgagcgaggagaccatgaggcgcatggctagggcacaacatgaagctgtgattctaccaactccatggactgcacatgcacatgatcacaaagtggtggtggatagggttcaaaagcttacaaagaatgagatg

SEQ ID NO: 110308 - DNA, 687 bp, Glycine max
  Peptide Sequence Number=SeqID_227086
atgccagttatatataacatccaaggggaagcaaagttgggattcatatataaagccaagctggcggaaaggcatttgaagatgggagatgtataccaaattccagctgaggaggctcaaaagcttcacattatctgcagcattgacccctctgagagcttgggagttgatgttttccagtccttctatattgaaggaggagcccatccagcctcattactttctggattcgagtctgaaatccttgaaactgcttttaacgtacgcatcaggagaagagttgcgaaaaatcttcactgggcaacacgagggcccaattgtgtacgtgggggttcacatgccacaaccatatggaccaagttccttcaacttaaggaggaagacaaactgtatcacctgagggagatagtgcaacaagaagaaggaaaggaagaagaggaatttgttgatgaagaagagcaacagacaagttggtcctggaggaagatcttggaatctgtatttgaggatgaggtcaagaacacaagggagaaggttactaaaacatcccctctctcttgcaacctctatgacagaaagccagatttcaagaactgctatggttggagcgttgatcaagatggctctgagtattctccactcaaaagttctggcgtcggcatttatcatgtcaatctctcggcgtga

SEQ ID NO: 110309 - DNA, 279 bp, Glycine max
  Peptide Sequence Number=SeqID_227087
atggctagcacaagcacaagagtgttcatatcagaaggagcatccacaaataaaccaccaagcttcgataagagaaactactattattgtaaggagaaaataaagttcttcatggagtcacaggacatggacatgtggcaaattgaccaagaaggtccatatattcccacgaagaggaatacggaggggatattgcaagataaacccaaggtcgaatggagtccaaatgataatagaagtgagtatgataaagttgttggttgcgggacaactaagtaa

SEQ ID NO: 110310 - DNA, 387 bp, Glycine max
  Peptide Sequence Number=SeqID_227088
atgtttaatggtcttggggctataagctttacaatcccacttcaagatccttttcaacctcaacaacctcaagaagtgccattaaggagatccattatagagaagagaagtgcaatcccaaatgattataatatatttctccaagaacatgaagatgatgttggtttaacagaggaagatccaatcaacttcggtcaagctatgcatagttctaactctaaaaattggattgatgccatgaaggatgagatgaaatctatgcaagacaatggaatttgggatctcatcgaattgcccaaagatgtgaaacctattggtttgttaaatagatatttaaaaccaagaaggatgcaaaggataatatctagagatataaggctcatctag

SEQ ID NO: 110311 - DNA, 114 bp, Glycine max
  Peptide Sequence Number=SeqID_227089
atggggacttatactccaattcctatcacaaatcaatcaccagcgcaccacaaactatcagtacggaaaaaggtgatcaagctccttgttgcagaaagtaaaaagcatttttga

SEQ ID NO: 110312 - DNA, 327 bp, Glycine max
  Peptide Sequence Number=SeqID_227090
atgtttggatggattaaaggaggggaaattggcattgccggggtagagggcaagttgttgttttccaaaggtgaatggaaagtcacacttgtacacatgtggcatgtgaagtggcccttttctgaatccacaaccctaactcatacagttgcattaaaggccttgtgtgggcaatttcagaagggagggattgattcattgctcacccataataagtcaaattttcaattttcaaccccaagtaaagttcaactatgttctattctatacccaatgcttgttttatgcctcaacatgcctagctacagaatacgtagttgttactag

SEQ ID NO: 110313 - DNA, 3516 bp, Glycine max
  Peptide Sequence Number=SeqID_227091
atggcaatggcctattgcatctcccagctccccaaactcccactcctcccttctctccctcattcccgttcctctaaaaccctcccttcactaaaccacgccgttccccccacccttctccgtgcatgtcctcctcccaccacgcgcctcaaccccgcgcgcgtccgatgctccgccgtcgccgtcgccgaacctcctgcccccaaactcggcaagcggaccgacataaagaagatcctgatcctcggtgcgggccccatcgtcatcggccaagcgtgcgagttcgactactccggcacccaagcgtgcaaggccctccgtgaggaagggtacgaggttgtcctcatcaactccaaccccgccaccatcatgactgatcccgaaaccgccgaccgcacctatatcacccccatgacgccggacctcgtggagcgcgtcctcgaatcggagcgtcccgacgcgctcctccccaccatgggcggccagaccgccctcaacctcgctgtcgccctctccgagagcggcgccctcgaaaaatatggcgtggaactcatcggagcaaagctcgacgcaatcaagaaggctgaggacagggaactcttcaaacaggccatgaagaatatcgggattaagacccctccctccggcattggcaccactcttgatgagtgtctcagcattgccaatgatatcggggaatatccgttaattgtgcggccggcgttcacgcttgggggtaccggcggcggaattgcgtataacagagaagatttgctggaaatttgcaaggctgggattgctgctagcttgactaatcaggttttgattgagaagtctctgttggggtggaaggagtatgagcttgaggttatgagggacttggctgacaatgttgttatcatttgctctattgagaatattgatcctatgggggtgcataccggggattcgattactgttgcaccggcgcagactctgacggataaggagtaccagaggctgagggattattcgattgctataattagagagattggtgtggagtgtggagggtctaatgtgcagtttgcggttaatcccgataatggtgaggtcatggtcatcgagatgaaccccagagtttccaggtcttcggctctggcgtcgaaggctactgggtttcccattgcaaagatggcggcaaagttgtctgtggggtattctttggatcagataccaaacgatataacgaagaagacaccggctagttttgagccctcaattgattatgtggttactaagattccacggtttgcttttgagaagtttcctggttctaagccaatattgacgacacagatgaaatcagttggtgaggcgatggctgtagggcgaaccttccaagagtcatttcaaaaagcagtacgctctctagagtatggataccctggatgggggtgttcacaagtgaaggagttgaactatgacttggagcaattgaagtatagcctccgagttcctaacccggagcgcattcatgccatctatgctgcaatgaaaagagggatgcagattgatgaaatctttgagctgagttacattgacaaatggtttctcacgcagctaaaggagctggttgatgtggaaagtttcttgctgtctcacaatttgtctgatttgacaaatattgatttctatgaggtgaagagaagagggttcagtgataaacagatagcatttgcaactaaatccactgagaaagaagttcgcaataggcggttgtctctaggtgtcactccagcatataagcgagtagatacctgtgcagcggaatttgaagctaatacgccttatatgtattcttcttatgattttgagtgtgaatcggctcccactactagaaagaaggtcttgattttgggtggaggaccaaatagaattggtcaagggattgagtttgactactgttgttgtcatgcatcctttgctcttcaggatgcaggatatgagacaatcatggtgaactcaaaccccgagacagtttccacagattatgacactagtgaccgtctatactttgaacccttgaccgttgaagatgttttgaacattattgatttggaaaggcctgatggtatcattgtacaatttggtggtcaaacaccattgaagttatctctccccttacaacaatacctagatgaacacaagccagcatgtgctagtggggttggtcatgtacgcatttggggaacatctcctgattccatagatattgctgaggaccgagagaggttcaacgtgatgcttcatgaactaaagattgaacacccaaaaggaggaattgctaggagtgaaactgatgcacttgccattgcagcagatattggatacccagttgttgttcgtccttcttatgttttgggtggtcgagcaatggagattgtatatagcgataataaactggtgacttaccttgaaaatgctgttgaggtggatccagaacgccctgtattaattgacaagtatttatctgatgcctgtgagattgatgttgatgcactggctgactcacaaggtaatgtagtcattggtgggataatggagcacattgaacaggctgggatacattctggtgactctgcctgctctattcccaccagaactgttcctgcttcttgcttggagacaatcaggtcgtggacagtaaacttggctaaacaattgaatgtttgtgggctcatgaattgtcagtatgcaataactccatcaggggatgtatttttgctagaggccaaccctcgagcttctcgtacagttccatttgtatcaaaagcaattggccatcccttggctaaatatgcttcccttgtcatgtctggaaagaccctctatgatttacagtttacaaaagaagttatccctaaatatgtgtcagtcaaggaagctgttcttcctttttcaaagttcccaggctgtgacgtgtttttaagtcctgagatgcgaagtactggtgaggtcatgggtattgacccttcttataatattgcatttgctaaggcacaaattgctgctggccagaagttaccactttctggtaccgtgttccttagtttgaatgacttaacaaagccacatcttgagaagatagcaaaggcttttgttgagaatggtttcaagattgctgctaccagtggaacagctcatgttcttaacttagctaaaattccagcggagcgagtgctgaagttgcatgaagggaggcctcatgctggtgacatgattgccaatggggacattcagctgatggtggtaaccagttcagatgatgcacttgatcggatagatggtctggccctgagaaggatggctttggattacaaggttcctatcgtgacaacagttaatggagctctggcaactgctgaagctataaacagcttgaaggccaactctatcaaaatgatcgcacttcaggacttcattgatgcttaccgtgagattgtacaagttgctagatttgggagtggcagatga

SEQ ID NO: 110314 - DNA, 375 bp, Glycine max
  Peptide Sequence Number=SeqID_227092
atgaaattggagtgccttgttgttttggcctttgttctctttgcttctgcagttgctaggaaggaaattgaccccaaaggttggatccccatcgttaaaatcaacgatcctgccctaatagagatcgctaaattttctgtgacagcattcaatgagtgggctggtttgactttcaagttgcagaagctgctaaaagccgaaatgcagggccaagttgtaaatgggatctactttcgactcatcgtcgccgccggcgatgatcagtcctcctccaacaattaccaagccattgtctggaatttgccgtggacggaaaattacatgaaccttatttcctttatccctgttcatgatgcacctcctagttactattaa

SEQ ID NO: 110315 - DNA, 264 bp, Glycine max
  Peptide Sequence Number=SeqID_227093
atgccggatggggacgtcgggttcaccttagcaacagcgctggtagtggcaacttcaaccgcattggcttccattatcttcttcatgctcatcatggcctccatcattgcggtcatttgctctttcatggcctcctatgtcggcctccatctgctcttgcacctcctctacttcacctattactcttgctctagcataggttcggatatggggttgaatcaatttaaattttcaacatggttcatgacatcttcgtcaaggtga

SEQ ID NO: 110316 - DNA, 398 bp, Glycine max
  Peptide Sequence Number=SeqID_227094
atgatgatgtgaatatgatcttgtataaaaggtttgttgttggtggtggtggtgttgttgttattgttggtggtggttgtgttgttattgttggtggtggttgtgttgttgttgttgctctcaacctagtgatgggggttttcttggtggctaacatgaatgggcttgtagaatacacaagctcatgggagatcgctcgtatagtgttgaaactccatggagtagagttagtgttgatgggtcttgcttctacaagttccaccttcaatgtctctgccttatctctttttgatgcaaatggagaatctgatttgagggcaaatccttctcaagagggagagaatgatgaggacatgaccaagagcaagggcaaggatccacttgaaggacttggatga

SEQ ID NO: 110317 - DNA, 387 bp, Glycine max
  Peptide Sequence Number=SeqID_227095
atgggacacattggccataacttattgtcgcaacgtgcccttcgcgggcgagcgagggcgaggctctcgggtgcgctttccaaaggaggaaagatgcgcggagtcgccaccaacgtcgacaaaagcggggctcttgctcctacgtaccctccatcaaagaggaaatcagacctacgtagttctttcttgaagagagctctgaagaatcttcacaccatgtcacttgaggaacttgttggaactttaaaagttcatgaacaagaacttcaacaagacgaaggaatcaagaagggaaagtctctagctctcaatgcccaaaaagtcaagaaagttccatcattcaaagaatgtctaaatcatcatcctaaaggtcgtccaaagcattga

SEQ ID NO: 110318 - DNA, 252 bp, Glycine max
  Peptide Sequence Number=SeqID_227096
atggcttgcaagtttgtcacttcaattcttcaaagcttcttgtatttataccctttcttcataaggtctacccatacatatgcaaaagaaaggaaaacacccagttccataacattcatcactatcctaaacctagggaagaaactatatgcaaaaagggtgaagcaaaagggcaactccccaccaaccgttgtcactattgctacatgctttgatgcatttgaagaagacgacaaaaatggtgaagaataa

SEQ ID NO: 110319 - DNA, 375 bp, Glycine max
  Peptide Sequence Number=SeqID_227097
atggatgagataattgattacgtgatgcaagtgtatgaagatcttaaatcaaaaagggagaaatgggaaagagctatacaagctaagcttattgcaaaaatagctaaggaaaaaactaccaaggtcacccaagttaaaccttccaatgaggccacctcattacaaaaaaaggatcataatgcagttgttgtttttctcagcaactcaagcaacacgaaggatgttgatcccataagctatgttgcccccaatgtagatgctctttcaaaatacaaagttcaagccatggtaactctagctatgcggaagcaaagggaagaaacaaaggagttggtgacccaagctattatgaagcaaagagaagagacaaaataa

SEQ ID NO: 110320 - DNA, 627 bp, Glycine max
  Peptide Sequence Number=SeqID_227098
atggggaagaaggcgaagaaagctatgaataatttgaaaagggcttcctttaataataagccatctgagggtgctgatttcttgcccttggaaggtggtcctgctcgtaagctcgccgcctcccagcagaagccgccggagaacaccgccacggttttgtatgtcggtcggattccgcatggattctatgagaaggagatggaaggttattttgggcaatttggaaccatcaagaggttgagaatcgcaaggaataaaaagtctggaaaatcaagacattttggtttcatagaatttgaatctcctgaggtagcaaaaattgtggctgatactatgcataattatctcctttttgaacaccttctccaagtttatgtaatacctccagagcatgttcatccaagaatatggagaggattcaattaccattacaagccattggattcagtccaaattgaacggaagcgtcatgacaaggaaagaacattgaaagagcaccagaagttggtggataaggttctgaaacatgaccaaaaacgacgtaaaaggatagaggctgctggcattgattatgaatgccctgagattgtgagactcttgcttttatcaatctgtattttttcataa

SEQ ID NO: 110321 - DNA, 555 bp, Glycine max
  Peptide Sequence Number=SeqID_227099
atgagtgttgttgaattggaggatgacaaatttgggttagaaggtcacatcgagcctgagtttacaaaagagtctggcttaccaaatgggaaactcggttcctttagtgaggacgaagatgaagttctacacaatcaatcccaggaggaagatgatgaggaagaagctgagactgttccaccaatcacaaccggagttgtgcttgaaggtgcaagacatcatacatccttgcaactgtcgtatttgctcatcagtaaaagtatccacaacttgattgaaaatgattcatcaacttcggtgtcagccttgatagtacacatcaaaagcacagaaggatacaccaccacataccacaaagcatggttgacaaagcaaaaggctattgaaaacatctacgacaactatgaaaggtcgtaccatgatttaccgagattgttgcaagctatgcaacaattttgttcttggtttggttgtggagaaggaaacactgctaatatcaccacaaggagatcaagcagtagagagtttcgtgatgttccatcgtcttttttttga

SEQ ID NO: 110322 - DNA, 192 bp, Glycine max
  Peptide Sequence Number=SeqID_227100
atggtgatgcactctcgcacgaatttccgacatcgaaattggcagaaacaaaacgaagaagaagaagaacaaaaagaagtgaagatgaagcacgttacatgtatgaggaggaagagcatcgaggagggcaatagcgatgacggcggaaccctagaagcggagtcgaagaatgagagggaagttgaagagtga

SEQ ID NO: 110323 - DNA, 279 bp, Glycine max
  Peptide Sequence Number=SeqID_227101
ttgttggcggcatcttccttgtttgcggtggaagagttgatggtaggtgctgcagtggacttcgttgatgacgatgggttcgagatcgataaagacgatgcgcaggatgtgcttgttgaatctggtttcactaaagaaggtgttgaaggcatcatgggctacatccaaggtggaagagttgatgggcgattgttctacatcggttgtgtagcaacaaccgatgcagaatgtgagttttctacatcgattctaaggatgaaaccgatgttgaatgagtag

SEQ ID NO: 110324 - DNA, 1269 bp, Glycine max
  Peptide Sequence Number=SeqID_227102
atggcaaaaagtcggttgaaaactctaactgagttaagacgtgttagagtggatagtcagatcctaatggtacatcgctatggcaagtgggtaaaactctctggtacagagcttttgcctgaggatgttgtctccataggtcgctcttctggtcagaatggggaggagaagtctgtaccagcagacatgcttctattggctggaagtgtgattgtgaatgaagctattctaacaggcgagtctacccctcaatggaaggagacattgtcagcaaggcaagataaaaaccatgtgttatttggtggaacaaaaatattgcagcacactccagataagagttttcctctaaaaacacctgatggtggctgcttggttgttatcttgagaacggggtttgaaacaagtcaaggaaagttgatgcgaacaatcttattctctacggaaagggtgactgctaatagctgggaaagtggattcttcattttattcctggttgtatttgctcttattgctgctggttatgtgcttgttaaggggctagaagatcccacaaggagcaagtataaacttatactaagttgttcacttattgttacttctgtgattcctcctgagttaccaatggaattatcaatagctgctaatacttccctgattgcactggcatggcgtggcattttttgcacagagccttttcgaataccatttgctggaaagtgttgggatccctccttaattcgagagacagggacacttacttctgatgacatggaattttctggaattgttgggttgaatggaactacagatttggaatctgatacgagtaaagtgcctctgcgaacagtagaaatcctggcttcttgccatgcattggtatttgttgagaataagctggcttatgtagcgcctgtggagtttgctggttcagggttgcttgcgattgcatttgttagcttgtcttccccagaccaagggataagaagattagcgtatggcactcttgataaatttaagaatgcagtagagaaagtgcctgctgggaaagttcagctagagaatcttatgagactcatagaagagccatggcaaagaatcccatcagttattgctttatttgctgcagaggcatcttgtgtattgttagatccggcacatgatcattatgcagctatcaggatgaactcagatgatgatgttgcgatatatatcaggaactctatccttgagaagctaatgagtttttacgtctctcctctttcagattga

SEQ ID NO: 110325 - DNA, 267 bp, Glycine max
  Peptide Sequence Number=SeqID_227103
atggatgaactgaaggatttgatcaaacaagttgcgcctcgtgggattcccccttatggtgttgatgaaacacaaatggtgatccgtacattgatccgtaaaacgcttacggatcaagttgatcccccaatctactttgttatatccaaattgcttcttgcacctccttcttcaacttataatatcctcagcaaccagttcattcggatattcagaaagggtttattattcccaatagaccgacagacccggggattatatctctaa

SEQ ID NO: 110326 - DNA, 255 bp, Glycine max
  Peptide Sequence Number=SeqID_227104
atggcgggagattcggcggcacatggtgggaatgttggagttgtcgaaggggaggtggctgacaagaaggttgtagaggatgatattgcaggattagcgtttcaaaatttgttcatttttcttaaattctcatttttttcccttggcagttggcttctagtagttggttggacttcacccttcccaatggccaacacccttcccaatggccaagtatttgaggagtatcactattttctcaatctcatttcctaa

SEQ ID NO: 110327 - DNA, 1603 bp, Glycine max
  Peptide Sequence Number=SeqID_227105
atgagtccagcgaatctggaggaggagtgcttgaaacttctgaaaggagagcgagacgaacagcgtctggctgggcttcttctggtaaccaagttctgcaaagctgaggatcagtcctcagtccgtagggtctacgatgcggttggacctcactttctctatcgcctcctcagaaccggtatggcaagcggaggaggaggcctcaacgataaccggaatgcctacttaagcttatccatcacggttctcgccacattttgtcgtgttccagatattgcttcctcggaggacatgcttttctatatcccccttgtcttggaagtaatatccaccgggtctgtcttatctgttcttgaagaatgctatgagtttctatacttggtgtcagctgcttctgaaagtggaatcgcgagatttttcgaatccggaggcatcaagatactagcttctcaaatgcgttctcttcacgatggttcacatctgatggaattatcttttaaacttttgcaattgattctgggtaggacgtcctcggacataattcagaataatgacttatctgaaatctcagttattgtggcagcaatagcaaggcagtttgctgtcttgcacaattccttgaaatttgaagctctccacctactaaatgccattctttcctcaaaagattcatcacaacttcgtgatgccttccgattacttcctcaagatagctggtcacccaatatacgcattggtataatggctattttgcagaatcgtgttgcacctgctgaaaggttgcaggctctcattttagccgagtctatggtttccatgtatggagaagattggttgattggccaagtaagcacaaatgatgcactagatccagctccagctgacatgtgcttgttgcttgtcttggagcagtcaagggttgaaattgctgttcttctgaatgagttggcgtacttaaaatatgaagcacctcaggatacttctgccacagctgaagcaattttttcaaagcgacataatgtggctgttgcttactccttggttgagaggataataaaattaatatcaaatgttgaaggaaatgatggaaacctccttgatgaaggcacattgacaaagctgattcaccaactgaatgagacaattgctgttgtactagagtatttagaagatgcaaaggaacatgggcaaaagaaaggagatgatttacttgcttcagtgcgaattattgggagctatcttgcagaagcacctgtagcatgcaaggagaaggttcaagatcttttagggtatatgctttctcttgaaggtgaagatgaacaaaggcccttctacgctgtttgctttctgctacctatgttgtctcaaattactatggagattgaaggatgcaaagctttggcttcatgtaaaggacttgaggctgttttagattgcttcagtaaattagttgggtcacatgcttttctggttgaggataatggttgcatctttatggcatgtgatacaataatgaatcttttattaaagaaagacaaagttcagataaagttggatgtatcagctattgttgatcttcttaaagtgttggctcattggtcag

SEQ ID NO: 110328 - DNA, 294 bp, Glycine max
  Peptide Sequence Number=SeqID_227106
atggccaaggtcatagtggctgctgcaaggaaatggaaagtgcatattcctagttacactaaagaactttacgagcttgatttggaagagtatgccgagagagggagagtcagaattgattccactccaaccttgaggggatggatgctaagccatgttacccatgtagaggagaccaaacaaatgctaagaatgatccccatcttggttgctacattgattcctagtgcaatggttgcacacataggcaccttttttgtgaaaacactaagttcctcctctacaacaccttga

SEQ ID NO: 110329 - DNA, 435 bp, Glycine max
  Peptide Sequence Number=SeqID_227107
atggatatgaacttggggttcctcatctcagccttgattactgctttatgcaaggcccgaggagtcacctctgattctatgacctttgaatccctgagcctagccattaatttggcttatattaaacagaattgttggaacctggatgaccctttggtcacttttcagggaacctgcaaatctagggccagaagatctgaggcaccatctacttcaactccccctacctcagctccttctacatcagctccttctacctatcctctccctccaccaccaacagctccgattcttccagagcctgcatcagggcaagctcctaatcatgtagagtctgcaggatatggtccaccaacggccagttatgagcatcaaggattttctacagaaggtggcctggccaggagtccagccttcacctttgggagggggtga

SEQ ID NO: 110330 - DNA, 687 bp, Glycine max
  Peptide Sequence Number=SeqID_227108
atggatagagctaggtccaaaggagtcatttccgatagcttagcctttgaacgtttgagcccgatcattaatttggcctacatcaggaaaaactgttggaacccggatgatccaacagttattattagggggaccagaagaccaagggcaaggccagctaaggttcctgctacatcagcagctcctcctccatcacgtatgacagcagctccttctaccctacctcctacagattttcaacgtttcgaggccatgcttcggagcatacatcaggggcatattattttactgcaaagactacagctggtagcacctctagactccatcccgacggtagagcaatttaatgaatgggtagcttggctagggactcagcctccttttcacagagaagacgaagatcccgccactcaggtaccccatcagtcggaggatgagtcatcagaatcttccactcctgagcccttgatcaggaaaaggaggtctcttgaagctactccagagcttccggcaccagtggcaaataccacttctccacagcaggcagtagacccttccacgcctgaggatcaaaccaccccagtcttgtctccgaacacctctcctatagctactcctgtacttcacttgtcggaagaggaggagggtcagacactggacacccaggaccaatcacaggatatttaa

SEQ ID NO: 110331 - DNA, 834 bp, Glycine max
  Peptide Sequence Number=SeqID_227109
atgggaggaaaaagtgagaaaggtgaagttatggagtggtcagctgcaaacacaaaggctttcattgaaaaaatttgtgagagagtgaaaaatgggcaattacaagggtcaaccttcaaaactacaacatgggaagaaattaacaaggacttgtttgagatgatccaaaataattatgcccgtaccggagtcacttgggaaatggaatccaacaaagtgaatgcccctgatgatgtatgggacaaattgattaagaaaggaagacattacaagaatttcaagaaacatggttttgagtacgactatgatatcctcggtgacatattcaattcaagcacaacaactgggaaactaagtcatgcttctactcaagagccaccaaattctgatgaggagagagccatggaaggtgatttccttacaaaggggattcatattaatgttttcgatgatgagaaggatatcaaagggcttaggcacaaaaggaaggaaatattttcttcaggtgagcgttaccgtaaagagggaaaaacttctaacaaagagatgttagacaaaattgtaagcatatggagttattcaatgagccaaaggacaacaacttcaagagctagagaagagcgatataagggaaagacttctcaagctactagtccaataagtgatccttattcagcaaaggcatacatggaactgttgaacaacatgcaaaatgttcccacttcagtatactttaagttgatggagaagtttacaagtaagcattggaggcaaatgttcatagtgatggatgcagaacgaaggaagcaattgatagaatctcttactgagtag

SEQ ID NO: 110332 - DNA, 222 bp, Glycine max
  Peptide Sequence Number=SeqID_227110
atgaattggtgcacttgtcaatccatcaacattaagaagaacgacaagtgggtagtgatgccttttggactcaagaatgttggggacacatatcaaagggccatgaatttgatatttcatgagtttgaccaggacttgatagacttggagatgaatcctgaaaaatgtgcctttgggataatgacagaccacttcctaagtttcttagtgcacagaaaatga

SEQ ID NO: 110333 - DNA, 858 bp, Glycine max
  Peptide Sequence Number=SeqID_227111
atgtataccatagaattcttagtaggtcatgaaacaagatgttatgagaactttcggatgaagaaagatgtatttttgaatttttgtgaaactttaaaggaagttggtaatttatgtgatggtaagaaaatcagcatagaggaagcggttgcaatgttcttgattataatatgtcataacttgcgtcatcgggtagttgctgaacagtttcaacattcattgcacacggtgagcaagtggtttcggattatcctaaaagtagtttgcaagctagtgaagattgcattggtgccattgatggaacacatgtatctgcttgggctccttgcttctaaacaaactgcttttcgtggaagaaaagtgttggtgacacaaaatatattagttgtgtgtgattttgatatgtttttcacgtttgtttattctggttgggaagggacggaaaacgattcaagggtatttttggatgctttatctcccgaaaataatttcccaaagcctaatagagatcaattctatttggtcgactctggatttcctaacatgcctggctatcttgttcctttcagaaggaacatatatcatttgtgcgattttcgtgaaggatgtggacgtccacgtggaaaagaagaattattcaattacatacactcttcattaaggaatgtcattgaaagatgctttggagttttgaaagcaagatttccaattttgaaattgatgccaagttatcccattagaagacaaagattaattcccattgcttgttgcactatacataattttataagaatgcaaaatggtgtggatacactctttgaccaatatgttgaacaactcgtggacatggatgagtaa

SEQ ID NO: 110334 - DNA, 195 bp, Glycine max
  Peptide Sequence Number=SeqID_227112
atgacagggtcacaaatgattgataagcaacacacttttgaagccagacaacaggccagtgtacaggaagccctatccgtaatggattggcaatccaaagggtacaaaatccgaaatttttcaaccttctcaagcaaggatgagaagtccactatggagcatgttagccataagggtgttcgtggttcgatttga

SEQ ID NO: 110335 - DNA, 246 bp, Glycine max
  Peptide Sequence Number=SeqID_227113
atgcgcctaccagggaaggagagtctactgatgggatcccccataaccataaatgagatcttggatgttagcatttcgtttctaaatgaccatttagaggaaacactgggtccgacaaaaatagaagaaatccactcaaagtgtatcaatctcgcacagggtaaggtttatggtgagtcaggattttggctcaaggcttgtagattggctagacatgatacatgtcagggtttggttcaaggataa

SEQ ID NO: 110336 - DNA, 237 bp, Glycine max
  Peptide Sequence Number=SeqID_227114
atgtcattggctaacgctgttcatgcgtcctccaccaacgagtctggagccccgcgaatgtcattgcctagcgctgttcggcaattctccattctccactttttttcggagccccttgaatgtcattgcccagcgttgttcatgtgtcctccaccttcgagtctggagccccgccaatgtcattgccttgcgctgttcaccaattctccattctccccttttttcgaagccctatga

SEQ ID NO: 110337 - DNA, 450 bp, Glycine max
  Peptide Sequence Number=SeqID_227115
atgaccctagagctggtagcccacggagacaccttacggttatccgcgcctcgtcattcaatgaccccaagtgtgattgatgagcagaggccaatgtggtcatctgcgccctttccggagatgtcggcatcttccggtggagactttttcaagtctcacaagttatctagaactacaggcggcgggcccgatgacacgcagagacaaattatggtcattccgcaccccttttccattcagacacagtcgtgtccgatggcacgcagagacaaattatggtcattctgcacccttttgtcatccagaggcggcgggcccgatgacacgcggagacaaattatggtcattctgcacccctttgccattcagacactgtcgtgtccgatggcacgcagagacaaattatggtcgttctgcaacccttttgtcatccagaggcggcaggcctga

SEQ ID NO: 110338 - DNA, 413 bp, Glycine max
  Peptide Sequence Number=SeqID_227116
ccagatgcaatcccagtttcagtcgcagatgcaatcatgaggactcgcactacctcctgagcctgaggaatgatccagacacaggtgactcagacaaatacaggttgtacatcaaagaaaatcctccctgcctggttgccttaggaagagtttatgagggatccacaaccgttcacaacattcctttgctgcatgatcaagtcaaggttggtgttgaggaggttggagatgcagattctcctattcctatacctactgaattggttaagttattggggcagacacttaacaccttccttgcttggtcaacacatcttgtcaagcatttatcaaaacagataaacagggagctgtgggaccggcaaaacctacaaataggccggatcatgatgtcgatgatcccttgtatctga

SEQ ID NO: 110339 - DNA, 465 bp, Glycine max
  Peptide Sequence Number=SeqID_227117
atgaattgcgttttcgttcatgggtcctccacccacgagtttggagccatgcgtagtgattgcttagtgcaattctccattctcaacccttttttggagcccatgaattgcgttttcgttcaagcgtcctccacccacgagtttggagccatgcgtagtgattgcttagtgcaattctccattctcaaccctttttcggagcccatgaattgcgttttcgttcatgcgtcctccacccacgagtttcgagccatgtgtagtgattacttagtgcaattctccattctgaaccctttttcggagcccatgaattgcgttttcgttcatgcgtcctccacccacgagtttggagccatgcgtagtgattggttagtgcaattctccattctcaaccctttttcggacccccatgaattgcgttttcgttcatgcgtcctccacccacgagtttggagccatgtgtag

SEQ ID NO: 110340 - DNA, 337 bp, Glycine max
  Peptide Sequence Number=SeqID_227118
gctgtcgtctcttgtgacggacgcgtggggtgctattccttccccttttcctcaaataaacgttggtggcgactccgcgcgtattcctttcttggaacacgcacccgcgagtcacgcgtcgccctcccgccgaagggtaggttgcgacaaagagaaattgcttgcttacaaaggagtggggatgtctcctccacctctaggaatctcacaatcactcaaaaactcactaatctccctaaaagatgaaaacttggccccttgctctgctctatgctctctgaaattcacactcttcaggcctctgatggctattcagcacactttggctcccccttaa

SEQ ID NO: 110341 - DNA, 270 bp, Glycine max
  Peptide Sequence Number=SeqID_227119
atgccactccaagctccatcatctgcaggaccatcagattttttatttgctccacaaatgcttcactccatgatgcagagtttgcaccgagggcagtccatcatcatgaagagccatcagggattgggcttgccctccattatgagcatggaggagtttaaggctcaggtggcctggccaggagaccatccctcttcttctggagggggtggaacctctgtagcccaggagcctgatactgaggagccaccagcaccagcaccagcatag

SEQ ID NO: 110342 - DNA, 214 bp, Glycine max
  Peptide Sequence Number=SeqID_227120
ggatcgcacccacaagacacccagtggacccggagaagtccaacagggccctggggtttccagttttggttacgggcctctgtcagtcctacagggtgcccgtcccccccagcaaggttacaccatcgtgactaacgtcgtcatctgcaccttccctggagatgtcagtgtcttccggccaagactgcgaaaaagtctcatttgctatatgtaa

SEQ ID NO: 110343 - DNA, 282 bp, Glycine max
  Peptide Sequence Number=SeqID_227121
atggctattgggcagtgtttgagaaaacgacagggcattatgctgttaaagtatcctgaagctggatggacgttaattcctgaagttcgaggcaaaggttatgcgtctgaagcattggccgcagttttattatggggcgaccagacattttcctccccagtgtgctgtattattgatgaagaaaatataccttcaaattacctggctgagcgctttggtttccagtttcaaggttatgttaactatcgcgggaagcgggtgcgcatgcttgtacgcccgtaa

SEQ ID NO: 110344 - DNA, 450 bp, Glycine max
  Peptide Sequence Number=SeqID_227122
atgaagcgtccaaactggtttcaagtttccgctgaaggtggcaaggctctaggagcgctccataattacgccattaccgggacaagtttgccagctgatctgattcatttaatttttttaagagtttcacagatcaatggttgtgcacactgtatagatatacatgctcgcgatcttattaagagtggcatgtccgtcgagaagattgtattggtgcctgtctggcgagaatctacctatttattctcggatatagagcaagctgcgctctcatgggcggaagaagttacccgtgtaagtgaaacgcatgcttctgatgaagcatattccgcagcgctttctgtattcggtgaaaaagatttggttgaacttaccattgttattgccactatgaatgccattaatcgtatggggattagttttcgaatgaagccgctagctaaagcctga

SEQ ID NO: 110345 - DNA, 133 bp, Glycine max
  Peptide Sequence Number=SeqID_227123
atgggaaggatgccatgctgtgagaagggagggttgaagaaaggactatggacacccgaagaagataagaagctcgttgcttatgttgaaaagcatggccatggaaactggcgttcagtgcctgacaaagcag

SEQ ID NO: 110346 - DNA, 426 bp, Glycine max
  Peptide Sequence Number=SeqID_227124
atgggtgaagcagaggaggtgcaagagaggatgaaggccgacatggaggccatgaaagagcaaatggccacaatgatggaggccatgatgagcatggagaagataatggaagccaatgcggttatagttgccgctactagcgctgtcgctaagccttggctcggatatgccactgaagggcaagcagttggtggtatatcctttgaaaacactttggagggccctcagtttcgcccacaaccacacccattgcattttgcggtgggaagagcccctcctgctatggctgaaaagggaaaggcagatcatctaaaggaaaggctcagggccattgaaggaggtgaagattatgcctttgctaacctagaaaagttgttcctaatacccaaacatggtcattcccaagttcaaggtgctggactttga

SEQ ID NO: 110347 - DNA, 482 bp, Glycine max
  Peptide Sequence Number=SeqID_227125
atggaagatcatcagcatcagcaccaccatcatcactttggcatgaacgatctaaggcaagtggtgaataacgggccgaggccggcccataccaccttcccctccatgccgccgcaccccacggaggagcttttccccggccaccaccaccgtaatctcactcctttacctactcatcatccccaacaacaacagcacttcgaggttatgatgtttggtcgagacataatgccacctggccttcacgactttgcttccacaccccatgattctgctgttgctaccaccaccatcaccctacccactccaccggttacttgcggctttgatgccgctgagggtgcaggttgcatcggtggagaccccttcactggaagatggcccagacaagagactctcactctccttgagatcagatctcgcttggaccctaaattcaaagaggctaatcacaaaggacccttatgggatgaagtctctag

SEQ ID NO: 110348 - DNA, 338 bp, Glycine max
  Peptide Sequence Number=SeqID_227126
atgaagagagaatcaacatatgcgctctcttttcttgtcctcttactctcatccatattattcttcaaccttgtgtacccttttgatccacagtttctttctcgctttgctttcttgtcatcatcatatgtcactctcaataattcacagaattcgccactcaccggaggctgcgattattccagaggccgctgggtgtgggatgaaacctaccctcgtcaattgtacggcgaaaactgtccgtttctcgaccccggattccggtgccgccgaaacggacggaaaaatgagaggtttcgtaaatggagatggcaacctgatgactgtgacattccccg

SEQ ID NO: 110349 - DNA, 135 bp, Glycine max
  Peptide Sequence Number=SeqID_227127
gtttttactctcgtcgtccggagacattcaagcccgacgatgcacgagattcttctttgctgggcggggacgatcaagtttgatagcgtgtggaaacatcatggttatcccattttatcgctttcaagacactaa

SEQ ID NO: 110350 - DNA, 435 bp, Glycine max
  Peptide Sequence Number=SeqID_227128
atgaccaagaatagggtgttgaaagagcataacaagactttcctaaattggtttaaagatataatcttcgatgaccataatgcatttgaaacattaaggaacttccatgccttactttggagtcattcaagaaatctaggagatctaaagaagcttgcttatcagaatgagcttttcatcatggtcgaacaagctaaacatgtattttatgttcaacatccttgtgatgaaagatggtcagtggttctacacggaaaaacaattggtgttaatattaaagatgatgagaagtacggaataagcaaagagaagtggacccagttttgtcagagccatagaaagccttcatggcagatgttcgaaagaaggcacaggccatttagaaacaaaacactacccctcacatgttgtctcgtgggggctatgattttctag

SEQ ID NO: 110351 - DNA, 1223 bp, Glycine max
  Peptide Sequence Number=SeqID_227129
ttcacgtggacgacgggcatgccgcggtggcgggcggcgcgggcggcgtccagcggcgcgtcgaggggcgccaggaggatgccggccaccttggcctcctcgaagacgctgatgtaggagtcctgcttcgcgaggttcacgtcgctgttggccaggagcaggcggatgttgtgcgcgtcgagttcttcctcgacgccgcgtgccatgtcgacgaagaacgagttgcccacgtcgacgaccacgaagcccacggtgtcggctcgtccggtgacgagggagcgggcggcgttgttgcggacgaagccgagctcgtcgatggcgcgcagcacccggtcgcgcgtgtccgctgcgacgatgtgcgggttgttcagcacgttggagaccgtgccgagtgcgactccggcatgtcgggcgacgtcggccatcaccgggcgggggcggcccgcatcgggggaggtggtcattttcgtcgtccgttcgccgtgagatcgcatttgcttcttgaagcgtttcaagcgtactatctgaagcgcttcaagtgtgtgatcaacgcggctcgcccgttcaaggaggaaagaatgaagctgaccactgcacagctctggaggcgcggtgcggtcaccgcgatcgctggagcatcggctctcgccctcaccgcctgcggcggcggagggggctcatcggcgggcaccgactcgctgtccgtgttcgtcaacgtcgagaacaccgaggtgccggccgtcctcgagacgctcgccggagacgtctgctcggccgaagccgacacgctgccgctcgacgtcgagacggtgccgcagtcgaacctcgaccagcagctgcagctcaaggcgggccagggcgaccttcccgtgctcttcagcgccggcaacgcgcccgcgctgacgaagactctcgcggaatcgggcaacgtcgccgacttcgacgaactcctcaccgacctcgacgtgatcgacaacatcgagcccgcagcgatctcgaccatcgagaacctgtacggcgggttccgcgtgctcccgttcgagtacaacgtcgagggcatctggtacaacaaggcgatcttcgccgagcagggcatcgaggagccgcagaccttcgacgacctcacggctgcggccgcgaagctcgacgccgccggcatccagccgttctccgccagcggcgagcagggctggccgatcacgcgtctcatcgggatcctctag

SEQ ID NO: 110352 - DNA, 393 bp, Glycine max
  Peptide Sequence Number=SeqID_227130
atgtcgcctgcgaggtacagtcgggctcggcggaatctacaacgtttcaggatgcgcggtgaacagacccaaagcgctttgcatgcgcaaactcgccgcggcgctcggccggcggcgtggaaggcaggcccggtgaatgcgggtggaacagagaccatgatcatggcctctcgcttacagccttttcacgacatctatccgatcagcccttcccgcctctggccgtgcgggacgcctctccgaaacacggtctaccagaaccatgcttgtcgatgccggcaaccggttcgcaaaaggcgccgcgcgtatcgcccttccgttccggttgcgggaggaatgatgcagccaacggaggcaatggggatgggagaggaagaattttttcggaagtga

SEQ ID NO: 110353 - DNA, 474 bp, Glycine max
  Peptide Sequence Number=SeqID_227131
atgggtagaatgaagtataacaaaatcatgtttaatatgaaaaacaacttaaatggcaaggaacatacctcccaagaaaggaaagatattgagctggtagacgaggaagaagcccagattggtgctgatcgttctagtgcaacctctaataaatctgagatttataacgaggaagcatggaatgcagcacaaaagcataaaccaaagagggtggagagtgtcaatgctgatgcagaagcctttgatgttattccttctggttcgagtaataataaccatgacaattctctccataacacaaagaggggaacgaacaacaatttgaaggttgtacattcaggaactaaagaatgcaaaatagctagtaataagcgggatttgtttttgggattttctgagcaccaagagcggctatgcaagaagcttgcacttgaggagggaaggatatatgcagctaatgaacaactttcttaa

SEQ ID NO: 110354 - DNA, 238 bp, Glycine max
  Peptide Sequence Number=SeqID_227132
tctcggctagaagacgctgacatctccggggaaggtgcagatgacgattcttggccgaaagacgctgacatctccgggaaaggtgcagaagatgttgacatctctgggaaaggtgcagggcgtctccgcatgccaacggactcacaggtcacgatagcaaaaagtggggcagtcgacaaaagcaaggcttttgctcctacgtatcctcaatttgtgatgaggaactcagacctacgta

SEQ ID NO: 110355 - DNA, 165 bp, Glycine max
  Peptide Sequence Number=SeqID_227133
atgtgtgtacagttggtgcacagacatatgagtaagcacctcaagcgattccttgaatggtcgaagtgtgagtaccatgtcatgggatacgactcatgggaaaccgctcatatcgtgttgaaattccatggaatagactcaatgtttgagtttaaggtagcctag

SEQ ID NO: 110356 - DNA, 501 bp, Glycine max
  Peptide Sequence Number=SeqID_227134
atgaaggttgaacaactctttgcttgccatcatattagcgaagagagaaaagttccattggctacccttagctttcaagggtatgccctctattggtggacttcccttgttagggaacgaaggattcatggggatcctctagtagagtattggaatgatcttaagagtgcccttaggaagaggcacattcctccctactatgaaagggagcttatggacaagctccaaaggcttaaacaagggagtgtgagtgttgaagaatacagacaagaaatggaactactctttttaagagctggacttagggaggaggaaaggacaagcatagcgaggttccttagtgggcttaatatggaagtaagggacaagtttatgaattattttcagcttcttgctaagacaatttgtcggcttagcgagccatccgctgagcgcactcttgcggctaagcgcgaggaagaatctggaagaaaggatgagttggacacatgtgctaagtga

SEQ ID NO: 110357 - DNA, 376 bp, Glycine max
  Peptide Sequence Number=SeqID_227135
atggtgattgctcctttagttattgttgcaaacaataatgaagaagcacaacacaataatgagcccatgatacataatgaacctattgtggaagaaccgcaagaactagcattaaggaggtctcaaagagaaaggagaccagctatttcaaatggctatgttgtagaagcaagattcatgatgatgaacaatgcaattttcatgatgtcaaaagcccaagtaattgattcaagattgattcaagacttcaagatcaagcatcaagaatccaatccaaaattcaagattcaggagaagaaatcaagaatccaatccaagattcaagattcaagagaagaaatcaagaagcaacaagtcaagacttcatataggataa

SEQ ID NO: 110358 - DNA, 612 bp, Glycine max
  Peptide Sequence Number=SeqID_227136
cgcctgagcccggtcattaactgggcctacatcaggaagaactattggaatcctgaggatctaacagtttctatccgaggggctaggagggcgagggcgaggccagttgagcttccttccacttctgtaattcctactctagcatccacttcagcagcttcttctgtcccaactcagacagattctcagcgctttgaagccatgcttcagagcattcatcagggacaaatcactttattacaaagatctattccttcagttgagcagttcagggagatggtagcctggcccaggacccaaccttctcttcacaaggaagatgaaggtcccacagcccaggtaccacagcatgtggaggatgagtcatctgaggccaccatcccagagccatttgttataggggaggaggcagagcctcctgcaccagtggtggacctaccctcacctcagtgtacaacagacccctccactcctattgtacagacaccagaggacccgaccacaccagacctggctatggacacttctcctccagctactcctgtacttcatctgacaaatgagaaggatgttcagacacacgatacccaggaccagtcacaggaattctaa

SEQ ID NO: 110359 - DNA, 255 bp, Glycine max
  Peptide Sequence Number=SeqID_227137
atgaagcaagacaaagaaattaatggtgcagatggcgtcaacaaattccaatcaggggaagaagaggaagataaggaacagtgcagtccagtatctgttttagacccacccttggatgacgatgatgatgggcatgatgatgaccatgaaggggatggttttgatttggactgtagctatgccaatgtacaaacattttatgttgtgtggtcgtcttccatcaacatgccatcgtacacgcttcttcaaagttga

SEQ ID NO: 110360 - DNA, 174 bp, Glycine max
  Peptide Sequence Number=SeqID_227138
atggcatattttgttgggagggttgaaagaaggcactacgaggataccatggctgaacagagagccttatgcttactggaaagtgcactaatgctgtcgcggctaaacctaatccctgaggtgagtgggtctgtagtgtggagaagaaatcagcttgttgctccaattgattaa

SEQ ID NO: 110361 - DNA, 562 bp, Glycine max
  Peptide Sequence Number=SeqID_227139
atgaatacttgtgcatctagagtcctgttaaaacctcaaaaaggagaaacaactttgtttatcactgatatgatgaaggctaacgtttctcttccgagaaaaataaaatgggatgaagtaactcttcccgaaagatgggttatggataaggcaacaccgtctattccccgacccgctccaaccatagagcatattaagcaagataactccagaaaggtagagataaccttcaataggagaaattctttttcatcaaggataaaagcctctaggtctgaatatgagtcagccagaagcattgataaggaaaccctcaggaaagatttctattctccggagaatgaacctcaaaggagatggtttttccaacattacaagggtacaaacagaaacctaatccaagacaagttctatgaatttgtcgaaagagtcaaaattaatgtccttttctttgattggtttcatgcttatgccatcagaaaggatatagattacccttggaaacaagaaatcataggtgatccaacaacaaatgttataacaaactggcaagtgagagatg

SEQ ID NO: 110362 - DNA, 264 bp, Glycine max
  Peptide Sequence Number=SeqID_227140
atgagtgaagaactccatcatattcaatcattgatagccacccttgggttgaaggaacaatcaagtaagggaaaaggaatagctgttgagccagaaaattcaccaccaatttttgttccctcgtcttctgattacgatcctaaaaactctacctgtttaactccaaccaaaaggattagttgtctgcaaaccagttctgatttcgattcagatgagcatgcacagtatcagttatcaactaacaaacatatcaaagctgagtaa

SEQ ID NO: 110363 - DNA, 486 bp, Glycine max
  Peptide Sequence Number=SeqID_227141
atggcatcaaagaagagaaaggcacctgccacaccttcccaagttcgatatgatagatcaaggttcacttctccagaggcttgggaaaggtacacagaaatagtggtgcctagaaagatacttccagagagaaatgtggtaagggtcagaggtcatctagtgaagtttgacgaagacgccctcaacacattcttgaagaaccctatgatcattgaggaaggggaaacactacctgtttattctaggttcgcactcctaaggcttgatcctcaggaattggcagccaagctctgtatcccagggagaggatttgagcttaatgctaatggcttgccattgaagatcctcagaaagaacctgactaccattgctcagacttggagcatgctttctttctcaaacttggtccctacctcacacacatcagatatcactctggatatggccaagttgatttatggaataactcagaggatggacatgaat

SEQ ID NO: 110364 - DNA, 240 bp, Glycine max
  Peptide Sequence Number=SeqID_227142
atgtggtgttatgagtggaaaaagattgagactttgagggttggaaggctaagtctgaatgctgtgggaaaaacaaatgaccaaagtgaaccaagagccatttctagggcaaaattgggtgttgaagagtcaaatcttgatttgcttgggaggattgatggggacctggtattgagagaaacgaggatatgggctacgtgggagtacgtgagctcagttggaggtgggcaacaggggatg

SEQ ID NO: 110365 - DNA, 132 bp, Glycine max
  Peptide Sequence Number=SeqID_227143
atgattgaagaccctagagaagttgagagaagaagattacttggtattgaagatttagatggcccaacaagagaagatctagttgatgccttggatgaaggtactgatatctggcttttgaaaacctattag

SEQ ID NO: 110366 - DNA, 300 bp, Glycine max
  Peptide Sequence Number=SeqID_227144
atgggttgcagtttcgtcatgattgacaagaacgttaaattgcggacaaatgcgactgatgtggctgcaattgcattcatgcacagaagctggggatctaatctagttccatctgtgacagttgatgccgtgcctaagaaaaagcccagcaaatctctctatgcaaaagccactgacactggaattgatccagaattggctgcaaagaaactgaacattgattgggattctgctgctgaaattgaagagacaaatgcagatgatgagacagaagtgccttcagtggtggtcagttcttaa

SEQ ID NO: 110367 - DNA, 405 bp, Glycine max
  Peptide Sequence Number=SeqID_227145
atggcaggaggtgatgtacatgacactagggcatacactcttgcagacacaggcgcacaggctgctgaggatgagcctgagggattttcgagtgatccgagggacccatccgtgctgaccgagtatgtggatcacgttgcagagcgtcttgagttgaagttatcctctcacgggaggaaggtgcatagtttagacaggcctgatgtaagcttcattggaacttcgaaatggagaaggaagagagagaggagacaccacttcaaggagaagatgagtctagaagaagctcaccaccataggaggccatggataagagcttggaggaagaaggagatgaatgaagggagaggaagagaagagcacgaaattttgtgctccaaaagagctctgaaatatgaagtttaa

SEQ ID NO: 110368 - DNA, 186 bp, Glycine max
  Peptide Sequence Number=SeqID_227146
atggaggttaaaggctttaattttgtaaaagatgcactagaagagcaagaaaaggtcaatgtgagcacatgtgttaatcctaatgataaccctgatgataagaaaaacaagaagaggcgagattctgcctcaagtgtgctttgtaggaagatagctttcggaagcaaaacctttgcaattccatga

SEQ ID NO: 110369 - DNA, 438 bp, Glycine max
  Peptide Sequence Number=SeqID_227147
atggcgccaccaccattggcgtttccgcgtaggagctgccacgtggaaagggacgcgcaagtagcagcaacgcgttgcccttctgcttacgtggcgagggacgcgcaaggtgcactggcatgttgtgcatggcagagtgaagacgccagtcaaattgacgttttagctttgcagaaggacagggtgcacagtgctgcagcagtctgctgcaatagcaggaagcaggaaggaaacgccattggagcctgcgggttacgtttgcaggtggaacgcgccatcacgaggagcgctttgctccttttacatgcagttctcgtgcactgcattgtgctacccgttgtcctcagccttcttcaagcttgcttccttgattcctttggttcttctttacttcctttgcctctttggtttctgctgcttgtaacttcttggttataa

SEQ ID NO: 110370 - DNA, 306 bp, Glycine max
  Peptide Sequence Number=SeqID_227148
atgtggctaccaccaaagccttggaatgagaaaccaagagggcttgtagggaagaacacagccggaacaagttccgaggggctctgtggggcttgctcgaggtccaaaagaagtctatctcaacgtttatgcgagacggagaccaacatgttggccatcatcagcaagtaccaagaggaactaagtctagccacgacccacgagcatagagtggcggatgagtatgcccaagtgtacgcggaaaaggaggctagaggaagggtgatcgactcattacaccaagaggcaacaatgtggatggactga

SEQ ID NO: 110371 - DNA, 327 bp, Glycine max
  Peptide Sequence Number=SeqID_227149
ggatcgtgcccgcaagacacccagtggacccgaagaagtccaacagggtattggggtttccaactctgattacgggcctctgcaggcacagggcgagacaccacagcagcatggggatggccgacagcaggcaactgatgcaccgccgccacctccaaagcccctcagctcatctacaaaagttggagcgtttacgacccgtggccgaccagcaggcaaccaagtccaaagccaaagggtgaatgctgtgaaaattttcctgaacgccccaaatggactcggatggatgcgtgaattgataaaagaacatgtgtttggaagcactgg

SEQ ID NO: 110372 - DNA, 321 bp, Glycine max
  Peptide Sequence Number=SeqID_227150
atggaggagaaagtaaagctgaaaattagtggaggtttaaggagcacctacttgaagctcttgtgctctgataccacttgttggaagcttgcttatgaagcttctatggaggctggatctttgagcttcaataaggtccttcaatggagacgtcatccactagagaataagtcatggaaggagaagcttcaccaccaagagagtggcttggataagaagcttaaagaggaagcttcaatggaggaagagaataccagagagagagggggaggaggggggggcgaggtgtgggaattgaaggagattagagagagaagttga

SEQ ID NO: 110373 - DNA, 273 bp, Glycine max
  Peptide Sequence Number=SeqID_227151
atgggggtgcaaatagcaaccaggcccacttgggcctccagaagattcctccagaaggctattgcttctggaggaagcaaccctgctcgcctgggcgagctgggtggcaagcttctcccccaattttctataaatagggggagaagtgaagtagaaaaggaaatccaagctgagggcgctttccgtaacatttccgtgagtgatttcgcgaaggttttcgaccgttcttcgacgttcttcattcgttcttcatcgttcttcagtcttcaacgg

SEQ ID NO: 110374 - DNA, 290 bp, Glycine max
  Peptide Sequence Number=SeqID_227152
tgaagaaggagcttgagttggagaggatgtggtggagctttggtcgtgacagcttgcgattgtggggtcggataggggtgagtttcgacagcagaggggaaagggaagggttgaaaggtggtggtggtggagaaggagaaggagaaggaggagtgtggtgtggtgttgttgttgttgtggtggagggggttgttgaggaagatggcgggagtgtggtcgaggacagagaggggttcgtgacgacaaaggtggagaggacagagtcagtgaggcgtagggatcaacagtaa

SEQ ID NO: 110375 - DNA, 525 bp, Glycine max
  Peptide Sequence Number=SeqID_227153
atgcaggaaccatttggtcccgcactttttttcagcttttgtcatccagaggcggcgggcctgatgacatgcggggaaccatttggtccctcactttttcaccttttgtcatccagaggcggcgggcccgatgacatgcgggaaccatttggtcccgcactttttcaccttttgtcttccagaggcggcgggcccgatgacatgcggggaaccatttggtctggcagtttttttcaccttttgtcatccagaggcggcgggcccgatgacatgcgggaaccatttggtcccacactttttcaccttttgtcttctagaggtggcgggcccgatgacatgcgggaaccattatgtcccgcactttttcaccttttgtcatccagaggcggcgggcccgatgacacgcggagacaaattatggtaatccgcacgcttttgctatttgtaagaccgatgagtgataaacgcgtagagacaaattatggtcattatgtgccctttgtcattcaggagcagcaagtctag

SEQ ID NO: 110376 - DNA, 201 bp, Glycine max
  Peptide Sequence Number=SeqID_227154
atggaggtcacatccaaggaaccagttcaacaaagaccaaagtggaccatcctaaagaccaaagtcggaggagactttcgctcaattcatgcagtttcaggagaaaggatgaagaataagaaggttgaagcagctggtgtctcgctaagtgaggcatatgtgcttgtaacatccgctaagcgaggcactcaactcgcttag

SEQ ID NO: 110377 - DNA, 195 bp, Glycine max
  Peptide Sequence Number=SeqID_227155
atgacacctccgaggagtgaagttggtatggatagggtagcttgcaaaggaattgttgatgctattctgatgggagttaagcttgtgcgggccaaaggcctcaagcatatttgggttgattctgactctaaggaggccttagatctgattgaaggtggttgtgttggtgataacatgttccattacctgttgtag

SEQ ID NO: 110378 - DNA, 183 bp, Glycine max
  Peptide Sequence Number=SeqID_227156
atggagcatataggccaatttactactaagagtggtgaagctagtcagaatgagtttcacaagttacaactttttccactttctctgacagaatatgctgacctcggtcaactagattccaaggccaatcaaaaagagcagtttgtacatgagaaagaattgagggcagctaacaaaggatga

SEQ ID NO: 110379 - DNA, 279 bp, Glycine max
  Peptide Sequence Number=SeqID_227157
atgagggtggctgaatttaatatggagaagaagatgaaaaccttgcgaagcactattgacaacgagggaaggagcaaatctccaaacgtggaggtagaacaataccttagccatgatttgaaagctaggaggcaaggagagactttagtgatccaagtagctcttgcattggatcatgctgttgccaagcatctgctagtcacaacagaaaaatcagtcattttggatgattcagacaaccatgctctagaatataaggagaagaaagtgttgctctag

SEQ ID NO: 110380 - DNA, 303 bp, Glycine max
  Peptide Sequence Number=SeqID_227158
atggagtgccccaattgtagaccatctccctacgttgcaataatctcaacctcagtacacagagggtgtgcacttgttgaagaagttggtccatttagtgaagatgacgaagaaataaatttgaacaacaacaacaaagatgacgtagacgaggatgacaaccaaaacctaaatatcgagccaccatcagtaaatgatgcaatcctacccccaagggtgttggatagaagactccaagaggaatgggctagagctgataaagaaggccctagggttctcttgaatctcagggtagatttctga

SEQ ID NO: 110381 - DNA, 987 bp, Glycine max
  Peptide Sequence Number=SeqID_227159
atggacggtcacattgacatggccttggtcaaggagttctatgcaaacctttatgatccagaggacaaatctccgaggcaagttagagtgaggggcaaactaataaagtttgatactgagtccctcaacagcttcttggagacccctgtggttttggagccaggggagcactataccacttgtaccagtttctgtggtactcgcctagaacctcaggaattcaccgccagactctgtatcctagggaggggatttatgcttaacgtagagggcgcgctgtggaagcttctaaggaaggacctcactagtctcgcccagacttggagtgtgttatcatactccaacctcgctccctcctctcatacgtctgatcttaacatggacagggcgaggttagtctatggactagtcatgaagatggaaatgggcttgggctccctcatctcaggccagatctcacagatggcccagtctaatttctccagccttgcattttcgacgctcatctctgctttatgcatcgtctggggagttgttctagattcattgacaattgagtccttgagcccagccattaacttggcgtatatccagaagaattgttggaacccggatgatccttcggtcacatttctggggacccgcaaggcacgggctcgaggacctgaggcctcttcttcttctactccttcttcttccactcctccagctccagctccaccacttctagtaccctccaccatctccgttcagagcagtatccatgacttggctcaacatcggtcgattatgagcatggaggcattcagggcccaggaccttctccttcggagggaggtcacaccagaggccactccacagacttcacctgctactacaccattagtggaggtcttagaggatgaggaagatgctgaggacaccggttatgcagctgatttagcagcggcgcagaacacttgggatccctggcctactacagcatag

SEQ ID NO: 110382 - DNA, 351 bp, Glycine max
  Peptide Sequence Number=SeqID_227160
atgacgaaagatgcgatccatgatcacaactttgcagcgcccgggatctactttctcactccttcttccttgttgtgtgcttcctctggtttctccactagttctgtccctctcgagccttcctttgcatggcttttttttttatatagaaaaaaggaagaagctgcaagaccaactcacccaggtgagctgcactcgctcaggcgagttgcttgcttaatgctgaagatagcaatgaacctcatcttccatgactacattggcaagagtatggaagtatacattgatgatgtggttgttaagtcaactgatatggatcaacatttggccaatttagaacatgctttgtag

SEQ ID NO: 110383 - DNA, 303 bp, Glycine max
  Peptide Sequence Number=SeqID_227161
atggcggcacacaagaagaagattgaagaagcagatgaatggagaagattgaagaagaagaagcagaactccgaagaagaagaagaagttgaaacgcgacgcgggagagagagagattggaggaagaaatatgcatcgcacgaagcagtacaggatggagactttaatcccttctctttctctctaacatttgggaactctatcagagcaatcacaggaaaaattgaggaatctcaaaaaattgctagaaatactgttatcgctgtcggaagacacgtgagtccgcttagaagtaagggataa

SEQ ID NO: 110384 - DNA, 408 bp, Glycine max
  Peptide Sequence Number=SeqID_227162
atggatgacgttgctactttgcaacattctgcccaacgaccgcaatgccgatctccccctggggaagtattagttggtctgtgccatcctgacataggtaaggatcgcgcccacaagacaccaagtggacccggaggagtccaacagggccctggggtttccaactctggttacgggcctttgtcagtcctacagggtgctcgtttcccccagcaagggatcgcgcccgcaagacacccagtggacccgaagaagttcaacaaggtcttgtggtttccagctctgattacgggcctctgtcagttctatggagtgcccatcgcccctaacaaggtcatcaggcccttattaaccggactttcatcgagaagtactgcgcccccaggcaggcgcagtgggatcctctag

SEQ ID NO: 110385 - DNA, 831 bp, Glycine max
  Peptide Sequence Number=SeqID_227163
atgtcctcgccttcagaggactacacgtcctcagcttcagaggactacacgtcctcgccttcagagggctacaccccctcaccttttgaggactacgtgtcctcaccttcagacggctacacgccctctccttcggaggactacacgtcctcgccttcagaggactgcgcgtcctcacctttagaggactgcacgtcttcacctttagaggactacacgtcctcaccttcagagggctacacagcctcacctttagaggactacgcgtcctcaccttcagagggctacacaccctcgccttcaaaggactgtacgtcgtcatctttaaagggctgcacgttctcgccttcaaaggactatacgtcctcgccttcagaggactacacctcctccccttcgggggactacacgtcctcgccttcagaggattgcacgtcctcatcttcagaggactgcatgtcctcaccttcaaaggactacgcgtccttaccttcagagggctacaggccctcaccttcagaggactacgcgtcctcaccttcagagggctttaggccctcaccttcagaggactacacgccttcagctttagaggactacacgtcctcaccttcagaggactgcacgtccttatctttagaggactacacatcctcaccttcaaagggctgcacgcgctcgccttcagagggctacacgccctcgccttcaaaggactggatgtcctcatcttcaaagggctgcttgccctcgccttcaaaggactggacgtcctcgtcttcaaagggatgcttgccctcgccttcagaggactacacgtcctcgccataa

SEQ ID NO: 110386 - DNA, 1095 bp, Glycine max
  Peptide Sequence Number=SeqID_227164
atggcaggtggaggattttctgatgctggaacactcaagagggcgcatctttaccagtacaagattactggatatttcatctattcttgcattgttggagctcttggtggttctctatttggctatgatcttggtgtttcaggtggagttacctccatggatgatttcctcatagagttcttcccaaaggtgtatgaaaagaagcatgcacatcttgtggagacagattattgtaaatatgatgatcagacattgacactctttacttcatctctatactttgctgctcttgtgtccacatttggtgcttccagtgtaacaaaaaacaaaggcagaaaagctagcatcttagctggctccgtaagcttctttataggagctattctcaatgcagctgccaggaacatttcaatgttgatcattgggcgtatccttcttggtgttggcattggatttggtaaccaagccgttcctctctatctttcagaaatggctccttcaaaagtgagaggagcagtgaaccaactctttcagttaacaacatgcttgggaattttgattgccaaccttgtgaattatggcaccgagaagcttcatccttgggggtggaggctatcccttggtttagctacatttccagcagttttgatgttcattggagggttgttttgtcctgagacacccaacagtcttgtggaacaaggcagattcgacgaaggacgagcggtgttggagaaggttaggggcacccctaatgttgatgctgaatttgatgatcttattgaggctagcagagaagcaaaatctatcaagaacccattccagaaccttcttctgagaaaaaacagaccccagttaataattggtgccgttgctattcctgcatttcagcagttaactggcaacaactccatcctcttctatgctcctgtcattttccaaaccttgggatttggctctggagcatctttgtattcatctgttattacaagtgtagcacttgttgttgccacactcatctcaatggcttttgtagacaggtttggtaggagagctttctttttggaagccggtgctgaaatgataatctgcatg

SEQ ID NO: 110387 - DNA, 312 bp, Glycine max
  Peptide Sequence Number=SeqID_227165
atggtgagaaccctgtcttgtgacaaaagtggaatgaggaatatgaaattaattgcttatgtcactaggtattgcaagatgtgggaaaagttgtacattgagatggatgaattatctaaggccgcattggcatgtgtgatagcaaaatggattcttgtaggaaacaaaaaggcaggtgaagcagtgcctatatggagtcaaaggatcacattggacagcacattttatggacatgacaagtggattattttggtttgtggtgtggatgaacttgatgggtgcaatcacaaatgcactctttctaggtcttga

SEQ ID NO: 110388 - DNA, 300 bp, Glycine max
  Peptide Sequence Number=SeqID_227166
gttggtgttgaggaggttagagatgcatatgctcccattcttgtacccactaaagagggagctgtgggaccggcgaaacctgcagataggccggatcatgatgtcgatgatcacctatatctgatgacattgaccatcccacaactttttctgaagtcgttgcaagttatgtgggatgctactgtgtttggggtgtttaatgacaacttccccttatacataaagcatgaagatgtgtctgaaatagcacacggtggtcaatgtctcaacatctctattttacagttatgggttctgtaa

SEQ ID NO: 110389 - DNA, 450 bp, Glycine max
  Peptide Sequence Number=SeqID_227167
atggagatggtgtcgttcgaggtcgcgctcttgcgctctaagctgcgcggctcggaatcaatgatggagatctcccctcggggcggtgatgtgggtggtggtgatggtcattctcgtcgtggtgacgatttgcatctcgatggtggattgaacacaaacccagcgcacgatagcgacattgccgagcagggtggtgtcattgtggtaggggatctcgtgacaatggttgtggcgtggagaagcatcagtgaaaaaagtttgatggtatcgatcgtaaacgaaataattttaggtttgagatggtgggaagcaatcgtgggaagcaacatcaacatggttgtgtctgttgatggtgacttcacagaggaagaagataggaagggttggttggttactagggcattcattttcaggagaagggcatcgagtttggagatcgtggaggcttga

SEQ ID NO: 110390 - DNA, 726 bp, Glycine max
  Peptide Sequence Number=SeqID_227168
atgttgcgctctctctggcgatccatcgatcgcttctccgttcaacacttccaatacgtaatcaatgaactgcggaagatcaaagttgtggatgaacataacagggaacttgtgatgaatttgttgcaatctgttgtggagattgttacttatggcgatagacaagatccgcacatttttgagtatgaattatggtggaaatttcgttcttctgttgttcttgttttgtggatgaggtgtttcatggaacggcaagtgctggcagactttgttcgcatacttaagatcagtcaagagtcgaaaattgacggacctctgcttcaatatttgagcataatgattcaaaacatggatagtgaacatgcaattttttattgcttcagcaatggttatatgaacaacattattttgcatccctacaaatttgatgggggagatctagctccatactatgtttctttcctaagggcaattagcaataaaataaacaaagacacactttgccttcttgtgaatgttcagggggatgctgtagtctcctttcccttgtacactgaagctctaagatttgctcagcatgaggaaaagatgattcagacagctatacgtgcattagttctgaacatctacaatggcactcaagtagttctaaattatggagctaactgccctacactgaagcaggaaaatggacgctcaaaaacgaagagatggggttattcttga

SEQ ID NO: 110391 - DNA, 276 bp, Glycine max
  Peptide Sequence Number=SeqID_227169
atggttgtttttgcatcgatagttgcagggaagttgaactcttccaagaggaaaatcaggaagaggagagaaggactcaggagaagagttacttctaagttgtgtaaggaatcattggagaaggttgttgtgatatgtgggatgattttggagtggaaggctgtaaatgagactgttgagagatgtttggatggcaaactgtataggaaagacaaaaattcaccatacagaatggcagatggcattgtgggcaaacagaagaagtatggcaggtga

SEQ ID NO: 110392 - DNA, 438 bp, Glycine max
  Peptide Sequence Number=SeqID_227170
atgggtgacaatggtcaaaggttagggtcgtccaggggggcaaccttgtcgccagaagcacagcctaaacagatttccaacgtgccgtcacgcgccaaaaacagaacctgcttggctggacgtgttgcgcaaagaattggcatgtgggggtgcattgattttcttatggaggtgcggtggatggcgttgaatagattggcaatgggtgacccaaaccatggggtcaccagtcaaaatggtgccggatggcaacggacaacggcagtgactggaaaagtcgtcattcaaaaaagatcatcggagaagaagaaagggccctcggaacagtgggtcaccggaaaagtgacgacggctagtggtgactggaaaagttgctgggaaaggagaaaaaggttgctggaagacgggcaaagtagaaaggtccaccaaggacaatag

SEQ ID NO: 110393 - DNA, 198 bp, Glycine max
  Peptide Sequence Number=SeqID_227171
atggtatatacgcatgacattttcatactaaaaccatgcaaaaacgtcaatgaatattaccagagacatatttctgcagaaactctgttttcacctgggaaaaacgatatgatgtgctatattttggagtggtggctcgacaggagaatgaatgagctagttagtgatttaaactcgagaggtgtcacattgtcttga

SEQ ID NO: 110394 - DNA, 855 bp, Glycine max
  Peptide Sequence Number=SeqID_227172
atgaaggttgttggagaagaagcgaccacatgggcatgtgggaagaggctagggcagaagcagaagggtctgtttttttcaagcttcaaggttgcggaggtgaaaccgctccagggagcacgattgccctggttagatccagatagcagccactccgtgcatgacttcaaaatgcaacacaacaatgtcaatgttgcatttccgtgccgcttcaccaccgtgatgagcgctattgataacatagagcaaaaacatgcttttttggtaaaagttgcatcaataagggaggttgtccttggtgcaccattgagagtaattttagaacatcttgctgccagaactgttgctccagacctggatccacttgttgcccttgttcatcggcctaatgagtctttctttctttttcctcaggctgataaggtgactgtagtgtatcctatgagattcaacgattcaatagacattgttctcgcaacttcattcctgcaggaatttgtcgaagccaggcgtacagctggacttaataatacacctccttgttcatggtctcttactcctccactggaactaaaagaagttcccgctgcgaatgcaggatttgtgacatttgttatcttccctcgtcatgtcgaaggccagaaactggatcgtacagtatggaatctgtcaacttttcatgcctatgttagctatcatgttaagaggggcactggtggaaagtgttgggagagagtatatggtgatgtggagtttgttaatatagatttgaacactttcaaggacgtgtatgtggggattatggaaattggagacgagctagagaagctcatgctaatactgttatatacttag

SEQ ID NO: 110395 - DNA, 375 bp, Glycine max
  Peptide Sequence Number=SeqID_227173
atggtgctcgtgctagttcgtggtgccgtcgtcgacttcgggagttcgggagttcgcgtggagctcgcgctgcttactgctcagttttcatcatcattcagccatagggtgtattatttgactgtgtacttagacgacaacgccattacaggcagtgatgatcaccaaggtattgcacaagtaaaacatatttgtcaccactttcatacaaaagatcttggcagttgtctaatacttgaggatagaagtggcacaatccacaaatggtattttgatttcccaaatgaagtctgcgatggacatcctagaggaaacaggattgatgtgtgtttgatactcctgtgtatcaagtttggtgcgatatacacagcttga

SEQ ID NO: 110396 - DNA, 2559 bp, Glycine max
  Peptide Sequence Number=SeqID_227174
atgagaactggaagctgcgccgtgcaacagggtctaaccccggaggccgcgagcatagtgaagcaagccgtgacgctggcgaagcgtcgcggccatgcacaggtgacgcccctccacgtggcgaacaccatgctctccatcaccaacggtcttctgagaaccgcgtgtctccaatcccactcccaccctctccagtgcaaggccttggagctttgcttcaacgttgccctgaatcgcttaccggcttcgacttcttctagccccatgttgcaaggctctcaccaccaccactctcacgcgtgcccctccatctcaaacgctttggttgcagcgttcaaacgcgctcaagcccaccagcgacgtggatccgtcgagaatcagcaacaacctctcttggcagttaaaataaaactcgagcaactcattatttcgatcttggatgaccctagtgttagccgagtcatgagagaagctggtttctctagcacccaagttaaaagcaacgttgaacaagctgtttctttggaaatatgctctcaggataatggtagtggtaaaaataacaacaatagtaataaggcaaaggaaaacaatagcagtggagagaaagggtcggtgttggatcctattagggttgaggatgttgctagtgttattgaaaatttggggagtgagagaaagagaagtgttgtgattgtgggagagtgtgttactagtcttgaaggtgtagttaggggagtgatggaaaaagttgataaaggggatgttggtgatgagtgtactcttaggggtgttaagtttatctctctttctctttcttcttttgggaatgtttcgagagtggaggtggagcaaaaggtgggggagcttaggagtcttgtgaaggcaagtgaacatagcaaaggggctcgtggatcacaagggggagggtgttattgtcctgtggatcacatggtagtagagattgggaagcttgtgaatggggttgaagagaatggtgcaaggttttgggtgatgggtgttgccacttttcaagcttacatgagatgcaaaaatggccagccatcgttggagactctttggggtcttcatcctatcactattcctgcggggagcttgcgcttgagtctcatcactgacagtggtgtacaaaaccagcccacaaacgagaaagctgacaacagaactacctggctcttacttgaaggagtgggggatgatcacaaacaacaaccttgcttcgcggaaccttccaccaagaatgagaccaccgaagttcgaagcttgcaaagcagtagtacttgtaatagtgactcaagttcaacccttcctgcatggctccaacagtacaaaaatgagaataaaggaatcacccataatgatcagaactgtgtcccagtgggagagctttgcaaaaagtggaactctatgtgtagttcaatccaaaagcaaccttatccttccgacaaaaccctctcattatcctcggtgtcaccttcttcatcaaactcaaacttctcatacgaacagcagcatcctaatttgctccaaacccatcacgagtggcaagtgggtgaaccacccaaagattcattgaacaactaccatttctggatctccaacaatggcaccaacaacaacaccaatgaacccactttgagagtgtacattccagagaataacaataagcaaccattctcatcaccaaatccaagttcaaaccctaattccacttcttccagtgacatcatggaagtggagcacgtgagagagttcaaagagttaaacacggagaatctgaaaacactgtgcaatgctttggagaaaaaagtgccgtggcagaaagacataatacccgaaattgcgagcacccttttgcaatgccgttctggcatggtgagaagaaaagggaaagtgatgagaaacagtgaagaagtgaaagaagagacgtggttgttcttccaaggtgttgatgttgaagccaaggagaaaatagcaagagaactagctagacttgtttttgggtcccaaaacgacgtcgtttcgattgcacttagcacttttgcttcaacaagagcagattctactgaagattatagcaggaacaaaagatcaagagaagaaacaagttgcagttacattgagaggttcgcagaagcaatggcttgtaaccctcacagagtgtttcttgttgaagatatagagcaagcagattattgttctcaacttggtttcaaaagggccattgagaggggaagggttgcggattcaaaaggcgaagaggttgcactttgcgatgctatcatcattctaagctgtgaaagtttcagttctaggtcaagggcttgttctccgtcggtcaaacaaaaaccgctgactgaggaagaaaagaatggtggtgacatggttgcaactttggaggtgacaagtccttgtgtttctttggatttgaatatttccattgatgatgaaaacgaggttgaggataagtcagtggatgaaattgggcttcttgaatcagtagacaaaaaggttatcttcaactttcaggaattgtga

SEQ ID NO: 110397 - DNA, 516 bp, Glycine max
  Peptide Sequence Number=SeqID_227175
atgtatgactacttgattcttaaaacttttccaaaagggaatacaatttggcttagacatggggagacaaatactctacatactacagttgaaacacctacaatgccacaaccaaatgaagataaagttcttattaatgatcctatatgtgacatgattaatgatacatttgggcatcatcctgataataatgatatggaggaagacaaagatgtgtgtctagaagcaagccaaacaatgtcagatgatattatagaacttttggaggtaatgagggatggagaacaaagggatgcaaaccaaaaggatgagggtccattggtgggaatcatggaagggggaaggggaagaggagagaaagggtatgtgaggggaggggaagggaggggaaaggtgaatcatagtgtgggtgggtttgtgaacaatgtgtgcaatggagattggaaaagtgaagaagcaaaggagacgtggagtgaggggagggggttgggaattctagattgtgggtgtgtttga

SEQ ID NO: 110398 - DNA, 935 bp, Glycine max
  Peptide Sequence Number=SeqID_227176
ggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggaattcgatcctccactatgaaatcgcgtagaggctttactattcagcgtttgatgaatgcaatgcgacaggctcatgctgatggttggtttatcgtttttgacactctcacgttggctgacgaccgattagaggcgttttatgataatcccaatgctttgcgtgactattttcgtgatattggtcgtatggttcttgctgccgagggtcgcaaggctaatgattcacacgccgactgctatcagtatttttgtgtgcctgagtatggtacagctaatggatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 110399 - DNA, 216 bp, Glycine max
  Peptide Sequence Number=SeqID_227177
atgctgttgaagatggtgaggaggaaaacactctgtccaaagtgggtcaaggggagaatgggaggtgtagcgtcgcgagaacaccgtggtggcacgatgggcacatcacgctacgaggagttgagtcacggtgagagagcgagagttcgagttgcatggagggagagaatgggaggtgcagcactgttaggaggaggaggagtatgggagttgtag

SEQ ID NO: 110400 - DNA, 369 bp, Glycine max
  Peptide Sequence Number=SeqID_227178
atggcgaaggaagtgatccacagtcacaattctgcagtgccttggctccacgctactgaccctccttttttctcttccccttcatggctatttatagaaaacaaccatggagggcaggaaaactcacccaagcgagtggcttgcttagggttgaagttaactcttagcccatgcaagctggatgctagcctgggtgaatttagggtcagaaatcttcatgaaaagaccattttccccttccttgtggctttgtttctagatctcacaaacaaccatcaaaaccctgagcgatccctttggccttgcattgtaaccgatgccaaatgccgcaattcgattggcaatgataaaaacattctactcgaatga

SEQ ID NO: 110401 - DNA, 393 bp, Glycine max
  Peptide Sequence Number=SeqID_227179
atgccggtctccccctgcggaagtatcagttggtctgtgctgtcccgacataggggtagcgcccacaagacacctagtggacccggaggagcccaacaaggacctaggatttccagctctggttacaggcctctggatcacgcctgcaagacactcagtggacccggagaagtccaacagggtcctggggtttccagctctgattatgggcctctatcagttctatggagtgcctgtcactcccagcaaggccatgaagccccgcaggcacagggcgagacacaacaacaggctggggatggccggcaacaagcaacagacgcaccgccgccacctccaaagccccttagttcatctacaagagctggagcgttgcctacgacttgtggttga

SEQ ID NO: 110402 - DNA, 411 bp, Glycine max
  Peptide Sequence Number=SeqID_227180
atggtgatggaggagcaagaagaaaacgtaggagaagaggccagaaatttctggagaaaagagagagaagaaattccaggatgtcacatctactaccgtgtatgttgttacaaaaggggttgcagctctaaaggccaaaaagtaaccattgtaataaaaaagaaagatcgtgctttacgacacccataccggacgcgtgcgaggagcaagataatgagtgaaataaaggaggtgcaagaacaaatgaaggctgatatggaggccatgaaggagcaaatgatgactatgatggaggcaatgatggatatgaggaagataatggagtttaacgatttaacgctgctactgccagtactgctactgagagggacccaactcacccgcccgtttttaatcaagaaagtcacctag

SEQ ID NO: 110403 - DNA, 399 bp, Glycine max
  Peptide Sequence Number=SeqID_227181
atggtgggatatatgcctgtgagctttgcggatttggtgtttgcgggggaatggattgaagttagtttgaagaagggaaagtttgattatgctgcttcaatgaattctagtagtttgaggcctgagatgaatggagtgaagaagaaagagaaagaagcccatgtcgtggttgtggttcctacatgcgcaaacttctcgcaaaccccttacaaccccattcccaacgtgagaactaatccctttgtgaatcatgaaagctcatctgtgaacgctattaaagaaggaccttttatggtgaagaaggctttctcgggtggagcactgatactcacgaacatggataatgaagaactaccttcgcctgtgaattctgatgttgtcaaacgatactatgcgtga

SEQ ID NO: 110404 - DNA, 222 bp, Glycine max
  Peptide Sequence Number=SeqID_227182
atgggtaatccaggtgatttacaaccctttgatcctgaaatagatagaaccttacatagattagttagacatagtttgcatcttggtcattctgtgcattctgatcattttgagcattttgttgctggtgattgtgaatattcggatattgagcattcggctgttaattttcatactgagaacatggctcaacctccacctagtgaaagcactcttaggtag

SEQ ID NO: 110405 - DNA, 108 bp, Glycine max
  Peptide Sequence Number=SeqID_227183
atggcttcaccttggctaagtgagacacagtgtcgccaagcgcaattcattgcggccagaattgagggccatagggctgagcgacttagtgccattcatggtcgctga

SEQ ID NO: 110406 - DNA, 192 bp, Glycine max
  Peptide Sequence Number=SeqID_227184
atggattttgactggttttttgaagacaagcccgctcctgagcacaatgtttgcttgcgggtaatgggagaaggtcaagaggttttgaaggtgagaatcaaaactcctttcgctaagtgcctgcttctcgctaagcgcataatcgttcatgcactaagccacgagtatcaagcgcttagcgcacaaccctaa

SEQ ID NO: 110407 - DNA, 516 bp, Glycine max
  Peptide Sequence Number=SeqID_227185
atggagagggaaatgcggtgctgggagctggctaacgtttcgatgcaggtggtggcggcaacagtgcgattgcgggtgtcaggggaggagtcgaggatgcacttcgccatggactgcacggaggtgaggttgtcggagaagagggcgatggcggattggaggagctggagaggggttgggttgggagggagctggttgtgggatgaggagagagagcatcatcaaagcttaataagtgtctctgtcaatgtctcaagctacttagctagcagcttgttcggcgccaatagtgcatcttgtgaagaaagctctaacaagcttcttttgtggatttccttgaatcagctgaatcaaggaatgaggatatgtgatgttgtgagcctgaacttctggccgcgtaatgcttgtgaagaattgcggcatggtcgagctagaataatcttcaagagttaccctctgtggttgatcttcagccatgatatgagcttcggatgcacctactttgaattctcttaa

SEQ ID NO: 110408 - DNA, 331 bp, Glycine max
  Peptide Sequence Number=SeqID_227186
atgtcaaatcacaagagcacagagtcagatataaagaacctggagattcaagtaggacaactagctaagcagatagctgaaaattcttctggaagtttcggagctaatattgagaaaaatcccaaggaagaatgcaaagttgtcataactagaatcaagagggaaatcatagtagaagatgaagggaggaataatgatgagcaagagttagtagctgaagaagaaaaagaaaaagaagaagatcatgtgagggagaaaaaaataaatgatgaagaggaagaagaaaaaaatgaaaaaaagagagaaaaagagaaagagaagaagacaaaga

SEQ ID NO: 110409 - DNA, 1695 bp, Glycine max
  Peptide Sequence Number=SeqID_227187
atggagaaagatggttgtgtggcagaagcaatcatatccacaaccaccatctctccctgttctccgtatgcttcatcctctcccaaacccaaacacccacaacacttgatctcccttcttcccagagacccttctcaacgccaacctctccaacaagtccactctcacatcatcacatctggcctcttctacaacccttttcacaacaccctcacttgtttactcctcttcaacaacgtcatccgttgttactcttttggtccttatccccatgaagctcttcacttcttcacatacacccaacactgccacattttcttgacatacccttccctggacaccttctcttttgccttcctctgccatgcttctgccaatccaaattacacccactttgggactcagctccacgccctcattttcaaggttggttttcagtttcaagtctatgtgcaaactcggctgttgcaaatgtactctagttcgggccttttagttgaagcagcgcaagtgttctacgaaatgcagcacagaaacttagttagttggaatgtttttattactggtttgattaaattgggtgaggttgaacttgcttgttccgtgtttaatcagatgcctgctcggagtgtagtgtcatggactcttgttattgatggatacacacgaaggaatcagcccatcaaagctttaactttgtttaggaaaatgattgaagttgatggtatagaacctacggaagttactcttttgaccatttttccagctattgcaaatatcgggtgcattaagatatgccaatcagttcatggttatgtagagaaaagaggcttcaatgcctttgatgtacgcattacaaatgcattacttgatttgtatgccaagtgtggatgcatagctagtgtgagtagattctttcaggagatacctgaccagaggaggaatttggtatcatggacttcaactatctctggttttgcaatgaatgggatggggagggaagctctagagagttttgaaagcatggagaaggctgggctgaggccgaaccatgtgacattcctcggtgttttgagtgcctgtagtcatggcgggctggttgaggaggggatcaatttctttgttaaaatggtaaaggattggtgccttgtaccagacatcaagcactatggttgtgtgatagatatgctggggagggctgggaggttagaagaagctgaaaagattgctttacaggtacctcatgaggttgccaatgctgtgatgtggaggacactgctgggtgcttgtaatgttcataacaatgttgaaattggtcagagggtgaccaataaaatactggagatggagagaggacacggtggagattatgttcttatgtccaatattctggttggtgttgggagatttaaggacgcagagaagttaagggagatgatagataagagaattgcctttaaacttcctggctacagtttttccctcaaaaggaaggattgcatcaaacactttgccagcgtcagagagaaagtcaaagtgggtgtaaacggctatgagcttggtggccaagaagagcaaactatgcgcagtggtgaaaaccaactgagagtgaagttagagagcttgttggagagtgaggcaatattgaaaaaaagtgttgaaggagtcattaagttcatcattatgggtgactaa

SEQ ID NO: 110410 - DNA, 147 bp, Glycine max
  Peptide Sequence Number=SeqID_227188
atggagaattggcgaacagcgctacgcaataacttcgcggggctccagactcgaagagaatggagaattggcgaacagcgctacgcaataacttcgcggggctccagactcgaaggtggaggacgcatgaacagcgctaggcaatga

SEQ ID NO: 110411 - DNA, 954 bp, Glycine max
  Peptide Sequence Number=SeqID_227189
atgtcagccttttctgagcaaccatcttctagtgcctttgtgcggtcacctaaacctgatccttgttccaccactggcaaccttactatctttgatgaacatcgccaagagttcttcctgggccctttcttcctcaatgaaggcgaaaaatactacaaaatggctaacaagttgtttaatcataagaaaatccccctttccaattacttcttttgcgcatggcctacacccttttctagaatatcaaacctagtttggcctcgagatgtattgatcgaaatcctaaggttctgctcaacggttatcaatagatttgtccttccaaaggctatggttggcccaaccctccttgatgtggtggttattctgaacttaccaattcatggtgaagaacagtcgtcactttttgggacttgttgcattccttcaactaccctaggcatcaaattttctaaagatgactctaggtattccaaattcatgcttctcaaggccaaaaaaagtggtgttgtttcatcaagtgagcaccatgcttttcttttaacatggttttgcagctacttcatttgtattggttcagtaggcgtggtaagtgaatactgcaactttatgttggctattacattcaatcacgatttggctttggatcttctacttaggggcattttccatcttctcaacaaccttgaagatggccacactaagtacaacaccatatctagtccgatttggattctgattctttgggcacgactatattttctagatgccctttatcctagtattggtttgctagtgaccaagcaggataatacttgttacgggcaagctctcatttgcctctcattgccaaagatgttagcctttttcattgcaaattggctcttgacggctgatttcaccctttgcttttctctcactcctcttcaacatcaattgataggttcacactag

SEQ ID NO: 110412 - DNA, 330 bp, Glycine max
  Peptide Sequence Number=SeqID_227190
atgtcaatcgctgcttcagcttcttcacatgcttgtatttcctcaatccccacatgcatcccctcttcctcttccaaattctcttcttcgctgacactttcttcactccaaagaggctcaaataagagatcgggatgcagagccatggttcaacaagccgttcagggtgcccctgctgcgtatgccaaagaaatggaacgcctttctgccaaagaatcgcttcttcttgctgtttttcaaattgtagtcgtggatgctgttttaatgggatttgcagaaacaaatgtgttgaggagaccaggaaaacatgatgttgtggctataattgag

SEQ ID NO: 110413 - DNA, 360 bp, Glycine max
  Peptide Sequence Number=SeqID_227191
atgaaagaagagtatgttgaaggggttcttgtgacaccaacaattattgaagagagagtaccagaacaacttaaaggtgcactggggcaggcagctaatgctttacaacaacttcctacccctatatgggatcctgttgccagtgggctgaaagttcctctaagtgggagctttcaaagactcttcatgatttcttatctcgatgaggagatacttggtgtccgttgtcctacgttttacatcgagtatgtgatgtttggtagaataataaggaacacagccgggattccagaagttttaacgaggttggatgcagcaccatcttccttgggagattcaagtccagagtatgaaagctag

SEQ ID NO: 110414 - DNA, 276 bp, Glycine max
  Peptide Sequence Number=SeqID_227192
atgaagagtatatatgatcttctgtattgtgatggtgacatgatttcatcatctaaaggaagactatttgaatgtcctagtggtcctcaagtcgtcacaagaagtgaccacatgtcacttcactactacaaaaaagacaaacggcgacgatggaaaacaacatacaaagacagtgcaacatcgtctttgaagctaacatcgttgaaagttaagattttcgacgacggttctacaaaatccgttttagaaaaacgttatcttctaagcggtgattag

SEQ ID NO: 110415 - DNA, 183 bp, Glycine max
  Peptide Sequence Number=SeqID_227193
atgaccgacaacatgggagacgattccaatggtatctatgtattcggatatgggttttctcattggagctgtgtaaatttgattttgagacgtgtcccgttaaggaagttgatgtaccgagacaaactcatccttaacattgtggaaggacatgttgctgagggcacgactcatatcgaatga

SEQ ID NO: 110416 - DNA, 237 bp, Glycine max
  Peptide Sequence Number=SeqID_227194
atgacaattgaggaatcaatacatgttacttttgatgaaactaatattacctctctcagaaaggaatttcttgatgatattgcagattctttcgaagatattcacaatcaagaaaggaatctaaaaaggaagagaaatgaagaaaacaaggatgttcaagacgacatagcccaagaaaatgatgatcttcccaaagaatggatgattgaggccgtacccgaatcaaataaacattaa

SEQ ID NO: 110417 - DNA, 1191 bp, Glycine max
  Peptide Sequence Number=SeqID_227195
atggcaagagagacaaaatggaaatgcatgcatgtttgtaaggggttgaggaagtgtagggtaacattgaagtcaatgtataactttgccaagtgggaatgtggcatccgtgttcaagaagaggtccagaagtcaaggaatctagcaatttttttttttctaagggtagttaggacttgggagaatgattcagagaaacaggttttaaaacaaggttcattccaaaggttatgcctctcggatataagcattcctagctcccctcaggccattgaagatctttccatttccatttccctggttggcccaaagttgtacacattcccactagatgagctgagggaagcaacacacaatttctcatggaataattttctcggtgaaggcgggtttggacccgtgtacaagggtttcgttgatgacaaacttagacttggtttgaaggctcagcctgtggctgtgaaacaactggacttggatggcttgcaaggtcacagggagtggctggcagaaattatatttcttggacagctgagacatccgcatcttgttaagttaattgggtactgctgtgaggatgaggacaggcttctggtgtatgaatacatggcaagaggcagcttggagaatcaactgcacagaagatactctgctgccttaccatggtcaacaaggatgaagattgcattgggtgcagccaggggtctggccttccttcatgaagcagataaacctgtaatatacagagatttcaaaacttcaaatatcctactagactcggattacatagctaaactatcagaccttgggctagcaaaggatggtcctgaaggggaagacacacatgtaacaacaacatgcataatgggaacccgaggctatgctgctcctgagtacatcatgtcaggaagaagggtagtggatatgtgccggccgaatcgagaacgaagcctggtggaatgggcaaggcctcttttgagagatcaaagaaagctgtaccatataatagacccaagattggaagggcagtttcctatgaaaggagctttgaaggttgctgcattgacttacaaatgcttgagccaccaccccaatccaaggccttctatgagtgatgttgtaaaaatattagaatcacttcaggacttggatgatgtgatcataggaccatttgtatatgtcgcggggtga

SEQ ID NO: 110418 - DNA, 354 bp, Glycine max
  Peptide Sequence Number=SeqID_227196
atgacgtccccttgtacgtacataaagcatgacgatcttggggaaatagcagacagtgctcaatgtctgaacatcattgttaaacaattatggactatttcatacaaagatctgggcaatcgccgtttgaatttgaggatcatattaagaaatggatgcagtcgacgttgcagtctacctaggagcctacttgaatggggattcaacgataatcacataagtaaatccaaggcaactgctaattggattctagttaaatgtaataagcaaagaggaagcatcgagtgtggctattacgtcatgcattggatgtcaaccatagtcctaagaggtttcaaggataattgggaaatg

SEQ ID NO: 110419 - DNA, 261 bp, Glycine max
  Peptide Sequence Number=SeqID_227197
atggaggaggttgagcaagctaatagagtagctgttgaaagttgccatagggttctgagtttgttgtctcaaccaagggatcaggttcagcgtaggaatttaatggtggaaaccagtgaaactgtggtgaggttcaagaaggttgtttccatgcttcacaatgggccagatcctctaccagtagaagggttgacgtggacggttggtcgtggagaatctggtggtggaggggacctcgggggtgttgccatgcctgcatag

SEQ ID NO: 110420 - DNA, 225 bp, Glycine max
  Peptide Sequence Number=SeqID_227198
atgggacgccacgtggggttatgcaattggaaaatgaggaggttttgttgtggagtgtgggacaatcgatctcagcttcttgggagttgcgagctgtggtgggagtgggagattactgacattgccagctgtcacgacaaccacctttctccaattctccgttacattgaaaacgtgcaattcacgataaattcttcgctaactcctggttttattctaaattga

SEQ ID NO: 110421 - DNA, 477 bp, Glycine max
  Peptide Sequence Number=SeqID_227199
atggcagcgacgacggcgatggaggcggaggcggtgtggtccgtgaagtgctactgctgcgggttaacggaggagtgcacgccgcgttacattgacggcgttagagagagatatcagggtcgttggatttgtggtttgtgtgcagaggcagtgaaggaagagggtttgaaattgaaggatgatgttgatgttgatgttgatgttagcaccgatgaagcgctgaagcgccacatgaagttcagatcttccacttctagccctcccaacaaacccacccttgacttgattctcgcaatgaagcaccttcttttccgttctttggattctccgaggaaggagcctttgactttttcgccacttgcaacatcacgcacgtgcttttcacctggatcctcaaagggggagccacaagaggctagagagattttgcgaggtatgagaaatatctccagtgtcaggggaccttggccgatatga

SEQ ID NO: 110422 - DNA, 393 bp, Glycine max
  Peptide Sequence Number=SeqID_227200
atgcatatgaaggctgctcatggaaaaagctcaagaatccatttaccgccagaggtttgttgttccccaatgctttcattcctgctctccataaatccagttgctccagaggtgcagggcaatggaagaggaaatgagaggatagtagacctacatgggttgcacgcaagtgaagccattcatgtgctgaaacatgagttgagtgtgctgaaaagcactgccatagctgccgagcagcgtttgcaggtttatattcttgtggggacaggtcatcataccaggggttctcgcactcctgcgagacttccaatagctgtacagcgttttcttcttgaagagggcattgacttcatggaaactcagccaggcctactacgtgttgtgatatattga

SEQ ID NO: 110423 - DNA, 297 bp, Glycine max
  Peptide Sequence Number=SeqID_227201
atgtcccatgctgttaaagataatcgaggcaagtgggccccgaattatgaaggacctttcgtggtgaaaagatctttttttggggcaaggagcagaatcgtctcaggccacgaccagaagtcaagacaagtcaatggcagaaatcgaccaaggtacatagggacggatgcaagtggggctagggtcacgaccgaccaatcgttgcctcttcccggcgctaaacaagcagagaatgtcgctgcagggcagcccagtatcctttgtgttcgcagtttcttttactattgtttgttttaa

SEQ ID NO: 110424 - DNA, 2484 bp, Glycine max
  Peptide Sequence Number=SeqID_227202
atgtctagctttacgcaggctgttaaaatctgtcatgagaatttttccaaatctgaaggagagtgtgaaatttacagaaaagctgataaaaagattttggaggttgattttaattattctcaggcagaagatttgggatacatatctcccaaattaattgaacttattaaactctttcagtcatttggagaatctagtcaggtgttgtgccttatttttgttgatagaatcattaccgcaaaggtgatccaaagattcgcaaagacagttcccaatatttctcatttcacagtttcctatttaactggtaacaatacatcggttgatgctctggctcctaagaggcagaaggagatattggattctttccgctctggaaaggtcaatctattatttactactgatgtacttgaggaaggaattcatgtgccaaactgctcatgtgtgatacgttttgacctcccaaagacagttcgtagttatgtccaatctcgtggaagatctaggcaggcaaactcccaatttgttgtgatgttggagaggcaaatcaatctgctgggtggaaggataaccgaaaagcatattaagaaaatagtctttgtttctctcttttcacacttaattatcaacattaacccttgtatctacaggggaaacttgaagcaaagagatcaactctttgatatcattaggagtgagcggtccatgactgatgcatctatttataaagaacatgaatctagtttaagggcatgtatggtggggaaaacaaatgcatactatgtggaatccactggagcatctttcactttagattctagtgttagtctcatccaccgatactgtggaacactccctcgagataagtactcctgtgtaaagcccaattttgagtttctgtctgtggaagggggttatcagtgtaaattaatattaccatctaattcagctttccaaacaataattggtccttctggaaaagatatgcgtttggcaaagcatcttgcatgtttcgaagcttgtaagaagctgcatcaaatgggtgccttaaatgaacatttggttccattaattgaagattcttcagaagatgaccatattgtgaaaaataaagaatcaagttctggtgcagggaccacaaaaagaaaggagttacatggaaaagctaacattcatgcattaagtggtgcatggggagacaaactcactagagtcaaatttaatgcgtataaatttgaattcacatgtaatattgtaagtgaaatatactctgggtttgctcttttgattgagtcagagcttgatgaggatgtgggaaatgtaaatttagatctttatttagtctcaaagattgtgaaagcttccgtctcttcatgtgggcaagttgatttggatgctgaacagatgatgagagcaaaatgcttccatgagctttttttcaatggtttgtttgggagactggtcttgaagtccaaatcagcaggagaaagggaatttttacttcagaaagacacaaactcattgtggagcccaaaacacttgtatttgcttctaccactagagaaattgaatgatatctgtgagggatctttgcaaattaattggtgtggaattaattcttgtgcttctgctatcaaatttttaaggaggaaattttctttggtcactggagattgtgatgataacggcacaatcacatcacctcatgataccagttcatcagagatggaatgtgtaggagcaaacaagattcactttgctaattgtgtggttgatgctgataatataaaagacagggtagttttggccattcacactgggaaaatatattgtattattgagatcgacagtaacctatctgctgaaagtcctttctatggaaacaatgaaaaatcaaaggaaagcattaccttctcggattatttcagcaaaagttatggaatttcactgagacatcctggacagcctatgttacggttgaagcaaagtcataatccacacaatcttcttttcaacttctatgaggaagatgcacgagacaagtcatcaaaaattggccctgcagcctcaaaattgccagtgcatgttcatattcctcccgagcttctatacattcttgatgttaaaagagatgtgttgaaatcactgtacttgctgccatctctgatgtaccgcattgaatctttgatgttatctagtcagcttagagaagagatagatggtcaaactagcaagttcaacatacgtagctcactgattctagaatcacttacaactttgagatgtagtgaaagtttttcaatggaacgtcttgagttgctaggagattctgttttgaagtatgtggacaattatctgccagacgatcatcggctgtttgtaactcaaccctacataaactggggacagatcgcaaattacagcaaaacaaattctgatgactcgggagacaatcaaactcttaaccaaatgatgaaactttga

SEQ ID NO: 110425 - DNA, 2943 bp, Glycine max
  Peptide Sequence Number=SeqID_227203
atgcacttgcgacttcgagctgccacttccactgcaaacccattgaccccacgcgctcacctcatccactctctccctcaatgcttctccatcctccgccaggccatcgccgcctccgacttatccctcggaaagcgcgcccacgcccgcatcctcacgtccggccaccaccccgaccgcttcgtcaccaacaacctcatcaccatgtatgccaaatgcggctccctttcctccgcgcgcaaactgttcgatacaacgcccgacaccaaccgtgacctcgttacctggaacgccatcctctccgccctcgccgcccacgctgacaaatcccacgacggcttccacctcttccgtctcctccgtcgctccgttgtctccaccacgcgccacactctcgcccccgtcttcaaaatgtgcctcctctcagcttccccctccgcctccgagtccctccacggttacgccgtcaagatcggattacaatgggacgtgttcgtcgccggtgctctggtcaacatatatgccaaatttggactaatcagagaggcacgcgttctgttcgacggaatggctgtgagagacgttgttctctggaacgtcatgatgaaggcttacgtcgacacatgtctcgaatacgaagcgatgcttctcttctctgagtttcatcgaactggattccgtcccgatgacgtcactctccgcactctctcgcgggttgttaaatgtaagaaaaacattttggaattgaagcagtttaaagcttatgcgacgaagttgtttatgtatgatgatgatggttcagatgttattgtgtggaacaaggcactgtctcggtttcttcagagaggtgaagcttgggaagctgttgattgttttgtggatatgataaactcacgtgttgcgtgtgatggcttgacttttgttgtgatgttgactgtggttgccggtttgaactgtcttgaactggggaaacagattcacggcattgtcatgaggtccgggttggatcaagttgtctctgttgggaattgccttatcaatatgtatgttaaggctggttctgtttctcgtgcgaggtcggtgtttggtcaaatgaatgaagtggatttgatatcgtggaacaccatgatatctggttgcacgctgagtggtttggaggagtgttctgttgggatgtttgttcatttattacgcgacagtttattgccagatcaattcactgttgcaagcgttttgagggcttgttcgtctcttgaaggaggttactatcttgccacacagattcatgcttgtgcaatgaaagctggtgtcgtcttggattcgtttgtttcaactgctctgattgatgtctattccaagcgtgggaagatggaggaagcggaatttctttttgttaaccaagatggatttgatttggcttcgtggaatgctataatgcatggatacattgtgagtggtgattttcctaaggcattgaggctttacattttaatgcaagaaagtggagagagatcggatcagattactctggtgaatgcagctaaagctgctgggggattggtggggcttaaacaagggaagcaaattcacgctgttgttgtgaaaaggggttttaatttagatttgtttgtcactagtggtgttcttgacatgtatctaaaatgtggagagatggaaagtgcacgcagagttttcagtgaaataccctcacctgatgatgttgcttggactactatgatatcaggatgtgtggagaatggacaagaggaacatgctcttttcacgtaccatcagatgagactttccaaggtgcagcctgatgagtatacctttgctacccttgtcaaggcttgctctcttttaacggcattggaacaagggagacaaattcatgcaaatattgtaaagctaaactgtgcttttgatccttttgtaatgacctcacttgttgacatgtatgctaagtgtggaaatatagaagatgcgcgtggtttatttaaaagaacgaacacgaggaggattgcctcatggaatgccatgatagtaggattagctcaacatggaaatgccaaggaagcccttcagtttttcaaatatatgaaatctaggggtgtaatgccagatagagttacttttataggggttctttctgcgtgcagtcactctggtttggtatctgaagcctatgagaatttttattccatgcagaaaaactatggtattgaacctgagattgagcactattcttgtctagttgatgcccttagccgtgcagggcggatagaagaagctgaaaaggtgatatcatcaatgccttttgaagcttctgcttcaatgtatagaacattgcttaatgcttgtagggttcaggttgacagagagacaggaaagcgtgtagcagaaaagcttttggccttggagccatctgattcagctgcttatgttcttttatccaatgtttatgcggctgctaaccaatgggaaaatgtggcgagtgctagaaatatgatgagaaaagtaaatgtgaagaaggatcctgggtttagttgggtagatttgaagaacaaggtgcatttgtttgtagccggtgataggtcgcatgaagaaactgatgtgatatataataaggtggagtatattatgaagaggatcagagaagaaggctatgtccctgacacagactttgcacttgttgatgtagaagaagaagataaagagtgttctttatattatcatagtgagaagctagcaatagcgtatgggcttatgaaaactccaccatccactacattaagggtaattaaaaacctcagagtgtgtggagattgccatagtgcaatcaaatatatatcaaaggtttttaagcgagagattgttttgagagatgcaaatcgatttcatcatttcaggaatgggatttgctcttgtggtgattactggtga

SEQ ID NO: 110426 - DNA, 1590 bp, Glycine max
  Peptide Sequence Number=SeqID_227204
ggatatattcgagactctgcttttgaaccacgccgttgggttgctccaggacagcgttctatacaccttgtttgttgtgattgtgggttggaaacccttgaagtgcctttagatgcaaaattccatactgaagatccaaaagttgtggttgggaagttttgcgacagaggtcactgctggatgtgttctaagactattgctgactgtgttgaagctctgataggagcatactatgtagatggtggactttttgcttcacttaatgtgatgaaatggcttgggattggtgctgaacttgaactatcattggttgatgaagcaatcactgctgcatctctgcgtacatgtttgccaaaagaaagtgagattgcaagccttgaaaagaaaattgggtatgaattttcggtcaagggactcttactggaggcaatcacacatttgtctgagaaagaacttgggattggctgctgttatgagaggcttgaatttctaggtgactcggtattggacctgcttatcacatggcatctttatcagagtcacacagatattgatccaggggtgttgactgacttacgttctgcttctgtcaataatgacaattttgctcaagttgctgttagacataaccttcaccagcaccttctacatagctcaggattattactgagccagatatcagaatatgtgaaggtcatttctgaatcagatcccagatcacttccaagtattagtgctcccaaggcacttggagatgtagtggaaagtatagttggggctatactaattgataccaagctcagtcttgaccaagtgtggaacgttttctattctctattatctcccattgttactcctgataaacttgaattgcctccatttcgtgaattaaatgaattatgtgattcgctcggttattttgtaaaagtaaaagaaaattgtgaaaaagtgggatcagcaatgcatgttgaggttagtgtacaacttccaaatgccctattggttcgtgaaggaaagggggcaaataaaaaaactgcaaaaggagaagctgctttttatttgttgaaggatcttgagaagcagggaatttcacatggtagtttcatgtccaagggaaaaagagataatcctgaccatgtctatggttcatctcatctcaaaatggattctagtattctaattgaagaacattcctcagagccagcatcacataaaaggcacatattggatgaaactaacttaactgcaattaatttatcaattaatatgaagaagggaggaccgcggaccacattatatgaaataagaatattttgttctagaattggtagtgctgtgacatgtgaatccgacaagtttttattttgtcacagatctctatttgaatcctgtgaggggctgcaaggaagcaagggacagaactgctttgtgtcgaaaattaccttgtgcatacccaattatggtaatatagaaagcaaaggagaagctagaagtgataagaagacctcctttgactctgctgcagttcaaatgcttcttgagctgcaaagactgggaaaagttgaaattgatcctctcccttctagttag

SEQ ID NO: 110427 - DNA, 642 bp, Glycine max
  Peptide Sequence Number=SeqID_227205
gaagctgagcttgctaaggagaagactcatgggtacaaattggaccgggcacacatatttgccgtgagcatgtttgatgactttgacagattcatgaaggtgcctaatgagtgggctcctcctgaaactaagccatatactccaggggaaaatcttcaagactggctcactgatgcaaaggccagggaccagtttgtgattcgtgctggttcagatactgaggttctatggaacgatgccaggcatttaaagcctgatcccgtttataagcgagcatttggacagagttttgtgcaatggtctcctttggggacatacttggccactgttcatagacagggggcagcagtctggggaggtgctgccagtttcaataaacttatgcgttattcgcatcctcaggctttctttgagatttattctgtaaaacttattgatttttcgcctggtgagaagtatttggtaacatatattagccatgaaccaagcaatccccgagatgccaatagagttgtgataaatatatttgatgtgaggactggtaaagtgatgagggacttaggaagtgctgatgattttgcagtcggaggtgctgggggtgtcactggagtttcatggtctatggattggtggaagagatga

SEQ ID NO: 110428 - DNA, 978 bp, Glycine max
  Peptide Sequence Number=SeqID_227206
atggatttctgctggtcttctactgatccaattattgctcttgttgttcctgatatgggaggtggtaaccagcctgccagggttagtctgattcaaatccccagcaaagaggaactcaggcagaagaaccttttcagtgtcggtgactgcaagatgtactggcaaagcaatggagactacctcgctgttaatgtggagaggtttgcagttattcatggtgataaccctaagcctaatgtcatttactccatgcgtactggtcagaacagccaagtttcaaaactcactactctgaagggcaagcaagcaaatgctctgttttggtcacctgctggtcgctacattgtactagctgggttgaaaggcttcaatggacagttggaattttacaacgttgatgaacttaaaaccatggctactgctgaacattttatggcaacagatattgaatgggatccaactggaaggtatgttgcaactgctgtgacttcagttcatgaaatggagaatggtttcagtatggtctttcaatggcaaacatctatatcggattctgaaggatcacttatttcaggtactttgacatctgcacttgatgtattgtttggcaattatacttgtattaccgtgttcttatggagaccaaggccgccatctttcttgactcctgagaaagaggaagagattgccaagaacttgaagaagtacagcatatacgaggcagaagatcaagatgtttcgttgccgctgagtgagcaggagcgtgagaagtgtaggatgttgaaagaagattgggacaagtgggttaacgaatggaagcagatccacgaagagagtttacagaggcaaaagctcagggatggagaggctagcgatgaagaggaagaatatgaggcaaaggacatggaggtggaggaagtgatggatgtaacagaagaggtccttcaccttgagtatggtcattggtcaagagtttag

SEQ ID NO: 110429 - DNA, 195 bp, Glycine max
  Peptide Sequence Number=SeqID_227207
atgcaacaacacgaaaagcgtcggataaggggatgtgacctcgttccgagggagaagtttgagaagctggaaggagtggttcggaaaatttatagtcagattggtgttatcaaggaggatggcctctggatgcctatttatcctgaaaccgagaaaaccctaggttactgcttcattgagtacaatacccctcag

SEQ ID NO: 110430 - DNA, 1311 bp, Glycine max
  Peptide Sequence Number=SeqID_227208
atggaagtcgtccgagtaatctccacaacaacaatcagggaacccaatcacaataactcgactcagaaaatcgatttaactccgtgggatctccgactcctcacaattgaaaccatccgaagagggcttctttttcgcaacgaaaagcacacaccaaaccaaatcaaacacctccaacactccctttcttccactctagccttctttccacccctcgcaggtcgtctcgtcattctcgaacatcacgacaacattgtctcgtcccacatcgtatgcaacaacgcaggagcactctttgtccacgccgttgcagacaacaccaccgtcgccgacattcttcaacccaaatacgttcctctcattgttcgctccttctttcaactcaacggcgttagaaactacgaaggcacgtcacagcccttgttggcagtgcaagtcacggagctagttgacggcatcttcgtcgccgtcacaatcaaccacatcgttgccgacggcaagtcgttttggcatttcgtgaattcctgggctgaaatttcacgtggtaaccctaaaatatccaaactccctactctgcaacgttgctttctggatggcatagactgccccatactgtttcctttcacaaaggaggaacacttacactccccaaacctcaaacgacaacctcttcctaataggatcttccattttacaaaggaaaaagtcttggaactgaaatcaaaagcgaacgcagaagccaacaccgacaaaataatatcttctctgcaagcactattaactctcctttggcgttctgtgattcgttgccaacatgtggggccacaagaagaggttcattttgttctgctgattggcgttagagccaggatgattccaccacttgaagaggattatttcggaaacgcgattctggctggtcgtgttaccatgaaagcaggggaactattagagggtgggctcggaaagggtgctttggagataaacaagatgatttctttgcactctcatgagaaagtaaagaaccactatgagtctttggcgagaaccccaatgctttcaacgccgggtattggcgctgctaattccttgatgattagcagttcaccgaggtttgacatttacggtaacgatttcgggtggggaaagcctgtggccgttcgaagtggagatgcaaatattggtaacggaaaggttactgtgtttgctggttctaaagaagattcaattgatattcacgtgagccttccttatgagattttggaggcaatgggaaatgaccctgagttcgtggatgccatttcctattag

SEQ ID NO: 110431 - DNA, 276 bp, Glycine max
  Peptide Sequence Number=SeqID_227209
atgtttttatcattgtcaatcgaattgcggtgtttggcaccagttatagcgcaaggccaagtggtcactcagggttttgatggttgtttgttagatccaaaaataaagccaaaaggaagggggaagggggaaaagaggtccagagctttgaaaacaccaaagaaaatgcagaagaacaaggagaaaaggaaaagtggagccgagacgttggaaagttgtgaccgtgaatcacttccttcgtcatttctcttattagtctcgtgctctgcggaatga

SEQ ID NO: 110432 - DNA, 243 bp, Glycine max
  Peptide Sequence Number=SeqID_227210
atgactcactccttaaatgatgttgaagctatacacgcaacaccagaatccatttgcaatcctactaattacgacattggttgtgacgatgttgttaacaaccaaaaaaatgagaatgaaaccccacctgcgacacaaaattcaaagccaaaacgaggaagaccctttaaaacgccacctgaatcgattaaaaattggtatgttttacgcaaagaacgaaagatcgccaataggttcgatacg

SEQ ID NO: 110433 - DNA, 444 bp, Glycine max
  Peptide Sequence Number=SeqID_227211
atggcctctaggaagaggaaatcaactacctcccaacctcgagaaccatatgacatgaccagatttatttatgaggtcgcttgggagcgttatgagcagaacgttcactcctggaacatccttccgaagaggaatgttaatctttttgttacagagtacaacgagttccgcagggagctcgagaggaggcagtggcacaaggccttgaccaggcagcctgatggtcacattgatgtggccctggtcaaggaattctatgctaatttgtatgatcctgaagacaagtctcccaggcaggttcaagttcgggggaggttgattaaatttgatggggagacgctgaatgccttcctggagacccccgtggttttagagccaggggagcattactctgcttactccagattctgtcatgctcatccggacccacaggagcttacctaa

SEQ ID NO: 110434 - DNA, 765 bp, Glycine max
  Peptide Sequence Number=SeqID_227212
atggatagggtgaggctggtatacggtctggtgaccaagatggacatggacgtgggctcattcatattaggccagatttctcagatggcccagtccagctcctctaggctaggcttcccagctttgatcactgctctatgcattgccaaaggagtggtcccagattcgcttaccttcgagtccctgagccctgccattaatttggcatacatcaagaagaactgctggaacccagatgatcctatgattacttttctgggaactcacaaagctagagcttggggaccatcaaatgcttcagctcattcttcttccactcctcctactccagctccaccggcaccaccaacttccattcttgcacctccagtacccttcgacacctccgctcagagctcagatgccatgagcattcataacttgactcagcattggcccatcatcagcatcgaggactttatggcccaggtggcctggctaggagtccagccttctcctttggggggaggtaaggcttctacaacccaggagccacagccagagctagaggcgacgcccgaggccacaccgaaggagactccagagattacccctactgccacaccatttgaggcacttgaggagggaaacggtgctgcagacatagattatgttacagacatggcgagagcgcaaagctcctgggatccttggcctactccagctcacgacacatcattgccagcccaggatgctccctcttcacctcaggatgatcctacatag

SEQ ID NO: 110435 - DNA, 216 bp, Glycine max
  Peptide Sequence Number=SeqID_227213
atggagggtcctccaaagtgtttggcagcggaacaccaccaaatgcttgcctctcaattgagtatccgaggcgaggatcgaagtgggttagatgatgatgggggaatcggatccaccctagcaaggatgctggtagcggtaactgcagctgcattgacctccattatcttcttgatgctcatcatggcctccatgtcgcccttcatccgctcttga

SEQ ID NO: 110436 - DNA, 132 bp, Glycine max
  Peptide Sequence Number=SeqID_227214
atgatcattgcgcacggtcctactccaccaccaccactgtcggcagcggtagatgaacaagcacaattgccggtggagcttcttgtggatggggaacatcctttggcttcctcccacagggatggggactga

SEQ ID NO: 110437 - DNA, 276 bp, Glycine max
  Peptide Sequence Number=SeqID_227215
atggaaaaagatcccatgaaggctctccaactcctagatgctacaagtgtgtcataccctaatttcgtctggggaccattgtttgtcggcatgcgacctttgtttgaccacctcaaaatgtttaacacccatcgttgtagaatctgtaaagttccaagatgtttcgggaagaaaccgcaattcgaatctaggctcttcccggacattttggaagttgggttgcttaaggataaagcaactgggcggcaaggtcctccacgttttgaggcaaaatag

SEQ ID NO: 110438 - DNA, 1098 bp, Glycine max
  Peptide Sequence Number=SeqID_227216
atggctcgccagccatgcgctgaggccgtcatcaccctgattagcgacggcgcgatggcgcacctgcatcgcttccagcgccagcgcgcagttgcccgccgaaccgcccggacgcagctcactgtgctgcagcatcacttcggtgccgcgctgcggccagctgtccagcgtacccatgatgacatcgacattgatattgcccaccacgtagagcgtggcgcgggcttccttgttgctcatcatcctttgctcccgccactggcaaggccgctgaccagcgttttttgcagccagatagcgataaagagaggaggaaccgacgccagaataccgacggcggcaatcagcccatcgtcggtggcgcggcctgcggtaaagccggcaatggtgaccggcaggggcgtagaaaaattcatcccacgccagcagccagccaaacagcgccgccgcgcccagcaccggtttcgccagcggcagcgtaatgcgcagcagcacttgccagacgcgcagaccatcaagacgcgcggcctgttcgatatcctgcggcagggcatcaaactggtttttcagcatccaggtgagaaacggcaaaatcagcgagcagtacacgatgatcaaaccgggtcgggtgttgagcaaatcgaactgctgcagcagaaagtagagcggcagcacaaacgccaccggcggcaccatatagatggccagagacgcgaacagccagccgtcacggccgcgatagcgcgagaagctgaacgctgccgggatcgcgagcagcaggcacaccagcgttgcgccggttgccaccagcaggctattacccagcgcatgcaggaacagcgcgccgggctggccgggttccagcgagatcagcctgccgtagcggctgaaatcccactggcgcggcagccactccagcggcacgcgtgtcagatcgctggtggcgctgacgctcatcagaaacagccagcccatcggtgccacgacggagagcgccaccagcagcgccgccgcgtatttagcgccggtacgcagtttaaccttcataggcacttccccgacggcgctgccgccacagtaatagcatgtaaagggtga

SEQ ID NO: 110439 - DNA, 312 bp, Glycine max
  Peptide Sequence Number=SeqID_227217
atggcagatagatgggtgcggatcatgcacactagcatgaccatcctgacacggatttggatgacattgctgctcaacaacatcctccctagcgatcataattctgacctccccctaccgaagtgccagctggtctatgccattttgaaccagcatatgactagccagcaggcggctaatcaaaggggtcaggtgcagttgaatgagagcttctactggtacacccaacaccagcagagccaggaccccagtcctttcccgtggcctaccccccgaatagttcggggccacaattgcatggctgggagatga

SEQ ID NO: 110440 - DNA, 339 bp, Glycine max
  Peptide Sequence Number=SeqID_227218
atggactacttgaagcaaaaatggcacattgatagtgattgctccaaacacatggcgggagatgcatcaaagtttatttatacttttcccaaaaatagtgaacatgtactgtcgcaacgtgcccttttgcgggcgagcgagggcgaggctcatgggtgcgctttccaaaggaggaaagatgcacggagtcgccaccaacgtttatttgtggaaaacgtcggaaaaaccgaagaaaaccggtcaaaaatgaaaattctaagtttgggagttgtatttacgtttgaggaaggtattagcacctctcatgtttgtctcaaaggacaacaacctattttttag

SEQ ID NO: 110441 - DNA, 129 bp, Glycine max
  Peptide Sequence Number=SeqID_227219
atggcaactcagagagtcatccacgtcatcttcattggcgagggaactcgggaagcttctacttcaacgattagggtttgcgtcgggtcggagaagatgaggcgcacaagagacgtggatagacattga

SEQ ID NO: 110442 - DNA, 207 bp, Glycine max
  Peptide Sequence Number=SeqID_227220
atgcgagcggggaattccaatgtgtatggattcctcgagccacagtccattcagagatctgggcaatcacaatttgaatcagaaagttacatgaagagttcaaaacgcgatgtctaccttggagcctacctgaatggtgctttgaaaggacttgatgatactccaaaacttaaatccaaggctggtgctaggtggattgttgttaag

SEQ ID NO: 110443 - DNA, 141 bp, Glycine max
  Peptide Sequence Number=SeqID_227221
atgactcaagatctagctagggtttggttcgggtctcaaaagcagaagaaaggagaaggatatttggcgagacggtcaaggaagaggtgggtggttatggttcggctgccaataactgagctagcgtcgcggcagaactaa

SEQ ID NO: 110444 - DNA, 183 bp, Glycine max
  Peptide Sequence Number=SeqID_227222
atggtgattgtgagattggaggggaggaagaccataggtttgagcaaatacgtgagggtacttagtcaaacgggtttgaataaaacgtggaagctagggagttggatggaagaattaagcgggttaggtgcggcttggggtctaggtagtgcaataatagggataaaaattaaggtgtcgtag

SEQ ID NO: 110445 - DNA, 144 bp, Glycine max
  Peptide Sequence Number=SeqID_227223
atggcttcaggtggcaaatcctctttggagatattcaaacttacttctttgctcatccacgaagagcaacagtttgttggtgtaaaatccactctattgatatggcctgcattgggcatagctagtgctctaaggtgtaattag

SEQ ID NO: 110446 - DNA, 349 bp, Glycine max
  Peptide Sequence Number=SeqID_227224
tgacatccttggccagagtggatttgattgggatggcactaagcacatgatcacagttgagaatgaaaatgcttggaatgaatattgcatttcgcataaatcggctaaaccgtttcgatacaaggtgcttcaaaactgggatgatatagtggatttgtgtgctaaagatagagccaccggtcatggagctgaaactgctatggatgttgatgaagcgatgagtagagaaacaaatgaagtggaattcatggggttaggtgttactgccatagatttagaagaaccaagctctaatacaaaaggaaaaagacaaggttcgacttcttctggcacacatcctcacaagtga

SEQ ID NO: 110447 - DNA, 303 bp, Glycine max
  Peptide Sequence Number=SeqID_227225
atggtgggttacacaccttcaagctttgcggatttggtcttcgccggcgaaaggatcaaagtgggtctggaaaaaggcaaacctgatcatcctactttgatgaatgcgaaaactggggcaaatgaagaggatgagaatgagggagaaacccttgttatgactaccattcctacactgtcaaatttcacatcagcccaacaatgtcattacttagccagtaacagtccctctcaccctatcatccacaaagcctgcccgcctcaaatctggtgccaaaacaccaaccaaaaaggaattttgtag

SEQ ID NO: 110448 - DNA, 150 bp, Glycine max
  Peptide Sequence Number=SeqID_227226
atggagaattggcgaacagcgctacgcaataacttcgcggggctccagactcgaagtggagaatggagaattggcgaacagcgctacgcaataactgcccgaggctccagactcgaaggtggaggacacatgaacagcgctaggcaataa

SEQ ID NO: 110449 - DNA, 333 bp, Glycine max
  Peptide Sequence Number=SeqID_227227
gagtcatttgacttaatccatcaactgaaagatccttcaactatttctcatccttggaaaattctttttgcaagaatcaactgcatctttcattcttcctcactgcgaggttgtgaaaacaagacaacaattggtacctctaagccctacattggggcaatgaaaggccccatgcataaacctcaaatgaacctagggcagattagaagttctcacccaataggttccttgctacaaggtcatgatgaaagacaacgattgtacctcaagccctacactggggcaatgaaaggcaccatgcaaaaacctcaagcgaacctaggggcagattag

SEQ ID NO: 110450 - DNA, 207 bp, Glycine max
  Peptide Sequence Number=SeqID_227228
atgggtgttaaacattttgaggtggtcaaacgaaggtcgcatgccgacaaacaatggttcccgaatgaaattaggacttgtttgtctctcgatgataaaggtgcggataaccatgagtctcgaccggaagacgctgacatctccggaaaaggtgcagatgaggacgttagtcacaaaatgctatcaggctttgagtcctatgaataa

SEQ ID NO: 110451 - DNA, 358 bp, Glycine max
  Peptide Sequence Number=SeqID_227229
ggaaacatcccttagcactgccatacctattgagcttgaggttattcctcaagtaaaggagttgttagatgagggtttggtttgtattataaggcaccgaatccctatgataagtggtatgatgaatgtgttgagtggtgcaaccctcttttgtaaaatcacccatgcatccaacatcttcataattcatatacatagggactcattaggcagtgatcaagggattcccgcacaccctaagagaataaaggtcatttctgagtggcccaccccaccaacaccactcattgagttggtgaggaactatgttccctcatgggaagatgctgatgtgtcattattttctcctatttcttaa

SEQ ID NO: 110452 - DNA, 786 bp, Glycine max
  Peptide Sequence Number=SeqID_227230
atgcctgttgtgacagaacacatgaaatggagaagaccaagaaaccaatttaggaaccccatttcagaaaccgatgatccaatcactcaaatcccttccataatccaatcctctcacagcaaatccaccatctcctctctcttgtcttctttctccacctccggtgaaaccacacatgccagagaccaaaacagaaccaacaacaacaacaaaagcaacagaaaattctctgcagcaaccttcaggggcttcggctgcactgccggttcatcgcagaaggtgtcggtgccggcggtgattcgctcctcagcagattgggaagggaagaggaacagaaagaagaatcacagaaggaaaagtaacagtaacggtaacagtggcaacaacacatgtgatgatgatgatgatgatgtttctggtggaacatttgtggattttcaggatgtttcgtgtggccctggaattggattctcaactgatgctgcatctgtggaatgtgctgtggctaggaagaatgtgtcttcaagaggaaaacttgatgtggtggaagagagggtaacacacagggagagccagaaaactttattccgtgtggatgatatatgtatgcgttcatcttattttggaaggcgcactgtgaagccagaaagcttctcctttctggatgatgaacctgacatttttgcagcacgccctggattagagccttttggcactgctagattctatcgccatgttccacatccttcccctgatggtcttgctgaggctgacttaaatggataa

SEQ ID NO: 110453 - DNA, 447 bp, Glycine max
  Peptide Sequence Number=SeqID_227231
atgaacgcaaaccttctcagaaacttgtccttccacgcgcgccgtcttcgtttctctcccactccttccatcttctctcctacagctacagcacccacctccttctcttctcgctcccatgtccccgacaaaccccactccctccttgaagacattagcaacgaagagttgaagaggcgtgtggcaaagcttcaagagggggatgctgaggcaattccttctgtgtttgaggctatattgcagaggtatttagcagggaagcctatagaagctgatgaggagttgatgagggaaattctagggaagcgggcattgtcggaagatgaagaggacgagtctgattctgattgggaggaaatagatgacactgataatgatgatgaagaagattttgatcctggttttaatggaaggaatggagttgatgaaggaaaatataagagatga

SEQ ID NO: 110454 - DNA, 1408 bp, Glycine max
  Peptide Sequence Number=SeqID_227232
ttatgccaccaatgtctttcacatgatcaagaacccagatcttcgtgcctacaacatcatgatcagagcatatataagcatggagagtggtgatgacacccatttttgcaaggctttgatgttgtataagcaaatgttttgcaaggacattgtgcccaattgtctcactttccccttccttttaaagggttgcactcagtggctggatggtgctactggccaagctattcatacccaagtgattaagtttggattcttaaaggatgtttatgttgccaattctttgatcagcttgtacatggctggtgggttgttgagtaatgccaggaaggtgtttgatgaaatgctggtaacagatgttgtcacttggaactcaatggtgattgggtgtttgagaaatggaggacttgacatggcaatggatttgtttagaaagatgaatgggaggaatatcataacttggaattccattattacagggttggctcaaggggggagcgcaaaggagtcactggaacttttccatgaaatgcagattttgagtgatgatatggttaaaccggataagattacaatagctagtgtcctttcagcttgtgcgcaacttggtgctatagaccatgggaaatgggtgcatggttatctgagaagaaacggcatagagtgtgatgtggtaattggaacagcacttgtcaatatgtatggcaagtgtggggatgtgcagaaagcatttgaaatcttcgaagaaatgcctgagaaggatgcctctgcatggaccgtaatgatttcggtgtttgctcttcatggattaggttggaaggctttcaattgctttttagagatggaaaaagctggagtcaagccaaaccatgtgacatttgttggattattgtcagcgtgcgctcattctggtttggtagaacaaggtcgctggtgctttgatgtaatgaaacgtgtttactcgattgaaccacaagtttatcactatgcttgcatggttgacattcttagtcgagcaaggctgtttgatgagtcagagattctcataagaagcatgccgatgaagccggatgtttatgtttggggtgcattacttggaggttgtcagatgcatgggaatgtggaattaggagaaaaggtagttcatcatttgatagacttggaacctcataatcatgctttctatgtgaactggtgtgatatatatgccaaagctggcatgtttgatgctgccaaaagaattaggaatataatgaaagaaaaaagaatagaaaagaaaatcccaggctgtagcatgattgaaatcaatggagaggttcaagaattctcagctggaggatcatctgaacttcccatgaaagaactagtattggtcttaaatggattaagtaacgaaatgaagatatga

SEQ ID NO: 110455 - DNA, 558 bp, Glycine max
  Peptide Sequence Number=SeqID_227233
atggttgcaatgtgttggaatcaaatgaatgtgcagggttggaaactttacgcagtcaaagagaaaatgaaggcattaaagatcaagattaaaagctggagtagggagacttttggtggcttggatgcgaaaattgaagagttggttagtgaaatggacgtgcttgatacaaacatgattgaggggcagatccaatgctctgatcaaagaagattactctctgaagaatctggagatgaattagacagaaagaaagcatgttatttcagaaatccagggtcagatgaattaaactgggagactctaatagcagacaatgttggtggtgtgaaagatgcagtgaggaattattttgaggaggtttatcaggagccagaacttgacagaccaaatttggatggaatagaattcaaatgtctcagttctatggagtctgaatcctcagttgctgattttgcagatgaggaaattaaagcgacagtgtggagctgtggcaataggaaaagtcttggaccaatagattcaactaagaattttttaaagagtgctggagtatag

SEQ ID NO: 110456 - DNA, 713 bp, Glycine max
  Peptide Sequence Number=SeqID_227234
atggcgaaaaggattaaaaaggtacttccttcagttatatctgactgtcagtgtgcctttatcccggctgaaggactttcaagattaatgagaagtacggtggagaaggatgttttcaaaggctttcaaatggatgatgagacaaatttctctatcttgcagtatacggaggattcgataattgttggcaaagaaactcaagataacctgtgggcattaaaagcaatcttcagaacggagaactttctgcattgcaacattggtattttgcctcttaagttcctagggattccgattggggctaatccacgtaaatgccatacatgggcaccaatcataggatggtctgaaaaccagaagatcaattgggtatcatgggagaagatatgtctcttgaagcaagatggtggtttgggcaacaagaatttggagaaattcaacatttgcctactagataaatggtggtggcagtttctaacagacagatcaatgatttggtacaagttgttatcatatagatatggcaagtcctgcaaggtgattcttagatctagtgcagagaaagcgacaaccaaagaagcctacctagctgagctagtaccaacaccaacaataggattagagtggagatggctcaagaatgggcttcaaggagtatatgaggaaggaaattctgaggactcgtgggagtggaaaggagatgattcaaaaag

SEQ ID NO: 110457 - DNA, 1318 bp, Glycine max
  Peptide Sequence Number=SeqID_227235
tctgtatgtggatgacttaatatacactgggaatgatgagggaatgttctgtgaattcagaaaatctatgaggagcaactttgcaatgaatgatctgggaaggatgagatatttcttgggagtagaagtcaagcaagtggatgatggcattctaatctgtcaacacaaatatgctcaagacatattggcaagatttggcatggagaattgtaatgcagtgtgcaatcctatggtaccaggcaacaagttaaccaaagatgaaggaggaaaatcagtagatgctactaaatacagacaaatgattggaagccccatgtatcttttggccacaagacctgatcttactttttctgtttgtctcattgcaagatacatggatagacccactgaacttcacttagctgcagcgaaaagagttttgaggtatttgaagggcactatggagtttggagtgtggtacaagaaacagaatggaagagtaaatttgcaagggtggactgactcggattatgcaggtgatttagatgacagaaaatccacttctggatatgttttcacctttggatctggaccaatctcttggtcatctaagaagcaggccattgtgaccttatccaccactgaggcaaaatttgtagcagcagcatcgtgtgcttgtcaagctgtttggctcaaaagaatccttgatcaacttggcaaacctcaagacagtggagttgtgatctggtgtgataatagttcttcagtcaagttgtctaaaaacccagtcatgcatgggagatgcaagcatatcgatgtaaggtttcacttcttaagagatcttgcaaaagaaggagttgtaaaactgaagcattgcagcactcaagagcaactggctgacataatgaccaaagccttgaaacttgacagtttttgcaaactaagggaggagttgagcatgtgtgatgttaaagatgataagagaagcttgggcttagttctcttgtatatatgggcttacttgtaccaacatatgaacatgtgccatgttcactccttaaacaacaaggcttgtcctaagcaaaagggccgggagggacaaatggtgagagaattgagagaagtgaaaattgtggatgcagcaaatcttggtttctttggtaatgcctatgcaatattgttggtagtttttgttaccttttgcattataccagcaatcatcttttcttgcgcggatggtgtatctaaagagaaaaattctgctgcagatcaagagccttatggagctggatgtggtgctggatgtggtgccggatgtggtgctggatgtggtgcatga

SEQ ID NO: 110458 - DNA, 168 bp, Glycine max
  Peptide Sequence Number=SeqID_227236
atgaaagagacatataagataagtagaccgataagaggcacttatgagaatgaaaaggcacttatgaggatgaaaagggaaccaaggacccagacgaaccccactagactggaccacgaggctcaagatagtagtgggagcggcacaagacgtggctttcattcataa

SEQ ID NO: 110459 - DNA, 372 bp, Glycine max
  Peptide Sequence Number=SeqID_227237
atggcattttcgttttctttagctctgtcatcgcgccaccatcgtgctgccatcatcgtctcactggcctcatgccgttgggcccgacactggtggcaccatggaggcataccacccttcgtggtagtggcctcctttctcgtgccgttttgggatatagcgggagtgcagtcaaggttggggcattgttatctggtagaaatcttcatgcggtgggagaatttgacacttggtacatttattaatattggttacgtggagagagtggacaagggtattggaaatggcaattatgaggccatggggctctacgtatggacagagggattttggttgagcctcgagcaagttggaaagatatataacaaatag

SEQ ID NO: 110460 - DNA, 546 bp, Glycine max
  Peptide Sequence Number=SeqID_227238
atgaagcaaaaaatagttatcaagctgcaaatggactgcgacaaatgcagaaacaaagccctaaaaattgcagcagaagtacgaggtgtaactacggtgtccctggaaggggacgacaatgatcgcgtggcggtgagcggtgtgaatgtggacatggtttgcttggccaaccagctgaagaagaagttcagctccgtgacgattctcaccgtggtagacctagttaaagaggaggaggcgaagaagaagaaggacgaggaggagaagaagaagaaggaagaggccgagaagaagaggaaggaagaggaagaaaggttgaagaagatgctgcgttctgttctttgcaaaaagtgtaaaagctccagttgccatgccccaagtgtgagggtgactgtaagccatgtatcaattgcctcagctctaagtgtgagtgtgagtgtgagccatgccctaagcctccttcaccctgccctaaatggtgcaactgtcataaatgctatgtgccctatcaacaaccttgttattacccttatcctccccaagtag

SEQ ID NO: 110461 - DNA, 558 bp, Glycine max
  Peptide Sequence Number=SeqID_227239
atgttgctcgacgtcggcgaacgaaccggccagcgcctcgaggcgcgggcggcggctggccatgccctgcagcacccgggcgatgaacggcaattcggcgtagcgctccagccagcgttcctgccacaggtagccgttcaggttctgaaagcgcggcggcgtgagcggcagaaaaggttcgatctggctgcgggcttcctgggtaaactggtgcaggtcgcgcgaaggctcgagctgctgccagtggcgcgccagaaaatggtcccacaccacgtcgagggtgatcggcgccacgcggcggtagggggcgctgaaatagtcgcggctggctttgacctgcggcaggctgtcggtcagcacgtcgacgcggcggtgcatcatgatgccggccaccacctcgggctggtagtcggcggcggggttgccgcgcacgaaatcggccagcaggttgcccagcagcgagctgtccgccagcatggccaggtgaagatgagcgagaaaattcatccctcaactatacccgaagtcaggcaaatcctccttatttcttgccgctga

SEQ ID NO: 110462 - DNA, 330 bp, Glycine max
  Peptide Sequence Number=SeqID_227240
atggagatagcagattttgttcctgtgtgtggaagcatgaagaggtacaggagaaaaagatcaacatatcataagcttaagagaggcaaagaggtaagtgattgcagtagtgttgagaatggttgcatgttgagaccaaaagtgaaaatggttgaagaagagataccaaaagctcatcatcaaccaccaacaaataagattaggttatccataaatctttggaaaaggttgagaaatgcttatgtacagcgtatgcttggcttggctgaacatgttgcgcatttgaacaatggggaaatttgctttctcaagaagatccatgatgatgaa

SEQ ID NO: 110463 - DNA, 255 bp, Glycine max
  Peptide Sequence Number=SeqID_227241
atgaaagattttgttcaagtttctacaagtccttgtaataatagtaataaagataatgctggaagtcgttataaagacatgtgtcgagtgctttttaggattgcaacaagaacagcagaatatgagaaaaccattttgatagttaagaaatttgaggataagattatgcaagaggtggaagcatgtttgaagaacatagtacttgaagagcgtaaatctgaaactgactgtgaaacattgagccacaaaatctag

SEQ ID NO: 110464 - DNA, 351 bp, Glycine max
  Peptide Sequence Number=SeqID_227242
atgcgctgtaaagaagtgaaacgcctgcggaaaggagccaatattgggaaaatacccaagtcccacatcggctgcctcaatccttggagtgcaacttatatacctgttgggcaacttcacttaatgccaattggttttaagatgaaatctaacatggtatcagagcaggctctaaccctgggacctctcattcgcttccgctgcgacaagcacccaccatttgtggttcacgcaccaagcccaataagtgttgggcgtgaagggggtgtattgggaaaatacccaagtcccacatcggctgcctcaatccttggagtgcagcttatatacctgttggacaacttcacttaa

SEQ ID NO: 110465 - DNA, 2010 bp, Glycine max
  Peptide Sequence Number=SeqID_227243
atggatcctccacccctctctgccaccactcaaaaaaaccatcctgactcagtagagtctttctctccacgttcccgaaactcggaaacgtggaatgatgagactctaccggccgttcctggcgccaagctgcgcctcatgtgcagctacggtggccacatcatgccacgccctcacgataagtctctctgctatgtcggcggtgacacgaggatcgtcgttgtggaccgccattcgtcgttgaaagacttgtgtgcaaggctttcccgaaccattctcaatggaagacccttcacactcaagtaccagcttcccaatgaagaccttgatagcctaatcactgttaccactgacgaagaccttgacaacatggtggaagagtatgatcgtataatggcaaaaggttcggcttcttcgcggctcaggttgttcttgttcttcaccaaacctgaggccacagtttcaatggggtcactccttgatgattccaagtcagagacatggtttgttgatgcacttaacaactctggcatgatatcaagagtggtgtcagattctgctgcaggggattcctttgttaaccttgatggtgttggtgttggtgttggtgttggtgttagtgctagtggttcaagcaacaacttggaggctttgcctgatgctaacaactgcaaggttaagaatttgcctgaagtggtgcaagtgcaatcaacacctggttcacctatgatggagaacaacagttcttcttctccttctttctctccttctctagctaatctacctccgattcgggttcgtgttgatgacaatggtagtaggcttcatcaagagaacaaggtcgggatggtggtggaggagcagtttgctcagatgacaattgcaagtggggtgaagccagatgatggattggtgaatgttgtttcttctacagtgcctgtgcctgtaattcctgcagctgtgaccatggcatcagttggggtgattactactagtgataatgtgatgaatagagttgtttatgaggatgagaggtcagatcctgggtttcggaagccccctttgccaatgcagcttgtgcagcctaggactagtggtggcgtgggtttgccttctcctgattcagtagcaagtgatagtagtattgcatctgcaaattctttctccaagactgtttactaccaagatcaagtccaagccacactactagacaacaaagttgttgctgctatgccaaatgcaaagagtgaaatatctgatcagatgattcaggtccaaggacaacttcaagattctggctacacattacccccacaattggatcaaaccaagcaacaattccagcagcagcagccattgatccatgccaacaatcactacatccaccaccctgcagccacaggtccagtgccagtttcatcatactacccagtttatgccccaccaccacaactacaacaacttcaccctcatataagtcaacaacagtacccagtttatgtgatgcctgttggacctacacaagtaacacaaccctacaacatggcattgcagcacaatatttctgaccctaatgtggtagcttcaagcaggccattaatgccacaaagtgttgttacctcagcagcatacaaagatggtactccacctatttactccaccaagtcacttagcccaactatggctccatcaaatcctggatatgctccaatacctaccaaccaatttcagccacagtatgtgggtttgtctcagttccatcatcaaccacagtccattgctgtggctccctctagtactactactactactactaattatggctatgaatatggtggccatgtgcaagatcaagcttactacactcaacaacaaaccactaatgctacattgcttcctcagtaccaatccatgaccccagctgcagctgctgcagcactatcagatgcttcaaaacagtttcctgcagacaacattcagcagccaaatagagcatcacaaccagtatga

SEQ ID NO: 110466 - DNA, 735 bp, Glycine max
  Peptide Sequence Number=SeqID_227244
atggagaagaaaggcggcaagcggcggtcgatatgcaccgccgacgagcttcaccgcgtggcagtttcgaactccaattggaagctcgctctgtggcgctaccgtccttctcctgaggccctgtcgaggaatcacccgcttttgttgttgtcaggggttgctaccaatgcaataggctatgatctttctcctgagtcttcatttgctcggtacatgtcagcccaaggtttcgatacatggattcttgaggttcgaggtgctgggttgagcacacttggagatagcttggaggaagatgaggaatgcctcaagaatttttctaagattgattctgttattaatgatgatattggtgaaagcagtgcttcttttgtatcagaagttcctcatatgaaaacgagaggatcagaggtagtaactaaatatgaggaaatgcagctaatgacgaggttcatggagattcttacaaggatatctgaaaggcttgcaggatttctcaatggagatttgttggaaggacagaactctgcaattgctggacaaatcaaggatttcaatcggaggcttcgagctattattgaaggtcagctgttgttcccagcaaaaattttagaattgcaagaccgttttgctgccaatctagaagagttccagaaacagcttgagctgatggtcaagtatgattgggactttgaccattatttggaagaggacgtacctgctgctgtgagatga

SEQ ID NO: 110467 - DNA, 435 bp, Glycine max
  Peptide Sequence Number=SeqID_227245
atggctagaagtcaagacaagtcaatggcagaaatcgaccaaggtaagacgatgaccggacacgattggccattggattttttgtttcctacttacaagtacatagggacggatgcaagtggggatagggtcacgaccgaccgatcgttgccccttcccggcgctaaacaagcagagaacgttgctgcaaggcagcccagttcaagtgggcaaacgctaacccataaggaaggaggagacatggttaatgttcccctaaaaaaaaaaaagtacaggttagctcgcctgggcgagatgagctcgcctgggcgagcaacccctgcattaggcctatgttgtattctgaagcaatggggcatgccacattgtccccattctcttgcaatttgtgtccaaacgtgcgccccccaagtgctcagtgaaatgccccaatga

SEQ ID NO: 110468 - DNA, 848 bp, Glycine max
  Peptide Sequence Number=SeqID_227246
cgcgcccaggcgaagtccggactggcgctggtgcagcttggcgtggcgctacagcagatgggcgatacgcagcgcgcgcagctggcgctgatgcagggcatcgcgctgcaacgccagctgacatgtggctgggcgattacggcagcccgctgcgtgaccgcgcgctgacgctggcgctgctgagggaaaatcagctgctgccggcgcagcaggggccattgctgattgaactggcgcaaacgctgcacgggcagcgctggttctccactcaggagaacaatgtgctgttcctcgccgcgcggacgctgcagcagcatccgggtgaagtctggcaggccacgctgcaggaccagccgctgcgcagcgatcggccgctgagtctcgggctgagcgcccagcagttgcagcaggggctgacggtgaccagcgacacgccgtcgccgctgtacggcacgctcaatgtggtcggctatccgcgcaccgcaccgtcgccggtcagcaacgtgctgagcatcagtcgcgaatacttcacgctggacggcaaaccggccgatctcaataaccttaagagcggtgagctgctggtggtgcggctgaaggtgggcgccagacagcgcgtcagcgatgcactggtggtggatctgctgccagccggactggagctggaaaatcaaaacctgagcgacagcagcgccagcctgggcgacagtgccgatgcgctgaaagagagcatgatggacatgcagcaggccaacattaaacatcttgagttccgcgacgaccgctttgtcgccgcgctggcgctggatggctacacgcccggcacgctgctgtatctggcgcgcgcg

SEQ ID NO: 110469 - DNA, 411 bp, Glycine max
  Peptide Sequence Number=SeqID_227247
atggtgggttacacaccttcaagctttccggatttggtcttcgctagagaaatgatcgaagtgggtctgaaaagaggcaaatctgatcatcatgctttgataaatgcaaaaaaaaaaactggggcaaatgaagagggtgagaatgagggagaaacccatgctgtgactgtcattcctatacggccaagtttcccaccaacccaacaatgtcattactcagccaatgacaacccttctccttacccaccacccagctatccacaaaggccatccctaaatcaaccacaaagtctatctaccgcacttccaatgacgaacaccacctttagcacaaaccaaaccaccaaccaaaaaggaattttgcagcaaaagcctgtaggattcaccccaaatgccggtgtcatatgctaa

SEQ ID NO: 110470 - DNA, 459 bp, Glycine max
  Peptide Sequence Number=SeqID_227248
atgatgcccgcctcgcacaacggcttcaatataaacctcttagaggttatcaaatctttcaattgctttggcttctggggtctgcactcctctatcgcattaactattggccctcatgactggcaagagggtttgtctatgtttggaccatcctcttggaacatcagccaacttgcattgatcaaacttcagaccttatgtttgaaggacatacattgtgtcgcaacctacccttcggcgggagggcgacacggggctcgcgggtgcgtcttctataggaggaaaatgcgtggagtcgccacaaatgtttattcgaggaaaacgtcggaaaaaccagaaaggtgtggtctacgaagtttaagtgtgaaaggttcgggagttgtatttacgcacggggaagggtgtttcccttgctcctacgtattccttaattatgatgaggaaatcagacctacgtag

SEQ ID NO: 110471 - DNA, 267 bp, Glycine max
  Peptide Sequence Number=SeqID_227249
gtgggttttgtggttgattcagggatggcctttgtggataactgggtggtgggtaaggagaagggttgttattggctgagtaatgatgttgttgagatggtaggggagtttggccatgtaggaatgatagtcgcagcatgggtttctccttcattctctccctcttcatttgccctctcattcgtccaagcaggatggtcaaatttgcctctttttagacccacttcaatcattttgccagcaaagaccaaaatccgtaaagcttaa

SEQ ID NO: 110472 - DNA, 294 bp, Glycine max
  Peptide Sequence Number=SeqID_227250
atgacggtgtttaatcaccctgaagttgagcagctggaattacagggttatcgggtcattaaaggattactggaaatttatcagtcgctgatgcagctcgattatgaacagtttaccacgttaatgaatgaggattttctcgcgaaacatccgatcgaaacccgactgtttcataaactttccggtaaacatcgtaaagcttatcagcaacagatgcgtaacctggactatatcagcgggatgacggacaattacgcctgggatgagtatcgtcggttgatggcggtggaataa

SEQ ID NO: 110473 - DNA, 417 bp, Glycine max
  Peptide Sequence Number=SeqID_227251
atggcgttaagccctgtcagtgttttcgcggcggagacagcgtcttcctccagtcagcaactgcccagcctggcacccatgctggaaaaagtgatgccttccgtggtcagtatcagcgtggaaggcagcaccacggtgaaaaccccgcgcatgccgcagcagttccagcaattctttggcgataattccccgttctgtcaggacggatcgccgttccagggttcacccatgtgccagggcggcggcggtgacggtagcgacgatggcgccaacgcgcagaagcagcagttccgcgcgctcggttccggcgtaatcatcaacgccgacaaaggctatgtggttaccaacaaccacgtggtagataacgcccaccaaaattcaggtacagctgagcgatggccgtcgctacgatgctaa

SEQ ID NO: 110474 - DNA, 354 bp, Glycine max
  Peptide Sequence Number=SeqID_227252
atgagacaactaggctatcctatgagaggggcaccattgaaagagagtatcgcccctttcatcgctcgaggcttcagtgaccccaatgcaaaaatgcttcagaaagtccaaaaagcatggaatgtggtgcaaagaaaggataaggagcttagaggaagcatcaacggtgttattgtggatatcatcaatgaggctgaagtccctaaggagagcgaagaagtgcaagccttgaaagcggaacttgaaagaacacgagtggtcaaggaaaagatcaagatgacagccatcagggtcaggaaagagtgtgacgagctgagggacgtcaacatggccatagccgaagcaatagaatga

SEQ ID NO: 110475 - DNA, 147 bp, Glycine max
  Peptide Sequence Number=SeqID_227253
atggcaagcgcgtcaataagagagagtgaaacatggagtggtcacatcacaaggccattcttattgaactctcaaatagccggggacatgctaggtgcacccaacaacattgctggtgcacccagcacaaaaatggaggacacatga

SEQ ID NO: 110476 - DNA, 465 bp, Glycine max
  Peptide Sequence Number=SeqID_227254
atgaatttgaatcctagtggactcactgaggcaacaggcaaggaagacaagtgtgccacaaagaggaagaagacgaacgactactattactctctaaatctcctcgtggacgtaattctaacgaatattatggtgatggtgcaaagggtgacagtgaagaaaacaacgaagaagaagatcgggaatcgggaactgcacatggacaatggtcgcaaggcgctaaaacaacaaagaagaagaagaaaatctttgctccattgtgttactcactctggcgtccatttcatggtctttgttctctttgatgtgtattcatcttctctttgtggcatgatgatgggtgttggtggtggatctagatggggttgtgcggagggtggtcacactagagataatagtgacgcggagggtggtcgcacggattcgtcttctctttgtggtcgtgtggtggttgttgttgtttga

SEQ ID NO: 110477 - DNA, 183 bp, Glycine max
  Peptide Sequence Number=SeqID_227255
atggaagagagagaaccgaagatcttcataccaaataaattttcggcaagattgccattctcgactggcgaagtcccaccccacatgaacaaagaggaaaagaccgaaacacccagcttcctctccaaaaacactaccctcgagaaaatcctattggtccgtgatcgtacgtttgatcattga

SEQ ID NO: 110478 - DNA, 414 bp, Glycine max
  Peptide Sequence Number=SeqID_227256
atgactagttcacatgggtcagcttgttcaggactgatgataatgttggaaggtgccaaggctaccacagaaactgttaatgcattgagaactaaagctgctgctataagggcattaccttataacagttataggaatgaaactagagctaagggtataaggttcatccagagtaacggcaccttctatgaaacctatgaagcatacataaacaatgcaaagaattcaagttcacagggtgatgtcattttggcagcaggggttgggcaaggaatgcaagacaacccttggcaagcagttttggtggactcaaagccacagaataggctccctgatccaccccaaattgttggcataacagatgacttcaagatcatagttgaagcatcagtacttcccctaacttcgaactaa

SEQ ID NO: 110479 - DNA, 285 bp, Glycine max
  Peptide Sequence Number=SeqID_227257
atgttccttctgtggatgaaagaaatagcaagtacaactcctaaagctgcaacaacggaggctcacttggttgttcttaggaattcagcagatgaagtaagatcaaaggaaaattattctccaaaaattcacctttacattgtgtcgcaacctacccttcggcaggagggcgacacgagactcacgggtgcgtcttccaagggaggaaggtgtgcggagtcgccaccaacgtttattcgaggaaaaagtcagaaaaatcagaaagatgtggtctacgaactttaa

SEQ ID NO: 110480 - DNA, 120 bp, Glycine max
  Peptide Sequence Number=SeqID_227258
atggaggaaaacgtggaggaagctttggctgcgcacgagctccgatttcgcccaataagcctttctggtaatcgattacaggatgttgtaatcgattacaggcggcctgttcatgtgtaa

SEQ ID NO: 110481 - DNA, 255 bp, Glycine max
  Peptide Sequence Number=SeqID_227259
atggcagaagagagaaggcatcttctcgttcagaagcttagacagcttgacaatgagcaggagggcaagagcgaaggacaggttgcagagttattgagtcagtatcctcgtcgtgttgatgcatttaaggagagaattgctaagtctgagcatatggctgttgagcagaggattgctatcattgagcaactaatggaggccgtgatgctgtggcttgcagattttgagcggaggttgaggccccactttgagtag

SEQ ID NO: 110482 - DNA, 1134 bp, Glycine max
  Peptide Sequence Number=SeqID_227260
atggtatacaagttgaacaaggcgctctatgggctcaaacaagcaccaagagcatggaataggagaattgatgcatatcttgctcaacttggcttcaaaaggtgtgtggtagaacatggagtttatgtcatgttgaaggaggataacaaggtgttaatggtgtgcctatacgttgatgatttactagtgactggtaatcatacaacagagattgataatttcacttcactcatgatgagtgaatttgaaatgactaacttagggaaattgtcatatttccttgggttagaattcttgtggactgaatatgggattgtcatgcatcaaaggaaatatgctggtgaaattctgaagagatttgggatggaggattgcaatgttgcaatcacaccggcagaaacaaaccagaagcttgaagacaagcctgaggaagaaggtgttgatccaactggttacaaacagttggtaggctcactgagatacctctgcaatagcagaccagatatctgttatgccgtaggcgtgctgagtaaattcatgaataggccaaagaaatctcatttcttggctgccaagagggttctaaggtatgtgaagggaactatgcagtatggtgtgatgtttccaagtagtgttgatggtgctgagatgaaattgattggttactcagatgctgattggtgtggggacaggacagataggagaagcacatctggttacttgttcaaatttggtggagctgctgtgtcttggagctcaaagaaacaaccagttactgctctctcaagctgtgaggcagagtatatatctggttcctttgctgcttgtcaagcaatttggttgaaatcagtgcttgatgagttgaaatgtgaagtacatatgccactgttattactgatagataataaatcagcaattagtcttgctaaaaacccagtctcacatgggcgtagcaagcacatcgaaacaaggtttcatttcatcagagaacaagtgaataatggagttctgaaattgatttactgtcccactgaagatcagttagcagacctgctaaccaaggctgttaaaccagacagattcataaagctaagggaagagatcggagtcatttgttttgaagatttgaattaa

SEQ ID NO: 110483 - DNA, 163 bp, Glycine max
  Peptide Sequence Number=SeqID_227261
atgacaaagattaatgcgacaaagatgaatggcctcgctaatgtgtcatcgatcaccttcactcaccagccacaagaaataagtagtgatcacccgggagttaaacttgtgcctaatgcagttattgagagaatgataacgtgggtgggaccaaaccgtgatc

SEQ ID NO: 110484 - DNA, 369 bp, Glycine max
  Peptide Sequence Number=SeqID_227262
atgtcgaaagggggttcgcttcaaaaggacgtgccatggagagcatcgtcttcttctgcgaagcccatccccagaattcatcacagtccgcttcttcgcgtttctcgaacacctgtttccgattacggtatctccgtcatgaggcatccggaccctatagggggtggattgggtgacgaggccacagtggaaccagctggccctgattgcctcgtccctggccagaaaatgcccatccaattacttggccttcaggtctggccaatccatgttgacctgaagtttttggaaccggttgggcgagaacttaagatgcttggaaaggctacggaggttttggatgacgccacttccagtgaaggaagataa

SEQ ID NO: 110485 - DNA, 231 bp, Glycine max
  Peptide Sequence Number=SeqID_227263
atgatgtgggatctcaatagtcaatacacccccctcacacccaggattggacatctagagcatggatattataggattgggaaagctatggggattggtagatgcagagggaaaatcatgggaatgagtagatttttgcaacagttgatgatggctcaatatcatatctatgacaaggtccgataccatcttgaatttgagtttagcttaaccccaaaagcaacatcgtga

SEQ ID NO: 110486 - DNA, 408 bp, Glycine max
  Peptide Sequence Number=SeqID_227264
atgcaggttgcagaacgagctctctttttgtggaataatgagcatattgtcagcttaattgcccaaaacaggactgtagtattacccataatatttgaagcattggagaaaaatatcaagagtcattggaaccaggctgttcacggcctgactgtgaacgttcggaaaatgttcatagaaatggatgccgaattgtttgaagagtgtcagaggcagtatgaagagagggaggctaaagcaaaagaattagaagagcagcgggaattgaattggaaaagactggcagatgcagctgcacagaatggggtggatatgttggataatcagcaagttgaagaagcagtgattaatggatcagcctactgccggtgccctcttccttggttcttacatctaagaaccacataa

SEQ ID NO: 110487 - DNA, 1413 bp, Glycine max
  Peptide Sequence Number=SeqID_227265
atgctcctccaaacaacctgcatttttctactctcagttcttctgagctcgttttcaccacttggaacagcaatgctcaacctcactcttcccggagctcatcctgaccccgaagccgttgcccacgaagttcataggaaggttaatgcttcaatcgcaagaagggaaatgctatcagtgtctgaaaaagacgggtcttcgtgcctaacgggaaatcccatcgatgattgttggaaatgtgacccagattggccaaataaccggcagaggctagctgactgcgtcattgggttcggtcagtacgcaaagggaggaaaaggtggtgaattttacgttgttactgattcctctgatgatgaccctgtgaacccaaaacctggcacgcttagatacgcagtgatacagaacgagccactgtggatcgtgttccctagtaacatgatgattaagctgtctcaggaactgatttttaacagctacaagaccattgatgggcgtggagctgatgtgcacattgtgggaggagggtgcattactttgcagtttataagcaatgtcatcattcacaacattcacatccatcattgtcatccctcagggaacacaaacgttcggtcaagcccggagcactacggattccggacagaatcagacggagacggcatctccatcttcgggtcgaaggacatatggatcgaccactgcaccctttcacggtgcaaggacggtctgatcgacgcggtgatggggtccacagggataaccatctccaacaacatgctatcccaccacaacgaggtcatgctactcggccacagcgacgactacctccctgactccggaatgcaggtcaccatcgccttcaaccacttcggggagaagctcgtccagcgcatgccccgctgccggaggggatacatccacgtcgtcaacaacgacttcaccgagtgggagatgtacgccattggtggcagcggcgagcccaccataaacagccagggtaaccgttacatggcaccggaaaaccccttcgctaaggaagttactaagagagtcgacacgcaacagtccaagtggaagggatggaactggcgctccgagggtgacattctcctgaacggggccttttttgttgcgtctggtgaagaacttgaagttaagtatgagaaggcatacagcgtccaacccaaatccgctgatcgcatctcttttctcaccatgtccgcaggtgttctcggtaatgccagggacaacaaccttggcatgtggagcagaggacctgccgatgacaccacggagtccggaatggaatacacggatgacatgtccaccactgcaacaatgcttctgtcttcttttttgcttctcttcttcttgtcttacacgatattacgcttgacggttattctttaa

SEQ ID NO: 110488 - DNA, 324 bp, Glycine max
  Peptide Sequence Number=SeqID_227266
atggttcatgttagcccacagcctgatggaacaaataagactgcggttgttggtattctgtacaagtacggttcccctgatccgttgctctctaagttgggaaaatacataacggagattcctgaagaggatgaagaaaaaagcgtaggggtgattgatccctcaaaaatcatgaagggcagcaagatgtactacaggtacatgggatcactcactgtacctccttgcactgaaggcatcatttggaccgttgataagaaggtaagaactgtttcaagggggcaagtgaagttggtcaaggatacagtacttaattatatgtaa

SEQ ID NO: 110489 - DNA, 177 bp, Glycine max
  Peptide Sequence Number=SeqID_227267
atgcatattgttgtggtacttaggaacggatgcaagtggggatggggtcacgaccgaccgattgttgcccctttctctacgctaaacaagcagagaacgtcgcgcaaggccgcccagtatcctttgaattcacagtattttactaccattgtttgttttttagtaattaacgcctaa

SEQ ID NO: 110490 - DNA, 405 bp, Glycine max
  Peptide Sequence Number=SeqID_227268
atggttagaactagaggtctaggtcatgccttaggcagggtcataggtagagccctggggagagaggatcatcatcattcagatgatgttcccaagcagcgaaggactacaacatccgcatataagtggccgcgtgacccatcagtgttgactgactatggtgaccatgttgcagtcatcatatggaatggagaggaacgtcctgaattgaagctatcctcccatggaaggaaggttcagaaatttgggaagtctgctcctgaaattgaagggctagtcgctgccacaggattaagttttttgatcgcatattcagtagacactggcgatcggggacttatatccgcttttgtagagaggtggcataaggaaactagcaatttccatcttcatgttggagagtaa

SEQ ID NO: 110491 - DNA, 254 bp, Glycine max
  Peptide Sequence Number=SeqID_227269
atggtgggttacacaccttccagctttgcggatatggtcttcgccggcaaaaggatcgaagtgggtctggaaagaggcaaatttggtcatcctgctttgataaaaactggggcaaatgaagaggatgagagtgagggagaaacccttgatgtggctgccattcctatatggccaagtttcccaccaacccaaaaatgtcattactcaaccaataacaacccatctccttacccaccacccagttatccacaaag

SEQ ID NO: 110492 - DNA, 150 bp, Glycine max
  Peptide Sequence Number=SeqID_227270
atggcacggtgggagcttgggtcaacacacgactcgaggtacagtagtgatgccatggcgggagcttcggtcaacacacgacaccagctttctacgatagtgttgcaatacttgttgttgaagaactcaatcgaagaagggtttgagtaa

SEQ ID NO: 110493 - DNA, 372 bp, Glycine max
  Peptide Sequence Number=SeqID_227271
atgtctcaaggaatcagtgaatctaatcctcatctacagtgtcaaccattttttaacaactctgattggactgtgatactaagtcgtgaaaataaactcagcagaattccccaacaaatgggtttagccttccatcacatggaagcacctttaacaatcaagaagtgggcttttagagaaaacaccagattacatagcaatggggatgtctcctccacctctagaaacctagaaatctctcctagacctaagatcctcctaaaagctaaggtctttccttccttgctctgtttttcgcctcttttctctgctcttcacaaagctctcttagtctattcggactccctttctttttcttcacttcaggcttaa

SEQ ID NO: 110494 - DNA, 339 bp, Glycine max
  Peptide Sequence Number=SeqID_227272
atggggatcgcacccacaaagacacccagtgaacctgaagaagtccaacagggccctggggtttccagctctgggttacgggcctctatcagtcctacagggtgcccgtacccccccgacaagggatcgcgcctgcaagacacccagtggacccgaagaagtccaacagggtcttggagttgtcaagctctaatcacgggtctctgtcagttctacggagtacctgtcacctccagcaagggcatcaggccccctactaatcgagctttcatcaagaagtactgcgtctccaggcaggcgcagggcgaaacaccacagcagcctggggatggtcggtag

SEQ ID NO: 110495 - DNA, 105 bp, Glycine max
  Peptide Sequence Number=SeqID_227273
atggccgaccagcaggcgaccaaatccaaagccaaagctaaagacgttaaaaaagcgctactaggaggcaacctagtaccttttgaatctgtgcttgttatttga

SEQ ID NO: 110496 - DNA, 260 bp, Glycine max
  Peptide Sequence Number=SeqID_227274
gcggtgttgtccttgctgaggtgttgttggctgattcacgattcactcgaccggatatgggttttcacccaacaaaactcaatttcgtgcctagcgatgcggatgaggcgccactcgatgtttccatttgcctgcatgcctttggtattgtggggtgtggttcgtttagtggtgtcaagtcttgcgaacgtgaggacccattccatccaggcctctttgtggggacgctggaggatttcaaagtcccacacgtgaaccac

SEQ ID NO: 110497 - DNA, 298 bp, Glycine max
  Peptide Sequence Number=SeqID_227275
catgaccatagatcaacctcttctccctatgtctgacacagacccggtccctagtggagtcaccatctgtcgcaaacaaccctttgacgggagggtgaggcaaaaagccaaaggagcgccttccaaaaaggaaaacgcgtgggagtcaccaccaacatttattcgaggaaaacctccattagagcttgtaagcctaggatcttcttcatcaatggattcctttgcttcttggaagatgaatggcagcggaatggagaaagggaaagagagaggagacgccacttcaaggagaagatga

SEQ ID NO: 110498 - DNA, 288 bp, Glycine max
  Peptide Sequence Number=SeqID_227276
atgtgggtgcaagccattggtccatttgctcaagtgacctgtgctcctgagtttggacttccaagaccattcaatcagagattactcgtcttgcacgttgggggggctgccgtaaaacaacgtggacaacccttcccttgtgttcaagaatcccctacaacaagagacccacggtctcttaatcccttttcagaaataagaagaagagaagaagagatctctcttaaaagagatagattgtacaatgaagatcaatcaaaattccttattgaatatgcaagtggttga

SEQ ID NO: 110499 - DNA, 227 bp, Glycine max
  Peptide Sequence Number=SeqID_227277
cccatgagctcaaaatctaccctaaggatcaagagaaccctagggccttcccttggatctctggcccaatctgcttggattcttctatccaatgcccttgcggggtaggattgcatcaactaggctgcctcccagcggcgcttttcgcttgtccagagctgggcatgggacgacgatttatcgatcatgatcctagcctccacttgcgtccatccctaagtacttga

SEQ ID NO: 110500 - DNA, 318 bp, Glycine max
  Peptide Sequence Number=SeqID_227278
atgcagcctcaaagccatatttcgattgcaattttgctaatatccatcctattttgttccgtatcaactagagctcttgatgaacctgggtatggttacaatgaaaaaagtgcaaatggcccccgatattggggtgatctcaaagaagaatgggcagcttgtaaaatagggaaaattcaatctcctattgatttgtccactaatggagtggaagtgatccccaagttagggggactaaagtactggaactataagcctcaacatgcaaccgtctccaacaggggtcatgatgttgcagttagtacaaacatcatctaa

SEQ ID NO: 110501 - DNA, 336 bp, Glycine max
  Peptide Sequence Number=SeqID_227279
atgatgatgaaagaagaaagaagaaggttcctcttttgccccaaaatgctgagtgcgatcaaacttgggcacatgagattcaattgtcatgtgtttaaaagaagaatggaaaaatccgacaagacgaatttcaaagagaagaaagaaaagaaaggatatatcacttgggaagataatgtcataaattattcaagtgattcagagaagaaaaccataagtttgggtatcatgatgaaagactatgaaaatggagaagagcaaagtcgatacattgatagtaatttctccaaacacatggcatgcatcaaagtttattcatatttctcctcaagataa

SEQ ID NO: 110502 - DNA, 276 bp, Glycine max
  Peptide Sequence Number=SeqID_227280
atggcgattccgtttgaactatactacaacatcgaaaacgatattgaactgattgaagaggcagaagaatatggaaccgctgtgccatctcctagggcttcgcacgaatcacagaatcacgatgtgaggaaactctatgcttcccaagtagttgacgttgatgaagaatctcagaagagaattcggtcacttgaggccaaatattctgcctttgaaagtaaggtaggattggatgccaggccattgaggctatcttttcttcctggctttgattaa

SEQ ID NO: 110503 - DNA, 738 bp, Glycine max
  Peptide Sequence Number=SeqID_227281
atggcgaatcgggtacaagtattcttcaaccaatttccacaattcgactaccccgaccccgaccccgacccaccatttgaccttcttagcattcacgatgaagaagaatatggaaccagcgacgaagataactacgacgcaatctacatcctctctttgccaagaacaataacaactaatccttcttcatataaccaacaagaactaatcgttatacccgacgacgacgaatcacagaattgctttcgagaggacgggtcaaacaaacgctgcaggaccgaattagagagcgaggcttctcgttccaaagacattgaccatctactttgccctatttgcatggacgtttggaccagtagcggcgaccatcatatctgttgtcttccttgtggacacatgtatggcttgtcttgcatcaaaaaatggcttcaacagcataggaattccaataagtgtcctcaatgtaataggaattgttcgattaaggatgtgaggaaactctatgcctctccaggagttgccgttgatgaagaatctctcaagagaattcggtcacttgaggccaaatgtactgctcttgaaagtaaggacaatgattggcgcaagaaagaagccgaatggcagaagagagaagctgcattgcatcttcaagttgagaagcttacaaaggatattggtggcggcaagaggcaaggaccggtttacgacgctggagatccttcattgagtgagcattga

SEQ ID NO: 110504 - DNA, 163 bp, Glycine max
  Peptide Sequence Number=SeqID_227282
gtgttttactctgttgggaattgatagaaacaagattatcaaaaccgaattgataaatccatgtcctgaatcacaggttaagcgggcaattactgaagaactgaagcaatcaaagattttggcctacgtaacagctctcaaaaagttgtgcaatcatccaaag

SEQ ID NO: 110505 - DNA, 1243 bp, Glycine max
  Peptide Sequence Number=SeqID_227283
atgacgcttcctcggcacgactgttcgttcctcgcgctgctgcggtacgcctcagccgtgactgcggcgagcgtggcgggctggcagttaacggcatcacatgaggacattcccatgaagaagcgattttccgacgaacagatcatcagtattctccgcgaggccgaagccggggtttcagccctggaactctgccgtaagcatgctatttcagacgccaccttttacacctggcgcaggaagtctggcggcatggaagtccccgaagtgaagcggctcagccatgctggattaggaggcgcttcaggtggctccgggccgaaagctctgacgacagaccagaagcgggaagccgtggaagccatgtgtgagacaacgggtctgtcgcaacgccgtgcctgcaggctggccggtctgtcactttcaacctgccgttattcggctcagcgcccggctgctgacgcgcagctgtctttacgtatcacagagctggcacctgaacgccgatttggttaccggcgcatctggcagttattgcatcgggagggctttcacgtcaaccacaggcgggtttaccgcatctgtcaccttaacggtctgggtgtaaaacgcaggcggcgccgtaaggggctggcgactgaacggcttccgcttcttcgcccggatgcgccgaacctgacatggtcgatggattttgtcatggattcacttgccagctgcggccggattaagtgcctgacctgcgtggatgatttcacgaagaagtgcctgacgatcaccacggcattcgggattacaggcgttcaggtgacacgtattctggacagcattgcgctgtctcaaggctatcctgcaacgataagaaccgatcagggcccggaatttacctgccgcgcgctcgaacaatgggcgtttgaacatggcgctgagctgcgcttaatccagccgggcaagccagcgcagaacggatttactgagggtttcaacggtcgctttcgggaggaatgcctgaatgaacacgggttcggcgatattcttcatgcccggaaaatcattaatgactggcggcaggactataacgagtccagacctcattcatcgctgaaataccagacgccggctgaatttgcagcaagctggagaaatggaaaattagaaggtcaccaagaccggactggtcgaaaccgtcaagcaccttcatcagctgcacgctgctcgcccgcggcgtatcctcatcgaacag

SEQ ID NO: 110506 - DNA, 207 bp, Glycine max
  Peptide Sequence Number=SeqID_227284
atgtgcacatcataccaactggataaggctcctctaaagtatgtttgtcatcaaagcaagcaatggttcctatatcaatatccttttgggttgagtaggtggctaccttaccctctggttgacttgatactggaaggacttcttgaactactacagaataaagaatgtgctcactggaaagctaagtatgtatctggctggatctaa

SEQ ID NO: 110507 - DNA, 150 bp, Glycine max
  Peptide Sequence Number=SeqID_227285
atgaaaagagaggctgaagttggaagacatgtggttggagaccgcgagtgggaagtttatagaatcttgcttgatgaaggggagggtttatccattccaaggaataagattgagaaaggagtttggaagatgttgatgggttgggagtga

SEQ ID NO: 110508 - DNA, 1542 bp, Glycine max
  Peptide Sequence Number=SeqID_227286
atggatgaagatcctaagagaatggaagaaggcctcaattcagcattgaatggtgatggcaataaggatgacttgaagaagagggcaaccattaaaaccagtaatggaggttctatttttgagcatgacaaagacacaatggctaagcctgtggctgagggtgagtccgtacagcaaatagctgaacaggagcaaccaccggttaagcagaagacaaagagggttgcaacccttgatgcatttaggggtctcaccatagtgttgatgattctggtagacgatgctggtgaagcttatccacgcattgatcattccccttggaatggatgtactttggcggatttcgttatgcctttctttcttttcattgttggggttgccatagcccttgcactaaagagaatctcaaagataaagcattccgtaaagaagataatccttaggacattgaagcttctcttctggggtataattttgcaagggggttactctcatgcccctgatgatctcgaatatggagttaacatgaaatttatacgatggtgtggcattctccagagaatcgctcttgtatactgtgttgtagctctaatagaaacatttaccaccaagcttagacccactacgttggcttctggacacctatccatttttgctgcttataaatggcaatggtttgggggcttcgtggcatttctcatttatatgatcacaaccttcagcctctacgttccagattggagtttcgtggatcactttaacggcgatgaaccaaagagatacacggtcatatgtgggatgagaggacacctagggccagcatgtaatgctgttgggcacgtggaccgacaagtttggggggtcaaccatctttattctcaaccagtttggagacgcttgaaggcgtgtacattcagttctccaggcagtggtccttttcgtgatgatgccccaagttggtgtcttgctccttttgaacccgaaggcttgttgagttctatatcagcaatcctcagtggcactatcggcatccattatgggcacgtcctgattcacttcaagggtcattcggagaggctaaaacaatgggtctcaatggggtttgtgttactcatcatagccatcatccttcacttcacagatgctttaccaattaacaagcaactctacagcttcagctatgtttgtttcacagctggggcagctggaattgtcttctctgggttctacatactgatcgatgtttgggggctccgcacaccattcctgttcttggagtggataggaatgaatgctatgctagtgtttgtgatggcagcggagggcatctttgcagcatttgtaaatggatggtattatgaagatccacgtagctcactagttagcattactaaggtacactggatcaagaagcatgtgtttgtcaatgtttggcactcagagagggtgggaaccatcttatatgtcatctttgcagaaatcactttctggagtgtggttgctggcgtcttacacaaattaggaatatattggaaactataa

SEQ ID NO: 110509 - DNA, 732 bp, Glycine max
  Peptide Sequence Number=SeqID_227287
atgaagaccttgatctacaatgttctcacggggcgttggttcatgctctttgcatcattactcatcatggctgcagcaggagcagcctacatgttcggcatgtactctaacgaggtcaaaacctccttaggatatgaccaaaccactctcaacttgctaagcttcttcaaagatgttagtgccaccgttggaatcatcatgaacttctttggttacttcataatatttcttgctgtcactggccgcattgccaaaccccaagcgtggaaaatgtgtctctacatttgcattggcttaaattctcaaactttcaccaacatgggtggtactgtcacgtgtgtgaaaaacttccctggaagccgtggcaatgttttaggcttactcaaaggttacgttggttcaagtagtgccatcgttgcacagctctaccatgctttctatggtgatcataaccctcaggctgttattttactcattgcttggcttcctgctgctgtttccttccttttccttccaacaattcggatattcaacagcgttcaccatcccaacgagaacaaagttttctaccaccttctttatatttcactcgcccttgccgggtttctcatggttcttataatcatgcaaaacaagctcagtttcacaagaccagaatacgtaaccgttggtgttgtggtttttatctttctccttctcccacttgttgaggtgtttttagagaagaaataa

SEQ ID NO: 110510 - DNA, 786 bp, Glycine max
  Peptide Sequence Number=SeqID_227288
ccttcagaggactcccacgtcctcgcctgcagaaggacgcatgccctcgcctttagaggactacacgtcctcgccttcaaaagactccacgtactcaccttcagaaggctgcacgtcctcgccttcagaggactggacgtcgtcgcctatagaggactacatgtcttcgccatcagagggctgcaggccctcaccttcagaggactacacgtcctcgccatcagaggactgcacgtcctcacctttagaggactacacgtcctcgccatcagaggaatgcatatcctcacctttagagggctacacgtcctcgccatcagtggactgcatatgctcaccttgagagggctacacgtcctcgccttcagagggccgcacgccctccctttcagaggactccacgtccttgccatcagagcgctgcacatcctccccttcagaagactacacatcctcgccatcagaggactgcacgtcctcaccttcagaggactgcacgttttcgcctgcagaggactgcaccccctcgccatcagagggctacacgccctcgccattagaggactatacgtcctcgccttcagaggactgcacgtcctcgccttcagaggactcgacgtcctcgcctacagagtactacacgtcctcgccatcggaggactacacgccctcacctttagaggaccacacgttctcgccatcagagggttgcacgccctcaccttcagaggactacacgtcctccccatcagagggctgcacgccctcacctttagaggactacat

SEQ ID NO: 110511 - DNA, 1392 bp, Glycine max
  Peptide Sequence Number=SeqID_227289
gaagagatcctggtcaccgtgggcgcgcagcaggcgttatacctgatggcagacgcgctgctggccccctcgcaacgcgtgggcttcgaggagcccggccacccgcatgcgcgcaacaccttttcgctgcgccgcccgcattgggtgcccgtggccgtggatggggaaggtgtggtggtcgatggcctgccgccgctggactatatgttcgtcacgccctcgcaccagagtcccaccaccgtgacgatgagcctgcagcggcgcgagcagctgctgcgccgcgccgagcagggcgatttcgtgatcatcgaggacgactacgaggccgagaacctttaccagggcacgcccatgcccgcgctcaagagcctggacaagagcgggcgcgtgatctatgtgggttcgctgtccaagagcctgtcgcccgcgctgcggctgggatacatcgttgcgccgcgcgcgctgatcgacgagttgcgcgtgctgcgccatgccatggccatgctggaacgcgtggctcaggtggaccgctcgctgcgcgcgcacctgccggatttcatcttccgccagccccagggcggcgcgtcgctgtgggtgcaggcaccggcctggctggacgccgatgcgctggccgccgtggcgcgccgccacggcgtgctgatcgaggcaggcagcgcgttctttgcgacgccgcgccagccctgcccctttttccggctgcgcctgtcctccattgccaccgatcagatcgatgcaggcattgcagcactggcacaggcggtggccgaactggcccgcagctgcttgagcatgtcgctcatgggcaggttcagcggggcattcttgggcggaatgggctgcacgaaccacttgtcgtagatcttcgccacttcgcccgaggccatcatgcccaccagcacgtcgtccacagccttcttgaaggcgggatcgtcgcggcgaaacaggatggcgatgggctcggagcccagcacctcgcccacgatcctgaagcctgcagggttcttggagttggcgatgacgccggccagcaggttgtcgtccagcacgaaggcatcggcacggcccgattcgagcatcagaaagctctcgaaatggtccttgcccagcgaggtgggcaggttcacgccattgtcgcgcccgtacttgcgcagcagctgcacggcagtcgtaccggccgaggccgccacgggcttgccgtcgagctgcttgaaggaggtgatgcccgagtcggcgcgcacggccatgcgcacctggctcacgtaggtggtcacggcaaaggccacctgcttttggcgcgcgaggttgttggtggtcgggccgcagccgatgtccacggtgccgttctgcaccaggggcatggtgttctgcgag

SEQ ID NO: 110512 - DNA, 414 bp, Glycine max
  Peptide Sequence Number=SeqID_227290
atggagggtccgtgtcgccttcttaaaaacatgcgttggggcattttgctacccctagacgtcgtatctaagaaggggacaaattccccggacccccgcattcctagattgcatctgtgtcatatgcattccatcatgcattcatccattccacccatgaaatatcggagttttgatttgcaccagcttttatctcactttagtaagcatgggaacaaatcaaaccggcaagaggttctaccaagtcaaggtcaaaagcccagataccaccagcatcaaggaattagggcggttgatggaacccctccaaatgcaagccttccgcaagacttacggaaagatcttgagttgaccatagcagaggtgtccatagaagccattgcatcacttacccaatactacgaccagccttga

SEQ ID NO: 110513 - DNA, 303 bp, Glycine max
  Peptide Sequence Number=SeqID_227291
atgaagttcttggagctcaagcaggggaatatgactgtggctgaatatgcagccaagtttaaggagctgacaaaaggggcattgtcgcaacctaccctgttgcgggcgagcgaggcgaggctcacgggtgcatcttccgaaggaggaaaatgcgtggagtcaccaccagcgttaatttgtggaaaacgtcggaaaaaccaaaggaaaccggtcatgaagaatattctagatttgggagttgtatttacgtttgaggaaggtattagcacctctcacgtttgtcccaaaggacaacaaccttaa

SEQ ID NO: 110514 - DNA, 637 bp, Glycine max
  Peptide Sequence Number=SeqID_227292
atgggtttaccttggtatcgtgttcatactgttgtattaaatgatccaggccgtttgctttctgttcatataatgcacacagctctggttgctggttgggccggttcgatggctctatatgaattagcagtttttgatccctctgaccctgttcttgacccaatgtggagacagggtatgttcgttatacctttcatgactcgtttaggaataaccaattcgtggggcggttggaatatcacaggagggactataacgaatccgggtattaggagttacgaaggtgtggccggagcacatattgtgttttcgggcttgtgctttttagcggctatttggcattgggtttattgggatctagaaatcttttgtgatgaacgtactggaaaaccttctttggatttgcccaaaatttttggaattcatttatttctcgcaggggtggcttgttttggttttggcgcatttcatgtaacaggattgtatggtcctggaatatgggtgtccgatccttatggactaactggaaggatacaatccgtaaatcccgcgtggggcgtggaaggttttgatccttttgttccggggggggtagcttctcatcatattgcagcaggaacgttgggcatattagcag

SEQ ID NO: 110515 - DNA, 1716 bp, Glycine max
  Peptide Sequence Number=SeqID_227293
atggatgagaatgttggtaatcttgagcgcggcgatattcttgtcacaggctcaaccatcaccgcgatcggtaaggacctgaacgccggagatgcttacgtcattgatgccacaaagatgattgctatgccggggatggtggattctcatcggcacgcctgggaaggccagctgcgccgtattaaccccaatgctacctgcctggacgactacagcaacgccacgcacttctcgttcgcgaaatactaccggccagcagatatctatgtcggtaatctcctgacggctctgggcgcgattgatgcgggtatcactaccatgattgataactcccacaacagccgtaccgcagcgcatgcagacgccgccgttgaggccctgcttgatgccggcattcgcgccatccatgcttccggcgcgccggttgcgggcgaatgggataaagcgcactggccgggtaactggcagcgcctgcaggaaaaatatttcaaagacaatcctgatggcctggtgtctctgggcgtcatggcccagctggagccggaattgtgggccgaggcccgccggctggggctgccaatcgtgaccgaattctttggcgctgaaatggcttcagagcttaaatcactgcatcagcagggcctgctgggcccggacaatatcttcaaccactgtaccgcactgcctgatgagggctgggagatcctgcgtgaagccggcgtacgggtgaacgtctgtccgcgctcagattcacattatggtattgaaagcgggatgtttgccattgaggccgcgcagcgccatggcatcaatcctggcctgagcgtggataacgaaacgtcttacagcaccgatatgtttatggaaatgcgcgttgcgttctatctgcagcgagtaatgggcatgcataagcagcactgctgtgattcaggacattcgctgacaacgctcccggcagcgcagctgctgaagtcggcaaccgtcgatggtgcgacctgtgccggactacaggataaagtgggtagcctgacgcctggcaaacaggccgacctgatcctcattaacgcagctgatctcaatctctatccgaacgggaataccttcgggacggtggtgcatgcaactgaacgcagcaacatcgataccgtcatgattggcgggcgcatcgtcaagcagaacggcaaagttctgggcgtggacagcgagcgtcttcgtgctgccatcgatgaatcacgcgaacacctttttgccgccgccggatatgagcccgacatctttgcagagaaatttctgccgctgacgaccctgaacagtcagctcgcaaaaggactcgggggtgatccggtcaccgccgcgttcttttccttcacggccggagcgtcatgcctgggaatttactcgctgctgcgtggagggttattcacctcccttgctgcaattccttcgcagcctgtgtggagtctggcgggcggcctgatcggtgcctgcgcgctgttcagctacgtggtgctggcaccgaaaatcggtttttcagccctgctggggctggcaatcgttgggcagttactctcgtcgcagatgattgaccatttcggtctgctgggtgctgttcggcgaccggtttcgctgctcagactgggtggcatgctggtcatgctggcagggctcgccatcatgcttttcggtgacagactttcagcgcgttttttgccctga

SEQ ID NO: 110516 - DNA, 176 bp, Glycine max
  Peptide Sequence Number=SeqID_227294
atgccgggttcatcggcagaagggccaggcggggggcagctgcaggcacttgaccgtaaactcgccgttgacctcggcaatcacgatgtcgccgtgtgcggcttcctcggcccggtaaaccaccatgacgtcgccgtcgcagaggcccaggtcccgcatgctcttgacgctgacgc

SEQ ID NO: 110517 - DNA, 861 bp, Glycine max
  Peptide Sequence Number=SeqID_227295
atggccgccgttgttgtcagtctgctgtcgggaatatcccttacaggaatactgtgcgcgccaggcctgtcgatgctgtgggctgccattctgggattcggctgcggtgccagcatgatgctgggcctgacgtttatcggattacggacaacaaactcgggcgacgcagcagccctgtcaggcatggcgcagtgcgtgggctatctgatggccgcaatgggtccactgttgctgggtaaaattcacgactggagcggcggctggaccgtcccgctgctgatgacggcggcgatcacggtggccggagcctgtaccggtctggctgccggacggaacttaaaccagctttatgtcgataccgcaggtgatgttctgcggcagctcggacacaatgtctctgttacgaaagctgacagcgattttgatccgcataacgaaatcaccagaattcttgacagcgatatcctgatatatcagatgccgggatggtggatgggtgagccgtggactgtaaaaaaatggattgatgaagtgtttaccctgggccatggttctctgtacgaaagcgatggccgcacgcgctctgacagctcaaaaaaatacggctcgggtgggcttcttcataacaagaaatacatgctgtccctgacatggaatgccccactggaagcgtttaacgatccggagcagttctttgagggcgtcggtgtggacggattatatcttcatctccataaagccaatcagtttctggggatgacaccgctgcccaccttcatcacaaatgatgtggtcaaatcgccagatgtggagaacgaaatccgtcgtttcagcgatcatcttatcgcgacatactcctga

SEQ ID NO: 110518 - DNA, 624 bp, Glycine max
  Peptide Sequence Number=SeqID_227296
atggctggcgtgagcgatcgtcaggtagacctcgttcaggaaggtgttgactgtgtgataagaacaggagagctgcagaattccacgcttgttgcccgcccgctgggccggttacgctgggtcacctgcgcctcgccggattatctcagggaatatggcataccgcggtcacctgaagacctgacccgccatcgggccgtccactatttttccggtcagccccggcgtaatgatacgctgcgttttatgcggggttccgaaccactttctgtggctgtcagcggcctgggcgccgttaacgaaacaggactctatattaagatgtgtctggagggtttcgggctgatccagcttgctgagaatattgtttctgagcatctgcagcaaggggcgctggttgaagtgctggccgactggcagccgccgtccgtgccggtcagcctgctttatccgcatcagcgctttctctctcctgctgtgcgggtttttgcagactgggtcaccggggttttcatgcaggggcgcacggaggcggtgtcatccccagaaactgattggctttatggagatgaagatataatccgtccacaccgacgccctcaaagaactgctccggatcgttaa

SEQ ID NO: 110519 - DNA, 315 bp, Glycine max
  Peptide Sequence Number=SeqID_227297
atggagtatttcaacgggtgcgccaggaatttgctccaggagcacggcagcaattctgccggttttatcatcaggggaatagcagggattctgctcagcaagataaagaatgagctcgcggacaagcggcgtaatggcaaccgtacagcatcttaccggcataacgacagcaccgggttcaataaaaagaaagcaggttcgggcattttgtgttacgcgacaacgatgaggaatattaccggggatccagacggcatgcctgggaggaaccagccacagtgcattctcaacttcacagctcacggcgccatgtaa

SEQ ID NO: 110520 - DNA, 1718 bp, Glycine max
  Peptide Sequence Number=SeqID_227298
gccggcctgtcattacggcttaagaagcaggcttaacgtaggatattttccttcttcaggacgcctctcaactgaatcggcatcagaagcttctggtctgccgactgccggaatcacagactcagacaagcataatatcccgggatatactaaaggggcagatattatgcagattaactccacggaaaaacagatagattatatcggtaatattgtctatcgccaggtcaaaagtatgcgttcagtcaggcagttacatatgtctgttctcgttccgcgtaccagcgatttgaaaccggcaatcatctattttcccggcggtgggttcacaacggctgagcacgacaagttcatagagatgcgtctggccctggcgaaagccggttatgtcgttgcggcagcagaataccggacaatccctgacacattcccgtcaccggttgtcgatgcaaaagcggcggtgaggtacctccgtcagcatgcaactgattatggtatcgatcccggacgcattggcgtactgggtgattcggccggaggatggcttgttcagatgctggggacaacaaatggcgataaatcttttgatacaggtaattttctcagccagtcctctgctgttcaggccgtagccacgctatatggaatttcagatctgcgtagtatatgtgagggatttcctgagaatagactgaaagttcatcagtctccggctgtgactgaagctctgctggttaatggtgtggctttcagggactttgccggcgcctccctcatatccacaccccagaaagctctcagcgcgagtcccgtcgggcgtctgaggggaagcaatccccccttcctgattatgcacggcagcagggatactctggtatcgcccgagcaaagtgcaacactttacaacgcgctcaggaaatcgggagggcgcgcagattatgtgcttattaacggagcagaacacggagatcatcactggtatcagccagcagtcatcaacagagttgttgactggtttcgccagattctggggactccggaaaaacaggacgccatctgttcggcatcatctgccttaatgggaaaacggcgacatctgaatggcttccatctatcggggaaggcgaaacccgatagagcattgagcgtaatgaagctgccgcaggttttgtccgtgaaatggattaactggagtgtcgccgcgacaacgccaccggcgggtgcagactttgctttctgtcaaccggcccgcgcgctgagaaattatcagtgccgggctcagagtgtattactgaccggccctgttattgaacgcaccctgagcgggttactcactcagggagtgttctccatgaaattaccattttactacctcgcagcactgttccttaccgccggaacccattccggcactgtcatttataccgacagcgcccacccggtaaccgaccgtgcctacagcgggtttaacgttctcctgctctggatggccgctgaagaatacggatatacgtccgaacgctggctgactttcctgcagtctaaaactgcgggaggtcacgtcaggaagaatgaaatcagcacgctggccattatctacaaatcgtttgagaaacaagcccgggacagcattgataatctgctgttcagggacggtgagcgggttatggagcagctggccatgctgaagcaactgcagctgttcaacgtagaacagt

SEQ ID NO: 110521 - DNA, 682 bp, Glycine max
  Peptide Sequence Number=SeqID_227299
atggctattttcaggcggaggattaatgtgtttcagactgcattatttttgaaagtggacctgggaattgatgtctcttttatcctggagcccattgtaagctctggtgggcatttgatggcaatggaactactctcaagattttttgttagcggagagatgaaccctaccaacctatctcccgagttactttttagaaaaatcacgtcagagcaaaagaaaaaactcctctcatgtcagattgatgctataaagacacagtcgatattttttctcaagaataatattatctgcagcctgaatattgatgaatgcctagctgacttcatctgtaatacacccgacgttagaaggcggttaattaacatgccttttataaggcttgaaatctccgaggcgtttcctgaactggataacgccatgcgtaatccactgctgacagatttgagccgggactttggactctggctggacgacttcggatctggttacgccaatatgtctgccgttcacagtggacttttcgaagccgtcaaaattgataaagccttcttctggaaacatattgaaagcccgctctggcctgggcttctcagagaagtcaggcgggatgtcacttcaatagtggttgaaggcgtcgaaacagaacggcacacagaacagctgcgtgattccgttgaag

SEQ ID NO: 110522 - DNA, 594 bp, Glycine max
  Peptide Sequence Number=SeqID_227300
atgacattgaccatcccacaactgtttttgaagccgctccaggttatgtgggatgctaccatattcggggtgtttaatcaaaacttcccgttccatctgaccgagacaagtgtgcgagcggggaattctgatgtgtatggattcctcgagccacaatccattcagagatctgggcaatcacaatttgaatctgaaagttacatcaagagttggatacaaagttcaaaacgagatgtttaccttggagcctatctgaatggcggacactggcaaatggtcgtcattctgcctaaggaaaactttgttgtctggttttgttctttacataacaggccagacaactactttaagggaataattaacagtgctttgaaaggacttgatgatactccacaaccgaaatccaaggctgctgctaggtggattgttgttaagtgtaatagacaaaaaggaatcactgaatgtggctactacgtgatgcactggatgtccatgttaatcttaggatctttcaggaataattgggagacgttagaccattggaagcagagagattcaaggcacttcgcatacagtgggcacagtattatctaa

SEQ ID NO: 110523 - DNA, 405 bp, Glycine max
  Peptide Sequence Number=SeqID_227301
atggcatacggcagtaaagtgcgtttagcaagtaccagtgatagtagcgtcaatgtcgttattcctttcgttgcagctaatcgttcagtgattgttaaccgaaactgtgatttcagctcacaaagtgcctcagtgaccttacctgaatattctgtggcaggaacatccgcattctcggtgcctctgagtctctcctgtacagcggggggcaacatatatgggacaatgagccttacgggaaccacggcatccggcgataatacagtgttcacatctgacggttcagcgcaggggggtctacagtttggtcccatatccggaaacaacataccaacccccctcggtctctccgtcgcttatgctcgtaccggtggacgtcttacagcgggaactgttcagtcccgt

SEQ ID NO: 110524 - DNA, 290 bp, Glycine max
  Peptide Sequence Number=SeqID_227302
atggtcctccctccagttcatggctcgaagccgggtggcattccaaagcttttggcatattgcctgtcctatctaccgctaaatgaaaggaataaagcacagcatattagccctaacaccggaatcgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 110525 - DNA, 401 bp, Glycine max
  Peptide Sequence Number=SeqID_227303
gtatgccacctaccaggaaccctctagacccagataagtctaacatggccctggagtttccagcgttgatcacaggtctctgccactcattcggggccgcagacgcaccgccgccacctcatcagggtgatccagctgggtcatttggcatggagcgatatttacaacacttggttcgccgcaggcggccaaccacatggggcaggtgccgatacatgagtgtctctaccagctcagcctcagtcagtagagtcaggctttcgctccttttgcgtgccctactccagatcagttcagggctgaggttgcatggctcagagattggcctgaggcccaggcaggggaagtgcccgcaaaggctcccggcgatgcagaggaggcctgcatggatggggagatga

SEQ ID NO: 110526 - DNA, 147 bp, Glycine max
  Peptide Sequence Number=SeqID_227304
atgttggatattcctgtttctcatgaggaggaatacttgtacttgagggcatgtcactcggtttggaactcccttgagactcaggctgattctcatggaggggagttgccagtgcataactgggtgacctcgacacttactgcctag

SEQ ID NO: 110527 - DNA, 327 bp, Glycine max
  Peptide Sequence Number=SeqID_227305
atgaagttgcaggaaaatcgggatacggtgacatacaccaccacactcaaccatagcattcagtcaacacgcaagacatgcccactgcgtcaacaagcacctccgtcgcatgatggattcgaaaacaaaaggcacagcttccagcaggtcacttatatttctgttagtgttttcatcacaggctgctttgctaaaaacttgggcatctctaagtccatctatgttgagttcttaggggccatcattgttgttgaaattgcaatctccaaaggttggcactctctttggttagagtgtgactctacttgttgggcaggctttctctaa

SEQ ID NO: 110528 - DNA, 711 bp, Glycine max
  Peptide Sequence Number=SeqID_227306
atggctaatttgcaaggagggcctgactttgacaaaatctttcacttcctctccatttgcatccttgctttcatcaatgaaggctcttcctccctctcaagtgcattcatgaatgaaccatggtcatggggcctaagcattcccataagtttgtacgtgaaattcgcacttgagattcacactcaccttggaatctgcgttggggttggagtaccctctttggtctattggggtgccacacgtggtgccattgattggtactgggaagcagcattgaagttcaaccacgagatcttcaagacatgcttgttcaatgttgtgattgggttgctacacttgttggtgtcaaagcttgctcattacatcattgagtgggtgagggatcacaagctgatgaacaagggtttgttgtctcatttgctagtggttgcaaacttggacttggaagcactctctcaacaccctttactaaggcctatttctttcaaaactttgttcttgaagctcattgagttgcttgttgtgttcttctacaatgggaacatattgctcttgagttggtgcttttcagggcaggtttatagttatgaggttggtaaggctatttcttgggttagcttggggagctccatgtttgtgtggattaagtctttgctcagggaactgggaacacaacaggaaccacttgaagagaagccatgcatgaaggag

SEQ ID NO: 110529 - DNA, 234 bp, Glycine max
  Peptide Sequence Number=SeqID_227307
atggcaaagcatcagcatcaaggctgcatactaagcgcaagatcagtgtgttatttgcagcaggtgtcttcagccaggctcaacgaaagactggcgctaagcccaaacccacttactcgtgctaagcgcgagggtgacttgtgcacactattccagagtgcctatttcgggaaaagagccctagaagcagcaagagcagcagcttgtgcattgaagcctaagttttgtaaatag

SEQ ID NO: 110530 - DNA, 1413 bp, Glycine max
  Peptide Sequence Number=SeqID_227308
atggcatggcgtcagaagacggtggtcccgggggctaacacccttggcatccttgccttcgaggccggaaaaaccatgagccacctcatttccctctaccactccctctcggacgaggaaatcatcaagcttcgcaaagaggtgatcaaatccaaaggggtaacatacttgaattcccaacatgaatgcttccttctcaacctcgccgcagcagagcgccttgaggagcttgacacggcagccgacactgtctcgcggctcggccggaaatgctccgatccgagcctcagcagcttcgaccttgtctacgccgacctcaagcttggcctcatcgaccttcgaaagctgagttacggtactcgcaacaccccgaagattatctccaaaattgagaagcttgtctcttcaaccaaaagtcttcattctgccatgcattgcatggcggaacacgagacttccgagaagaagaaacaaagattgaagacagttatgagacccattaattataacaacaactacaacgcaaaacaaaacaacatggaatacttgaacgagcagatagcgtatcaaagaaaacaagtacagcattacaaggaagtttcactatggagccaaacattggacaaaaccgttgggatcatggctaaggtggtttgcattgtctacgctagaatatgttccgtttttggaggctacatttctaattgcaactgctatgaaatcaatgatgacaacaacatcaacaacaattgctgttgcctcttggaacaccgcgagttgtacaagaaaaattattgtctctacgaggaatcacttcagaagcgtgtcacaagatccggtccaattccgaaggctagtaataacaacaaaaccggtgtgatacggttcttgaaccgtgaagttgataggccaatgagtaatgttaataatagggttttgaggctggcgccgccgtcgacggtgggcggggcggggcttgcagcgaggtatgcggaggtggttttggcggcggaacggttgctgcacgcgccggcaacggtggcggaggacgcgcgggagaggttttacgagatgttgccggagagggtgagacaaaaggtggcggcgaagctgagggggcggtggaggagggaggaggagggggaggcgctggcagaggggtggcgggacgcggtggagaagatgttggagtggctgtcgccggtggcacacgacacggtgcggtggcaggcggagaggagcatggagacggcgaggtttgagacgaagacaacggcgctgctgctgcagacgctgcattactccgacttagagaaggcggaggcggccattgtggaggtgttggtggggttgagttgcatatattattgtgagagaaggtgttggcagggacatagttatagctgtggatga

SEQ ID NO: 110531 - DNA, 483 bp, Glycine max
  Peptide Sequence Number=SeqID_227309
atgactgctttagatgccaggggcacttgggaacttgtcccattacctattgacaagaccaccatgggtcattgttgggtttatacagtgaaggtcaaaccaaatggcagtattgattgctataagactaaagacacgagttcgctcaaatacctcttagggattgaagttgcccaatcttcctttggcatttccatttcccaaaagaagtatgctctcgatatcttaactgagatcgatatgcttgattgttgtcctattgatactcttatggatcttaatgtgaagcttctcccagatcagggggagccattggaagacctgaaaagatataatcatttggtactcttaggagaaatcaccactgagtttgttagctccaaagaccaattggcagacatgctcacaaaatccctcaaggtttcttatgttgatgatatttgtagcaagcttggttcatatgacatatatgctccaacttga

SEQ ID NO: 110532 - DNA, 216 bp, Glycine max
  Peptide Sequence Number=SeqID_227310
atgaagaatcaacttgcttccaacgggattgttccgtggtgtaaacatcctttgcatgagtggtcaagtgatcgacatgaccttggccttggaaccaaaggtggcaaggaggatcaccaaagatggtatgcccgaagtctgcgtcatggagacgatcctggtggtgtggtcacaccagcgaaaggagatcataatggcgatgggaaaggctcatag

SEQ ID NO: 110533 - DNA, 1392 bp, Glycine max
  Peptide Sequence Number=SeqID_227311
atggagcctgttgacgccaccatgccgtcagtgcaacggggaagcttctccaatcgccaaacccaattctccgagcggaggcagaagattatacaacagaggaagtctcttccgattgctccagttgagaaaagactggttgaagaggttcggaagcacgatgtgttgattatcgttggcgaaactggaagtggaaagaccactcagattccgcagtttctgtttgatgctggattttgttgcgatggaagggttattgggataacacaacctagacgtgtggctgctgtcactgtggctaaacgtgttgctgaggagtgtggtgttgagttgggccagaaggtcgggtattcagttaggtttgatgatgctacttctggcttaacaaggatcaaatatatgacagatgggttgcttttgagggaagcattgttggatccatatctttcaaagtattctgttataattgttgatgaagcacatgagaggactgttcatactgatgtcttgatgggcttgctaaaaagtgtacaacttgctcggtcaagttctgtaagtggtggccagggccttaattttggaaacaagaatatgaataagttgttcgagaaagaaaatgatcagagtggcatttttcttaaaaagccccgccatgagaagtatgctccattgaagttaatcatcatgtctgcaagtctggatgcacgcgctttctctgagtactttggtggtgccaaagctgttcacatccaagggagacagtttcctgtagatatattttatacccgtgatgcagagacagattatttagatgcttccttgataacaatattccagattcatttagaggagggccctggtgatatactagtatttctgactgggcaagaagagattgaatctgttgaaaggcttatcagtgagaaactcccacaattacctcaagaaagtcagaagcttctagttgtgcctatatttgcagctcttccatctgagcagcaaatgcgggtctttgcaccatctccatctgggtttcggaaggtgatattggcaactaatattgctgagacatcagtaacaattcccggaatcaagtatgtaattgatcctggatttgttaaagcacgttcttatgaccctggaaaaggcatggaatccttgattataatacctacatccaagtcccaagctctgcaaagaagtgggcgtgcagggcgtgaaggacctggaaaatgcttccgtctatatcctgaaagagaatttgagaaacttgaggactcaacaatgccagagattaagcgttgcaacctttctaatgtcattttgcagcttaaggctttgggtgttgatgacatactagggtttgatttcattgataaaccttcaaggtga

SEQ ID NO: 110534 - DNA, 210 bp, Glycine max
  Peptide Sequence Number=SeqID_227312
atggtgcagattgaaagaactttcatttgtgttgatgctggtgcattggtggaagaacctactaaatggtttcttccatataaaaatgcttcagaagggaagagtagtaatgtagagtgttgccatttaggaggtttttgcaagataaaggaagggaacagggtctcagaaaagccactagttgcagtgaggttgggatttaatatttga

SEQ ID NO: 110535 - DNA, 900 bp, Glycine max
  Peptide Sequence Number=SeqID_227313
atggatgctagattggagaaggtcgacgaggatttagctgagatgaagtcgtcgatggaattgatgagaaaagaagctgctgacaatcagtcgaaattgattgagctgatgacatggagtctggggagtatggggaatcgtgtgaataccgggggaaaaggcgaaggatcacacaaagaaaaggatccaaaagagtcgagggtgcatgacttactagagatgccgacgtcagagatggcaaaatctagaggacaaaggttagatgaggacgagatggaggaatttcgaaaatcggagaagaaggttgagcttacggcattggtgagtctcgctcaaatttgtatggagaatggtaccatccatttctttaattccttgttgttggactacgaaaatctgacatgggaggatctgaaacatgaattgctggagagatacgaatgggttagtgaaggttctgtgtttgagcaattcacatcgttgcgtcaaacaggaacgatggagaaatatatttatcgatttaagagtttggtggtgcaagtacctcgattattggatgggcgtgtagatatgcgaggaggaggttccggatttgggttggtgcaaaaaacccatggaactaatacgggtcatggagtaataaggggtgttgggtttcagggtggaactaatgggccatgcccaaatgaaaaagagttgagcttagctcatgagtgggctaagcgcgcatccaccgctaagcgcagcttcagtgcgtttagcacaacagaagaatctggcaaagcatcaatatcaaggccacgcgctaagcgcgagatcagtgcgctaagcgtagtagttgtcttcagccaggctcaatgcacgactggcgctaagctcaaatccacttactcacgctga

SEQ ID NO: 110536 - DNA, 414 bp, Glycine max
  Peptide Sequence Number=SeqID_227314
atgaagaataaggcccttgccactaccacgaagatctgtagtaacccaaaccaagaaaccgatcattggggtcagtatgttacatgcgcttggcttcacggcctcaaaggattacacgacccaaggagttacggtcctataatctggtgtgctaacataacgttgatggtgaaaaaattccttacgcacggcatctcactgctgaatttggttcagcttggtccttctgcccttgctgccaatggcctgcataatggtagtttagtgcagtgtcgtttctcttctagggtttttggaatggacaagagatactggttcatccctgcttattcagaggaagatatacgaaggatggctgttcttcagggccttgagtatccatcaacaccagacttcaatgcccaagatttttga

SEQ ID NO: 110537 - DNA, 1290 bp, Glycine max
  Peptide Sequence Number=SeqID_227315
atggtgagcaatgaggagcatggtttaaagattctagatttttggggtgaaaactctggacctatgacctggagattaactctagcagaggttaggcatgtattgggtctgctagttgattttaaactagaagcaatagctgctgtgaagttgtacaagaattatattatcataaaagggtgctctgagaagaaacgaccttctccaccttacattttgtggatgaaagaccaacggaatgagatcaagaaagtgaacccagaggccggatttaaggaaatttcaaccatgctaggtgttaaatggaagactgttactgcagaagagaagaagccttatgaggggatataccatgcggagaaagaagcttatttgcaggtgattgcaaaggaaaaacatgaaactgagtcaatgaggttgttggaagacgagcagaagcagaggactgcgatggaattgcttgaacagtacatgcaattcaaacaagaggcagaaaaagatggaaagaagaacaagaaagagaaggatccattgaaaccaaagcaccctatgtcagcctatttcttgttcactaatgataggcgagcagctcttgctgccgagaacaagaatttcttggaggttccaaaaatcacattcgaagagtggaaaaacatgacagaagaacaaaaaagaccctatgaagagatggcaaagaaaaataaggagcaatatgccctagaaatggaggcttataaacagaagaaagatgaggaggctggccatttcatgaaggaagaggaggaccatatgaaagcatcagaggaaacacaacaaggccaggtttcacgcagttgcgttgtttactgtcttggtgttgtcataattgagatactgacagcgaggttcccttctcagtatgtcagcaatggaaagggctctaggaattggcttgctgagatggagcaactcctcctcattggtgctgcttgcactgaaagtaaccctcagcagcggttagacatggcggaagccattagaaggataatggagattaaattcgagtgtgcttcaatagataatgttaaagctgtcaaggctattcttagaagttatgagatggtttttggcctgagaatcaattttggtagcagtcaatttggagatgtcgcaacctaccattcggcgcgagggcaacgcgagggctcacgggtgtgtcttccatgggaggaagatgcgcggagtcgccaccaacgtttattcgaggaaaacgtcggaaaaaaccagaaaggtgtggtctacgaactttaa

SEQ ID NO: 110538 - DNA, 597 bp, Glycine max
  misc_feature (105)..(105): n is a, c, g, or t
  Peptide Sequence Number=SeqID_227316
atgaaggatgaaagaaatgcaagtagtggggatgtctccacctctagaacctcacaatcactcacagacttatcttatgctctcaagatggcttcctcttcactntcagttctctgccagggtctgttacagcccttacctattttggagagagtgtgggaggatatctatcttgattttataacaggactaccgagatcaaagggacatgaaggaatcttggttgtggtggataggctttcaaagtatagtcattttatccctttgaaacacccgtacacagtgagatctattgcaaatgtttttgtcaaggaagtagtaaggttgcatggaattccaaactcagtgataagtgacaaagatccattgttcatgagtttgttttggagtgaattctttaagatgcaaggaacaactctcaaaatgagtacaacataccatcctcaaacggatgaccaaactgagccaaaggaatgggtgacttggattccatgggcggaatactggttcaacactacataccatgagtctattggcactactccttttgaagtaatatatggacgcgaacctcctaagatagtgaggagtatatag

SEQ ID NO: 110539 - DNA, 303 bp, Glycine max
  Peptide Sequence Number=SeqID_227317
atggcagcagccctagatagcaaaagggaaaatgcagtagggcacagttcaaatagtcagcagcaagacagcaccactcctcagattgcccaactgctcctgtcataccctaattttgtctggggaccattgtttgatagcatgcaacctttgcttgaccgcttagagggggtgcaaatagcaaccagacccacttgggccttccaggaagttcctccaaaaggcggtgccttctggaggaagcaacctagctcgcctgggcgagctgggtggcaagcttctccctcttttccctataaatag

SEQ ID NO: 110540 - DNA, 354 bp, Glycine max
  Peptide Sequence Number=SeqID_227318
atgcaatcaaatatttatacaggattagacgaaacatacctagagcaagaaagcttcgatggagaagaagacaacgagaaggagaagacaacgcgaaggagacgaaacatacctaggtgtggtggcaaaggagaagaaccacagagttgtcacgatgctcgaagagcaagaaagcttagatggcgaagaagacaatgcgaaggagacgaaacatacctaggtatggtggcgaaggagaagaagcagagacttgtgacgatgctcgagtgcgatgaacacgatgctcagatgcagaacagagaccttcaaggtagacggagattagaagaagaagaagaaagtgcgaaagcttag

SEQ ID NO: 110541 - DNA, 543 bp, Glycine max
  Peptide Sequence Number=SeqID_227319
atgatagactccgaccagtgttcaaggtgtgggtccaagtcagaatctattatgcatgttttgatggattgtgaggagattcaaaagttttggttccaatttgttagccaggattgttgggctaatttttttggtgttgggctccatgattggctattgtttaacctcgataagtttcttatgcaagctcccattagcaagtggtcttctttctttgaccttatgatttattacctttggagagaccgtaatgatgtggtctttaataacaaatctaatatccagtcaaccctcatacaacaaattttaagtcagctgaggaacattgtccgtgatattcagactagcttgtggcccgcagattggaatgcttcgttggttcattcttatagggaagccaatagagcagcggatttcttggctaatttgggtcatagggccatttttgttgtttctgttattgatactttccctcctaccttgcgtctgattttgtcggatgatgctcgtggagttgtttttaagcgctctatagcgttgtag

SEQ ID NO: 110542 - DNA, 180 bp, Glycine max
  Peptide Sequence Number=SeqID_227320
atgggcaaggtaggcagccacacaagtaatcaactttggttgtgtcagtttcaaatcaatggtcctggtggtggtgtaaggcttggtggtggtgtaaggcttggtggttggtttgagagcttatgtggtgcttgggagggagtaaccactgtggttgttgaactcgtaatctttttttag

SEQ ID NO: 110543 - DNA, 633 bp, Glycine max
  Peptide Sequence Number=SeqID_227321
atggataatgcttatcatgtggttgctagagtttggacaggagagttggcctctcatgggaggaaggtagagaaatttggaaggtctgcacttaagattgaagacattatggttgctacaacattaagttctttgattacatgtttgctggagacaagtgacaagggacttttatatgcttttgcaaagaggtggcacaaggaaactagtagtttacatctaccgataggaaatgcgactataaccctcgatgatgtggtgtccttattatatgtgccgattacaggtgccttccatacctttgatgctatagatgtagaggaagctgtgacttcagactacatgaagtggttctataggatatctcacctattcatgagtccgtcacagcttaaggatcctcctagacatccacccgtggtgcaggatgatacatttattttactagatccacctatgttgcccgttctgttagcaactatgccacaaccacctgtacctacgactaccgatgcaaacatgcctcgacatgcaatgatagcagaaagtttggaacacatgatcaacatgaggatggtcactgctagaactaatgcatacactctgactgagcactgcctaagattagcctag

SEQ ID NO: 110544 - DNA, 423 bp, Glycine max
  Peptide Sequence Number=SeqID_227322
atgcagagggcttatgcatcattatgcaaagaaaaatcttcaagtaccaaagtactcaagacgagaaagtatgagaatgtctcagcacagtcattgtcacttgtagtaaaattgacatatgcaagatgcatgctttttaacgcaggcaagtgcagagaatttgtagtgcatgcaaaaaccatgcaaaccgccagctccattggcgcatttgctgtggctgtgacacgtggtgaatacgccattgccactagcgggttccatggtgtcgccagccccattggcgatttcgccatgcaagggggagtagccagtcaaactggtgagttccaagcacagggcgcaggcttctcagccttttcaggctttttagttggcaggctttttcagttggcaggggcaggggtacaggctacagggaagtag

SEQ ID NO: 110545 - DNA, 234 bp, Glycine max
  Peptide Sequence Number=SeqID_227323
atggctacgggtgagtatacaggctcaagcccacagaagtggcatctccaatcacctttcttccttctccattccactgccattaaacttcaagaagcaaaggactccattgatgaagaagatccaaggcctacaagctgcacatggagctacatcatgtggtatcaagagcatctttgtctaggtgatgttcttttgcttcctctatctttttgtttggtcaattcactttaa

SEQ ID NO: 110546 - DNA, 438 bp, Glycine max
  Peptide Sequence Number=SeqID_227324
atggcggttcctgattctaagtcgaattcggttcttggggttttctatgatgtgggagagagagtgaagcgaagcaagggaatcattggatcgcagaaagtgatcaatgaggtcacatggagtagtgaggggcgaaagtgtggtgatcactctgcgtggaaagggcttaggactttggagatggagtgtgttgtggaggaggatccagaaagagatccggattcgggggatcagtcttggtcttcagctaagccggagaacaatcttggattcactagaagtcctcacttaagtccaagtatgaagggtcaaaagttgaaaagtttaaagatcaaaagtgatgagaaccaactaaggagcatagaccttgaagcaaagcatgaatttgatggactaatcacaagagtgtgtcctaagcaaacggtgaataaagtctaa

SEQ ID NO: 110547 - DNA, 819 bp, Glycine max
  Peptide Sequence Number=SeqID_227325
atgaacaattacccttttggatcccaagcccccaagtccttccccgcttacccaagaaccgaattcgacttagaatcaggaaccgccataaaacgaacccgaaagccgaaaaattcgccctttcaccttctcagaatgatcaaatcatttgggaaccgtttccatcacttcttcaagcttcaccctctaatgggtctcttcctagccttgtcctttttgctcacacttgtcatgattctctccttgtatggaacccaatatggggtgcagagtggtggttatgtgaaatctgacatgggctttgatgattaccctttttcaaagcttcagaaccttgtgatggttgctgggcattccatttacactagcagtagttgtggaaaaattgagaaggaggattcttggtttttggagtcttatcagaagaatcctggccaagctgccacttttgtgacacacattcatgaagggattgaggttgtggcaagggatgactctgctttgctgctcttcagtgggggagagactcggagagacgccggaccccgcagtgaggcacagagttactgggctgttgcggattccaaagggtggtttggtgagttatggagaaggaatagaatagaattgtctgattgtactggtattcacccattaagaaggtttatagcaggaataagaagagtggctaggaagcattaccaaagtagagggaatagaatagaattgcctgattgtactgttattgtgttagtaaaccacccattaagaaggtttatagcagggagaggaagagtgattccaagtctcattaattag

SEQ ID NO: 110548 - DNA, 492 bp, Glycine max
  Peptide Sequence Number=SeqID_227326
atggtgcctagtggaataccaaagatgatgaattatgccctgtggaaagatgataggaagtggatattaaacgaggggggattttcaggcagtgaaggaagggccacatatagaagttacacatcatacaaaacaacatatgaatttgtttctaagaaacctgtaggaaccaacccaaaagaaggttcgatgatggattttgcaactggcagaaccaaatgccatgcaaagtcttttgttttgatgcctaaggaagaattgtacatcaaggatcaatgggcaagacaatttggagaagaggtggaagcacatgaggatcaaggccaccattgggagaataagattttgaatcatctcagccctaggcctgatgttttgattgaaatacaacctgtgttaattcttgatttgcatgatacttgtgatgtgctttatgcatacgatttgcatgatattgttttaggtgatggtgccaagtccttaagtttttag

SEQ ID NO: 110549 - DNA, 222 bp, Glycine max
  Peptide Sequence Number=SeqID_227327
atgtcggcttcccaatttggaggggagtgtgcttattgcaactctttggctgttgaagagagtgaatatgcttttatggatgttattgaatctaattctcttgaaattggttctactaatgttgattcagattcctctgaaatggaacttgacatgggtgatgagatgactacactttcaatgatgaagaacaagcaagaacaacagcagaaaatgcagtag

SEQ ID NO: 110550 - DNA, 387 bp, Glycine max
  Peptide Sequence Number=SeqID_227328
atggcgactttgatgtcatacacattacttgcgctcttttttccttacacatttgttgcatgtcttcaatctaatttgttgaatctgggaatcagatttgcgcatctacaccgatctgcgatcagctttccagaatcaaggttcttctatgccggcactcctgctacatcaaatgcaaaagcagctgctctaaaaggcgaggaattggttagaactcagttccaagtagatccatatggatgtcgaggctcactttatcacaagaaactaaagcgtgacccttttcatcggtcaattccttatcccaatgggtgtcctgaaattgaaggcttgttcagatattgtggaccaactccttatcctggtgcactaccgtgggcacagtaa

SEQ ID NO: 110551 - DNA, 1140 bp, Glycine max
  Peptide Sequence Number=SeqID_227329
atgtatctagaaggggtaaaggcacgtgtggttctatttggaaatcgcgatgaacgcgctaaacgcgcctgtgcgcttagcctgttcatcgcaactgctaagcgcaccctgtgccctaagccggagtgtcattttgatgaggctaagctaagcacgccatgctgcactaagctccaactctcttcgatggcatctaagaaaaggaaggcaccttctacacctacccaggccagatttgatagatccaggaatgtggtagtttattacaccgagtttgacgagttcaaggaggaactcgagagaagacattgggatgagaagctaactgattttgctgacagtagcatagacattgctattgtgaaggaattttatgcgaacctctatgaccccgaggataaatcacctaagcaagtgagcgtgagaggtcacttagtgaaatttgatgagaataccttgaacacatttctgaagacctcggtaattttggaggagggagagaatttgtgtacttattctaggtttgcactcctgaggcctaatcctcaggagttggctgctaagctctgtatcccagggaaaggatttgagctaaatgctgatggagccaagttgatttatggtatcattatgaagatggatatgaatttggggtacctcatctcccaccaaatctctcttattgcacaacatgatacatctagacttggattccctgccttgatcacaactctatgcaaggccaggggagtccaatcagattctagatccctgcagaacttgagccctgccattaacttggcatatattaagaagaactgtaggaatcttgatgatccaacagtgacatttagagggccaatacctcccattcagactccagttattcctccagcatctacacagataccacttccagctcctatatctgcaggactttcagactttgtatttacaccacagatgcttcattccatgctccagagcttacacagggggtgtacacatggctcagaaggaggagacttctacagaccagatcccaaagccatcccagcacccatacctgatgatgccataccatctgcaccagcatctaagttaggacagcctatctctcaggattcaccaattgctcag

SEQ ID NO: 110552 - DNA, 294 bp, Glycine max
  Peptide Sequence Number=SeqID_227330
atggagaagcctaaagaagaattggtcaagaaggaagatctcttgtcgagactcaaacctatccaagatgaactttgtttagttcatctcaagctcacgaaacatcgatttactaaagtagcttatcagaagaataaatactttctttatttttatgctaaagacatagtagagaagaccggtagactctgtagtgaggagagtagaccagatggagagaagacaaacaattcgaggcagaggaagacccaaaaagactataagagaggttatcaaaaaggatctcgaaattaa

SEQ ID NO: 110553 - DNA, 222 bp, Glycine max
  Peptide Sequence Number=SeqID_227331
atggagaagaacaccaacactagactcaaagaccttaatgagacagaagataaagatgtttctcatcttcaacgaaagagaaaggtaaaggttgacaatgcagctccatctgacaaagaacccatcattgcatttgttgtatcaagaaaaatgaagacaagggcaaattcttccatctctgaaaaggaagtggacttcaccttctccttctcagggaactag

SEQ ID NO: 110554 - DNA, 450 bp, Glycine max
  Peptide Sequence Number=SeqID_227332
atgcaaaaagttaatgaacaagttgagtccaatgcagccaaggttgttgaggttattctaatatgtcaacctgaacctgcgtccaactctgacaaggcagaaagaagaaactcaaacgctagtaaatcaggtcatggagaaacaaagagaagaaacaagaatggaactacaagcttatgctatacaacaaagataggagagtcagcaaaatacaagcaatctattcaatctgccatagctactcagtttgccaatctccctcaaatgctactacaaaacctacaacaagctcagcaaaacatgttgggtgttgtcatccaaccacctcccattatccaacaacaaccaactccaagtatactgcttgcacctattgaaggaaaaccatcatcacccacatcaacaccaccagttcagccaccaccaccaccatcgaccaatcaagagtga

SEQ ID NO: 110555 - DNA, 207 bp, Glycine max
  Peptide Sequence Number=SeqID_227333
atggaattaaaacgagagattgagaaatcgataagtctgtgtgaaagacgatggaagaggcagagttacagggtcgcttatataataggaaacggagaaaccctaattcgctatttgaaagcccatttgcttacctatccgaaatggccatgtccatccataatcgtcaactacacgggcccaaacctcgtgagtccatctaaataa

SEQ ID NO: 110556 - DNA, 567 bp, Glycine max
  Peptide Sequence Number=SeqID_227334
atgggcgtggctgctgttgtgcacctttacgtcttcccggcagaaccttacaaaaagggagagagatgtgtccgtaacgtagcagtgatggacgactatgcatcactaggatcgcctctggaccctgaggaggttcaagatagtcagcgctcaacaagaacgtggctgggagcacataataacgagagagagaaaaggcctatgaaatttacccagagtgtttgtgacgtggttgttggaagcggtgaaattttatccgcctcttttatgtttcagattgttgatgacatgaagtttacagtttcacatgtggtagaacctgttgaaaggggcattgcaaagataaacaaaaccttccatcagatatcagaaaatgtgaaacgccatgaggagcagcggacacgaaacaccaaggatgattgtgatcttgttcccttgagatcacgaatgtcagaattttctgatgttcatgatattatgggtgaaggaagtgtcagtgatagtggcatgtccagtggaaagcgacaccatttccaatccaaagaagcaagcaaccaccagaagtag

SEQ ID NO: 110557 - DNA, 216 bp, Glycine max
  Peptide Sequence Number=SeqID_227335
atgtggcaccaaaacttaggtgtggattccacgggaactgtgagtttgactgtcttcagtgcaagtatatttgtgcttgttgctctagttctctccatgtatttggtattcgagcatttagctgcctataatcaacctgaggaacagaagtttttgattggtctcattttaatggttcctgtgtatgcattggaatcggtaagagacaccaagtaa

SEQ ID NO: 110558 - DNA, 918 bp, Glycine max
  Peptide Sequence Number=SeqID_227336
atggatgagcacagcctactccaacatcccaactcccttcaggctgggagcaagatagtatggcctttcaccatagcgtttattcaagaattgaaaaatgacctgtcccagagagatgcaactcacttccactcttccaccccttgtggatgttgggggacttggttatttttaggaagttctgatgtttgtatggtgcagtttttgtcagtattgaattctgatgcagcatttaacagcgaaattatccgggaatgctatgaagcttttgcattatactgctttgagagatatttgatagcttgcttaggtggtgaggagaaaacaattcaatttatggagaacatgagcctaacagaatccagcattcctcttctgaaagaagcctatgcatatggagttgtagagcacccatttcccttaaatatcttcttggaggattggaatctaggccctgagttctatcaatctgtgaaaattggcattgtacaatatatgatactgaagatgatctgtgcattactggcaataattcttgaatcttttggggtttatggagaggggaagtttgaatggaaatatggagatatgaaaatcattcttgcatctcctcctatctgtttaagatttatggagaattggttattgacatggtatccatacttggcactagttcttaactttagtcagacatgggccctatattgccttgtacagttctatgctgttattaaagataagttgaaacccatcaaaccattggcaaagtttctaacttttaagtcaattgtcttcctgacatggtggcaaagtgtggctgttgcatttcttttttatatgggagcttttagggggtcattggctcaggagttgaaaacacgtatacaagactacatcatctgtatagaacattcttaa

SEQ ID NO: 110559 - DNA, 354 bp, Glycine max
  Peptide Sequence Number=SeqID_227337
atgtgggacttcacctcacacttgtactccaataatctccccctcatgtgtgatacttatccacatggtagcctccccctcaagcggaagtcattttcacccatgagtatttccatggtgcaaccaggcccacttgggccttccagattcttcctccagaaggcggttgcttttggaggaagcaacctggctcgcctgggcgagctgggtgacaagctcctcccctattttgctataaatagggggaggagtggagaagaaaacggttcagccttcttggcacttcgtattcacctgaaattgctaaggaaaattgtttccgtgaagaaaatccaagccgaggcgcttccgtaa

SEQ ID NO: 110560 - DNA, 267 bp, Glycine max
  Peptide Sequence Number=SeqID_227338
atgccggttacggaaatcagcgtgaacagcaggcccatcaggaagaccgcgcccagcgccaccggcacgctaatgtgctggcccagtaccaggctgaacgcggtgaaggcggtcagggagatggcacagccaatcgccatcggcaggttggcccacagtcccatgatgagggagccaaagctggccaccagacaggtagcgacaaacaccgccgtcggtgagaagcccgctttaccgagcatgccaggcaccacgatgaccgaatag

SEQ ID NO: 110561 - DNA, 297 bp, Glycine max
  Peptide Sequence Number=SeqID_227339
atggtgatggtgacacgagatgactggggtgacgaagagatggcaatgacggtgtcgcaaaatgctagtgagggagaaagggtttgcgagattgagcatgcgggggggaaggagagactgatggtggcgctacacaaccacagtgatcacctcttcctggtttccgacccacatttgcaacatacccttcctcacggcaccaccaacagtgtacccaatctccttgaattaaatgctttctactctcctaactcttgtaaaatggaactgaagcagatcgaaaccttggatttatga

SEQ ID NO: 110562 - DNA, 213 bp, Glycine max
  Peptide Sequence Number=SeqID_227340
atgaccaacatggagatagggatagacatgagtttgttgtcggtgtctctgcgtagtggtgccatggaaaggagttcgtcatcgtatacctctgaggcccgaagttgcgtgttttgtctgtgtaacatagaggctccactagtgacatcgtggactgaggaaaatccagggaggcatttttatggttgtggacttgatgaaggaggtcgatga

SEQ ID NO: 110563 - DNA, 273 bp, Glycine max
  Peptide Sequence Number=SeqID_227341
atgtggctgtcacgaccaaggttgcggactgatggtttaatccatgagaatgattgtatggtctattctgcatcctctaatggaaccattagttgtactgacttagagactgtaatatcatcttctccagtgatccggaatcctgatggatggcagggttctgctaataaatggtctgctaatagtgtaagaactgcagttggagagcagtttgatgcaattacagctgccagagaaggactacctgtactttttagaagaggtacgttgtaa

SEQ ID NO: 110564 - DNA, 375 bp, Glycine max
  Peptide Sequence Number=SeqID_227342
atggcattggtagcccattttgacttggagctacatccaatggatgtgaaaactgggtttcttaatgaagatttagaggagaatgtttacatggaccaaccaatggggttcttagttgaaggaatgaaatacatggaaaacattgttgatcggtgtatatatctgaagggaataaaggatcacatggttacatataggagatttgatcactttgaggtgattgggtatttagactcggactttgttggatgtgtggatacaagaaaatccacccttggttttgtatttcttttagccggaggaacaatatcatggaagagtgcaaagcaatttgttgtttctacatccactatggaagttggatttgtagcatga

SEQ ID NO: 110565 - DNA, 192 bp, Glycine max
  Peptide Sequence Number=SeqID_227343
atggcatccttgcttcaccaaacattgcttattgaaaccaataatgtgttaaggagtaagttcttacctaagaagcacgaacgcggcacttcatcggtgtgtcccgcgtcgaattcgcaccggacacgtatgcgggtacgactccggtgcaacacgatgtccgtttcttccgctgtcaccagacacggttga

SEQ ID NO: 110566 - DNA, 2665 bp, Glycine max
  Peptide Sequence Number=SeqID_227344
atggaggatgatgagctattagatgaaaaaatagaggtgatcaaagagaataaggtgatcactgtgacatctaatcaacgggataaagctcagcaaccaatgaatgctctctcagcttcgacctatcaaaccatgaggccaagaagctggggtgagctagaatccataaccccactccctgtcactatggaaaatggtactcagttggaggcattatacgtatgcagacattttttgccgcaattacaacaaactcagttcacatttgatgccagaaatggagttttctatggaaggtgtgaggaattccagaatatctttcaagaacctactcaaattcccccaaggagagctggtttttatcacaagattcctttaaaggaggagtctattccctttaacatgcgaccttataggtattctatcattcataaggatatagttgataagttggtggaagaaatgcttaaccaaggtatcatctggaggctcaaccagcaagcagtcaaagataagttcccaattccacttattgaagatttgatggatgagttgaagggttcctctatctactccaagttggatttgtgctcaggttatcaccaagtgagaatggaggaaggagaggatagagcaagtgcacttttgccacctcatgagaagagtacttgggccattttatttcccaagaaggggagatttgtacaaaattttggcagtatttccaaacctctcaatgacatgcttaaaaaggactgtttccaatggtcgatagaatctaaggatgcatttcactatttgcaacaggctttaatatccacacccattttagcccttccaaatttttccaaaccctttgtggtggaggcagatgcctcaggttcaggagttggggttgtgctaatgcaagaaaaacaccttattgcttacatcagtaaagctttgggccctaaacaactggccatgtctatctatgagagggaattccttgctattgtctatgcaattcaaaagtacaaacctgatcttgcagcctctccgaaccttttacaacctctacctattcctcattgggtatggaatgttattagtatggacgttatagaaggcttaccacattctcatagtaagcaagctatatttgtggtggttgatagactgagtaagtatgcatgtttccttgcattagcatatccttacacggatctagatatagctcaattatttttagatcacattgtcaagttacatggctggccaaccaccattacttgtgacagagaccccattttcgttagcgggacttggagtgaattagttcagctacatggtacttcagttaacaaatccatgacttaccatccacaaactgatagtcaaactgaggtggtgaacaaaccacaacctcttcctactaattccactatgtcattcaagaaagcagagcctgaagctattttggatagaaaaatggtgaagaggggtcgtgtggctaccaccaaagtactcatcaaatggaaaggtcttcctgtagagcatgccacttgggagaattattcatacattgaatcccctgttcttgggtcgacgaattcttggagaacctatcttcctgaaatgccccttaagactaccttcttgtggaacaccattctctccactacgccaaggctcgcaacttggactctgcgcgctgatgctattcacatgtttctccaaatggttccccctggaatttctgaccaagctctggatgttggaaaaaaggttcattccttcattgtaaaactagggtcttctggggttattcttatggcaaactcattgcttaacatgtatgcaaagtgtggtgattctattatggcaaaggttgttttttactggatgaggctaaaggatacatcaacttggaatactatgatttatatgcatatgcaggttggtcaatttgaccttgcactagcactatttgatcaaatgactgacccaaatattgtcacttggaattccatcatctctgggtactgtcgtcagggatatgacatcaaagccctcgaaacatttccttttatgcttaagagttcgtctttgaagtcgaataagttcacattgcaaagtattctgtcagcttgtgtgaatcctgaaagcttgaaacttgggaaacaaatccatgcacatattgtaagagctgatgttgacatcactaggtggctgctgaaaaattgcttcttattgatcccaatagcgcttgctaatacactttcaacttgtggtaaatgggatgttgctgccaaggactctcttcacccacaaagagatgcaatctaccatatgatttccaaaatatggaaggagatcaagaaaatgggctttattcctgacaccaattttgtattgcatgacctagagcaagaagtgaaagaacaaatccttagacatcatagtgaaaaactcgccattgcatttgcattaataaatactccagtgcatactacactgaggatcataaagaatcttagagtcagatggttcttgctcttgtcaggattactgatagaagaaatagttgaatttcatgtcttaaagggaatgattggaggaatgattgagtcaatcaagcttacagatgaagtctcatattaccaaattggacatgttcaggaac

SEQ ID NO: 110567 - DNA, 429 bp, Glycine max
  Peptide Sequence Number=SeqID_227345
atggaggcgtttggttcgcttgcgggaaacggcaaggagaagatgaagaagaaccattttccggaagaaacggacatcgtgttgcaccggagtcgtacccgcatacgtgtccggtgcgaattcgacgcgggacacaccgatgaagtgccgcccttcaacggtgccggtttgagtgctgaagaggatggtgaccttcttggtgtcatcgtcaacttcgatttcgggaagcttctcgatgacgcgtttaggaggctcgagaggcttggccttgggggaggaggatctgcaccagatgaagacgacgacacagccgatgaggacgacgaagaaggtggtgaggagcatgaggaagtcacgggagtgatacacgctttagggtttggaggggaggagtggggtgtagcggggggtggagtggttgagagatga

SEQ ID NO: 110568 - DNA, 1137 bp, Glycine max
  Peptide Sequence Number=SeqID_227346
atggaaggaaaagaaactgagggaatgttgaagatgacgacagataagagacaacagaagcgaagcagaagtgacagagaagaggaaagggacaggctgagtgagttgcctgactgtgttgtgctccacataatggaatttatggacacaaaatatgctgtacaaacttgtgtcttgtctaaaagatggaaggacctttggaagcgtctaacttatcttggattcaatacaaccctctttaacaatgttgtcaaattcaacaaatttgtgtctcgcgttctgtctggccgagatggttcagtttccctgctcaatcttgaattcacgcgtcgcggtatggcagagcccaagctcttcaataggctgatgaaatatgctgtgctgcacaatgttcagcagtttacagtatctctaaatttaagcttcagacagagtttcgagtttcgcccctacatcttttcctgtgagtccttgacatttctgaagctttcatttaattcttttgacacctcgattgtagcacttccaggatctctgaacatgccagcattaaaaagcttgcaacttgaggctgtctcttttactgcaagggacaatgactatgctgagccgttttctacctgtaatgtgctgaatactttgatacttgatggttgttcattgcataaagatgcaaaattcctctctatatcaaattctagcctctctagtttgaccataagtggtagctttgaaggaggagcttacaaaattgcgctttctactccaaaccttagttctctcacagtcacgggtcataataatcacacaatctcctccgcatgcaatctttctttccttgaagaagtaaccattgacacccttggttatacactttttccgaatacagacttactcatcataagctggctgcaagttctcaccaatgtaaggatactgaggctctattcgggtacccttctgacaatactacgggatatatcaaatcctgtttcggtgagtactcagcctccctgctttgttcaattgaagtcattgattttggagaaccaaccatctgcagatatatcttttgagcaactaaagagagcagtggagtacctacttcaaaactctccacaacgtagaattgattaa

SEQ ID NO: 110569 - DNA, 350 bp, Glycine max
  Peptide Sequence Number=SeqID_227347
atgtctgtctccgccatcttgctgcttgttggaatattatcgtccattgaagtactagaatttacagctgcagcaccacttgtagcaccaattgtaggaatttgctatggaataaacggtaataatctaccatcaaagcaagaagttgtggatatgtttaaatcaaggggtatacccagaatgcgcatatactctccagatgaagaaataattcaagcccttagaggttcaaggatagagttggtgatggacgtggctggagataccattcaatctcttacagatcccaatgttgctgctgattgggtccatcgttatataacatcctattcacaagatgtcaatttcaa

SEQ ID NO: 110570 - DNA, 102 bp, Glycine max
  Peptide Sequence Number=SeqID_227348
atgaagcaaaatcttgaaaataaagtgaaacgccaaattgtagacataatggaagagttatcagcctctgaatcacctactaactcaagtgctcaggtttga

SEQ ID NO: 110571 - DNA, 756 bp, Glycine max
  Peptide Sequence Number=SeqID_227349
agataatctggcggattcgatcgttctttgcgatgcctatttctctagcgcggattgcgaatttatgcaattggtgttggcggagtgccctgatgccaagctcacagtgctgacgagcatgaaaggagtgagtcacgaggaattcagtcaggacttattcctgagccgctggaagctcctatcagatgatgatccgccagacactgaaattattgccattgcaggatacgataacaagggtcagatcctcatccatgatcgttggctgattagcggggacgccgctcttaggctgggaacttcctttaacagtttgggaatgggaaagctcagcgagctttctcctgtggtggctgaggggtgccctgctgtgcttgaagagattgcaaagtacaaggcgaagaaccgtttagtgaacggtgtccgtgcgcaaacgaggagagggaagatgctagtgatggttaggcacgcgcagagcatggctaatgcgggatttgtaactgccgacccggagtccattgcccttacggccctgggcgaggagcaggctcgcgcattggcaatgacctggtcggctgcgcctgaccgcatatttacctcaccattcttccgggctaggcagacatcacaaccactcgccgaacgcttcaagctggtcgttgcgcccctgggggtgcaagagttcacttatctgtcgcctgagcggtgcgtgggcacctcggcagcagaccgcaagcagtgggtagaggactactg

SEQ ID NO: 110572 - DNA, 429 bp, Glycine max
  Peptide Sequence Number=SeqID_227350
atggtgaaagttggaacctcttacgtgccgatcaacgtctcattttcgccaaaagttggcccagggcttcccggtatcaacagggacaccaggatttatttattctgcgaagtgatcttccgtcacagctgtccctcctgttcagctactgacggggtgggttttcccagtcacgacgttgtaaaacgacggccagtgaattgtaatacgactcactatagggcgaattggagctccaccgcggtggcggccgctctagaactagtggatcccccgggctgcaggaattcgatggagtgcactctgagcaggtggaggatgcagtcctgggaaggctcggaggaatctgaaagcacagtcaagcagttgcatcactttgggtgctctgggctgcaagtcatgaacacccagtttttaaactgggtttaa

SEQ ID NO: 110573 - DNA, 165 bp, Glycine max
  Peptide Sequence Number=SeqID_227351
atggaggtggagttggagccgcgcgtgaaggctcttcctttcaaggtgaaagcgatgtcgagagaatcgccgtcgcagaaggcgcttcacgttctcgacaccgacctccgcactcactggtccaccgccacaaacaccaaggagtggattcttctagaactcgat

SEQ ID NO: 110574 - DNA, 393 bp, Glycine max
  Peptide Sequence Number=SeqID_227352
atgatgatgtcaggactctttgtgaagagattcaacgaatttctgagaaacaaaggaaatcaaaggagatcaaatatcaatccaaagaagaaaggagaagattcctccttagccccaaagttctacgaatgcgatcaacttgggcacttgagattcgactgtcttatctttaaaagaagaatggaaaaatctgacaagagaaatttcaaagaaaagaaagcatgcatcacttgggaagataatgacatggattcatcaagtgattcagaaaatgaaatcataaatctcgatctcatggccaaagactatgaaagcggagaagaggttttcatgatgccaaaaagaattcacttgataacgattgtcatcatcaaaaagggggagaatgtgaat

SEQ ID NO: 110575 - DNA, 177 bp, Glycine max
  Peptide Sequence Number=SeqID_227353
atgacctgcgctccagagccaatggccgaatctgcccgatcagaagtcgcttgttcagcacgttcggaaggggttccaacaggtgctaagtccatgatcagatttgctcatgatcgaagaaaagaattaggaaggatgagatggcaaagcctcggctacaaccatgcgtctggctaa

SEQ ID NO: 110576 - DNA, 246 bp, Glycine max
  Peptide Sequence Number=SeqID_227354
atggcttacacccttgccactatatcgtccatgatcaaagtaagccctcatggagatttgccatgcatcaacatcaaatgtcgtgttgagcttgcacactattgtttgatagaagaagagaaggatgcctcatatgctaatgtgactaggaaggtggtggccaggttcatcaagaaagaaataatttgcagatatgggttgcctaggaagatcatcaccgataatgccaccaatttgaacaactaa

SEQ ID NO: 110577 - DNA, 363 bp, Glycine max
  Peptide Sequence Number=SeqID_227355
atgggaaagctaaagcctaaaggtgagaggagtttggatcggagtgatcatgtcagctgcatcctgcaaatatatataaatttctcttcagccctgttggttttatgtgtcaaggtcgttgggaaaagaattgcatatattgctctgagaggaacctcggatcctcttctctcatcgtctcacagttgctgcgcagtagtgttctctatggaaatgctttgtgttgaattgaagttctccatagttaaatacttcacaatattgaaaacaaatgagcatgctgaaatgaaaaccccacttgggcctgtccatgcagcaaagctaaagtttcagcttttatggcatcagcagcagcagcagtag

SEQ ID NO: 110578 - DNA, 1074 bp, Glycine max
  Peptide Sequence Number=SeqID_227356
atgtcggctaactgtgagaaaatggtagccatccctccaacgaccaaccaatggccacaggtggatgatcacaaggtcttgatgggttccaacggtggaagtagtaacaacaacaataataaggtattggaaaaaccaggtcaagatcagcttgtgcagcagcagcaacaacaacaagaagcccccaagtgccctcgttgtgactcatcaaacaccaagttctgctactacaacaactacagtttgtctcagccacggcacttctgcaaagcctgcaagcgctattggacaagaggtggaactctcagaaacgttcctgttggtggaggctgcagaagaaacaagcgtgtcaagcgtccattaataacgacaaacccttcttctgctgccattgacactgctgcttctaataattcttctaactcttcttctgctccactacaacccccgatcgacactgcttcaacctcaaatcacatcaaccctttgttttatggcttaccaagtagctctagcgatgtgaatcttccattgttctctaggttcggttctagaatctccagctccgggtttgatcttcagctgaataatgcccttggattaggtttttcatccggggttttgtccaatgaagctagtgataataacggttacagaaactggtttggttcaaacaatacgcttctttcaagttatacatccaccactagtactactactccagctatgtcttctcttttgagctcttctttgcttcaacagaagttcatgacagatggtgttgatagcaccaacactttccagcatggcttaggcttaaccccactagagcagttgcaaatggcaagtgatcatagcagtgaggcagggatggtggccttaaaagacgtgaaagtagaattaggacaaaacaacaggttggagtggaataatggtgctgcttgccaaagccagatccagcatgtgggcttgtacgatccttctctttattggaataattcagcggcaacagctttgggtgtttggaacgatcaagctgctaatattggttcatcagtcacttctctgatctag

SEQ ID NO: 110579 - DNA, 201 bp, Glycine max
  Peptide Sequence Number=SeqID_227357
atggaattgatcctcaacatcgattgcggcggagaagaaatgaaatgctatgggaatagatacgtttgggaatgtcatggccttgtattgatgtccaggaaggagaagcctatgggtttactctttgctattcaagttgctatcgaaatggggctgcaacaagtgtgctttgaatctgactgcaacaaatggacaaattaa

SEQ ID NO: 110580 - DNA, 1488 bp, Glycine max
  Peptide Sequence Number=SeqID_227358
atgaattttttagattcagtggttgattctccagatggatttctgcttgaatggtggtctattttctatgaggtatttaactctaggcaagggaaggacctagagactgggccagggtcctctagtaaggtcccaatgatgacacataatgcaaggaataatgctcccccgagaatccctcaaatatcaatgagtgagcagagaactccacaatttcaagtcaactccagctttaacaacatgatggctcaaccagccgtttgtgtaataccttcaacaatgtacaataaagaagagcatcttggatatctgcccgaaaatgttgaaccaagtttgcatgatgttataaaaaataacctgacgttcttgtcagggattagttcaaattatccaccgcaagatgtactaagcaagcaggcccagaagcaagtctttaaggatagtagagttggcatgagtgtggagagggatatacctagggacccattggatgatgcaatccttgctcaagcaattgcaggtacttctaaaaatcagacttccacagttcctgaaaactctagcaaatgcaacactaggaagatttctgagactgaatcaagggataaggataagcaggtcggttgccttcattcaagcaaaagcaaggttttgtctagccatttttcatcggatggaaaagttttggcaagtgctggacatgagaagaaggttttcatttggaacatggaaaattttgattgtgtaactactacagagacacattcacttcttgttacagatgttcggtttagaccaggttcaactatctttgctacttcgtcctttgatagatctgtgagactatgggatgcagccagaccaaccagttctctgctcaaacttactgggcatgccgaacaagtaatgtcattggacttccacccaagaaaagtggaccttctttgctcatgtgatagtaatgatgtaattcgactgtggaatatcaatcaaggtgtttgcatgcatatcactaagggaggtagtaaacaggtcagattccagcctagttttgggaagtttttggctactgctacagaaaataatatcaaaatatttgatgtggagaccgacagtcttctgtacaatctagaggtaaccttcgagggacatgttaatgatgttctctccatttgttgggataaaaatggaaactatgttgcctccgtcagtgaagatactgcacgtatctggtcatcagacggaaaatgcataagtgaattgcattcaaccggaaacaagttccaatcatgcgtatttcatccagaatatcataacctcttagttattggtggctatcagtccctggaattgtggagtccctctgagagcagtaaaacatgggctgttccagctcacaagggattaattgctggactagcagattcttccgaaaatgaaatggttgcctcagctagccatgatcattgcgtgaaactatggaaatga

SEQ ID NO: 110581 - DNA, 408 bp, Glycine max
  Peptide Sequence Number=SeqID_227359
atggattacaaggaacctcaggatttaagagtgaaggagatgcaaagaatccccaacaaccccaaaagtgtcctagatgcgactctctcaacacgaaattttgctattacaacaactatagtctgtcacggcctcgttacttttccaaatcatgcaggaggtcctggactcaaggtcatgttggattttttggactcccttcttatgtggaataaatgttcaaataagaagccaagaaatgcagctgaacgaagcagagacgcaggatatgattctgcagaggcaagaggcaaggcagatgaaatgtcaaaagagcaagcacaagaagtgaaagaaagcaccaaagaatacgcacaagacgcagagggacgtgagggaaagagcagagtgtgcaaaagagaaggatga

SEQ ID NO: 110582 - DNA, 954 bp, Glycine max
  Peptide Sequence Number=SeqID_227360
atggagcaacgagttggagaaggaggtggcatgaacaagcaacctcgagattcaagagtgaaggagattcaacaaggtgatgcacaagttcatgctcaggctcctcaacaaccccaaaaatgtcctcgatgtgactctctcaacaccaaattttgctactacaacaactacagcctgtcacagcctcgttacttttgcaaaacatgcaggaggtactggactcaaggtggaaccttgaggaacgttcctgttggtggcggttgccgcaaggggaagcgagccaagacttctaactcatcatcttcatcggagaatataaattcttctttccggtcacttcctctacaacaaccgcaagggatggtggttcaaactcaagcaccacccttaacatcggtagtgaaggctaaagacccttcttcagttgtggcttcacccttttaccaaagtggtggatacttgtcttctttggctgctatgcattcactcaacccgtcatcatcacacccttttgatcagtctctaaatgttattgcggggagtgacgccttgcgttcttccaatttgggccttctatctggtttcaatgttcagcgcccaattgggcaaatttgtccaccgtacttgtatcatcaaatggggagtgatgaaagggagatggtgtctctgtatgaacaaggtttggttaatccatcttcatccagcatggctaatactaatactaatactaatggcagtggtgtttctcagcatgattggcctcagagcttcatcaataataatgttagtaatagagcctctgatgcctctttgtggagcaccatcagcaccactattggtggtaactctgagaggactagtactagtggtgttggtgttgatgttggtgctggttcttcttctttcgtcacgaatcaatggcctaatcttccagggtatggtcctccaccgtga

SEQ ID NO: 110583 - DNA, 307 bp, Glycine max
  Peptide Sequence Number=SeqID_227361
aacgttttttgaagctgggttgcttctaagcaacccagctcgcctgggcgagctaaggtcgcctgggcgagctgggcggcaacctcctccccctttttcctataaaaaggctgaagggggctgttctaaggatccctcagccccctggctatgtatttcagctgttttgggtgaaaaaaattgtttccgtgaagaaaatccaagccgaggtgcttccgtaacgcttccgagatgtttccgtaagcaaatccgtgaaggttttcgtccgttcttcatcgttcttcatccgttcttcgttcttcaacgg

SEQ ID NO: 110584 - DNA, 240 bp, Glycine max
  Peptide Sequence Number=SeqID_227362
atggcaaatcaagaggagtgggtaccgtttgcggatatactagctttgctaatctttggggttgtcctctttccaaacgtggacggtttggtggacctagccgcaattgatgctttccttgcatatcaccatagcaaggagagcctggtggaggtagcacaatcaactggtttcctcgatggaaggaaggaaaggagggagttctcttctcatgtggggactacccaaacgttccgttga

SEQ ID NO: 110585 - DNA, 234 bp, Glycine max
  Peptide Sequence Number=SeqID_227363
atgtttgcgctcaaacatcatcagaggttcaacgttgcaaagcaggatgaggtgcatgggtcggataatgatgatgatgatggtgatgaccatggtgatgatgatgatggtgaagatgtgaagggtgggatggtgaatggggatgaggagagtgaattgggttcaaacacagtgataaagctcagtaggaacatgaataatgtcaaggctttagccatttttctactcaagtgg

SEQ ID NO: 110586 - DNA, 297 bp, Glycine max
  Peptide Sequence Number=SeqID_227364
atgggagttgctacgtgcacccagcattattgctggggcacccagcaaacagtgaagtggcgaaactgcccttcagcaattattcttccggaagaaggttcttccggaaagtttccggaaataatttttccggaaagtttccggaagaataatttgtgtcttccggaaatactcacagacaatttccggaagaacgtcatccggaatgtttccggaagaagcttcttccggaagaattccagtgtcttccggaagaagcttcttccggaagtcttccggaagaagcttcttccggaa

SEQ ID NO: 110587 - DNA, 1608 bp, Glycine max
  Peptide Sequence Number=SeqID_227365
atgggggaagatggttattcttggattaggaggacaaaattttcacacactgtctgccatcgtttggatcctgctaggttaggctctattcctatcagtgttcagtcagagcaaaaatcaaggcctgctgcctcaaaggctcagagacaccccataacaaacaagcagagatctttgtcaccattgcctgagacttatctttctgaggccttcagggaagctagacatgaacagaagaggttctccacgccgaatccccggagggaaaagaggattatggggaagttgttgaacaaagattctagggagactaaggaatcaagttcaaagtcaccttcgcatagtccaaataggcaagtgaagtcaaagaaccgcaaggattcagcatggactaagcttttggacaatggtggaggaaagattactgctgtggaaacagctgaagagtggaatgttgacatgtctcaattgttttttggcctaaagtttgctcatggtgcacatagtcgactttaccatggtgtatataaggaggaggctgttgctgttaaaatcattatggtacctgaggatgatgaaaatggagctttggcttctcgattagagaaacagttcattagagaagtcacccttttatctcgtcttcaccatcaaaatgtcataaagttctcagcagcatgcagaaagccaccggtttattgtattatcacagaatatctggcggaaggttccttgagggcatatttgcataaattggaacaccaaactgtttctctacaaaagctaatagcttttgctctggatattgctcgcggaatggaatatatacattctcaaggtgtcattcatcgggaccttaaaccagagaatgtcctaatcaacgaagacaatcaccttaaaattgccgattttggcattgcatgtgaggaagcatcttgtgacttattggctgatgaccctggcacctaccgttggatggcacctgagatgatcaaaaggaaatcctatgggaaaaaggttgatgtctacagttttgggcttatgatatgggagatgttgactggaacgataccatatgaggatatgaatccaatacaggctgcttttgcagtagtaaataagacctttttgaatgaccagcatggaagagtagtgcaaactaagcttcttacaattggtcattcatttggcttgcagctagacaagaattcaaggccggttattccatcaaactgccctcctgcgatgcgagctttaattgagcaatgttggagcttgcaaccagacaagaggcctgagttctggcaggttgtgaagatattagagcaatttgaatcttcacttgccagtgatggaaccctgagcctggtgccaaatccttgttgggatcataagaaagggcttcttcattggattcaaaagcttggtcccttgcaccaaaatagtggcccttgttacagtgactcgttcgtccgagttactaacccttatgccgctatgcttcttcctcttcgtggtgtcctttttctgcttcttgttgttggtggtggtggtttgtggttcttgctggtttcggttcttcttcttagttgggtcatcctctttgag

SEQ ID NO: 110588 - DNA, 1782 bp, Glycine max
  Peptide Sequence Number=SeqID_227366
atggcaccgtttgaagacactcttccggggcacggcttagttttcatcttcacccctgtcactggcatccaaggcacaagttcagcccaacaccttggtctgttcaacctcaccaacaacggcaactcaagtaatcacgtgttcggtgttgagttcgacgtgttccagaaccaagagttcgatgacatcgacgccaaccatgttgggattgacataaactctcttaaatcttatgtttcccatgatgctggatattggccagatggcgctgacaaatcctttaaggagttgacgcttaacagtggtgagaattaccaagtttggattgactatgaagattcttggattaatgttaccatggcaccggtgggtatgaaaaggcctagtaggcctttgttgaatgtttctctcaacttatctcaggtttttgaggatgaaatgtttgttgggtttactagtgccactggccaattagttgagagtcataagattttggggtggagtttcagtaatgagaaattttcattaagtgatgaacttattactaccgggttaccatcttttgttcttccaaaagattcaatttttaagtccaaggggtttgttgcagggtttactgttggagttttctttgttatttgtctccttgttttgttggcactgtttttgattcagagaaagcgtgagaaagaaaggaagaggatggaaatggaagactgggagttggagtattggccacacagaatgacatatgaagaaattgaggcagcaacaaaggggttctctgaggagaatgtgattggggttggtgggaatgggaaagtctacaagggtgttctacgaggaggggtggaggttgctgtgaagcgcatttctcatgaaaatgatggtttgcgagagtttcttgctgaagtttcaagtcttgggagactgaagcaaaggaatctggtggggttgagaggttggtgcaagaaagatgttgggaatttcttgttaatttatgactacatggaaaatgggagcttggacaagagggtgtttgattgtgatgagagcaagatgttaagttatgaagacaggataaggattctaaaagatgtggcttttgcagtgttgtacttgcatgaggggtgggaagataaggttgtgcacagggacatcaaggccagtaatgttctacttgataaggatatgaatggaaggctcggagattttgggttagccagaatgcatagccatggtcaagttgctagcaccacaaaattggttggaacagtggggtacatggcccctgaagtttttaagactggaagagcttccactcagacagatgtttacatgtttggaatcttgattttggaggtcttgtgtggaaggagacctttagaagaaggtaagccacctttggtggagtggatttggcaactaatggtacaagggcaagttgagtgtgcactggatgaaaggctaagggctaagggagagttcaatgtgcaagaaatggagagggtaatgcacttgggtttgttgtgtgcctaccctgaaccaaagaccagacccacaatgagacaagtggtgaatgttttagaggggaagaatgaggtagaggactcagaaattgagaatatggatacctatttgctccaacagttaaaatcaagggacatattgtctgaatattctcagtattttagctatacgtcacacccaactttccaagatattcgtctctcttcctcaatgtctcttacatggtccgaatctgtagttgagggtaggtga

SEQ ID NO: 110589 - DNA, 321 bp, Glycine max
  Peptide Sequence Number=SeqID_227367
atgaaagaggtggagaaaggatacacgcgagaagagtttggtttcttggtggggatttttttgttgtacaaggcacgaccgacggagaatctttgctggtgggtgagtgttagaattcgagaatcgacggtggcgttgccaaagagcaacacttcagaggagttgaagccgttgaagacgaaatctatggcacatgttgagttgaaaagaaagagaattgagagaagaattgatggaagatggtgtgtgtgcttgtgtctgatcatgtctttagcagagaacaaacagaggggtgagagtgagaaagacttgagaatgtag

SEQ ID NO: 110590 - DNA, 1530 bp, Glycine max
  Peptide Sequence Number=SeqID_227368
atgtcaaaagacagggaggagttttccaccgagattgtgcagagaggtgttgagaactctggcccaaatgctggctttctttctttctctgtgaaagtgaagcctagactgccagatttccttagttcagttaatctaaaatatgtgaaattgggttatggctacctcattagccatcgcttgtacttgttgctggcaccacctctccttgcagccttcattgctcgtattggaaagttcacttggcaagacctctatgagaaatatggtttcattgagattctatttatatcaggacttttgggcctaatgctatatttttatattgacttaacacccggctctacctatttgcttgatttctcatgttttcgcccttcagatgaatgcaagatctctaaggcagagttcattgagttagccaaaaaatctgggaatttcaatgatactgccattgagtttcaagaacgagttcttaagaaatctggcattggcgatgagacctacctgccaaaaagagtttttcaccctggttacagaaactcactgaatgatggcagacaagaggtatccatggtgatgtttggggcaattaaggaccttcttgctgccacaaaagtgaaaccaaaagatatcagaatcctgatagtaaactgtggaatactaaacaccaccccatcactctcatcaatgatagtaaaccatttcaagcttaggcatgacatccatagcttcaaccttggtgggatgggttgtgctgctggaattacagctattgatcttgctaaagaccttctggatgcttatccaagaacttatgcacttgtagttagcacagaagctgtaagctcaacatggtacagtggcaatgatattggcatgctgcttcccaattgcttcttcagaatgggagctgcagccatcatgctctcaaactttcacctagatagatggtgcgccaagtatgaactcaaacagctggtccgaactcacaaagggatgaacaacagaagctacaaaagcatacatcaaagggaagatagtgaagggaggaagggcatttctgtgagtaaagatgtaattgaagttggaggccatgcactaaaggccaacatcaccacactaggtccactagtgctacccgtttcagagcagcttcacttcttcaccaacttgatcttcaagaaaaggaaaacaaagccatacattcctgattacaagctggcgttcgagcacatgtgcattctggcaacgagcaagaaagtgctggatgagattcagaagaacttggagctcacagaggaatacatggaagcatcaaggaagacattggagcgatttggcaacacatcaagcagcagcatttggtatgaactggcttatcttgagttgaactcaaggatcaaaaggggtgatcgggtttgccaaatagctcttggggcagggttcatgtgtaacagtgttgtgtggaaggctcttaggaatgttgggagacccaagcagagtccttggattgaggatgatagctga

SEQ ID NO: 110591 - DNA, 456 bp, Glycine max
  Peptide Sequence Number=SeqID_227369
atggacatagactatgctataaggaaagacgaaccacatgcaatcactgatgaaagtaggcgatgggagcgatttagccggctcagcgtgatgttcattaagaccaaaatcttggttgggatacgtggttttgtcgaccagcatgaaaaagtcttagacttgcttaaggccattgatgaccagttcatcacttcagataaggctttagcaagcaccctgatcatgaagttctcctctcttcagctcaccagtgtgaaaggtgaagaagaaaggcttgtaatggagatgggtaagagtgcattgctgcaactacttgtgggaggaacaaagcagttaagtcttgatctaatcagaaggggaatgaagaagggacgcatgaagaaaaattgccttagattccaaaaatggcttgagaagaaagggtatgcaaaacctaaggaaactagtgggaagtga

SEQ ID NO: 110592 - DNA, 813 bp, Glycine max
  Peptide Sequence Number=SeqID_227370
atgacgcgcccgttcttccgcgagctgtacgatcgtaaaagctgtatcgcctttatggacaaacaaccgctggtgatcgatgccgaaaccgaactcgatcgggtcgcgcagcaggtggtcgccagcggggataaatcagtaaccgatggctttatcgtgactgaacagggccgctatattggcatcggtctgggtatcgacctgattcgtaccgtctccgatttgcaggcgcagcagcatcagcaaattttacagagcatcgattacgcgcgggtgattcaggacgcgatgctggaccgctcgcggcagcagatggcgcagcaactaagcgactggtgcctgcactggcagccgcgcgatggcgtgggcggcgactattacgcctttcaccgcgacgagcacggctggctggcgctgattgccgactgcaccggtcacggcattcccggcgcgtttatgacggtgattctgcatgcggcgctggagcgtgcgctgcagcacaaccatcgtacgccgtctgccctgctgcaggcgcttaaccgccacatcaaacaaaccctgggccagcttaacgcctcgcagcagacttcgctgtccaacgacggctgcgatgcgattgcgctgcggctggagacggccagccatcagctgagctgggccagcgcgcgcatgcacgccgtgctgcagccggtacaggggaagccgccgcgctgcaggccgatcgcgtcggcgttggctacaccgatacaccgcacgactattgctggccgcagcagcagcgcacactgcagcccggcgatgtgctgctggtga

SEQ ID NO: 110593 - DNA, 1021 bp, Glycine max
  Peptide Sequence Number=SeqID_227371
ggacgatgagtacgcagattttcaggaaaagatagctcgccggcgttggacgtcgctagtcactcccatggctaagtttgacccggatatagtcctagagttttacgctaatgcttggcccatggaggagggcgtgcgagacatgcggtcatgggtaaggggccagtggattccttttaatgcagacgccctcagccagttcctgggtgacccgctggtattagaggagggccagaagtgcgagtttagtcagagaaggaaccgggccgatggatttgacgaggaggccattgcccagctgttatgcataccgggtcaggattttgctcgaaccgctgccgggaggcgggtgcagatcatgtgcaccagcatgaccaccttgacccagatgtggatgacattgctgctcagcaatgtcctgcccaacgatcataactccgacctccctctgtcgaagtgtcagctggtgtatgccatcctgacacagatgagcgtccatgtggctcagttgatcgctgacgccatttatttatttgcaggtatgccacctaccaggcaccctctagacccagataagtctaacagggccctggggtttccaacattgatcacgggtctctgccagtcattcagggttcccgtcacacctagtaaggtgattcgaccgccgatcacccgggccttcattgagaagtattgcacgcctagacaggccgcagacgcaccgccaccacctcatcaggctgatccagctggggcattggcatggagcggtatttacaacacttggttcgccagcaggcggccaaccacagggggcaatcagcagagtcagggtttcgctccttttgcgtgccctactccagatcagttcaggactgaggttgcatggcccggagattggcctgaggcccaggcaggggaagctcctgcagaggctcccggcgatgcagaggaggcccgcatggatgaggagatgacagatttactcggtttcttgggagggagtggagccacatga

SEQ ID NO: 110594 - DNA, 534 bp, Glycine max
  Peptide Sequence Number=SeqID_227372
atgcaaaataatggtgtaagtctaagggttgaatctcaacactttactactgtacatgatgacaaaccgtgtgtagcgtccatgccttactttggagtcattaaagaaatctgggaggttaattatgtaaaattcagtgtttgtgttttcaagtgtaagtgggtagatagcaatatcggtgtgcgaaccgatgatttcggatttactttggtagatatgaagaactttgcttataagaatgagcctttcatcatggcagaacaagctaaacaagtattttatgttcaagatccttgtgatgaaagatggtcagtggttctacacgaaaaaacaattggtgttaatattaaagatgatgatttaacccttgatacttgtctcattcctttctccacacaaatgttgagtaacgtcaacagagaagaagaaattaatgatgtcctcacaaatcgtaatgatcatgatgaaggagaattaattaacatacatcgtatgtgggatcctctagagtcgacctgcaggcatgcaagctga

SEQ ID NO: 110595 - DNA, 1161 bp, Glycine max
  Peptide Sequence Number=SeqID_227373
cgcggtgccaaacccgcgcgccgccggatcgggcaggccttcgggcaggtaacacaatgcctgctcgggccaattgaacggactcggctggaccagcgtgtgcggatcgtccaggcccaggcgcgtggcgatgtggtcgaagccaccgccaacggtcagcgtggccgaggtgaaaatccacgccgcgcggctgcgctcgcgatgctcgcgcagcgggccggacacatccatcggcgtacgctggcagcggaaaccccgcggggtgagctcataccagagcacatcggcggcactgggagtctccgccggatcggtatcgaaatcgagggtgggctcatcatcgcccagccagcgctggagccgcgacacagcttcgcgcgcccgcgcatgacaggcgtccaggcccgccgccgcttcccgcagcggctgcaatgcctgctccagcgtcaccaggccggccatcaccgtatcgaatccatcgcgcacctgtggcatcgccagcgcgcgccactgcgtaccacgtggcggcagcccctccatcgccgaacgcaacgccagcaacgcctgctgcaactggtcgaccggttcctgcagggccgactgcgcaccgcccacgccgcgtgcttcggccaggcagtcgcggcccagctcctgccacgggcgcatgccgaagccttcgccgaagaactgcgcggccaactcgggcagctgatgcgcctcgtcgatgacaaaggcctgcgcccccggcagcaactcaccgaagccatcctgcttcagtgccaggtcggccagcagcaggtgatggttgaccaccaccacgtcggccgcctgcgcacgctggcgcgcacgcaccacgaaacagtcatcccagaacgggcaatcggtacccagacagttgtcgacggtggaggtgaccatcggcagcagcggcgagtcatcggccaggccttccagttcggcgatgtcgccgaactccgagcggccggaccaggccaggatgcgctggaactgcgcggcctgctcggggctggaaaaccgcggttcaccccgcgcctgctgcagtcggtagcggcacaggtaattcgcgcgtcctttcagcaggcgcgctgcgcaggccgacgcccagcgcctggcgcacacgcggcaggtcgcgggtggtag

SEQ ID NO: 110596 - DNA, 318 bp, Glycine max
  Peptide Sequence Number=SeqID_227374
atggtgggagcaggtttgaaaaaggatcttagagtgtctagggttgtgccaggagggtctcttaatgccttcctttttcttctcatcggagttatttcacaaagacttgccatgcgaaatgtggcaaaaggaaaaagaatccgtggagcgaccccatcgtctccaccccgtaggaactacgagatcaccccaaggacgccttcggcatccaggggtcgcggaccgaccatagaaccctgttcaaaaaagcggaacgcattagctatccgctctcagttggacagtaagggtcggagaagggcaatcactcattcttaa

SEQ ID NO: 110597 - DNA, 288 bp, Glycine max
  Peptide Sequence Number=SeqID_227375
atggaagttgtcctccctgtcgaagtagagattccttctttgaagagaagaatgaagaacatttttgacaaaaggatgccctcatgtaaattctatgagggagaccttgttttgaagaaggtgtcacatgttcaaaaagatcttcaagggaaatggggcctgaactatgaaggaccttttatggtgaagaaggctttcttggatggaacattgatactcacaaacttggatggtgaagagtttccttcgcctatgaattctgatgtcgtcaagcaatactatacatga

SEQ ID NO: 110598 - DNA, 399 bp, Glycine max
  Peptide Sequence Number=SeqID_227376
atggatgaaactccagaggcgtccaatgcagttatagcttatgagattgtccatcatgacaaagaacttgcatccaagcaatccacaacctcaaatgaagctacattaagagaaaagggtgaacccgatgttgtcattgtctattccaccatttcaagacctactcctttgaactatgcacctcctgctgattttaagctctccatgcaaaacgcaatcacaacccaattctccaaccttggtgttgtccttctacaaaaccttcaacgggatcaaatgtctatgctaggagctattgttgcatctaaacccacacctataccagtacccccaacgcttaagccaacacctccacctccacctactcaacctccaccaccatcgccagctcaagactga

SEQ ID NO: 110599 - DNA, 465 bp, Glycine max
  Peptide Sequence Number=SeqID_227377
atgtctcaagcagttatcaatgataatgaaagggacattgtgattggcacactacactctgatctcacatcttttaatcagagcattaacattattatttctgtagcttctgacaaagctgtgattgatttacatacaactatgcaaactaaaaccatgcgttgtgccaatttatgtaggcacttgtataaattaggaatgaccctatgtctcaatttatatcatgtcctgctttttccgtctcaggaaaagggggcattggatgctgaagagcagattcaaaaggctcatgccttgagtaatggaagagtgggaaaaatagtgatgactgatactacaaaacaacttacatccgttgtgctggagcttggaggaaaactatgctatgatggcagaggatgctacaacatgctatgtctagttgataaaactcttcactttggcacaagtaaagagaaattatga

SEQ ID NO: 110600 - DNA, 207 bp, Glycine max
  Peptide Sequence Number=SeqID_227378
atggagcaacacaaacagaagaagcaccacgaacacgccggcaacaatgcggaagaagaacgcgcaggacaacaagtggcctcaagaagaacgcgaagacgaagcggaacgaagaagaacgggctcaggaatgcagcgcagaaggaagaagaagccgttgggtttgggtgcacaaatgtttttaaaaatagggcagggatattttag

SEQ ID NO: 110601 - DNA, 567 bp, Glycine max
  Peptide Sequence Number=SeqID_227379
atggcaagtctgatgacacgtggagaccaatatggtcatctgcaccctttgtcgaagactcgatgtctatcaaccgagactactttagtctcccttcatcatccagagacgagaccaatatggtcatctgctccttttgtcgaagactcgatgtctatcgaccgagactactttagtctcccttcgtcatccagagacggcaagtccaatgactcgcagagaccaatatggtcatctgttccctttgtcgaagacttgatgtctatcgatcgagactactttagtctcccttcgtcatccagagacagcaagtcccatgacacgcagagaccaatatggtcatctgctccctttgtcgaagactcgatgtctatcgaccgagactactttagtctcttttcgtcatctagagacagcaagtctgatgacacacagagactaatatggtcatctgctctctttgttgaagactcgatgtctatcgaccgagactactttagtctcccttcgtcatcaagagacgacatgtccgatgacacacagagaccaatatggttcatgctgtaa

SEQ ID NO: 110602 - DNA, 249 bp, Glycine max
  Peptide Sequence Number=SeqID_227380
atggcctctaagtcaaggtgcaatagtcatcttcaagaaagtctatataaggacattaaagtgcagctggagttctttgctaggaaggaaaaacaatataaaggacataggccagaagacatattgttgaaagtgaccataacatggtgctatgttgatcaagtagaaggtgctactgtgggtttgaagcctagagaggcttttagaaagaatactcaaggttttctgatgaggtttaaagaatactaa

SEQ ID NO: 110603 - DNA, 327 bp, Glycine max
  Peptide Sequence Number=SeqID_227381
atgttatcgttaggaagcatattcttcaataacataagcaactcagtgaagcttttgtcactccacccaaatctggtcttcaagttcaccaaagctagcacggctgataaccaagtgaaggttgtgcatcccacatacaatgctaatattggtgtgtcgcaacgtgcccttcgcgggcgagcgaggacgaggctctcgggtgcgctttccaaaggaggaaagatgcgcggagtcgccaccaacgtttatttgtggaaaacgtcgggaaaaccgaaggaaaccggtcaaaatgaaaattctaagttcgggagttgtatttacgcttga

SEQ ID NO: 110604 - DNA, 261 bp, Glycine max
  Peptide Sequence Number=SeqID_227382
atgtgtctatcacatatagctgctagtggagggttggagccttcaaaagggatctcgcgtttgaggctagaccgtgtgctaaccatgggtgaacaagagagggatgacgagagactgcgggttatgttttacagcggccccacgatgggtgccaaatgtacttaccaaaatccggagttgggacacgtcagggtggacgtggccaaagtgggctcccggactttgcatgagaggagtggagctaggggtccttgtttgtag

SEQ ID NO: 110605 - DNA, 1023 bp, Glycine max
  Peptide Sequence Number=SeqID_227383
atggcgacttgtaagtatttgaatgctcctagggcctttggcagtggtcccagtatactcattccccacatggaaaagggccaaggggagctcagattgtggagatttttaggaggaatgcatggaaaatctggaaactcttggcatcgtttgcatctctttgtgaagtcaaagtcgtttgccctaagtgttgaccatgtctacggtgggagtttcaagcatctcctgaatgatagtcttgaggtgccaaacctttttggtgttggcaagctaggagagcatgtttgctttggtgttgttttctttggacttgcaatgagcgcctcatactctgcatggttgtttgaggctttgaggttgagcttgggggcttgctctagagtgacattgtcaaggccttttaggatgattcctgccccgcttccttttacgttggttgcaccatccacaccaggccaccatccttcccgcgagctcaggctttttcaaaacttgcttgatggggtagttcattttgactaccacttgatgactctaaaggagctgatgcttctcttcctcttgcacaagggccgagctaacaacttcgtcaactaccaaaaggatcggcgatgtagctatggtcttcttgaaagccaggaaggcttgttcgcaggaacctggacaggaatactagcctaccgttcagtttctggacttcttggacgttggtcgggaaacacatctctagtacatgtcatatttacggagttccccaaagacttcttccaggtctaccacttgttggactatgctttgagatttgacaaccatgtcatccaaatataccttgatgtttcgtccaatctattgtttaaagactcggtccatcagtcgttggtatgtagcgcctacatttttaaggccgaagggcatgaccttgtaacaaaaattggtacttttagtgacgaatgtcgttttctcctcatctggagcgagcatcctgatctagttgtatccagagtaagcgtcccagaagcttaa

SEQ ID NO: 110606 - DNA, 1029 bp, Glycine max
  Peptide Sequence Number=SeqID_227384
atgcagccacaagcttggtcatacctcctttactccacagtgagcttcaaattgtgtcgccattgccattgtctgtctaagtctcgacagccagccacaagcttggtcgtacctccttcactccgaccattgtgcggttttgtgatcaggcatcagcttgtaactcatctatctttggggattgctcttcgttatgttcttgatgcattgtgcatgcctatgtttttgtttggaagtttggcattggaacagtttctggatcgtcttattgagtggcctcagtattgcaatcatattcttcaaattttccatttgtgcaatacacattcagaaatagtttccttcattgagctggctctcgctaggatttcctctggtcatttggatgttgatggggcgagtcatgcttctgttattagtaatcatcattctacacaggctacaataggacatgtggagggaaagaatcctattattaatacttgtcacttgataagcagctcagtggctctagtgttatacaacctgggcagcaacatttgtcactacagcttcaataaagacgtgaaaatctcttggatgatcgtcacaaagcttatgttggttcatctactgatgcattctacagaccatgaggttgctctcatagtacacatggcatacctttcgtatatactatatgagctattttctttaggtgccattctgactgttttcttctgcgacattgtaatgtctcactgcacgtggcataatgtgatagagagttcaagagtgacaaccaagcatgtttttgccactttgtcattcattgttgaaatctttatcttcctctatgtggggatggatgcattagatatagaaaagtggcaaattgcgagtggacaaggggaaggtgtggttatcaacatgcagcttctcctttggaagagtagggatagggacaggtctgatggcggtgctaaagaagtttgtttgttcaacaattaccttaacaccaaattgatcttcggtctgggttgcaattga

SEQ ID NO: 110607 - DNA, 711 bp, Glycine max
  Peptide Sequence Number=SeqID_227385
ggacaccaaaaacctgcatggttggaagccctttatgcacaaaagttctttgtcgggtgctctcaccatgagaatgctaaaaagaatgagaagaacatatgttgcttagattgttgcaccagtatttgccctcactgcttgccatcacatcgctttcataggcttcttcaggttcgccgttatgtttatcatgatgttgtcagattggaagatcttcagaaactcatagattgctcaaacgtgcagccttataccatcaatagtgctaaggtggtgttcatcaagaagagaccacaaaaccggcaattcaaggggtcagcaaactactgcacttcctgtgatagaagtctccaagaatcttttatccattgctctttaggatgcaaggtggattttgtgttgaaacactacaaggacctctctccctatttgagaacatgcaagtccttgcaacttggtcccgatttcctaatcccacaagagatgggtgatgatgaaacaactcgttcaaccattgtggattgtgatgagcccatgagctcgtcttcagggtcagagagcatgggcatggcttgcagcgagattgttaggaagaggcgtagtgggtggaacgtttgtgcaagatcaatgaacaacaaggtttcggatgaagacatggttacaagcattagtagaaggaaaggcatcccacatagatctcccttgtgttag

SEQ ID NO: 110608 - DNA, 210 bp, Glycine max
  Peptide Sequence Number=SeqID_227386
atggctcacaagtggctgaacatccgaggagtagatgaagagagcttagttaagacttccaaaagatctcgggagagatatcaaaaggcatctttgtttgaatttagtcataaggggaacttaacacccatcgttaggcaatccgtgaagatccgcgacatgctggaagtcgaaaggaagcattgttgcacaatccgtaaagttccgtaa

SEQ ID NO: 110609 - DNA, 449 bp, Glycine max
  Peptide Sequence Number=SeqID_227387
atgaccggccctctcaatgagttaatctcatgctttctcataagggtggacccttgggtactagaacctattacctttagaggactacacgtcctcgccttcagagggctaaacgccctcaccatcagaggactacacgtcctcaccaacagagggctacacaccctcaccttcagaggactacacgtcctcgccatcagaagactacatgtcctcaccttcagagggctacacgtccttgtcttcagaggactacatgtcctcgcctttagagggttacacgccctcaccttcagaggactacacgtcctcaccttagaggactacacgtcctcacctttagaggactgcacgtcctcctcttcaaagggctgcttgccctcgccttcagaggactacgcgtcctcgccattagaggactacacatcctcacctttagagggctacac

SEQ ID NO: 110610 - DNA, 396 bp, Glycine max
  Peptide Sequence Number=SeqID_227388
atgaacctgattcttcaagacaaaattgctttagtgaccggcggcacctccggtattggcctcgccaccgcccaggaactggcggcacagggcgcacgcgtgtttatcaccggtcgtcgtcaggctgagctggatgcggccgtcgccagcatcggcgccaccgccaccggcattcgcgccgatgcggcacagttaagcgatctcgacgccgtctatgcgcagattgcgcgccaggccggccggctggatatcctgtttgccaacgccggtggcggcgacatgctgccgctgggggccatcacagaagaacattttgatcgtatcttcagcaccaacgtccgcggcgtgctgttcaccgtgcagaaagcgctgccgctgctgagcgataaggcgtcg

SEQ ID NO: 110611 - DNA, 906 bp, Glycine max
  Peptide Sequence Number=SeqID_227389
atggatcaattactggcaatccgggcgtttgcccgcgtggttgaggcaggcaactttacccgggcggccaattcactggatatgcctaacgccaccctgagtaagctggtgcaggagctggaagcgcatctcggcgtgcgcctgttgcagcgcaccacgcgccgggtcacggtgacggcagaagggcgcgattactacgagcgggcgctgcgcatcgtgcgcgatctggaagatatcgattgtgcgttcaatagcgtcacgacgaaaccgcacggtcagctgcgtatcgatatcggcggctcaacggcgcgcgatgtgctgctgccggcgctgcccgattttgtcgccaggtttcccgacatcaccctggaccttggcgtgtccgatcgcaccgtggatctcatcagtgataacgtggactgcgtagtgcgcggcggcccgctgagcgattcgtcactggtggcacggcacttaggcaatgcgcaaatgatcacctgtgccacgcccggctatctgcggacctacggcattccggcgtatccgcaggagctggacaacggccatcgcatcatcagctatctgtcgccgcagagcgggcgcgcctttccgctgcgcttccgccacggcgaagagcgaatcgaggtaaagaccgcgcaccgcgttggcgtcaatgagagcaacgcgcaccttgccgcggcggtggcggggctgggcatcattcagacgttccgttacgctgcggccgcggatttgcaggccggacggctggtggagatcctcgccgactggcgtccgtcagactatccgttccacgtggtttatccgcagagccgccatctcacccagcgcctgcgggtgctgatcgactggctgcgtgaggtgtttccgcaacggctgaatggatga

SEQ ID NO: 110612 - DNA, 1329 bp, Glycine max
  Peptide Sequence Number=SeqID_227390
atgctgcgcaccagcgaggactggcagatcgaacagcgtgacgatgagcaaatctgcgccacgctatgtacggctgtcgacagccgatcgctggtggcgttgctggttaccgagcgcgaaccgctggcggtgccgccgctggaggcgatcgatacccgtattgaaaccagccataccgcctggtgcgactggacccgcagcttgagctatcaggggcgctttgcggagcacgtgcgccgctcggcgctgtcgctgaaatttttatggtattcccccaccggcgcgcaggcggcggcagccactacctcgctgccggaaggcattggcggagagaagaattatgactaccgctacgcatgggtgcgcgatgcctgtctgatcatcaaagcctttgtttttctcggtgcgctggaagattgtaaagcggcgttctcctggctgtcgaaaaccatcattcgccatggtaccgcgctgcgcacctgctacacgctggagggcaacgaagtgcctgccgaacgctttgtgccgctgcgtggctatcaccattctcagccggtacgcgtgggtaacaacgcgcgcgaccagctgcagctcagtatgtatggcgacatgcttgccaccgccgagctgtttattcgcgccgggcacgtgctggacttagccacctcgcgcatgctgggtgcgctggctaatcactgtgccgatttatggcgtcagaaagacagcggcatctgggagctgcccgagcagcagcactatacccattcaaagatggcctgctggctggcgctggatcgtgccgtggcgctggccgaagcgcgccacattgaaccgacctggctgaaacgctggcagcgcgagcgcgaccgcatcagcagctggattgaagcgcactgctggaacgaagagaaacaggcgtatgtgttttatcccgatagcaacggcaggctggacgctgcgctggcgctggtgcatccctatggcagccgcgtcaacccggcacgtatgcaagccacctaccgtgccattgagcaggaactgggacacggtagcgccatgctgtatcgctacagcggcacggaacaggaagagagcacctttatcgcctgctcattctggctggtggaagcctgggcggcgctgggagaatgcacgcgcgccgagaacgccatgcagcagattctcgtcaaactgtgccagcgcggcaacgtggaaactttcaacgaaatgtttgatgtgcgcagtgacgaatggcgcggcaatatgccgcagggcctcagtcatctggcattaatttgcgccgcacaggcgctgaccgatcatggctga

SEQ ID NO: 110613 - DNA, 279 bp, Glycine max
  Peptide Sequence Number=SeqID_227391
atggcttctccacctgcctcgcctcctcctcctcttccttttgctcttcctcctcctcctccttcagacacatcaacttcgccgtctaccgtgaagcggacacgcaaagcctcacatctacgatccttgtctactagaccacctggtgctgagagaccagtggtccacgttgatcctgctactggcaaggccgacggtccccacaggaagaaattaagaacatatttggggattgtggcacgtgataaggtggacgtcacgtatgagaactggaaggag

SEQ ID NO: 110614 - DNA, 534 bp, Glycine max
  Peptide Sequence Number=SeqID_227392
atggaggagaggctatgcgccattgaaggaggaggaaattatgcctttgctgacatgacagagttgtgcttggtacccgacatggttattcctccaaagttcaaggtgccaaattttgataagtacaaaggaaccacttgccccaagagttacttgaaaatatattgtaggaagatgggggcgtatgcgaaagatgaaaagttattgaggcatttcttccaggagagtcttgctggggaagttattacctggtggagtgatttggttgctcaaatagcgcccccgatgatggagagagaaatgataataatgatagttgacacattgccgatgttttactatgagaaaatgataggttacatgtcttcaagttttgcagatttagtgtttgctggcataaggatcgaagtggatctaagaagagggaaatttgattatgctgctactgcgagttctagtaatagaagacctgggatgagtggagggaataagaagaagggagaaacccatgctgtgattgtcgttcctacatga

SEQ ID NO: 110615 - DNA, 447 bp, Glycine max
  Peptide Sequence Number=SeqID_227393
atggctccacctaaagaaattatgaccctcatttaccacagtggtctcattgtagacgatccagttcaaggatcgacgtaccaatgtaccaccccaatatttttttacgccagtcgttctattacgtttacacaattcattcgaaaaattaacaatcgtcttcctactcgagcaactgaacaagttgctcaattgttatttcgtgtccctatttcaattcatcttggtcagacacgttttatttcaactcaactattcgacaatgatgatcttagaggcgcgatggaaacaattatccagaatccacaattgaattctgccaaattctatgttgttactgagcttattcctcaaccacaaccatcatctccacaaccctcatgtccacaactacaactaccacctccacaacagttaccgtacaacaacatagacctcaataatcca

SEQ ID NO: 110616 - DNA, 528 bp, Glycine max
  Peptide Sequence Number=SeqID_227394
atgtggtcatctgcgccctttccggagatgtcatcatcttccggtggagactttttaaaatctcacaagttatccagaactatgagcaagagcctcgcttttgtcgaccacaccgcttttcgttaccatgacccaagagctggtagcccgcggagacaccttccggttatccgcacctcgtcgttcagtgaccccaagtctgagttcctcattggaggttacgtaggagcaagggcctcgcttttgtcgaccacaccgctattcgttaccatgacccaagagctggtagcccgcggagacaccttccggttatccgcacctcgtcgttcagtgaccccaagtgtgattgatgagcagaggccaatgtggtcatctgcgccctttccggagatgtcatcatcttccggtggagactttttcaaatctcacagttatccagaactacgtaggtctgagttcctcattggaggatacgtaggagcaagagccttgcttttgtcggccgccccaaaagctctgtcatactga

SEQ ID NO: 110617 - DNA, 303 bp, Glycine max
  Peptide Sequence Number=SeqID_227395
atggcgaggattcctgacaagattaggtctattgatggatcaaaagaaacgcttaagcttgctgttaggatcaccgatctttggttcgttgggactcctaacaagtctgagcaagcggagatggtttttgttgattctgagggtgatcaaattcatgctatttgtaaatcggaccacctcaagtcttggaaagctgatttgaaagagaattgcacttatgttatgcataatttcaaagttgttaagaatgatggtcaatttagagtgtgcgaacataagtacaagttatttttattggagtga

SEQ ID NO: 110618 - DNA, 279 bp, Glycine max
  Peptide Sequence Number=SeqID_227396
atgaaccctaagagaataaaagtcattcctgagtggcccactccaccaagtgttgatgaaagaattaatgagtttcaagaacctctggatttgaggtcaaatccttttcaagggggagggaatgatgcaatcctacccccaagggcattggataaaagactccaagaacattgggccaaagatgcaagagaaggccctagggttctcatgagccttagggtaaggtaccctagaaatataggacttttcagcccttgtattttagggcacctagactag

SEQ ID NO: 110619 - DNA, 403 bp, Glycine max
  Peptide Sequence Number=SeqID_227397
aatgaccaaacttggtctctgcgtgccaacggacacgactgtgtctgaatggcaaaggggtgcggataaccgtaaggtatctccgcgtatcataatgaccaaacttggtctctgcgtgccaacggacacgactgtgtctgaatggcaaaggggtgcggataaccgtaaggtatctccgcgtatcataatgaccaaacttggtctctgcgtgccaatggacacgactgtgtctgaatggcaaaggggtgcggataaccgtaaggtatctccgcgtatcataatgaccaaacttggtctctgcgtgccaacggacacgactgtgtctgaatggcaaggggtgcggataaccgtaaggggtgcggataaccgtaaggtatctccgcgtatcatgtgtgcagaatga

SEQ ID NO: 110620 - DNA, 531 bp, Glycine max
  Peptide Sequence Number=SeqID_227398
atggtgcaaaagaagaacaaggaactcagaggcagtaacaacgggcccatcggcggctactgtaggtggttgaaagcccacatgcaaggtctggattggctcctgagtttgagaaccactaaaggggtggaagttgaagcaccaaaggaagacgaagaggtgcaggcccttaggagaagcttgtctcagcgtttatgcaagacagagaccaacatgttagccattgtcagcaagtaccaagaagaattaaatctagccacgacccacgagcacaaagtggcggacgagtatacccgagtatacgcggaaaaggaggctagaggaagggtgatcgactcgttacatcaagaggcaacaatgtggatggaccgatttgctcttactttgaatgggagtcaagaacttccccgattgctggccaaggccaaagcaatggcggacacctactctgccctcgaggagatccacaaacttctcagctattgtcagcatatggtagacttaatggcccatataattaggaaccactag

SEQ ID NO: 110621 - DNA, 165 bp, Glycine max
  misc_feature (5)..(5): n is a, c, g, or t
  Peptide Sequence Number=SeqID_227399
gtggnttgggtctgtgttagccatagggagaggaggtcaatctatggtcatgttgggttcccgactcgcttgacaacaatgaagcctcatctagagtttttctcttttggtgatgcattgttgttgatagtccttatcgccacaatgtattacctaagtggatga

SEQ ID NO: 110622 - DNA, 294 bp, Glycine max
  Peptide Sequence Number=SeqID_227400
atgagggttcactgtaatcaagcaagtcggagacctagcatgatcacggattcacctccactccttatgttcccacgaacccggtccccagtggagtcgccaactgtcgcaacctacccttcggcgggagggcgacgcgtgactcgcgggatgcatgttccacgaaaggaatacgcgcggagtcgccaccaacgtttatttgaggaaaacgtcggaaaaaccggaaaagacgcgatctacgaacttttaagtgaaaggctcgggagttgtatttacgcacggggaaggtattag

SEQ ID NO: 110623 - DNA, 297 bp, Glycine max
  Peptide Sequence Number=SeqID_227401
atggtgaaactaagaaatattcttctcacgttgaaggagtacaatgtcaatagttatacaacaatcaagcaagtatacaatgcaagaaattcataccatttttccattagaggtgctcaaagatcaatcaagaacaattcaagagttcaagataagaatcaagaagaattcaagactcaagaagaaagtctagagacaagaatcaagattcaaggttcaagatctcaagaatcaagatcaagattcaagactcaagactcaagattcaagaatgaagagaagactcaatcaagataa

SEQ ID NO: 110624 - DNA, 210 bp, Glycine max
  misc_feature (200)..(200): n is a, c, g, or t
  Peptide Sequence Number=SeqID_227402
atgggtaaagcggaggaggtacaagagcagatggaggccgacatggaggccatgaaagagcaaatggccacaatgatggaggtcatgataagcatgaagaagataatggaagccaatgcagttgcagttgccactaccagtgttgttgctaaagtgaacccgacgtccccatccggcatcaaccaaatgaatcatccaanctcagatatg

SEQ ID NO: 110625 - DNA, 625 bp, Glycine max
  Peptide Sequence Number=SeqID_227403
atggacgttgataagatccttccatctagcagcaccttaggatggcatagccttaaagttaagggcgagttgaaaataagcgtagatccggggattcccgatataggtcaacctttcgaactgctgctgaatccacgggcaggcaagagacaacctggtgaactgaacatcttagtagccagaggaaaagaaagcaaaagcgattcccgtagtagcggcgagcgaaatgggagcagcctaaaccgtgaaaacggggttgtgggagagctatacaagtgtcgtgctgctaggcgaagcagcagagaatgctgcaccctagatggcgagagtccagtagccgaaagcatcactagcttacgctctgacccgagtagcatggggcacgtggaatcccgtgtgaatcagcaaggaccaccttgcaaggctaaatactcctgggtgaccgatagtgaagtagcagtggcttggttaagggaaaccaccggagccgtagcgaaagcgagtcttcacagggcaattgtcactgcttatggacccgaacctgggtccgaaccgactgatgttgaagaatcagcggatgagttgtggttaggggtgaaatgccactcgaacccagagctagctg

SEQ ID NO: 110626 - DNA, 453 bp, Glycine max
  Peptide Sequence Number=SeqID_227404
atggcgctgctgaccgcgaaactgccgcgtaaacgtaccctgattctgctgatgatcatcttcatcatcggcaacgtactctgtgcgctggcttatacctataacctgctgatgctggcgcgcgtcattaccgcgttgtgtcacggtgcgttcttcggcatcggttcagtggtcgcggccagcctggtggcgccgagccgtcaggcgtcggcggtggcgctgatgtttaccggtctgacgctggccaacgtgctgggcgtgccgctcggcacctggtttggtcagctgtttggctggcgcgccaccttctggggcgtggcgattatcggcatcctcgcgttcatcgcgctgattgtcagcctgccgactaacaaagatgaaaaaccggtgcacctggcgagcgaaatcagcgcgctggccaacggcaaactgtggctgtcgctgctgatgacg

SEQ ID NO: 110627 - DNA, 894 bp, Glycine max
  Peptide Sequence Number=SeqID_227405
atggtcgcacattgccgataccccaatggattgcccggtaatgcggcgtcaacacaacagggggacagagttatgcgatggatcatcgcgctggcgatcggcggcttaagcggctgctcggtcgggcactatgaatacagctcagaagcggccaggcgcgtcgatatgaccgtcaccggcatccccaccgtgctcggcatgggtgcgctgggcaccactatccccctgacgcgcgaatacagcctgacggcggcgcacgtggccaaatattcgctgtatcgggtgaaggcctggcatccggagtgcgatatcgccgtggtttatcatgcgaataaagaagccaacctgcccccgcagttccgcaacagccatatcggcgacaacgttaatctgtatgggtatagctttatctccgcgctgccggtggcatcaagcggcaaaaacctgatcaatacgacgctgagcaatgactggaataaggccagctgcgtagtggtggcggccaatgccggcgtggtgaaaggcatgtccggcggcgcggtatataacgccagcgacgacacgctggccggggtgattgtcggctatagcagtcggattgatgataataagagcggcaaaacgctgttgggtgcgcgctggtgccctcaccccggccctctcccaccgggagagggagaaaaccacagcggtcctctgccacagggagacggagaaaaccacagcggccctctgccacagagagagggagaaaaccacagcggacctctgccacagggagagggagaaaaccacagtggtcctctgccacagggagagggagaaaaccacagcggccctctcccaccggggtacaggcaagtcccctctccccatgggagagggttagggtga

SEQ ID NO: 110628 - DNA, 1072 bp, Glycine max
  Peptide Sequence Number=SeqID_227406
atgaaaactcgtgtgccgcaccttgcgcactggggcgcgtttactgcagtcaccgaaaatcagcgcctgattgcctgcgaacctttcttcgccgatgccgatccttccccgatgatccacactctccctgaactggtgtactcggataaacgcatccgtcagccgatggtgcgccgttcgtggctgaagtcgcgtgaaaacagcgatcgcacgctgcgcggccgggaagattttgtcgccgtggactgggacaccgcgctcgatctggtggcggaagagaaccgccgggtgcgcgaccgctacggcgcttccggcattttcaacggttcgtacggctggtcatcagccggccgcgttaaccacgcgcgcaccctgattcgtcgcttctatttccagggcggcggtggcgttgatcagcagggtaactacagctggggtgcggcacagttctttctgccgtacgtgattggcacttatatgccgctcaccggccgcgtcaccgactggccgcaggtggtggagcatgcagaaattttcgtcgcctttggcggcctggcgctgaaaaatgcgcaggtggcctccggcggcgccggcgagcacagcctgaaaccggcgctgcagcagctgagcgccaaaggcacgccgatcattaacatcagcccgatgcgcgatgactgcccggcgttcgttaacgccgagtggattccgattcgcccgaacaccgacgtggcgctgatgctggcgctcggctatgaaattacccggcggaacgctatcgatgaggctttcctcgccagccactgtaccggctggccgcagctgcgtgcctatctgctgggcgaaagcgacggcgtggcgaaaacgcccgcgtgggccagtgcgataaccggcatcccggcggcgcgtatcgcgctgctggcgcagcagctggcgggcaaacgcagcttcatcacctgtgcttatgcggtgcagcgcgcccatcgcggcgagcagccgtactggatgatgattgcgctctcgtcgatgctgggccagccgggactgccgggcggcggcttctcttttggccatg

SEQ ID NO: 110629 - DNA, 882 bp, Glycine max
  Peptide Sequence Number=SeqID_227407
atggaagtttcccgtatccgagcgctgcgcggccccaacctgtggagcaagaacacggcgatcgaagccatcgtgtcgtgcgccgacgccgaatgctccatcgacaacctgcccgatttcgaagcgcgcctgcgcgcgcggctaccgcagaccggcctgctgcgtcccgagggccaccagggcgccgtctcgatcgcgcacgtgctgcagatcgtcgccctgacgctgcaggcctacgccggctgccccgtcaccttcggccgcacctcatccaccatcgagcccggcgtgttccaggtggtggtggaatacagcgaggaagaagtcggccgcctggccatggacctggcgcagcagctggtgcaggcggcgctggacgatgcgccgttcgacctggccgacgccctcaagcgcctgcgcgagctggacgaggacgtgcgcctgggccccagcaccggctccatcgtcaacgccgccaccgcccgcaacattccctaccgccgcctgacgcaaggcagcatggtgcagttcggctggggcagcaagcagcgccgcatccaggccgccgaaaccgacctgaccagcgccatctccgaatcgatcgcgcaggacaaggacctgaccaagatgctgctggacgcggccggcgtgcccgtgccgctgggccgctcggtcaccacggccgaagacgcctgggccgcggcccaggagctgggcggcccggtggtggtcaagccgcgcgacggcagccagggccgcggcgtggcggtcaacatcgagacgcgcgagcgcgtgatccaggctttcgaagtggccgaggagatcagctccgaagtcatcgtcgagcgctacatccccggccacgacttccgcctgctggtg

SEQ ID NO: 110630 - DNA, 312 bp, Glycine max
  Peptide Sequence Number=SeqID_227408
atggccgtggcgcgcgcgatgatgtcagtgttgctggatccagcggcggacgagatcgatggtggggccggagaaggcttcgtcggattgcagcagcacgaagtcgcccgcggcgatgccggacagctggctctcgatggccttgccgtggtccggctcgtcgatgatctgctttacccggctgccttgttccagtccctggcgcagcagcgcgcgcgcctggccggcgggacgcttgctggtgacggtggcgtcgtcgtacagcaccacgcggtcgaaggcgtcgcccagcagcctgccctgctcgatcag

SEQ ID NO: 110631 - DNA, 147 bp, Glycine max
  Peptide Sequence Number=SeqID_227409
atgcggatgagggcacacacggccttcctacgtcaaatcacaaagcaaacagagaagaatgcaatgtgcagcgaccttggtcatgtggctccgctccctcgcaagaaaccgagcaggtcattcatgtcctcctccatacgggattaa

SEQ ID NO: 110632 - DNA, 141 bp, Glycine max
  Peptide Sequence Number=SeqID_227410
atggacacatatctttgtgtgattggtgattccattaatggagttcaacgggggtggggtcacaaatcactttttgaggattcacctagtaagtgtggtggtgggggcgccactgtgagatatgggctaatctctaagtaa

SEQ ID NO: 110633 - DNA, 315 bp, Glycine max
  Peptide Sequence Number=SeqID_227411
atgacggtgtcatacaaagattggcatgagatgtttccttttgccctgcatggatatcgaacctcgatacgaacttctactggggcaacgccgtattccttggtttatgggatggaagcagtactcccatttgaggtagcaggccatgagccatgggcacctgtatcaacaaaggataaagaacgtgttcgacaagaagggcctttcattatgaaaagggctttttctagaagggctctggtgctcaccaacatggatggcgaggagctaccctcacccgtaaactccgatgttgtcaagcgatactacgcttaa

SEQ ID NO: 110634 - DNA, 327 bp, Glycine max
  Peptide Sequence Number=SeqID_227412
atgtgggcaatcaattgccagtataaagagaagctaaatctacctgctagccatgagcaaagaatagagggcgagcatgcaaaagtatcagctctacaagcagaaaaggaagcaagagagagagtgatagactcattacacggagaagctatgatgtggatggataggtttgctttcactttgaatggaagtcaagagcttccaagactgttagccaaagccaaggcgatggaggatatgtactcagctaccgaggaagttcatgggcttttcgattattgtcagcatatgatcgagttgatgtctcacataattaggaaccactga

SEQ ID NO: 110635 - DNA, 210 bp, Glycine max
  Peptide Sequence Number=SeqID_227413
atgagtgagatagaagaagtgcaagagcaaatgaaggccgatatggaggccatgaaggatcaaatgacctccatgatggaggccatgttaagtatgaaacggatgatggagaacaatgcagctgcagttgctgccaccagcgccactgctgaggcggatccaacccagccatctgccctaaaccaagcaaaccaagcaatcccgaacatg

SEQ ID NO: 110636 - DNA, 425 bp, Glycine max
  Peptide Sequence Number=SeqID_227414
atggcggagaagggaaagttggatcatatagaggaaaggcttggagccgttgaagggggtgaaagttatgcttttgctgacatggtggaattgtgcttagtgcctgacattgccatccctccgaagttcaaggtgcccgacttcaataagtacaaggggactacttgccccaagaaccacctaaagctgtactggaggaaaatgaaggcatacacaaaagatgaaaagttgttgatgcattttttccaggaaagccttactagggaagctgtcacttggtacactaatctggagccttcccaagtccattcttggaaagacctaatggtttccttcattaggcagtatcagtacaattctgatatggctccggataggacacaactacagaacttgtgtaaaagggagcacgaatctttcatagg

SEQ ID NO: 110637 - DNA, 267 bp, Glycine max
  Peptide Sequence Number=SeqID_227415
atggtcaggcatcgcgcgttgactgtcagcgggagtaattcatcagggtgcttatgccccagtgagctggcgtttcgccttgtcatgctgttctctgacatcagcacagagatgggcggatgggagagcatcgaaatggttcagcgttatgctcacctggcgcctaatcatctgaccgagcatgcgaggcaaattgacgcgatttttggcagtcgtgtcccaaatctgtcccacggtgaaattttgaaggctgaaggaggttcttaa

SEQ ID NO: 110638 - DNA, 372 bp, Glycine max
  Peptide Sequence Number=SeqID_227416
atgagaatgaccagccgtaaaaaagagatactgagcttctttgatcctgaacaccgcgaatgggtaactggtacgattggtgcgccgccgtttgatgtatccggggtcgcatatcttctcagtggcatgaactcattcaaatcacggcatcacatggaatcagccaggagaacgctggaggcgatggttaacgatgggctgctggagaagatcaccagctatgagcagcggcaggacagcacgcagtctggggcaggtaaaggtgtctggtgtaactgttcccgatacgggctcatcggtcagtgtctggtaatgcgtgatcgtgatggcagtgataattatattgaaggtgaattcgacagggtaaattga

SEQ ID NO: 110639 - DNA, 996 bp, Glycine max
  Peptide Sequence Number=SeqID_227417
atgtatcgtgtcggtgaaggcggcaagcctgaaatctttaaagccagcaatggcagccagtacatgatcccgggtgatagcggaaaggtgattagtaataaagatatcgccggcgctggcggcaacggaggagtgagcctagaggtcaatttcaacatcactaccactaacggtattgatgacgccacacagaagcaaatgatccaacagatggaaatagttgccctgaaagtagcgcgagagcaaagcacccgggatggtggctttcttcaaaaacggattaagaaacagatgcctgacagcacgaaagaacaggccagccgtgataaaggcggcaaatggaagaaaggcgcatcgggtaatccaggtggccgcagcagtaaagcagctgaactgcgccgtgttctggaaagcggtgctgatgatgctgtgaaaaccatcatggacgcggctaaagaaggcgatatggctgcctgccgcctcatcctggacagagttgtcccgccgagtaagccggtttatcagccggtatctttcgagctggacgacagcgatttacctgcagcggcacgttctgtgattaaggcgatcgccgcaggagaacttcccgccgaccaggggaagatgattctggatggcctggcgaacatggcgaagattatcgaaattacagaactggctgagcgcgccactatcggcgctcagaccaccagcagtggccccgatgaaatctggctaatcggtgtcagccctgacggttctcgcgaggtgaaaatcatgggtaacctgctggcacgacttaacaggctggaaaaggccatgacgccgaaagatggtgatgtacaggtgatttcaaccctgatggatgagttagccggcaatgcccctgcaggtgcttgtcagaaggttatagaccgcctgtcagcgcgtgggcataacttcccgcagtcatcagaactgagggcattgctagtgggtgctggtgatgaaatttaa

SEQ ID NO: 110640 - DNA, 672 bp, Glycine max
  Peptide Sequence Number=SeqID_227418
atgacgcctttgaaagagatcggcgagtgcttggttattgatggcgatgatgagtactttttccgtccgtccctgatcgctatgtcgagtattggcgagccaggtgagattgtttcaactttccatgcgctacacagcgatgaggtaacacctttactgcgacgcgcatacgacgcttacagcactatacctgattgggtgctcaagcacgctaaggggcctgagctcaccaagccagcactatatgccgctatggatgtgttaaccgcctgctgtaatcatgatgtttcaccgctggtgggtgttctggtgccaagcaaaatcaaaaagcgcaccttcctgcatcgccccggcaagatgccggccacagacatggttatctttgcccaggcgctgattacacacggcattattggcaaggctaaagtacgacgcctacaacgcaatgagtcatcacagaccacaagcgagttcaatgctgtcgagtacatcaacgcagcgcgaacgcacctcggcatgagcagggaggaggcggaaaagctgaccatgacggagtttcagatgctgctggcggcgaagtttcccgagcagaagggcttcacgaaagaagagtatgatgcggtggcagatgactatctggcaaggaaggcgaagcggctggcgaatggataa

SEQ ID NO: 110641 - DNA, 432 bp, Glycine max
  Peptide Sequence Number=SeqID_227419
aagatgaccgtgtcatacaaggattggcacgagatgctcccattcgcgttacacggtggaagtcctgtcattaagaatcttggcggaatccagattaaaggaatcggaaaacgagtgaagaatgcttttgacaagaaggtacgcacgcgctggttcagcgaaggggacttggtgctgaagaaagtctcccaagctctaaaagacaatagaggaaagtgggccccgaactacgaagggcctttcgtcataaaaagagctttctccggaggggccctgatgctcaccaacatggatagcgaggggctaccttcacccgtgaacttcgatggattcttgatgcaatcctaccccgcaagggcattggctagaagactccaagtagattgggctagagatccaaggaaaggccctagggttctcatgagccttagg

SEQ ID NO: 110642 - DNA, 531 bp, Glycine max
  Peptide Sequence Number=SeqID_227420
atgatcgaaagttttcaacaacaacaacaaatgtcagttctagaattgtatgtagaaaaggatgttgctggtgatgatgatgattaccttgcatctaactcatacgttgaagagtttttcgatgaagatgatagtgatgatggaatatctgatacagacgatgaagtcactaacatcgttgaaccagcttcaattgttcacccaaccgaaggtgtaccacaaattcaaaatccattttggaatgatgctatgcattataataatatcaattggagtcatccggacgaggaggacatttgtggtctggacatgccaatgacttttaatgttggacaagaattatatgttggcatggattttgacagtaaagatgcggtaaaaaatgcactgaaacaatatgtgatgaaggtgcatcaaacttttaaggttgttgagacgaaatcacacaaatatatcgtttgttgccccaacaacaccgaagagtctccttgccctttttatatgagggcaattttatcgcaaaaaaactga

SEQ ID NO: 110643 - DNA, 378 bp, Glycine max
  Peptide Sequence Number=SeqID_227421
atggatgcatggaaaagactttcgactgacgaacaggaaaaagtgatcggaaggtcaaaggaaaatgacattgagatgtctgattccgtaaaaccatctaattcccacattgctttagccaatattgaaggtgaaaatggtgaagaattaaaaatcgttagagataacatgccatttgggaatccatcaaccaatgaattcggaacttattttatcgcatatgcaagcacctttacaacagtgaaaaaaatgcttaccaacatgtttattggcgatccggcagggaattatgacaggattttagattttagcaccgctaaaacagggacattattctttgctccgacccgagatatgctggacgacttttcgggataa

SEQ ID NO: 110644 - DNA, 306 bp, Glycine max
  Peptide Sequence Number=SeqID_227422
atgtgggtgcaaatagcaagcaggcgtgggccttccaggatgttcctccagaaggcggttacttctggaggaagcaacttaactcgcctgggcgagctgggtggcaagctcctcccctattttcctataaatagggggaggagtgaaggagaaaaatgttcaaccctcctgtgtagaaaatccaagccgaggcgcttccgtaacgtttccgtgggtgatttcgcgaagattttcaaccgttcttcgacgttcttcgttcgttcttcgtcgttcttcgatcttcaaccgataagttcccgaaattga

SEQ ID NO: 110645 - DNA, 465 bp, Glycine max
  Peptide Sequence Number=SeqID_227423
atgcctcaacaacccatgttgttctgtgaggtgtttgatgtcttgggtatagactttatggggcctttccccatctcttttggttttgtttatatcctccttgctattgattatgtttccaaatgggtggaagccaaagccaacagagctaatgatgctgaggttgttgtggattttgttagatctaatctgttttgcaggactgcctacaaagcacccataggaatttctccttatcgggttgtctttggcaagacatgtcatcttcctatagagatagagcacagagcctgcaacttctctattgatcaggctggagaggaaaggaagttgcaactaagtgagctagatgagatttggttagaagcctatgagaattccaaattctacaaggagaagaccaagaagttccatgacagcttgatagctaagaaggacttcgtggttggacagaaagttttatag

SEQ ID NO: 110646 - DNA, 219 bp, Glycine max
  Peptide Sequence Number=SeqID_227424
atgaggaggaggaaatggaggaaggaattggaatatcttgagcctcggagtgtcgttggcttctacttgaagaacctttgcgcttctttgatggttcctgcatttgagaaaaattttcgaaatttcaatcagttgaaaggaaagagaatgaaaaaagatgaattttgggctttgtgggaagtgatttggataagaaatcagagcagggacgcattgtaa

SEQ ID NO: 110647 - DNA, 636 bp, Glycine max
  Peptide Sequence Number=SeqID_227425
atggggagcttcacagattcagcatgggaatggaacctttcttggagaaggcccctatttgacaatgaggtagcctcgactcaaaacacaacattttggtgggaatccctatcatggataggcacctcgggggcctatcctataaatccaaggctccattttctgcagcacaacaatgggatgaaaggtaggaagaaatacaataggtggaagtgctggtgggtagctctaaattggtctatttggcagcatagaaataagattattttcacgaatgctccattcaatggcagtaacttgctggaagatgcactgtttttggcatggacatggttcagaacaatggagaaaaattttacaatgcatttcaactattggtctagcaatctaccagctgagaaagctttgagctttgagcacccacgactgtttcagcaccctagtaacaacaatgtatgttgggttttctttgagccagacttccaagaacagtgtagggggttctgtgggttcaagcgaggagaatgtgggttttccggcagtgtagggggttctgtgggtttgagcaaggacaatgtgggtgtcgagggagcggtttccggcagttttcaggctggaggagaaagagaagagtga

SEQ ID NO: 110648 - DNA, 333 bp, Glycine max
  Peptide Sequence Number=SeqID_227426
atgaattctttagcattgtgttccctttgcctgtttctcattgctcagtctccttggttaacaaatgctacagtgtttggtgatggttccgacctaattggccagatttgcaatgaaaacccagagaagaagattgaatgcacgaatattctaagagcagatcctacagtcctgggtgcaaaaaatcttcttcaactttcggaggcaatcttgaacttggccgtgaataagacagaaaaagctgaagattttctaaagggattggcgaacacaacagatgttccggccattgcaaattgtgcactttattatgaaaatgcggttgaacgcgtt

SEQ ID NO: 110649 - DNA, 702 bp, Glycine max
  Peptide Sequence Number=SeqID_227427
atggcatttctaggagaaactagcagtcagacgattgtcaactcaaggttggctttcatttatccaaatggatcgattattcacaatgatactggggtttacttccaaacttcaactccggtgcccattcgagtaccaaataggtgtgattttgcaagcctaaaaaccagaatacacaatacccttcagctatccgacaaacaatttttggatgaaattcactatcggaagccattcaccgatacaggtaaccaaattcgctttgagtgtatcaaattgataaatgatgacgatgtcaacacaatgttaatgtgtaatgatcaattttcttgtgttggtccgattgagttattatgcaccgttggaagaacaccagatggaataataaacttacttgaacgcactatgcctcgtattcatgacgcgatcctgtattacaacggcaaatggaacatgccaccgcagaacaaatttgttggttgcgcgttcacaggaaaaaatcctaagaaatttcaaattccttcaacatgtaccatcgatgaactgaagaatttaatcaagcaagttgcacctaaagggatcccccctcttggaattcacgaatcacaaacggtaagacgattgtttttccgtcaaccagctcggtttgagtattcatattcggttacaacatatgaaatacatgctcctgatcaccaatga

SEQ ID NO: 110650 - DNA, 816 bp, Glycine max
  Peptide Sequence Number=SeqID_227428
atgtcctctcttctgacacttcaggatgtgtccttcgtcacggctgatggccgtactcttttcgaatccgtcaatttcagtgtaaccgcaggccgcatcggtctggtgggacgcaatggcgtcggtaaatcaacgctattgcgcatcatgagcgggatgctgcttccgacaaatggaagtgtgaccgcaaccggaagcatcggcatgctgcggcagaacatcggcggtggcgatgccgagacgctggcggatcttttagaggcacggaccggtttcgatattctggcacgcgtcgaacagggcgtggccagcgaaagcgatctggacgaggccgactggctcttgccgcagcgctttacggacgcgctgcagggacttggcctgcccgatatggctcccgacactccactttcagccttgagcggaggccagcaaacgcgggcggcgctcgccgccctcatctttcataagcccgatctcattctcctggatgagccgaccaataatctcgatcgcgccggtcgcgtggctgtggccgacttgctgaccgcctggcggggcgcggccgtcgtggtcagccacgatcgcgagctgttgcagtctttggatatgatcgcggaattgtcccccgacgggctccaggctatacggcggcaactgggatttctatcaggggaagagggcagaggagcgagagacggcggcacgcgatctagctacagcgcggcgcgaggtcaggcaggtcgaacgcaaggctcaggccgcagccgaaagacaggctcgcagcgacgcgcgcggtcgcaagtcgcgcgctga

SEQ ID NO: 110651 - DNA, 246 bp, Glycine max
  Peptide Sequence Number=SeqID_227429
atggataaagttgatatctttgtccctcatcctctcacaaacgcatgtttgcttattcaactttcaccggaatgtgggtgtaagccattggtctgtttgctcaagcaacctgcgctcttgagtgttgacttccaagaccgttcaatcagagattactcatcttgcacgttggtggggagaagtgagttatcaagaatagggtgttggacaaatggcctcagttaccttaagaaaaaggggggttga

SEQ ID NO: 110652 - DNA, 153 bp, Glycine max
  Peptide Sequence Number=SeqID_227430
atggccaacaaccccgccagagctcaaaagaaagaaaatcctcaaaaaggaagcaaagagagttctctcaatcagctctcaatagttgcaggactggatataggtggagtccacaagtttgaggaatctgcagatggctatagcaagatgtag

SEQ ID NO: 110653 - DNA, 777 bp, Glycine max
  Peptide Sequence Number=SeqID_227431
atgcttcagctcagggagaaaaagcacatgaagaactttttactgattttaagaacactcggtgctgcaacggagagtgatcatcaactccttataaaagggatcaaagctgtaaacgatgtaaaggaatatcttgacgagtttttaatggacgaaagggttatagattatcgctggattttcagagctctccttgtgcgtggtattatactcaatacaagaccggccaaatctgctgaagcttacaaaaccgtatggacagatgagggttcaccattgatagtgatcactgagaagattcagaagaagttacagaagttggttgacgttcctgtggaaatcggaatgcgatatgcacagccgagtatcgaagccgggattcaaaaactggttgatcagggagtttccgaaattgttcttttcccattgtatccccaatatgctatgagtacgacggaaacggtgattgaaaaagcagaagaagtaagaaagaaaactttccctactgtaaagatcaattatatccagcctttttacgatagagatatttatatcaactgcctagcagaaagtatcaaggaaaaacttcctgaaaatttcgatgccttgcagttttcatatcatggagttccggaaagacatatctataaaacagatccttcccacacgtacatcagtgctataagaccactgaaactgttattgcaaaaatgggattacccaaagaaaaaaccattgtttcatttcagtccagactgggaaaggataagtggatag

SEQ ID NO: 110654 - DNA, 321 bp, Glycine max
  Peptide Sequence Number=SeqID_227432
atggtggaagcctctggtaatcgattaccagcctgtgtaatcgattacacagaggaatgggtcactggtaatcgattaccagcctgtgtaatcgattacacagaggaatggatcgtgatggcggcgcagctaatccgtgatcgagtagagatggagtgcctagagggagcttgggagaccctcgaaggcaacacgaggtgccgatttcggggcaccattcgattcacggctacttctttggtgcatccagatgaacctgcacggacgcttcagcgcacggtggagtggacagctccttggattagttttgtgtatttttga

SEQ ID NO: 110655 - DNA, 411 bp, Glycine max
  Peptide Sequence Number=SeqID_227433
atgaagcccgagatgtccttaaagatcaaagaagaggtgaaaaagcaatttgacgctggctttttggcagtggctcggtaccccgaatgggtggccaatattgtgttggtccctaagaaggatgagaagataacagccaatttcgctttgttttccttcatgaacgagttctcgggttacaatcagataaagatggcgtcggaggacatggagaatactatgttcgtcacattgtggggaacattctgttataaggtgatgtcctttgggctcaagaatgtgagggcaacctatcagcgggctatggtagcattattccatgatatgatgcataaacagattgaagtctacgtggatgacatgattgccaagtctaggatcgaggaggaacatttcgtcaactgcgaaagt

SEQ ID NO: 110656 - DNA, 315 bp, Glycine max
  Peptide Sequence Number=SeqID_227434
atgttcgttgttcaatatctcggcagctcaagaagttggactagctgctcccattcctcaaagcccggagtggattctaggggaagggcagagcctcaccttgctgtaggaaggtcttcgttgctgggacgggttcaaactggactgaagggaggaggaatgaaagactccgatcttactggggattcatcactggctagggcgaatcaaagcatgggcatctgcaaagggactcctagcaacttgtatgacggggccccatggagacgcaggagatgcaggagccgccagccggatcgaccaataaataaatga

SEQ ID NO: 110657 - DNA, 465 bp, Glycine max
  Peptide Sequence Number=SeqID_227435
atggcttttgtttctcaagttgaaccaagaaacattgatgaagctttatgtgatgaacattggttaatggaaatgcatgaagagatgaatcagtttaagagaaatgatatggatgtaaaaagcatcttcctcaatggacgcattgaacaagaagtgtatgcagaccaaccaccaggatttgtggatcatgaacatcttgactatgtctacaaattgaaaaatgcaccatatggtttgaagcaagcaccaaggtcatggtgttacagtcttggtacaaacaaaggggtgttcttaaagcttcctgcaaactttgtgaaaactgtagaagcaaggcttcaagaagattttgatgatgccaatagtcaagcatatccaagaccaacccaagaagattttgatttcaagaaagatttgtcttcatggataattcaagtaaacatcaagcaatccaagatattcaagtaa

SEQ ID NO: 110658 - DNA, 449 bp, Glycine max
  Peptide Sequence Number=SeqID_227436
ggtacatctacttgggtttgactgagaacaagagagggtacatctcttgtggatcagttctagtggagggtacatccactagggtttcaaagagaacaagggagggccactcgatccaacaggggggtgcagatgaccatgattggtctctgcgtgtcaacaggctcacttgcctttggttgacgaaggcacggataaccatgaggtgtctccacgtgccatcagacttgccgtctttggatgatgaaggtgcggataaccatgaggggggtgcagatgaccatgattggtctctgcgtgtcaacaggctcgcttgcctttggttgatgaaggcacggataaccatgaggtgtctccacgtgccatcagacttgccgtctttggatgatgaaggtgcggataaccatgaggtgtctccgtgtgtcattggacttgccgtctccggatga

SEQ ID NO: 110659 - DNA, 147 bp, Glycine max
  Peptide Sequence Number=SeqID_227437
atgtttgtattcaacaatgctttgaaaggacttgacgatactcaacaaagtaaatccaagcctcctactaagtggattgttgttaaatatttcactgatcatagaccattcgaaccagagagattgaaggcgcttcgcatccagtaa

SEQ ID NO: 110660 - DNA, 156 bp, Glycine max
  Peptide Sequence Number=SeqID_227438
atggaggagacatgtggcattccggatgaaatatatcttgagtgggctaggtttgtcaagattatcccaatgtcactaggagataagagaaaattattcatccaacgacaagagtcaattagaaaggatgtcgagtgggcttttggagtgctctaa

SEQ ID NO: 110661 - DNA, 1166 bp, Glycine max
  Peptide Sequence Number=SeqID_227439
atggttgaacaacaaatcatcagtgttgttggttcttcctctagctcttctcttatggtgtcttctaaaaaatatgatgtttttctaagctttcgaggtgaggacacacgcatgaatttcacaagtcatcttcatgaagctttgaagcaaaagaaagtcgaaacctacatagattaccaacttgaaaagggagatgaaatctcaccagcactaatcaaagcaattgaagattctcatgtatctattgtcatcctctcagagaactatgcttcctcaaaatggtgcttggaagaactcagcaagattctagaatgcaagaaaaagcaaggacaaattgtgataccagtgtttcacaacatagatccttcccatgtgagaaagcagaatggaagctatgagaaagcgtttgcaaaacatgaaggagaagccaagtgcaacaaatggaaagctactcttaccgaagtagccaatttagctgggtgggactctagaaataggactgaatctgaacttcttaaggacattgttggagatgtattaagaaaattgactcctagatatccaaaccaacttaaaggactggttggaattgaggacaattatgaaaaagtagaatcattactaaagattgggtcaagtgaagttataacccttggaatatggggcatgggtggcataggaaagactactcttgctagtgctttctatgccaaactgtctcatgagtttgaggctgattgcttccttgtaaatgtaagggaaaatgcaaaaaggcatggattagaagctctaagtcagaaacttttttctgagttgttagagaatgaaaatcattgttttgatgcaccctttttagtgtcccaatttgtcatgcgtaggcttggatgtaaaaaagttctcattgttttggatgatgttgctacctcagagcagttagaatatctaattaaagattatgatttgttaggacaaggaagtagagtcattgttacaactagaaataagcaaatatttagacaagttgatgaagtatatgaggtcaaggaattgagttttcataactctcttcagcttttctgtttgactgtttttgatgaaaaacaacctacacatggttatgaagatctatcaagtcgtgcaatttcttattgcaaagggattccttt

SEQ ID NO: 110662 - DNA, 273 bp, Glycine max
  Peptide Sequence Number=SeqID_227440
atgacggagtgtgacgaccaacattttcatcgtgactatagagtgtggttttcagtggaagagaaagagaaagggaaaatgaaagagaaagagaaactctacacgtgtcaaaaccctatcgtaaggatgaacaattgcaaatgggatcgtccttcccaagaatggtgcaaagatccacagataaagatgaatggcaacggaatggagaagcaagagagagaggagacgccacttcaaggagaagatgagtctagaagaagctcaccaccatag

SEQ ID NO: 110663 - DNA, 1674 bp, Glycine max
  Peptide Sequence Number=SeqID_227441
atgattaacttgagatttcttataattcatgattcgtgccggacaaatcgatttcatgtgtactttccaaatggtctcgaatcattatcttctaaattgaggtaccttcgttgggatgaattccatgttgagtctttgccatctagcttttgtgctgaacaacttgtagagcttcgcatgcttcgtagcaaggttaaaaagctttgggatggggttcagaatcttttgaatttgaagacaattgaccttgatgactcccgagacttgattgagatcccggacttatcaatggcagaaaatcttgaaaaagtgtctctttttggttgtgaaagcttgcatcagctccatccatccatcttatctctccccaagcttagatatttgattttaagtggctgcaaagaaattgaaagccttaatgttcattcaaaatctctcaatgtactgagactcagaggttgttcatctctcaaggaattttcagtgacatcagaggaaatgacacatttggacttatctcagactgctatacgtgcattattgtcgtcaatgttatttctcctgaagcttacatatttgtatttaagtggctgtagagagattgaaagccttagtgttcatataaaatctctccgtgtactgacactcatcggttgttcatctctcaaggaattatcggtgacatcagagaaattgacagtattggagttacctgacactgctatatttgcattgccaacatcaattggtcacttattatctttaaaagagttagacctatgtggaactaatattgagcttttgcctgcaagcatcaaaatcctttcaatgctgaaagtgctttggttaaatgattgtaggaaattggtgtctctgcaggagcttccaccatccctgagcgagctttatttaaatgattgttgtaaactcgtgtctctgccggagcttccaccatcggttaaagaggtgagtgcctttaactgtatttctctggagacagacatcacacaagatctagtgttacaacacatgttacaaagccgcataccctacatacatcaacaatatctttacaatcctgcgtattttgatgatgggtatttcatcttcccgctaggagaccatgtcaccgacttgtgtaggtttcgtacagcagagagttcgataactattccgtctcttcctaagtctcaattgcggggttatgtttctgtcatcattctttctaagggtccagtgtcagatcatcagttttcttgttctatccatcgagatgacatattgataggtagtgaccgtcgcaggtttataggctgcgaaaatttaatttcagatcatgtgttattttggtatcataatgccagcaaattttgtggaacaggtgaagtgtatgatcctttcagtaacatgacatttatatttgctgacattaatggtaataaagacaccataaaaggatgtggggtctttccagtatatgggacagaatccgggtttaagctggtgagtagtagcagcaacgaaatttttgacaatgagtcagaaccaagagcaaaagaagttggagttgaaagctgcaataatgaaaatgaagaaaactgtgaacaacttttcagaaccaagaggaggagaactgcatgtgataatcttcctgccattacttcatcggtatga

SEQ ID NO: 110664 - DNA, 687 bp, Glycine max
  Peptide Sequence Number=SeqID_227442
atgtacaaagataattggacccaactttggcccgtgggctcaaaaatctaccctgagattcatgagaaccctagggccttcttcagaagctctagcccaatcctcttagagcctcttgctcatggctctagtgactggtcccttcctagggaggattgcatcactttccttagagagaggcgtgcccaactaagggaaggagagtacacagaattccaggaaaaggttgccaggaggcagtggacccaactgacaaagcccatgggtaagtatgactctaagatagtcatggagttctatgcaaatgccctgcccacggaagaaggagtcatggataagcgttcccaggtgtggggccaatggatctcatacgatgaagatgttatcaaccaattcctggggcatcctttggtcctagaggagggacaacattgtgaatacaccgaaagaaaaagccaggcggccaaccataggggccaggtgcaattgaatgatagcttttatcagtttacactgcaccagcagcgccaggaccccaacccttacccgtggcctactcccgagcaattcagggtcactgttgcatggcctggggacaagcctaattttcaagcgaggctaggtcccacaaaggtcccaggagatggagatgaagacatggtagatgtgatggatttcttcctttga

SEQ ID NO: 110665 - DNA, 393 bp, Glycine max
  Peptide Sequence Number=SeqID_227443
atggatttcattttgtctggatttttaacctttgtaacattctgtggctatttttgttgttgcattactaccaaggaacttgggactgttatgaggtcacttggtcaaaacccaactgaggcagaactgcaggatatgataaacgaggttgatgctgatggcaacggaaccatcgatttcccagagttcctcaacctgatggctcgcaagatgaaagacgccgactcagaggaggagcttaaggaggctttccatgagctccgccatgtcatggcaaatcttggggagaagctgacggacgaggaggtggatgagatgatccgtgaggccgatgttgacggtgatggacagatcaactatgaggagtttgtcaaagtcatgatggccaagtga

SEQ ID NO: 110666 - DNA, 513 bp, Glycine max
  Peptide Sequence Number=SeqID_227444
atggcgtgcgctggcatctggatatgcataccgctattcgcggctcgctgcatccgcgctttgggttgttgccggcacgcgaggagccgtggagcgaagattttctcagctggcttggcgcggccgggctggaggcgctgttgcgaacgttttgccgcgctggcctgtacgctggagttgggcaaagcgctgccttttggcgacaacgatttaacccagttctcagcgacgcagcgggcgttaagcaggctgttggtgggcgatttggcggtggaagaagcgactgcgccgctgcgctaccgggtggtgcagcagatcacgcgccacagtgaccagttccagttgcatatgtcgggggagacgctcaattttacgccgttcagcgccgggacgctgctggcggaggatggcgaaacgcgctatgtcgtcgaaaaggcgcaagagtacgtgctgtttcccaaccccggcgtggcgccagggctacgggctgggctgatgctggagcggttgtaa

SEQ ID NO: 110667 - DNA, 189 bp, Glycine max
  Peptide Sequence Number=SeqID_227445
atgaagaagattactgctctgtttgttgcctctacgctggctctgggtgctgctaacctggctcacgcagccgatactaccgctaccacccaaaccgacagcaaaccgatgatgcaccataaaggtatgccgggtcatcacgatatgatgttcaaagacttgaacctgaccgatgcgcaaaagcagcag

SEQ ID NO: 110668 - DNA, 687 bp, Glycine max
  Peptide Sequence Number=SeqID_227446
agggctacatgtcctcaccttcagaggactacacgtcctcccctttagcgggctacacatcctcgcctttttagggctacacgccctcaccttcagcggattacacgtcctcgccttcagagggctacacgccctcgccttcagaggactacatgtcattgcctttagagggctgcacgccctcgccttcataggactccatatctgcgccttcagagaactcaaggaggaggctatcgcgcaaccactatgcataccggggcaagatttcacccgtgccgctgcaaagagacgagtgcggatcatgcacaccaacataaccactcttacacagatatggatgacgttgctacttagcaacattctgcccagtgaccacaatgccgatctccccctgcggaagtatcagttgacacccagtggacctggaggagtccaacagggccctggggtttccaactcttgttacgggcctctgtcagtcctaccgggtgcccatccccccccagcaaggtcatgccattgtgacatagggatcgtgcccgcaagacacccagtggacccagaaaagtccaatagggtcttggggtttccagctctgattacgggcctttgtcagttctacggagtgcccgtcgcccccaacaaagtcatcaggccccctattaatcggactttcatcaagat

SEQ ID NO: 110669 - DNA, 832 bp, Glycine max
  Peptide Sequence Number=SeqID_227447
atgccctatacggtaacccgcccacactcttttgctatccgtcagactcagagtctggtagaacgcagagacttacgttgtcttctgcaccttttgtcatcccgaggcgatgagcccgatgacatttgggggtaccgtatggttatccgcaccttttgtcatcccgaggcgatgagcccgatgacatgcgggggggcgaacgagcccgttgatgcgcagagactaacatcgtctcctgcacctttcgtcgcccaagggcaaacaagctcgttggcacgtagagacttatgtcatcttctgcaccttttgtcatcccaaggcaacgagttcgatgacatgcgggggtaccgtatggttatccgcacctttcgtcatcccgaggtggcaagaccgatgacatgcaggggggcgaacgagcttgttgacgcgcagagactaacgtcatctcctgcacctttcgtcaaccaggggcaaacaagcacgttgacgtgcagacacttacgtcatcttctgcaccttttgtcatcccgaggcaacgagcccgatgacaagcaggggtaccgtatggttatcggcaccttttgtcatcctgaggcgacgagcctgatgacatgcggaggggcgaacgagcccgttgatgcgcagagactagcatcgtctcctgcacctttcatcgccaaggggcaaacaagctcgttgacgcgcagagacttacgtcgtcttctacaccttttgtcatcccaaggctacgagctcgatgacatgcgggggtaccatatggttatccgcacctttcgtcatcccgaggcggcaagaccgatgacatgcgggg

SEQ ID NO: 110670 - DNA, 477 bp, Glycine max
  Peptide Sequence Number=SeqID_227448
atgagtcagttacgtccggctatagtattgttagtgctgcttaccctgctgaccggcgcgagcagatcggtcaggcgttcagccagcctgggccacttctggggccgtccatcggccaccagtgacgtgccgtacaatgcgcaggcgtcaggcggcagcaaccttgccgccagtaatccggcgctggataaagcggtggcggagcgggtcgctgcgctgcgcgctgccaatccgcaggcgtcggcagcggtgccggtggagctggtaaccgcttcaggcagcggcctggatccggatatctcccctgaagcggcgctgtggcaggcaccgtgcgttgcggcagcgcgcaatatgacgctgaaagacgtcgaggcgctgattgcgcgcaacaccgagcgcccgctgctgccgtttatcggcgaagaaacggtgaacgtgctgcggctgaatatggcgctggatgatttgcagggatga

SEQ ID NO: 110671 - DNA, 210 bp, Glycine max
  Peptide Sequence Number=SeqID_227449
atgcctactccagaccagttcagggcagaggtagcatgcccggagattgcccgaggcccaagcaggagaggcaccccagaagctcccggcgatggagaagaagccctcgaggatgaggagatggccgatttgcttgacttcttgggagggagtggagatacggtgaatgctgtgaagattttcccagacgcccaaaatggactcggatga

SEQ ID NO: 110672 - DNA, 573 bp, Glycine max
  Peptide Sequence Number=SeqID_227450
atgaagccacgaaacatccaaggtgcagacatctcaaattcctccctccatatcatctcctacgttgttttcctcagaagaacaacgtaccagtttatctccatgaaacttcccttctaccctaaattggttaaagctttctattcaaacttggaaattcaagaagattccttgatttccgaagtctatgggattaagatggtcatagaccagtcccttttctttgatctcactcaactatcaagtgacggtgtaccatttgagggttcagttgatgatgagtggaagtttgatttctctgtttctgatgcccgccagatggtttgtactaaccaagcggatatgaccgtaaggcttctttcaggttcattggcatttgaatgccgcatcatgcactacttgattatgcgtatcctactccctagatcttccaaccttacacaggtttctgaggaagatttgataatcatgtgggttttcttaaccggtcgtcaaatcgactgggcccatcttgtgagatattgcatgcataaggcctgcgatcaaatgctccactcccatatcctcatttga

SEQ ID NO: 110673 - DNA, 111 bp, Glycine max
  Peptide Sequence Number=SeqID_227451
atgtcagttgagactgcattaggtacaaagggaaaatgtgaggtaatcttggagcttaagaagttagagttgaacatgcattatgtaactaggattgccagttgcaactaa

SEQ ID NO: 110674 - DNA, 426 bp, Glycine max
  Peptide Sequence Number=SeqID_227452
atgaccggcagattacttgttgggtcattaacctttgatttccgcatcatgcactttattattgctcacttgattcggtaccggatgcataaggcattacggaccaatgcacctctcccttatcctcacctcgtcaccctttttcttcatcatttcaaaattcctttggaagatgaaccatttgttcaagtaaaaaggtcttttgttattagtgctggtgcggttatctcatttggttaccgtaaggatgatgatggtcagtgggttcggaaacaagacttacctcagccaatccctgacgaatatactctttctcctccaccgcaaagggttgattcctcttcacttctgaacgatgttctctctgaacttcacagtcttcgagcttttgtgggtgaccgatttgatgctatggatactcgctag

SEQ ID NO: 110675 - DNA, 585 bp, Glycine max
  Peptide Sequence Number=SeqID_227453
atgcagatgatgcaaggtaatatttggatatcaactaactctctgggtttggcacaaggaatgacgcttcttctcaagtttcagataggatcatcccatggaagattcactcttgctcctacagatttttcaaactctcagtttagagggcttaaggttgtgttggctgatgatgatgatgtaaacaggactgtgaccaagaagctgcttgagaaactggggtgtcaagtaactgctgtttcatcaggattcgaatgtcttggtgctataagtggctctggtaactcattcaaaattattctgttggatcttcacatgcctgaaatggatggttttgaagttgcaagaaggattcggaaattccaaagccataattggcccttgatcatagcttttactgcaagtgcagaagaacacatcaaggagagatgtctacaggtgggaatgaatggattgattcgaaaacctatcctccttcgtgagatagcagatgaacttggaacagtcttgcaacgtgcagaaattgatattaaggctatcatatgtatagttcttgatatttgtaagcagttggtctcgtcttaa

SEQ ID NO: 110676 - DNA, 374 bp, Glycine max
  Peptide Sequence Number=SeqID_227454
atggggctccgaaaaaggttgagaatggagaattgcactaagcaatcactacgcatagctccaaactcgaaggatttcctcgagggtggtgtttttggagaggaagctgggtgtttcggtcttttcctctttgctcatgccaaggtcaaaaagtctaaggttgtgtttcaatggggtcttttatcgtgggaacccaatcttgatatctggggcgaaacaaatttgggtgtcaaggtgtcgatttcgggccgagcttccatattgttccataaggcacgcgtgacaatgatgattcgaaaacaacgtgcaaaattagtcatggctacagccaggtgggcactcaagcatcccgtttatggcattgtgatactacg

SEQ ID NO: 110677 - DNA, 336 bp, Glycine max
  Peptide Sequence Number=SeqID_227455
atgatgtttgcctttacttctgttggtattaagttcgacaaatcaattaatcattcaagaggacctcctacaataagaattcaaggtcaaccatgtcatagaataggtaacatgttaccaattcctgggaaagaaccaaaatttgcacaattgtatatctttgacacaaaaaatgaagtgcggaataggattaatgcaataagtccacataatcaaattcaagagcacattgtttcacagcttagtgagatgctggatgaatacaacgtgcatgcaaaaatttcaggatggcgagagatagattgcaagatgctcaagtggataatatcaagttga

SEQ ID NO: 110678 - DNA, 234 bp, Glycine max
  Peptide Sequence Number=SeqID_227456
atgtcagtgaaaaacatcgttaggcgcctaggagtacatgacaagacaaaccaaacactagtaaggagaccagtcaggatcatattgttttgtgagaatgctctaaccatgtgggatcgacacaggcttataggagcactcaaatcgagtgtatttaccctcaaggcctacactccgaagagtccgtcagagcttcttcctcctgattcgggtccaatccagaaaacattttag

SEQ ID NO: 110679 - DNA, 510 bp, Glycine max
  Peptide Sequence Number=SeqID_227457
atggcccgaggcgcggacctggcggcgcaagacatgtttggagaaacggctctacattacgccgctgagaatgggtattttgaagtcgtcaagatacttgtagaggctggttcggatgtgcagcgacgggactcctccaggcggacacctcttgattgtgcgaagatgcgtaagcgtcgaaaatatgcagaggttattgaatacttggagcgacctgatatccaccagatagttgggagtaagccacggccactctctccgatggatagtcaacagttttggattgatgcgatatgtattaatcaagatgatatcgcggagcgtaacgcgcaagtagccatcatgtccatgatctacacgaaatcatcgggtgtatttgtctggctgggtgtggatgatgagagcactatgcgcgccgccgaagccacacatcttccatctcaggaaggtatggacatgtggacccggagacgcgcgttgcaaaacaaggatctaatgaggctgccttaa

SEQ ID NO: 110680 - DNA, 528 bp, Glycine max
  Peptide Sequence Number=SeqID_227458
atggataaccattcatggtgttatccagcctgtgctcaatgtcataggaaaactaacatccaaacaggaccattcacatgtggatgtggcaaggataatgatcagcctattctaaggtatagagttgaggtcatggttacacaaaacaatgagagtgaaaattttttgctttgggaccgtgaatgtgctgaattgattggccaaacagctgatggtgtgaatagggtcaagattgaagatgatgatcttgatttgaatgcttcccctcaagcacttgacaaattgttgggtcatgtgcttgcttttaaggtcaggattcaatcaagattcaaaaatctagttgtacttaaatactcaaaagacctggatttgatcaatgctgttctggagatgctgcctgatagtgaggtgttcttttctgatatctattttagtcgttgttgtcatgatgatatgattcatgagtttgactatcatcaacttatatatggtgcagacatgtttcaaaatagatccttccaatgttga

SEQ ID NO: 110681 - DNA, 390 bp, Glycine max
  Peptide Sequence Number=SeqID_227459
atgaagatgcaccctcaactagattcattaaagtatgtcctagtcaacccttcaagcataagattgaagccatcaagaggaataccagtcattctaataaggattgagtacgctgatatgctcatacaacccttcatgcctcaaccctctaaagcttatgttaaagctctagaagctgagttgctaaggacaagagaagctttaaggcaagcacttgaagacatgaaatatgttgaggagaatgccaagactcaacatctagttacaaatttcttctacaagaaggacactagctacaaatctcctaaaaagaatactttttctccattacgcactaattttgattcgaactttgactcttccatagagattcttgcaaatgggttgtga

SEQ ID NO: 110682 - DNA, 360 bp, Glycine max
  Peptide Sequence Number=SeqID_227460
atggataggatagaacctgtaacaggagccgaatttctgatactagatgatagagggaagataagtcaggatagacgctacaaggattaccttgataagtccaagattcgttcagcgaggaacacacaaattaagaagcaaagcatcagtacagtttcaagcctaccacttccagctcccttccatgagcacgcagagattgggcatgccatggaccactttcacttgcaaagacacctctccacactctcaaagccaagaccagcccatgttctctccaacaacacattcgctcagtcactctcatcagttcctaatgatgttaaggaagaggggttggacttcgaggagagaggttga

SEQ ID NO: 110683 - DNA, 237 bp, Glycine max
  Peptide Sequence Number=SeqID_227461
atggccgaagaatttgtgaaaagctttgttcatcaagacggcgtcattgtcataacccttgatcaccccaaagcattttccgctatggccgaagaatttgtgaaaggctttgttcatcaagatggcatctctatcataaccaatggggagaaacatgaatcaacaataggggcagtgtttttttcacaggcactggcagtaaatgacgtgaggcaatttaaaggtgggacttactaa

SEQ ID NO: 110684 - DNA, 1026 bp, Glycine max
  Peptide Sequence Number=SeqID_227462
atgatagaagtctttgtcaaagccattgcatccctcactcagtattacgatcagctgctaaggtgcttcacgtttggggactttcagctagtaccaactgtggaaaagtttgaagagatcttgggatgtctgctaggagggagaaaaccatatctcttttttgggttctatccctccatggcgagaatagccaaggcgaagacgttggcggatcaaggtgaatggccttcgttcattgatgtcttggcacttttggtatttggagttgtcctctttccaaatgtggatgggctagtggactttgcggcgatcgatgccttccttgcttatcaccatagcaaggagagtccggtcgttgctattttggttgatgcctatgacactttcgaccgaagatgcgaaaagagtgggccaaggatcgtcaccgcatgtgcgccgagaaagggaaggcaaactgggagattcccaaacattcccatgatgggtatgaggggttgtatcaattataaccccgtcctcgccataagacaacttggctaccccatgagaggagcaccgtcggaggaaagcatcacacctttcatcgcacggggtttcaatgaccccaatgcaaagatacttcaaggagtctacaaggcatggggcacagtgcaaaggaaggataaaaagcttaggggaagcagcaatgggatcatcggcgactatcataagtggttgaaggctcgaacgcaagagttggattggctcccaaagctaaaggtttcaagcaaggaagaggctgaaacccttgaggagagtgaggaggtgcaagccctaaaggcggaacttgaaaaggcacaagcagtcaaggaaaagttcaagacaacgaccatcaaggtccagaaagaatgcgacgaactgagggacatcaatgtggccaccgccgaagcattggaacaggaaacaaagagggcccgaaaagaagaatacggccgaaacaagtttcgaggggctttgtggggtagcaacagcgagcttaagctttga

SEQ ID NO: 110685 - DNA, 189 bp, Glycine max
  Peptide Sequence Number=SeqID_227463
atggatccagatatcaatgtcagactctatcatggattcagaggctggaaatttttccctagaatcacactaagcctagggagactttttaagaagaagataaagaaagaccttgagcaccctgaagatagtcccaactttgttgaatgggaaaagtcagactacaactcagatttgaggatgaattag

SEQ ID NO: 110686 - DNA, 165 bp, Glycine max
  Peptide Sequence Number=SeqID_227464
atgggtttttatactagtttaggggcgttactgttaagtggatgtctcaatggagtagttctcacttgtgacgcggtttctagcaccgttgtgcaaagttgcaaagttggaaatttaacggagctgagtccccggtgtcacgcgcatcctgagttcagagcttag

SEQ ID NO: 110687 - DNA, 285 bp, Glycine max
  Peptide Sequence Number=SeqID_227465
atggcagaagcagtaactcaatttatgtccagacaacaaaaatcctttgtagaggctgcagctcaagagaaaagccctctaaaagagcatgaggaacaagcacaacaacaatgggagaagtactcaacagtaaaaaaccaacaagaaaatattctccaaagcgataaccttcctcatcaactgattgacaagaaaggaaggcaagcagagcatgaggaaaccttaagtgccattctttctttaataactaacacctttcttgaaatgtccttccagattatatga

SEQ ID NO: 110688 - DNA, 1675 bp, Glycine max
  Peptide Sequence Number=SeqID_227466
atggccgaccacggaaccagaaaaaccaccaccgaccgccttgaagaggcaatcactcgtcttaccaacagtcaagcctctctctcagatcgatacatgaacctttctggcaaggtcgattcgatcctcgatcaccttcgccttcatgactccagccggaacactgccaacaccacgaatcaccataatcctcaacttgcttctttatacctcgacggcgcaacactgagttggtatcagtggatgttcaacaatggtttcattacctcctgggaagaatttcttcaagctcttgagtcgcgcttcgccccaagtttttacgatgatccaaagggagccttgttcaagttgacgcagaaaggcaccataaacaaatatctaatgaaatttgaacgccttgcaaaccgtgtggtaggtcttcctcccccattccttttaagttgtttcatttcggggttatgtccagatattcgtgacgaggtaatggcactacaaccaatctccctcttgcaagcaactgctctcgctaagcttcaggaagagaagcttcgagatagagttatgtcgaacccacgcaacctttaccagcctaaacgacctccacctctcactcccagccctactacaaaagctaaaccaccatatgtgcaacgaactccgactgagatagcttttcagcgagaaaaagggctatgctacaattgtgatgaaaagtggaacactaatcatcgttgtaaaggacaagtgatgctcctcatcgctgatgaacaatcacctaacaccgacgtaagcatttccaagctcgaggaaactcatcctaccgccatcgacaacaacatcgaaccatctgttgactcaaattgctctcatattagccttcatgcgttcagtacacataacttccttcagctacgcattgctcagttcctgaaacttccagtccaatccactcatcctctgcaagtgttagttggtaatggttccaccttggattgcaatcagggccacccatttttcgtttcgttccaccttctgcaaatcagtgcagctgatgcagtcctgggagataactggttgaagaagctaggcccgataacaacgaattacgcatcacgtatcatgaacttcactcatcaaggccaagaggtttcgttaacaacagatgcaacaattgggctcgaacccgtctccccggcccaactgaagcggttcattcaaacgggttccacttcagctttttaccagctcaatgtccgacccataaccaaaaccgaacccgccccggcccaacatcctttcccttccattcagcatcttcttctccgataccatcatctgttccagactccttcacgactaccaccaccacgtcaagtggtccaccacattacactacaccctgccacagccccgataaacgtcaggccttataggtacccccacttccaaaagaatgaaatcgagaggcaagtttctgatcttctctcagctggcctcatacgacccagttccagtccgtattcttcaccggtcctcctggtaaagaagaaagatggcacatggagactatgcgttgattacagggcactcaatgcagttactattcgcgatcagtttcccgtaccaacgatcgacgagctctacgctctcgccactccctctcttccccttcccc

SEQ ID NO: 110689 - DNA, 996 bp, Glycine max
  misc_feature (35)..(35): n is a, c, g, or t
  Peptide Sequence Number=SeqID_227467
atgggcgacccccattttgtgcaagttcagaacanacattccttcccaccatatggcttgcctcccaactatacaccacccaatgttgcacatgctcctgatgagaatgtcaataactccactcctatactcattgagagccaacaaccccaatctgatcatgcacatgtctctcaacccatggaggagacacatgatgtaccccaccacaatctggccgacttcgatccttaccccggacatgccattgaagggcaagcatttggtgtgggaagagtccctattgccaaggtggaaagggaaaaattcaatcatatagaagaaaggctgagggcgattgaaggaagtggagattatacctttgttgacatggcagagttttgcctagtgcccaacatggtcattcctcttaagttaaaggtgtcggactttgataagtataagggggctacttgccccaagaatcacttgaagatgtactgtaggaaaataggggcatacgcaaaagatgaaaaactgttgatgcatttcttccaggaaagtcttactgaggcaaccgtcacctggcagcatcagtacaattctaatatggctccagatagaatgcagctacagaacatgtgcaagaaggggcatgaatctttcaaagaatacgcccaaaggtggagggatctagcagctcaagtagtgcccccaatgatggagggggagatgataacaatgatagtagacatgttactgatgttctactatgagaagatggtgggttacacgccttcaagctttggcgatttagtttatgccggcgaaaggaacgaagtgggtctgaaaagaggcaaatttgattatcctgctttgatgaatggaaagcctggggcaaatggagagagtaagaaggagggaggaaaccatgttgtgacttccattcatacatggccaaatttcccaccagctcaacaatatcaatactcagccaatatcatcccttctctttaa

SEQ ID NO: 110690 - DNA, 567 bp, Glycine max
  Peptide Sequence Number=SeqID_227468
atgaagctgactttagtccgtcatacgagtttgcaaattgctgaaggtatctgttatggccagagtgacatcgacgtttcgattaactttgccagtgagctgtcgcagcttaaacaaaaactgattcatgagcaggtggatgcggtttatagcagtccgctgcaacgctgtagcaagctggcgcatgcactcgggttcgatggtattttgcatgatgagcgcctaaaggagctgcattttggcgattgggaaatgcagtcctggaacgatatcccgcgtgaactgtttgatgtgtgggcgcaaaactatgccgagctggcaccgcccaatggcgaaacttttgccggcttgcagcaacgcggcattgattttttacaggaaatacaggcacgtcatagcggtcagcatgtattggtcgtgacccatggcggcatgatacgggccttgatcgcacacgtgctcaatatgcaactcaaaggcttgttccgctttcatgtggattacgccagcctgacgcggttggatctctcgggagcgattccaaaggttgaatttgtaaaccgttaa

SEQ ID NO: 110691 - DNA, 249 bp, Glycine max
  Peptide Sequence Number=SeqID_227469
atggcagtcgaaaatagttctgaaactcatgatatgcctgacttactcctggtgttctgtgacgttaggcttaaattcaatccagagcaagcacaaacaaaaattcaatccgaagaatacaggatatctccaagtgttccctgtaggcgaatgtgcattggtgtacgggatgaacaacaggcgtgtaaactgtttccaacttgctttagttcgaagaattggattactttggggctaagatttcgataa

SEQ ID NO: 110692 - DNA, 1800 bp, Glycine max
  Peptide Sequence Number=SeqID_227470
atgagtggtggatcattgggtattcgttctgggagttatgggtctttggagaagcagcagcagcagctacagaacaatggtgtgtcgcttattcaatcagcacgcaaacccaccaagacgctgaaggagaaagacaggttcttcctttggatcttcaagtttgctggcagaaagaaggtcggaatgctctgtctctttaccatctccgctgctgttttcatctgggttttgaatcaatgcatgccacgtgttttgctgaaggtggaggaagaaagcatgttttgtgattcacatgatttcggctttgatataaaatttggcttgctttcagatgaagattcacaggaggggaacagtgttcataacattagtgttaatggaaatatgtctataggtgtttctccatctttgatcgctggtgcaaatatcaagggcttcactacaatttcagttctacctcctcctcccccgagctattttctgggttacactcttccttctggtcatccctgtaatactttcacacttcctcctccaccggcagataaaaagcgaactgggccacgaccatgcccagtatgttaccttcccgtggatgaagccattgcacttatgccaaagtttccgtcaccttctccagtacttaagaacttagcatttatctatgaggaaactcttagcagggatggtgaatttggtggttcggactttggtggatatcctactttgaggcagagaaatgaatcttttgatatacgagagtcaatgagtgtgcactgtggatttgttagaggaactaaacctggccgcaacacaggatttgacatggatgaagatgacctccttgaaatggagcagtgtcacggcgtagttgttgcatcagccatatttggaaattttgacgagataaacgagccaacaaatataagtgattattcaaaggagacagtatgcttccttatgtttgtagatgaagaaacagagaaatatttgaggatttctggcaggctggggaccagaaagaagattggtttgtggagaattattgttgctcataatcttccttatacagatccaagacgcacagggaagattccaaagcttctgttgcatagaatggttccaaatgcccactattctatatggcttgatggaaagcttgagcttgttgttgatccatatcaaatccttgaaaggtttttgtggaggaagaatgcaacttttgcaatatctaaacattatagacgctttgatgtatttgttgaggccgaagcaaataaagctgctggaaagtatgagaatgcctctattgactttcagattgagttttacaagaatgaaggactgactccatatacagaggccaaacttcctcttataagtgatgttcctgaaggatgtgtaatagtacgagagcatgttcccattagtgatctttttacatgtctttggttcaatgaagttgaccgattcacttctagggaccagattagtttctcaactgtcagggacaaacttttgtccagggtggattttcattttctcatgttcttggattgtgaaagacgcaactttgtagttcagaaataccatagggatatattggagcgcctggttgctccagtggctattgctctcagtcctcctcctcctctagaaactttgccggaaaaggttgctaggagaggccctggaaggcgtggaagagatcggagaccaggctctaggcgccaccgtaaagtcgtggccggaggcagggacataaacatggaagcaaattatacagttttgtttgtgtga

SEQ ID NO: 110693 - DNA, 1842 bp, Glycine max
  Peptide Sequence Number=SeqID_227471
atgacagacgagaagtatgagtcccctataaattcatccgtggaaagttatgtgccaagagatgaagcttttgaaggtgtgagaaaggaagctcttgatgtggaaaagttaaaaggggcaacccggaatttgattcccttcataagaacttgtatcaccaagtgtggaaatttcaagcagctttcagatgttcaacagatatacaagagaaagcacgttgataaaatgaaacccgagaacgtaaccacaacaaaatggcctctacctatgaatatgatgagcaagatccaaaatgacgtggaagagtattttaaattcgatactccgcgtattatcaatggtgggaattgttgttgcataaaagatgaagaacttgggcgtcaagcattggccggtatcaaccctctaagcataaaaagacttgagactttcccacccgtcagtgatctggatccttccatatacggtgcccaaaagtctgccctaaaagaagaacacataataagccatttggatggaatgcctgtacaacaggcaatggcagaaaagaagctattcatgttggattatcatgatgcctatctcccatttctgaatggcatcaatgctcgtgaagataggaaagcttatgcaactcgcaccatcttgtatttgacaagactaggtactttgaagcctattgccatcgagttgagtcttccagaatcgaaacaggtccttacccctccattggatgccacctctcattggttgtggcaaattgccaaagcccatgtttgctccaatgacgctggtgttcaccaacttgtccatcattggttgagaacccacgcatgcatggagccattcatcatagctgctcatcgccaactaagtgcaatgcacccggttttcaaacttctaaagcctcatttgaaacacacgttgcaaataaatgcattggctcgtgaggctctcatcaacgaaggaggcatcattgagactgatttttcttctggcaaatacagcactgagattatctcagctgcttataaagattggtggcgttttgacatggaagcccttcctgctgatctcattagaaggggactagcagaacctgatccaacacatccccatggactaagactactgattgaagactacccttatgcaaatgatggacttcttatatggtttgctttggagaacttggttaggacttatgtgaactactattacagtgataggatcatggttcgatctgatagtgagcttcaatcatggtatagtgaggtcaccaatgttggccacgctgatcatgcaaatgcaagttggtggcccacactctccactcctagtgatcttacttcaatactcaccacactcatatgggttgcttcagttcagcattcagctgtgaattttgggcaataccctcttggtgggtatgtcccaatgcgttccccacacatgaagaagttgttgcccaaagaggatgatttagagtacaaagaatttttggaggacccagaaggatacttgctgtcttgcttgccaaatatgtttgaaaccaccaagtttctagcagtggttaacatactttctcagcattcgcctgatgaagagtacatggggcagaggaaggacttgtcagattggactggcgaccctgaaatcataaaggcattctatgagttttccatggatataaagagaatagaaaaggagattgacaagagaaataaagacacaacacgtagaaatagatgtggtgctggaattccaccatatgagttgctcgtagcctcctcggctcctggagttacaggtagaggagtgccaaatagcataagtatatag

SEQ ID NO: 110694 - DNA, 240 bp, Glycine max
  Peptide Sequence Number=SeqID_227472
atgatgcatggaaacttgtggagctacccaaggacaagaaggttgttagagctaaatgggtattcaaaaacaaattggacgaggaagttgtatcaaatgaatgtaaaaaatgcatttttgaatggactcattcaaaaggaagtttatgcggaacaacccccaaggtttgagagtgacactttttgtcatcatgttttcaaacttaacaaagctttatatggactcaagcaagctccttaa

SEQ ID NO: 110695 - DNA, 237 bp, Glycine max
  Peptide Sequence Number=SeqID_227473
atgagaattacaaagaatcaagcaaaaatagaaactttagggttgtccaaattggccaccattttcaaggataaaattcaaaaagctaaaaaaaaggataaaaagaaggtcaatgatcatgatgatgaagactatgtacctgaatataaagggggacttggatcaaattctttaagtaaacattacgagaacgacaaacatgatgagtttgttgctataaatgatcttgaggagtaa

SEQ ID NO: 110696 - DNA, 525 bp, Glycine max
  Peptide Sequence Number=SeqID_227474
atggcatctttaccttcttcagtcgacaaaaacctagaggtttggttgctaccatttccacttatacatatgtggcttcaaccaatgaacatgttcgcaagagtagcttgtggcaatggagagaaacctattccacttggtgagaacgttcttcagacaaacacaaaattatttttgaaggttgaaattgacgttgacgtaaaccgcagtagcgacggactcgacgacgtcggcgaggaccttgggcgccttgacggatccgccgtgagcgacggggtgaatctcgagcttgacaacatcgacgaagcacttgacttggtcgacgaagcgctcgacctggtcgacgaggggaggggcgttgtggcaaacgtagtggtggaggccactgcggacggcgacacaggcaagcttctcggtgctgttgttggcggcacggagggcggagaactggccgggatcaagatcggggtaagcgagaaacaagtggctacacatccactcatgatggcgagactcagaacgtga

SEQ ID NO: 110697 - DNA, 399 bp, Glycine max
  Peptide Sequence Number=SeqID_227475
atgtcgagcgccgatctcaagcacaaagaagaagaggaggaacttgtcgttggcgacgacaaggacaccagagcttacgttgctccaatcgtcaagctccagaaggttgctatcaccaccggtgaggaggacgaagatccaatcctggatctcaaatcaaagctttaccgattcgacaaggacgagaaccagtggaaggagcgaggtgccgacaccatgaagttcctgaagcataaggcttccggcaaggttaggcttctcatgagacagtccaagatgctcaagatctatgccaatcagcttatttttgagtctgtacaattttcatcgattggtttcattcatgattgccctagcttccttaaacctctgggagaggaagaagaaggacaatcttag

SEQ ID NO: 110698 - DNA, 126 bp, Glycine max
  Peptide Sequence Number=SeqID_227476
atgtaccctcacatggaagttcaggatcaagggctagcagcaaccctaacgcaaagctcgtctcgctcccaaggccttcgccgtctccctcgcgccagagagagaggcggtgatgtcttcaattag

SEQ ID NO: 110699 - DNA, 261 bp, Glycine max
  Peptide Sequence Number=SeqID_227477
atgttctgtccaggttgcagtcaaaaggaggcagctctttctgaacagaatttcaagaagcatggaagagagaaagggataagtatagaagaaactatgggagatggaaggaaaatggtgttggtgcacattgtcaacatttccaaagagacgattggtattggaaggttgaagcatccttcagagagtagtgggcgaatcatcaacacactcaaagagggagtggaaactaatcattatcacatcattactcagttttag

SEQ ID NO: 110700 - DNA, 189 bp, Glycine max
  Peptide Sequence Number=SeqID_227478
atgagaaaagcccgagtgattgagaagatatacttaagacccactgcaaatttgatggtagtaaggtgggaacctcctcctctagggactttaaaatgcaatattggcgctacttttgtcgaagaggaaaactcttctaagttcgttgttttatcagggaggatagagggagacaagcaaactcggtga

SEQ ID NO: 110701 - DNA, 315 bp, Glycine max
  Peptide Sequence Number=SeqID_227479
atgtcggatacaatgtccaggacatcctgcccgaaaatactggaagttgctgtacaatgcacaaagctgcaggatccacgatgtcggatacaatgtccaggacatcctgcccgaaaatactggaagttgctgtacaatgcacaaagctgcaggatccacgatgtcggatacgatattttcaggaagaatgatagatctcatccagcacaaggagttgcagcccagaaacgcacactgctatataaacatgaaggctgcacgagttctgtaccaagtccgggattgaagagttattttgtgatttttgggacttga

SEQ ID NO: 110702 - DNA, 162 bp, Glycine max
  Peptide Sequence Number=SeqID_227480
atgaatgaagataaaaagaattggaatgaaaaggctaagacaatgatggagattaacagaaaaacaaaggaaatgttcaacacaattcatattaaagatcaggacttttgctgtaagatagaaggatcaactagagcatacttggcatttgctagacagtaa

SEQ ID NO: 110703 - DNA, 504 bp, Glycine max
  Peptide Sequence Number=SeqID_227481
atggcagggctgagagactcgaagatgagggaatctgagacaactcctcaggcgacgcacaaggcgtgtagtgaaattcttcctcgggagcttccagggtgcccctttagcattcaaaacaaattcgtgccctggaatgcagagcttggaagcaagctcctaaggatctatgcgcatccggggggatttgtcttcgagatcatacaagttcgcataaaactccttgaccagggctacatctatgtgcctatccattttcctggtcaaggatttatgccagcatcgcctctcgagctcccgacggaactcgtcgtattcagtaacgtagagaacaacgttcctctccgaaagaatgttccgagagtgaacgttcaaggaatacctctcccaagcagcctcagaattaaatctggtagtatcataaggctcctagggccgagaggcagtagatttcctcttcatggaggccatcttcatcaaaaagaatcacaggaagcaagttag

SEQ ID NO: 110704 - DNA, 426 bp, Glycine max
  Peptide Sequence Number=SeqID_227482
atggtagtaaggtgggaacctcctcctctagggactttaaaatgcaatattggtgttgcttttgtcaaagaggaaaattcttttaagttggttgtgtttatcagggatgatagaggtcaatttgtcatggctttatctcacacttccccgtttaaactgttgattcatgaaaggaaggccctagccatgttggtagccttacaatggctcaaagatttggagattgatgatatcattattgaatctgattgccttcaagtggagaatgaagtatataactgtcgctcagataaatcgaaatatgggagacaagcgaactcggtgactcactctcttgatcgagctctgaattctcaagttgatccccattattttagacatgttccaaattgtattgctgatttttttcgtattgaaataatataa

SEQ ID NO: 110705 - DNA, 483 bp, Glycine max
  Peptide Sequence Number=SeqID_227483
atgctcctgaggagaacggcagagaaggatgcagttcttttcggagaaagaaaatcaagaaacacaccctggagaagggaacgctctagagaagaaccctcactgtgtcgccatggtgttgccagagaaggacgtagggggccgtcaatttcttttgccgttgtggtattgtcagagaagaagcctgtcgaggacgtgcgacacagagtgaagaagaccatgaagcgtgagctttatattaaagcatcttcaaaaggacgaccctctacaatcagggaggttaaagctttgaacattggtcaacttgtaagaatttctggctacatctatatggaattccaattagttgatggtaatgatgatatgggagtttctggggatgtgggtttgagtacgtatgaagttcagatgcatcaagaaacatatgaagaatttcagcaggaagtgacagaatttcaggttcaattcatgttctctacatag

SEQ ID NO: 110706 - DNA, 192 bp, Glycine max
  Peptide Sequence Number=SeqID_227484
atggggagtagttgcattggcgtgcctctaggaccatttctcctatgcaagcttgtgtttgagcatctgcccaatgttggttacatggagggagaggattacatgggtggggaccttctagaaactaaatggaagctattaagaggtaccgggcgtgccctttcgatcaaggagaaattgaatgagttatag

SEQ ID NO: 110707 - DNA, 276 bp, Glycine max
  Peptide Sequence Number=SeqID_227485
atgagaggagttgtatacaatttacaacagtttcttatacaaaaaagtgctaaagttgatgtctcgctaagcaagctcaatgcgcttagcgagtgtcatccgctaagcgaggcatcaacgcgcttaccggataggaggaatctggaagggaatctttcatgcaggcacgcgctcaacgcatcatcagctcgctcagcgagtcgtttgttaccttccagccttagcgcgagtttggcgctgagcaaaaattcacttactcgcgctaagcctagaaag

SEQ ID NO: 110708 - DNA, 411 bp, Glycine max
  Peptide Sequence Number=SeqID_227486
atggcgaggacgtgcaatcctctaaaggtgagggcatgtccccctttgaaggtgagggcgtgtagccctacaaaggtgaaggcacatgaccctttgaaggcgaggacgtgtagtcctctgaagttgaaaaaaaaacacgctttacggcgcccttatcgaacctgtgctagagctagagtaatggatgaaatagagaaggtgcaagagcagatgaaggccgacccggaggccttgaaagagaaaatggccacaatggtagaggccatgatgagcataaaggagatggtggaggtcagtgcggcttaccaaacccatgctagagctaaaataatgggtgaagtagagaaggtgcaagagcatatgaaggccgacatggaggccatgaaagagcaaatggtaggcaaagattag

SEQ ID NO: 110709 - DNA, 780 bp, Glycine max
  Peptide Sequence Number=SeqID_227487
atgactttagcttcggcaattagttcacctgggaccatgtttactgcaaagcaaaccaaccaccacctcagtgctactctaggcaacgccgtccttctcgaggagaccacccaacgccgccaattcgtgttccaccaatccaccgtcacctatgacaccaaccttgcctttgacgtccaaaacatcgtcattttcatcttcttcaaaaaccttcactttgacacgcttgttggagagaaggactatgagaccgataagcccatcgaggatcgggtccatgtccaaggcccacctggcagagacccttccttttcactagccaaagtgcctcctcaaatttcacgccccaactctggaaggcaaagtgccttcttgaataatgataatgataacaagggcggggcagcaaaagatgatagtaatgataatggggctggtgctggggctcttatttctctgtctagagagggtaataacactgcttctgttgttcctgtgttgaacacttcgtcccctgtcaaggctttggttgaaacaagatctaaccagggcaaaggcgcagacacgggcaagtttgggaggaaggatgtgccatcatgtgtccccagtgacatcaagaaggagaggactctgctgaggtcacttgttgttcataacaataagcgtagcgaaggggatttcgtcgggaatttgagttccaaggagaagagtgggaagaaacgccttaggacttctaacaaggaggtagatcccagcgcggctcgagaatgtcatgaatga

SEQ ID NO: 110710 - DNA, 201 bp, Glycine max
  Peptide Sequence Number=SeqID_227488
atgaaggtgttcagctgtgtgctggagcttcccttctgctctgacactgacatggcggtggaggaggcccctaacttcttccggttcatggcagagactgacggaatcggcaacgtgagggcacacacagtggaaatccaccccggcatgaagaagatcatggtgaaggagggtggcttggtggagctctctctcgactag

SEQ ID NO: 110711 - DNA, 225 bp, Glycine max
  Peptide Sequence Number=SeqID_227489
tgcccaacttatttactctctgtcgattcgattccgcttctggtgcccccttcccggaaactccaagaaagcattcgcgtggctctcaaacccttccttaccttcccggagctctgccgcagaggacaccattgttgatgccacttctcgttagggttccgccctctggttactcttggaaggatgtttgcggtggtggttatggattcgccatggctatctctg

SEQ ID NO: 110712 - DNA, 366 bp, Glycine max
  Peptide Sequence Number=SeqID_227490
atgaatgccatattcagattccaagaagttgatgaggttgttaagaaagcaacacataaagaactcaagaggctagatagcaaggcacgattcttgatacatcaatgtgtggatgccacagtggttgggaaaattgctaaagccactactacaaaagaagcatgggacattttgatcaagacatatggtgatgctgaaaaaactaagaaggtattagtgaatgggatgaaggcttgcaaggaagctctaacaaatcaacaggtagttgacaaggtcttgagctctttgactcctcaatttgatcgtgtggttgttgcaattgaggaatcaaagaaccttgattcaatgaaggtggaagacctatag

SEQ ID NO: 110713 - DNA, 273 bp, Glycine max
  Peptide Sequence Number=SeqID_227491
atggagaaaaggtgcggaatgaccataatttgtctccgcatgtcatcgggcttgccacctctagatgacaaaagggcgcagaatgaccataatttgtctctgcgtgccatcggacacgatcgtatcgggatggcgaaaaggtgcggaatgaccataatttgtctccgcatgtcatatgacctcagggttagtatgatagagattgtggggcggccgataaaagcgaggctcttgctcctatgtatcctcaatgaggaactcagacctacatag

SEQ ID NO: 110714 - DNA, 612 bp, Glycine max
  Peptide Sequence Number=SeqID_227492
atgctttctgatagcgataatgcagctcaaaatgtaaatattcataatgatgaacttaaagaatatctagattgcaggctatatcacagatacatttctccctgtgaagctgcttggagaatatttgcttttccaatccatggcagaaagcctgctattgagagattgtattttcatcttccagatcaacacaacattatttatgaagatcatgatgatatagatgatgtactatcgaaaccaactatttcagattcaaaattcctagcttggatgaacactaataaagattttgatgaggccagaaatctaacttattcccaatttgtgtcaaagtttgtatataataaaagaaacagatcatggcaacccagaaaaaagggatataccattggaagactcatatgggtaccaccaaccacaggagaattgttttatttaagaatgatgtttggcagctgcaaaggacctacttcatttgaggatatcaggattgttgcaaatatccaacatatagagaagcatgttttgcaatgggctttctacaagatgacagagaatatgttgaggcaatcaaagaggccaaggattggggcacaaccaattatctaa

SEQ ID NO: 110715 - DNA, 186 bp, Glycine max
  Peptide Sequence Number=SeqID_227493
cttccaccagaggttaacttcaaaatggaaccaaagacccaaatcaattaccagctactaactgaaagcagagaaattcgaagtcctttcttctattctgaggaacagcgaagtcagacgcggcagagatttgaacctgaagaggagaaaactctagctgaatttggagaaaacaacgatgcttga

SEQ ID NO: 110716 - DNA, 294 bp, Glycine max
  Peptide Sequence Number=SeqID_227494
atgactaaagcacgtcaaaagggggtacggaaagaaaataggggagaagcttgccacccagctcacccaggcgagctaggttgcttcctcctgaagcaactaccttcgagaggaatattctggaaggcccaagtggatctagttgctatttgcacccccatttttactaagtacatctccttgctcttttttgaacttcacgaattgtctagcgatggtgccaagtacctcaaagtggtcaaaggagggtcgcatcccaacaacgggtggtccccggacgaaattaggctatga

SEQ ID NO: 110717 - DNA, 384 bp, Glycine max
  Peptide Sequence Number=SeqID_227495
atgggttgtccctgtgtgcctatccctcttaagattattgaggccacaaggtccaacaaatttaaaacaaagggtgcaccgaagtctgtgaaatctatcaaacatgaaccttcaatgggggagtgtgtcgatgaaatgagcacgatggttggtagttcagcaactccaagtgtggctttcaaggttggttgtgacaagaagaggacaaaaatggatcattatatagatgaatttcatgatgagttgcaacaatacattttgaacattaaagatgtcacaccgaatggaaattgtggttacagaacaattgcaactttgctaggccagtgtgagaagtcttggtctctcattcgccaagatttgattcaggaacttcaaatatga

SEQ ID NO: 110718 - DNA, 525 bp, Glycine max
  Peptide Sequence Number=SeqID_227496
atggaacctgatacttatagagttgagtatgagctgcaagtccttgtttgtaagggttgttacggtggtgtaacagcccttgtggataatcactggcttgtagataacagccagttgtctagtgtcgagggagtttttcctgtgtcgaaggtagtagccttgacaagtaggagggtcacaaatcctaatttcgtccggggactatcattcatggatgttttgattctcgatagtcgaattgcagtgttcgacaccaaccccagctcgcccaggctagcatctggctcgcttgggccatggaattacctcctggctaagcaaccagctcgcttgggcgagctcattacttcagggctaaggggttggaaggttcatcacttgaagggaattgagagaaaagaagaagaaagagaaaaagaagaagaagaaagaagaggaaacgaagccgagacgttaacgaatcgcgaccacgatcaatccctacgtcgtttcttattccgtgttcttcgtgcgacagtcgattag

SEQ ID NO: 110719 - DNA, 564 bp, Glycine max
  Peptide Sequence Number=SeqID_227497
gtcgagcatgaactgcgccagcgcgcggtgcaggcgggcaatgagaccgcgcatgaacgagaagcgcgcgcccgacagcttggcggcggtatcgaagtccaggcccagcggttcgcccagcgcgacgtggtcgcgggcctcgaacggcagcgcgggcgggttgccatcggcgcccgcggcggccggcagccagcggcgcacttcgacgttatcgtcggcggactcgcccagcggcacgctggcgtgcggcaggttcggcaccgacatcagcagctcgttgagcggctgctgcagggcggccagctcttcttccagctgcttcaggcgctcgggcacggcctgcgattcggccatgacggcgctggcgtcctcgcccttggccttgagttgaccgatctgcttggccagcgcgttgcggcgggcttgcagggattcggtttcggtctggaccgccttgcggcgagactccagctcgttgaaccgttccgtgtcgaaggacacgccacggctcttgaggcggtctacgacggtttgcaggtctttgcgcagcagtatcgggtctag

SEQ ID NO: 110720 - DNA, 438 bp, Glycine max
  Peptide Sequence Number=SeqID_227498
atgatgagtgaaatagaggaggtgcaagagcagatgaaggccgacgtggaggccatgaaagagaaaatgaccataatgatggaagccatgatgagtatgagaaaaatgatggaggcgactcacccatctgaggtggacccgaatcacccatctgggctcaatcaagtaaatcctctagtctcggatatgataggtcagggaggcaaagcgttgagaagtatgggcagtccctattttgtgcaggttcagagcaagcatcccttcctagcatatggcttgccccccaactatacaccgcccaatgtcacacacgctcccgatgagaatgtcgacaactccacacccttacccattgagagccaacaaccccaatttgttcatgcacaggtccctaaacctatggggagacacatgaagtgccccgagaccatactctag

SEQ ID NO: 110721 - DNA, 392 bp, Glycine max
  Peptide Sequence Number=SeqID_227499
atggcttctccatgttttagttccatttttcttcttctttctatcttcttgttggccttaatccaatttgcattgtgtgggaatttctacgaagatgttgacaatctctttggagatgtaagggttgacataaaagataaaggccaaagcatgaccctaacaatggatgaatattctggctcaggcattgtatccaagaatgagtatttgtttggaagattcgacttgaaaatcaagcttttcttgggcaacttgactggtgatccttatttgctctcaaccaatgtatatgctgatgttgttgggggtcgtgagatgcaatactatttgtggttcgatccaacagaggactttcacacttattccattgattggaaccctgatcgcataat

SEQ ID NO: 110722 - DNA, 246 bp, Glycine max
  Peptide Sequence Number=SeqID_227500
atgaagaggagaaaaacaggcctcttccaaagcatttcctttgagatatttgagagcatgttgtgcagcttgcaggcaatacctaagttggatcgggttacttcaaaaccaaggaagtacttgagcattccaagatctttaatgttgaattttgcatccagggtgaagaaattgcaacaacaacaatggttgcaagaaggatcaaacatcacagcagaagggaaaatttcaactgataccatgtga

SEQ ID NO: 110723 - DNA, 387 bp, Glycine max
  Peptide Sequence Number=SeqID_227501
atggctattaggaaatgttcgatcggcgtcatccagttatgggacttttggcatttgataaaatttggtgagagtttctctctgagttccttgttgaaccaatctcagacttatcaaggtaatccttgtggcgtctaccctgacttatcttccttcatcggaagtggcgtcatccaaacctccgtagcctgtatcaaacgatctgctcctactcaggttcacatcatcagtgatgaggagataaccaagggcaaggaccatgaagcacttgaagggcccatgaccagaggcagacttaaacaagcccaacacgacatagagacaaggctggtcatttgtatagctgccattgatgatgattttggccccgaggcagagacactatga

SEQ ID NO: 110724 - DNA, 2134 bp, Glycine max
  Peptide Sequence Number=SeqID_227502
atggactttttctctgaatatggtgatgccaaccggtacaaaatccaagaagtcattgggaagggaagttatggtgttgtctgttcagccattgacactcacaccggtgacaaagtggcaattaagaagattcatgacatcttcgagcatatatccgatgctgctcgtattctccgtgagataaagctgcttagacttctacgacatcctgatattgttgaaataaaacacattatgctgcctccgtcaaggaaggactttaaagatatttacgttgtttttgagctcatggagtctgatcttcatcaagattatgttgctacaaggtggtatagagctccagagctatgtggatcattttactcaaagtatacaccagcaattgatatatggagtataggttgcatctttgctgaagtactaacaggaaagccactttttcctgggaaaaatgtagttcatcaattggatctgatgacagatctgcttgggactccttcacttgatactatatcacgggtacgtaacgagaaggcaaggagatacctaactagcatgcggaaaaagcagcctgtgccattcgctcaaaaatttcccaatgcagatcctttagcactaaggctactggaaaagttgttggcttttgatccaaaagaccgacctactgctgaagaggctttggctgatccttacttcaagggactggcaaaagttgagagggaaccatcttgccagcctatcacgaaaatggaatttgaatttgaaaggcgaagagttacaaaggaagaaattcgtgagctgattttccgtgagattctagagtatcaccctcaactattgaaggactacatgaatggaacagagagaactaattttctttatccaagtgctgttgatcaattcagaaagcagtttgctcatttagaggaaaatggtaaaaatggtcctgttatgccacttgacagaaagcatgtttctctgccaaggtctacaattgtacattcaaatacggtacactcaaaagagcaaacaaataatgctgccagcaaaaaccggccaacagttgaggaatataacaagaacccaagagatacagaaattccagtgccaaggtcaatgcagggaccacaaagaattccactagcaaaacctggtaaagttgttgggcccgtagttccatacgagcatggtaacattgtcaaggattcatatgatcctaggtcattcatcagaggttctgtgcttcctacacaagctgttcccccggcatattactatcaaagatccagcactggaaaccaagaaaggccagcgacagaagccaacaagagtgtgcctttgcaggcaaaacatgcacagcaacaatgcggagttaatgccaagatggcaccagacatagctattaatattgatacaaatcccttttttatgacaagggcaggagttaacaagttagagcaaggtgatcaaatagccatagagacaaacatgctgcagccaaaggcacatcaatatggtggaatcggtgctgcagctggggccactgctcatagaaaagttggtcctgttcagtatgggggagcaatcctgttagagaaaaagacactttttagggatggagctgttgtagtctctggtgatggtttgtgtaaaaatgagagtgagaggcttaaaggcagtgcttccttagaaaaaagtgtcagctttctctggcctacaaagggtatgaactttggttacaactatcatgagactgttgacgatgaaattgagtcctatcttgccgcgaacggcgccgtatcgaagatcgaggcgttggagcgcgagaacgcgacgaagaaggacgagatccagaggctgaagaaggagatcggaggaggcggcagcgtcggcgctgaagaacctcctcgaagagagagagagagagagtacgggagagcgaggagcggaggaagagacgagagagaaggctggggagaaagagagagagagatcgaagagatgaaacagagaattgaggaattggagaaagttaaggtagtggaaatgagagagaaaggagagagagtggaagaaggggttgtggcttgtgctgtggccggtgatggcggcagggagtggagccgttgctgcg

SEQ ID NO: 110725 - DNA, 834 bp, Glycine max
  Peptide Sequence Number=SeqID_227503
atgcgtccagcatcctatatagttatcgccgcgctggcgggctttgtcggcggaaatgtgctgcagctgccggaactggtggataaagtcagcgggaaattcgctgaccagaaaaccgaaccggcggatttctggagcacgccggcgattgccggttacggtaaaattcactttgttaacacgccggattacaacccggccaacacgcccgggctgagcaataagattgtgtttcagatcaaccgcagcgaaggggatatccatcagccgaacctcggccttgagcgcgtggcacgcgtcaccaacctctattacgcggccggcgtgccgctgaatcagctcaactttgtggtgtcgatcaacagcgatgcggtgccggccgcgctcaataacgatcagttccgtaaagcgtacggcagcgataaccctaacctgaagctgattgatgagctgaagaaagccggggtgaaagtgaccatttgcgaccagtcggtggccttccatcagctggagcgcgactggattgacactcgtgtcacgcatacgctctccagcggcaccaccgtcgcgtcgctgcaaaatgaagggctgctgtcatcttttcgtcatcccttcgtgatgtcactgtcacagttcgccgttagtttaggcgccaatgagatcgatctcatcggcactttacgaggcgaacatgtccgacttactcacggtggcaaagctggcaggcgtttcacgcgccacggccgcgcgcgccttttccgatccccatctgctgcggcgcgacacgctggagagagtgctggcggcgtcggagcagctcggctttcgtcctaa

SEQ ID NO: 110726 - DNA, 174 bp, Glycine max
  Peptide Sequence Number=SeqID_227504
atgtcaggtacaactattacaaagtctgtggttgctaatgaacccggtggaaggaagagggatgagatctttgttgatgtaattgagaaaataagtgttacattcaactctagtggatttatacttactagtgagatagatggaaccattcaaatacacaaaccatcaaattag

SEQ ID NO: 110727 - DNA, 270 bp, Glycine max
  Peptide Sequence Number=SeqID_227505
atgtcatctacagctattcatcttctcccacaaataaagattcacaatcataacagtatgatgtatgcaccatcaatgcaccgatcgtggataattaaagattccaagtcattgatgcaatcctaccccgcaagggcattagatagaagactccaagaagattgggccagagatgcaagagaaggccctagggttctcacgagctttaggggctccacattaatggaacgggaccctggaaatgcaagagattctgtaccggggaactaa

SEQ ID NO: 110728 - DNA, 267 bp, Glycine max
  Peptide Sequence Number=SeqID_227506
atggaatccgatgatgaagtcggggtcgaggatacccgatacccgatactcgacgggtacggggatgggataaaatttttaaactcgtcgagtatcgggtacgagtgtgaggacaagttggggagtcggggttggggattggggaaacaatacccatctccgccctgccccattgccatgtctaaggttgagggtggcagcgcaatggtcacgtgcaccaccggtcttggtgcattggccacacaatcaattttaaaacaatgttaa

SEQ ID NO: 110729 - DNA, 2891 bp, Glycine max
  Peptide Sequence Number=SeqID_227507
atggctcgtatgaagcaaaccgcaaggaagtccactagaggaaaagctttgagaaagcaacttgccacgaaagcaacacacaagtccgctccgccgaccggcggcgtgaagaagccgcaccatttcaggccaagtacggtggcgctaagggagatccaaaagtaccagaagaacaccgagcttctcataaggaagcttcctttccaaagactcgtaagggaaatcgctcaggacttcaagaccaatctctacttccacagcagcgccgtctccactctccaagaagccgcagaggcctacctcgttgtgctcttcgaggacaccaacctctgcaccattcacccaagagagttgccattatgcccaaggactgaggcctaccttgttgggctcttcagcagccaccacccatggcgtcgttttccgccgccgtcgctcagttctcccgcgtttcaccttctcacacttcgctccactctcactctcacggcacgctcttccaatctcaatgccgccctttcttcctctcgcgcacttcccattcactccgatgtttcaccgaatgtgtccttggaggaaaaacaactacccaaaggagaaacttggtctgttcacaaatttggtggaacctgtgtgggaacctctcagagaataaaaaatgttgcggacataattcttaaggatgattcggagaggaaattggtggttgtttctgcaatgtcaaaggtgacagatatgatgtatgaccttatccacaaggctcaatcacgcgatgagtcttatacagctgcattaaatgctgttttggagaagcacagtgcaactgcacatgacatacttgatggagataatcttgctactttcttgtctaaattgcatcatgatattagtaaccttaaggcgatgcttcgtgcaatatacatagctggtcatgcaacagagtcctttacagattttgttgtgggacatggagaattatggtctgctcagatgttgtctctagttattaggaagaatgggactgattgcaaatggatggatacaagggatgtccttatcgtaaatcctactggttctaatcaagttgatcctgactatttggaatctgagcaaagacttgaaaaatggtactctttgaatccatgtaaggtaatcattgccactggattcattgcaagcacacctcaaaacattcctaccacactgaagagagatggaagtgacttctcggcagcaattatgggtgctctatttaaggctcgtcaggtcacaatttggacagatgttgatggtgtgtatagtgcagatcctagaaaagttagtgaggctgtgattttgaagacactgtcttatcaagaggcttgggaaatgtcttattttggtgccaatgtcttgcatccccgcacaattattcctgtgatgcgatatggcatacccattatgataaggaacattttcaacctttctgctcctggaacaaagatctgccatccttctgttaatgatcatgaagatagccagaacctgcaaaattttgtcaaaggatttgcaaccatagacaacttggcacttgtaaacgtcgagggaactggaatggctggtgttccaggtactgccagtgctatttttggtgcagtaaaagatgttggagctaatgttatcatgatatctcaggctagtagtgagcattctgtatgctttgctgtgcccgagaaagaagtaaaagctgttgctgaggcattgcaatctagatttcgtcaagctttggataatgggcgtctttctcaggttgcagtcattccaaattgtagcattctggctgcagttggccagaaaatggcaagcactcctggtgttagtgcctcccttttcaatgcattggctaaggccaatataaatgtccgtgctatagcccaaggttgttctgagtacaatattactgttgttgttaagcgagaggattgtataaaggctttacgagctgtccattccagattttatctctcaagaaccaccatagcaatgggcattattggacctggattaattgggagcacactacttgagcagctaagggatcaggcctcaaccctaaaagaagaattcaacatcgatttgcgtgtaatgggcatacttggttcaaagtcaatgcttcttagtgatgtgggcattgacttagctagatggagagaacttcgagaggaaagaggagaagtggctaatatggaaaaatttgttcaacatgtacatggaaatcattttataccaaacacggcattagtggactgcacagctgactctgtcattgctggctattactatgattggttgcgcaaaggaatacatgtagttactcctaacaagaaggcaaattcaggaccacttgatcaggtagtttctgaagcaaaggaagcaggttatactgagccagatccaagagatgatctgtctggaacagatgttgccagaaaggttataattcttgctagggagtcgggtttaaagctagaactgtctaatattccagttgaaagccttgtgccagaaccactacgagcttgtgcatcagctcaggagtttatgcaagagctaccaaaatttgatcaggagttcacaaagaaacaagaagatgctgagaatgctggggaagtcttgagatacgttggagtggtggacgtgactaataaaaaaggagtggtagagctgcgaagatacaagaaggatcatccctttgcgcaattgtctgggtcagataacattattgcatttacaacacgaaggtataaggatcagcctctgatagttcgtgggccaggagctggtgctcaagtcaccgctggtggaatatttagtgatattttacgacttgcctcatatcttggtgctccatc

SEQ ID NO: 110730 - DNA, 591 bp, Glycine max
  Peptide Sequence Number=SeqID_227508
atggaaaataacataatttccttgttgtccaaaaggtttggtgaagtgcgctctatcagcttatcactaatgcaacttgcaccttttcaaaaaggtggtgtcatatattataatattctctatatagtgcttcttagtggagagtggaaggaagggtacatccaatccaagacacagaacagaagaatggcctcaaaatcatccaccattagacttgtttgtttctgctacttcatgctcttcagctctatgcatttcaccagctgcaccgtgctctcattgaaaagtcatgcaagcacatgcaatggttccatagctgaatgcaatcaagaagatgagctgttgatggagtctgaaataagccgaaggtttctggagcagaagagatcatacatttccaatggagctttacagagagacaaaccagtttgtaatggtggtggctctggtgaagcttatagtaaaactggagggtgtcttcctcccccctcaaatcctcaaagtctgactcttgattacatcttcatgcaaacatctttaaggttgttcatgaatcacgccttttcacataatccttatgttgtccattaa

SEQ ID NO: 110731 - DNA, 378 bp, Glycine max
  Peptide Sequence Number=SeqID_227509
atggtttgggattgtgaggagttgaccctcttttgggactgctctgtcccttcccacagttgggcaaaattctttagtcttggtcttcacgagtggattcagtttaatctttcatctcttgatagtggaaatgttaatctcgactggcctattttatttggagttgctacttaccatttatggaatgatcgtgatttcgaaggaaacatcgggaaactctctgtcctcgctccccccaatcggaaagaggtagccatctcttggacccctcctcctagcctgttaataaatgttgatgggtcgtataaagcttcctcaagcaagctgcctatgttggtgttatgcatgatcatgtgggaaacattattatcactttaa

SEQ ID NO: 110732 - DNA, 306 bp, Glycine max
  Peptide Sequence Number=SeqID_227510
atgtcccaacccagattcattgtcatgactttcccatgtttggcacttgttcttctgcttcacacccttctcccaatctgcaatggcctatcagttgtggacctcatcaatttgagtgaaactgaagtgatgaccaaaaggcacataaagtacattagctatgggacactgaagagggacatggttccatgtgatagagcaggagcttcttactacaattttcatgcaagaccagctaatccttataataggggctgtgaggtcattactggatgtgcaagaggtgttcaaggcatcaaaacttga

SEQ ID NO: 110733 - DNA, 812 bp, Glycine max
  Peptide Sequence Number=SeqID_227511
gaccattttccaagactgcggtgaattacaacgcagggtgtaaaactgcgatggcaaacgtggtacaggcaataatagtggcactcgcactactatttttggcgccactatttggcttcacccctcttgttgccctttcagctattattatttctgccatgcttgggctcattcctttcgaagaagtcatccatctctacaaagttgacaagtttgactttgttatttgcatggttgccttccttggagttatcttagtaagcatggatattggcctcatgctgtctgttggactcggcattcttagagcacttatgtatgtggctagacctgcgtcatgcaagcttggaaagttacctgaaattggtttatatagagacacgaagcaatataaagtattaacatacccaggagttcttgttgtacaacttggttctcccgtttactttgcaaattctttatacgtcaaagaaaggattatgaggtacattcgaagtgaggaaagctctactggagatgtagttgagcacatcatacttgatttgtcaggagtgacagccattgatacaactgctattaaagcattggacgagttaattataatattgggaaagaatggaattaaggttttgttcgtaaacccaagactggaggtgatggagaagcttataatgtccaagtttgttgagaaaattgggaaggagtcgttttatctaatattggatgatgcagtgatggcaagtcaatattcacttcgttcatcaaggcggcaaataatggtcaagaggtggtttagaagaattcatggctaa

SEQ ID NO: 110734 - DNA, 297 bp, Glycine max
  Peptide Sequence Number=SeqID_227512
atgccaaaagtaaagacaaatcgtgttaaatacccagagggctgggaattaattgagcctacactccgtgaacttcaagcaaagatgagggaagctgagaatgatccgcatgatggcaaaagaaaatgtgagaccttatggcctatatttaagattgcacaccagaagagccgctacatatttgatctataccatcggaggaaggaaatttctaaagaactgtatgaattctgtttagatcaaggatatgctgaccgcaatctaattgcaaaatggaagaaggaggaaattcattaa

SEQ ID NO: 110735 - DNA, 181 bp, Glycine max
  Peptide Sequence Number=SeqID_227513
gctggggatagtggtggacttcttttcccatgctaccattaatggcttcatcggagggacagcagtagctctcatcctccaacaactaaagggcgtatttggaatgaaacatttttcaactaaatcgaacatggtcgaagtggtgaagagcattgtccgcaatagacacgagcttctttga

SEQ ID NO: 110736 - DNA, 174 bp, Glycine max
  Peptide Sequence Number=SeqID_227514
atgtgtttttttggttatcattacctcaactttgtcattgttgcatatgggaacggtaataggcatcgtccatgggttgggccttgtgccctcggaaataagcgggtcatggcgatctggatggcagagttaactttgttagaggaggcggagacagaggaaagagatgtttaa

SEQ ID NO: 110737 - DNA, 957 bp, Glycine max
  Peptide Sequence Number=SeqID_227515
ggcgcggcccatgaccgtgatgctgacggtggtgacgatggcgctggcggtacccggcggcatggtgctggcactgatgcggctgtcgtcgaaccgcgtggccaacggcgtcgcggtggcgatcgtcgagttcttccgcaacctgccgctgatcctggtgatctattgggcgttctacgtcatgccgatggcgctggacgtgcagttctcggcggtgaccacggcgctggtggcgctggtgctgaacgtgtcggcctacaactccgagaccttccgcgccggcatcaattcgatccgcaagggccagatggaggcggcgctggcgatgggcatgtcgcgccgccaggccatgttcaaggtgctggtgccgcaggcggcgcggcgcatcctgccggtgctggccagcacctggatctcgctgttcaaggacacctcgctggtgtcggtgatcgccgtcagcgagctggcctatgcctcgatgcaggtgcgcgcgcagagcttccgcgtgctggaaatgctgaccgcgatggcggtgatctattggctgatgggctatccgcaggccaagctggtcgactggatccaccgcaaatacggagtcaaggagtgaacgagatgatcctggaacaaacggccgacacggccggcgcggcggtggccgccgcagcaacgcctgccgcagcgacggctgccgcggcatcggccgccacccgcaagggcgccgaccagccgccggtgctggtgtacgagcacgtgcgcaaggtctttggcgacttcgtggcgttgaacgacgtttcgctgcaggtcaacaagggcgaggtgatgtgcctgatcggcccgtcaggctcgggcaagtccacgctcttgcgctgcaccaacgcattggagaagatcgacggcggccgcgtgctgctggacggcgtggcggtgccggaggccgagtccgaggtgcgcaag

SEQ ID NO: 110738 - DNA, 467 bp, Glycine max
  Peptide Sequence Number=SeqID_227516
atagcaaaaaggttgatacggataaccactcgggtatctccgcccgtcagcgtgtctcaaaactcaatatgacagatcttgtaagcgcggaagatgacgtttttcgtcttacagatagcaaaaagttttatacggataaccactcgggtatctccgcccgtcagcgtgactcaaaagtcagtatgacagatcttgtgagcgcggaagatgacgcttttcgtcttacagatagcaaaaaggtttatacggacaaccactcgggtatttccgcccgtcagcgtgactcaaaagtcagtatgacagatcttgtaagcgcggaagatgatgcttttcattttacagatagcaaaaaggtttataccgataaccactcgggtatttccgcccgtcagcgtgactcaaaagtcagtatgccatatcttgtgagcgcggaagatgacgcttttcgtcttacagatagcaaaaag

SEQ ID NO: 110739 - DNA, 297 bp, Glycine max
  Peptide Sequence Number=SeqID_227517
atgttgctaaatagcaacgttatccacgtaagagtggtcatgttggtgcccatgatccgtactcgtctttttgcagcggcacgggggaaatcttgccccggtttgcatagtagatgcgtgatagcctccctctctggatgtgctcgcacagctggtcgccctctaatatcagggggtggcccagggactgataaaaggaaactactggccctcgtaaccgggagcgcaagtcttggtgaagcatctaaggtcaaaggaccttatattctcttaaggtgtggatatggagcacactga

SEQ ID NO: 110740 - DNA, 365 bp, Glycine max
  Peptide Sequence Number=SeqID_227518
ttgatgatccaacagtaactttcagaggacccaggaaggtcagagggaagagatttgaggccccttccacatcagcatcagaggcaccaacaccttattcttctacacttcctccctcttcctccacagagatcccagtgattcctcctgcacccacacagataccacttccaactcctctctttgcagcctccacagcccaggagcctgtgactgaggagccaccagcaccagcagcagaggaggagatcactccagctcagaccccacagccatctccatcatctgcacctgctcctatggagattcagccatcaacactggatcttaatgaagaacagccacaggagaagcatgacgtttaa

SEQ ID NO: 110741 - DNA, 324 bp, Glycine max
  Peptide Sequence Number=SeqID_227519
atgcggctgcgccgccgcccactgctgctgctgttgctgaacctgaccctgctggttattattcagatccccgttggaactgggttgagccatgtcttcttactaataaaaaatacctggtccagggtgggtggtgctgcggagatgccaagaccaggcgacacaaagagagaaagagaaaaaaagagagaaggggcgcaaattggtagggttggtgtttttataatgaaggaaggcgacactgctaaaaaacacaacgcaatatgggttggatctggggttaaaagcgtaaaaaacccttaccccctccttcgccgtccgtga

SEQ ID NO: 110742 - DNA, 237 bp, Glycine max
  Peptide Sequence Number=SeqID_227520
atgaagcaaaacactaattttaaaggttttgtttgtttcgatgtggaaaccagatggaattccacctacttaatgttagatgctgcattgaagcaccgaaagacatttgaagagtttgaaatggaagatatgaaatatgatgatgagttacaaaatggggatttaccattgtcttcaaatgaaaataaattgtttgagatgcttgagcaatttgaacaagaaactataccttcatag

SEQ ID NO: 110743 - DNA, 243 bp, Glycine max
  Peptide Sequence Number=SeqID_227521
atggaggccatgaaataccaaatggccgccatgatggaggccatgttgagcatgaagaaaataatggaaagaaatgcgattgtgtccgggcttccagcaagtgcaccggatcgcacaaatagtataaaacgcctaatcctgatcaagcatcatccgaagattcctcttgtaagacttaactcaaccaggactgcattaagacacacatactcaactaacttatcgcaccccgattcctcgtga

SEQ ID NO: 110744 - DNA, 717 bp, Glycine max
  Peptide Sequence Number=SeqID_227522
atgattgtagggttaaagttagtgaacgaaattggagtaaataaaattaggagcaaaattgactccaagcttgtcactagacaagtgaatggagattttcaagccaaatatactcaaatgcagaagcactatcatctaacgatttgtttgctcaatagctttgacgagtacgagctcaagcacattttcaaagaaaacaatggtagagcatatgtgttatcaaagtcagcaagtttcaagaagttagggcaacatagaacattcatacaagagacactttttacaccaagcatagataaatctgatatatttgcaaagaaaggatatgaacagttccaatggcagctcggcatcaaacacttggtgtcttttgttgaacatccacaaacaaatgggcaaacagaagtggcaaataaggtcatcctgacaaagatgaataaaagaggttgcaaaacaaaaggtctttggactgagttgcctagcatactatgggcataccattggactccgcaatcaacaacaaaagaaactcctttcaaactgacttatggtacttatgccatgattccagtggaggttgatgaaccctcaacaacaagagctcaatttgaagaaacacttaataatgaaaatctacccttggaacatgatatgattgatgaggtgagaaatcacgctcagattcaagaagaagcttgcaaaaggagagcaacttga

SEQ ID NO: 110745 - DNA, 903 bp, Glycine max
  Peptide Sequence Number=SeqID_227523
atgcgaatatcttgtacaatagagacattcctgaacaacagagacaacagcatgaaatccactcaccttgccctgctttccacgcttttcactccggctgtttttgccgcaccgttgagcattgatacctataaccctcaggagaaaggcattttcgcggtctcctccacgctggtttccggcccgaaagaagcggtgctgtttgacgcgcagttcagcgtgaaggatggcgaagcgctggttgagaaaattcgtcaaagcggtaaaaccctgaacaagattgtgatcacctccggcgatccggatttctattttggcctgcagccgctggtcaaagccttcccgaacgccaaagtggtggccacacagcatgtggttgaccatattaaggccaccaaagacgccaagctggctttctggggcccgcagatgaaagacggtgcgccaacggaactggttgttccgcaggtactcgcctccaccacgtttatggttgacggagaaaagatcgacatcgagcagcctgacagctacgcggcctatgtgtggatcccgtcagcgaaaaccatcctcggcggcaccggggtagcgtggggtattcacgtctggacggcagacacgcagaccgcggaaagccgtaagcagtggcaggacaccctgcaggcgatggctgcgcataagccagaacgcgtgatcccgggccactatctgggtaacccacccgcgggcagtggcgcgattgattttacgcgtaactatctgcagcgctttgaaaaggctttagctgcgcataaagattccgctggcgttatccgtaccctgaaaaaacagtatccgaatcttgcggaagagagctcgctggaattaagcgctaaggtcaataccggcgaaatgaagtggtaa

SEQ ID NO: 110746 - DNA, 216 bp, Glycine max
  Peptide Sequence Number=SeqID_227524
atgcagcatttaggcggtggttttggatctggttttattcccattgcagattatggaagtgagtttagaaagggttctagccgaaaagctgtgaggctattgtacagcgagatagagagaccacgagaggtatcatggctaaagggcatagacccgaccatagaagtgatagactcaaacagaggccttagtaagggtaaagatagagttagatga

SEQ ID NO: 110747 - DNA, 441 bp, Glycine max
  Peptide Sequence Number=SeqID_227525
atggcagcaacgctccctcttctagccatcaagcaagaccgttgtgcactagtttccattgttgatgcatggcaaatggaagccactgttgacgcaatccgccatcgaaaacaaagagagagaaaccatattcagatcgggatatggaaaacatttgggtctaactatgtgctccatctcggtggtgaagtcaaacgtggcatcgaatttgtgtgggttgtgcggcggacaagagagcagggattggaggatctcgacgttgatgatgttgtgaaggcagaggcagcggaaagtcacgacctcgtggtcggtgccagcagaggcgcatatgacaaagagtggttagaggtgcgaaggaagaagaggtcacacaagaggtgggaaaaagtgaggttcataggcgtgtggactagaggtgctctccacctgatctttttttaa

SEQ ID NO: 110748 - DNA, 705 bp, Glycine max
  Peptide Sequence Number=SeqID_227526
atggctcaagttggagaaactcttcacgacaaaatcaatctacaacgagttgcttctgaaatgacatttgtttggcctccacacaagagaagagctttaaatgaaaacatctggaatggtaatgaagtctctgcgttcgaattatcggtggctgattctgttaaaggacagaagaagaagaaaggaaaaggtagcaagaagagcaaggttgatcccaaatgctggttcctaacatatgaaatgtctggcggtaatgttctaatgggtaaaaatactccttgcaagttaaaaaatctagtctttatgggtgccatggattcaaaaggtttttcttgttgggttgaaggtggaattatgaaaatcaaatggaaagggaagtctgagatccagaaacaaagccaaaaggaagggcaaaatggtcttttctcaaatatttctgatttcaaattcgccagttcgtttgggctaaaatgtaactttagccctaagcaagcaacttgcctgggcgagtggatgccttcaacaccatgcatgttgaaggagaaaatcatcccagctgaaccaaaaaccatagaaaaatgcagaaaaagagtgaagaagaaggagaaaaggaaaagtggagtcaaggcactgcagagttgtgaccgtggatcacttccttcgtcatttctcttgttagtcttgtgctttgcacaaatcggttag

SEQ ID NO: 110749 - DNA, 657 bp, Glycine max
  Peptide Sequence Number=SeqID_227527
atgaggtttattgagttaaataaggctacaatcttggaatgggaaatcacatggagtctcaagcctctacgaactccatcactggtcatttttgggagcagatctagaagattcgataatgagaggatagagcatgccctcatttccttccctgaggtaaagcccctttggtttgcctcgttagtagattatcatcccaaagatgatgaaatgcttaacttacttgcttggatcagccaagtcttttattttaaggatgatgagcttgcggcaaaaacaattgagttactatgggtaatttggaagacaagaaatgatacagtgttctctaacaaaacaactatagtggaaagagctctggccataactaattttttgagttgctacaaggaacctcagggtatgaacattatgcaacctactcaaatttcacaacccacatggaagccacttgattttggacccataaaggttaattttgacgcatttgtcaagaaaagtataagcactggtgttggacttatctgcagagacaacatgggggagattctggccgcaacaacaatgttttggcccaatttctttgagccatccattgcaagaactatggcctttaagtggagtattcaaatcgctgctcattcagcattaccatag

SEQ ID NO: 110750 - DNA, 1195 bp, Glycine max
  Peptide Sequence Number=SeqID_227528
atggtttgagattgcgaattcgacgacgatgatggaaggagcgagcaatggagggatgctgtaccacgaggtgcaggagtcgaagctctgcgcggtgcattgcgtgaacacggtgctgcagggcccgttcttctcggagttcgatttggccgcgcttgcctccgatctcgaccgcaaggagcgtcaggtcatgctcccagcgctcgcgtcggcggatttcgagtcgcacaatgtctcgctcgacggggatttcagcatccagggatgcctggagcttggtttatgcactgcttgtttgacattggataggatggccttgtgctgtgtgggctgtgggtatgcaaatagtggcttcaatgggagaaaggggatgggaaagaggtgtggggtgcaatatggggatctgaatcttctcactctacttgctctggaagtttgggacctacaagttatccctcttgactctccagttgctgagcctgcccagattgaccctgagctggaaaatgccttcatttgtcatttacaagaccattggttttgtatccgcaaagtgaatggggagtggtataattttgacagtctctatgcagccccacagcacctttccaagttttacctctctgcctatcttgactctttgaaaggctttgggtggagcatattcctggttagaggaaattttccaaaagagttccccatctcctcatctgaagcttctaatggatttgggcagtggctttcacccgaagatgctgagaggataactaaatcttgcaactcagtacaggctccacacccgagagttaacgagcaccaacagcattacgatcagtttctttctcatggggaaaatgaaatgctattagacatggaagatgaggatctaagggctgcaattgcagctagtctgatggattcgtccccagctgtgaccaatgctgaagccagtactcctcaaaatgataatcatagtagtaaacaagtggcaaccactgaagctacccctctaaatgatcaacactccaaacaagtggaacccattgaagccactccacctgtcaatgctctaagcaacaaacatgtgcctgctattgaagcttgttctctgaatgatcaaaacagcaaagaagtggcatctactataggtgataatgctcaagatgaaaaccagaataaagaaaaaacagcctaa

SEQ ID NO: 110751 - DNA, 216 bp, Glycine max
  Peptide Sequence Number=SeqID_227529
atgaatgcaaagagaagagaagatatggttggtgtgcttccagagagaagaatactgatgcggcatgggaagtcacaggggaatcgggacacagcagcgtacatcatcacatccgaccacaacattcaagcaacgacacaaggcatggctcaggccctccgcacctgcgaacacctccaccatgtgatgggtagcgacgactgctctcctgactga

SEQ ID NO: 110752 - DNA, 255 bp, Glycine max
  Peptide Sequence Number=SeqID_227530
atgaagaataagaagggtgttgtggctggtgtctcgctaagcgaggtacttagcccgcttagcgagttgggagaatctggaggagaatctgccaagcatctgcacgctcagcgtgtcatcaactcgctcagcaagtcgtttgtcttttctcatgctaagcgcacccagctcgctcagtggaaaatcgcttacttcgacgtaacagggcaagggagcaccaaaaacctcagctttcaagaggattctaggttttag

SEQ ID NO: 110753 - DNA, 876 bp, Glycine max
  Peptide Sequence Number=SeqID_227531
atggtcattgaccaatccctcttctatgatttgacccaattgtctagtgacgatgtaccatttgaaggtgcactggacgatgattggaagtttgatttttctgtgcatgatgcccaccggttggtttgcaccaaccaatcggatatgaccgaaaggatacttgccggttcattggctcttgaaagccgcatccttcactatcttattgttcgtatcttactcccaagatcttcaaaccttgcacaggtttctgaagaagatcttatagtcatgtgggcctttcatatcggccgacaaattgattgggcacatttagtccggtatcgcatgcataaggcactgcgattaaatgctcctttaccatatccacatttagtcactcttttccttcaacattttaacatccctattgattctgaaccttatgttccaatcaagagatctttcttgatcggtgttgctgtggttgcgtcctttggttaccgcaaagagcatgatggctcttgggtaaaaaagggtgttcaaccaaatgatgatgaaggacaattactggttgaaggggactcttctctccttcaaagtattttggacaggtttgatggactccaaacctatgttggtgaaaggtttgttgctttggaacaacaagtggacatgcgatttgatgcaatggactcaaggatcacaaaggttgaagaagatgtcaccatcattcgcgactgccttgatttacctctaccaccaccagattgtcatcatcaaaaaggaggagattgtggaaacaaagccttccaaggttattttgatgatgccaaagaatcaagagttaagcaaattccaaagattcaagattcaagaatcaagattcaagaataa

SEQ ID NO: 110754 - DNA, 135 bp, Glycine max
  Peptide Sequence Number=SeqID_227532
atgacaaccgctatgctaagcgcactgatctcacgcttagtgcgcgaccttgatattgatgctctgtcagattcttctgtcacgctgaagctgcacgtagcgatggatgcgcacttagcccaactaatgagttga

SEQ ID NO: 110755 - DNA, 243 bp, Glycine max
  Peptide Sequence Number=SeqID_227533
atggatatgctagtgaaggtggataaatttttggaaggtgtggaagatatgctagggaaggtggataaatttacattcccagctaactttgtaatcatggatatggaagaggatggggaattaaaatccaaatggtctataccttttgatatcaagaaggtgaagccatatagtgcaatcattgtggaagacccctcaacggacaaaagccagattgtcaatggtcaaagacttaagccataa

SEQ ID NO: 110756 - DNA, 477 bp, Glycine max
  Peptide Sequence Number=SeqID_227534
atggaggtctataagaccgagcaaagacctcttcaggatgaacagaaacaggtatggtggaggcattttgggaggcaatttaaatccaagattggggtaacaggcataccccagcagaggccggctaggtctcggtcgccggatgaggctcagggccttggtttcgccacctctgctgtccgtagcgtctaccaattccgccacactccctcttcactagagaatataccacaagatgcacccctttgccagttgtcttttcacttgttatgtgctatccttacaggcaaggctagcattagcaaagtgctactcgtattcgtgagagttgggaaaagagttagcattgtgtttgttgggtcgatgcccgagcggtttatgggggcggattgtaaatccgctgacgaaagtcaacgctggttcaaatccagctcggcccaaagcagatgtgcctcccacaccttccgtgcccagtag

SEQ ID NO: 110757 - DNA, 395 bp, Glycine max
  Peptide Sequence Number=SeqID_227535
gtgacatgcggggttaccttatggttatccacaactttggtcaaccaggggcaaacgagcctgttgacgagcggggactaacatcgtcttctgcaccttttgtcgtcctgccccgtaaagtgacatgcggggttaccttatggttacccgcacctttcgtcaacccgggacaaacgagccggttgacgcgcagagagggcaaacgagcccgttggcgcgcggagactagcatcatcttctatactgtcgcaacctacccttcggcgggagggcgacgcgtgactcgcgggatgcgtgttccacgaaaggaatacgcgcggagtcgctaccaacgtttatttgaggaaaacgtcggaaaaaccggaaaaggcgcgatctacgaacttttaagttga

SEQ ID NO: 110758 - DNA, 297 bp, Glycine max
  Peptide Sequence Number=SeqID_227536
atggggcacgaatctttcaaaagaatacgcccaaatgtggagagacctggcagctcaagtggcacctcaatgatggagaaaaaaatgatgacaatgatagtagacacattaccagtattctactatgaaaagatggtgggccactcaccttcaagctttgatgatatggtcgtcaccaacgaaaggatcaaagtgggtctaaaaagaggcaaatctgatcatcatgctttgataaatgccaaaaaaaaactagggcaaatgaagagggtgagaatgagggagaagcccatgctgtga

SEQ ID NO: 110759 - DNA, 375 bp, Glycine max
  Peptide Sequence Number=SeqID_227537
atgggtgtgttcataattacaaacacgcctcccaagccttttggaaaaccgtccgaggtgaagcctaaaggagagagtataaatatcagcaggaaatgggaacgttacctccccatccacttcaaaccaccatatttgctgcaaaaatgccacagtgtgaaacctgaaaatcatctaagattaaggccagtatatagaacaaatcaagcttatcgataccgtcgacctcgagggggggcccggtaccagcttttgttccctttagtgagggttaatttcgagcttggcgtaatcatggtcatagctgtttcctgtgtgaaattgttatccgctcacaattccacacaacatacgagccggaagcataaagtgtaa

SEQ ID NO: 110760 - DNA, 228 bp, Glycine max
  Peptide Sequence Number=SeqID_227538
gttgaatgtccaaaatatcctgggttttgtataactcggcagaaaaaggagtatccattcattgagatatttcatagtccaacacaagcagctaaccagggaagggtagctgatccaaatattactaaatacaacgtgaaggtcttgcctttcaactacgatgttagtgcttacggttttagagaattcttcaagcaacatggtatacgggcatcagatccaaagtag

SEQ ID NO: 110761 - DNA, 360 bp, Glycine max
  Peptide Sequence Number=SeqID_227539
atggatgtagaaacaacagattgctttgcactcttccacgatattgctcctctatctaaaagaaatgcacaatcaagggtggatttccttgtatccacgcatctaacaaagtctgagtctgaatacccaatcacctcaagtgctaaaaggagcagtcatgctcaacggaccctatgggctcagtgcagatcctgggctaagcgtagcttcagtgtgcttagcgtgacaagggaatctggaagagctcaagaatcaaggccgcacgctaagcacgagatcagctcgctaagtgagacgtttgtctcttgccaggctcaacgtacgactaacgctaagcccaaatccacttactcgtgctaa

SEQ ID NO: 110762 - DNA, 336 bp, Glycine max
  Peptide Sequence Number=SeqID_227540
atggtggtggtggtggtgataatgacaatgaaggtgacattgatgatggtggtgatgatagcaatgttgatggtgatggtgatgtcggtggtgacgatggtggcaatgacagtagaggtggtggtagtggtgttggtggtggcaccaagtggtggtggtgataacaatgaggatgatggtcatggtgggggcgatggcgatggcgatgactgtagtgacaacaaaaagtatcatatgtcaaacatgggaaatgaaacttatatgacaatatttatgatcaacaaacaaattcagtcattctcaggattaataattctcaagaatgataactcctag

SEQ ID NO: 110763 - DNA, 141 bp, Glycine max
  Peptide Sequence Number=SeqID_227541
atggctgttaaggaaggtgatactgttcttttgcctgaatatgggggaactgaggtgaagcttgataacaaagattttgcctacatgatgcctagaagattcatttcttgttacaaagttgatcccttcaggtctaagtga

SEQ ID NO: 110764 - DNA, 183 bp, Glycine max
  Peptide Sequence Number=SeqID_227542
atgaagagtgagggatcactctttcttgtgaagaacccatatgacgtgatgaaggcttacaattattcatgccatgttcacggtgcttggcaaagctcacttaatttgacacggtgccttggagaaatggattgttggcgtccaattgatgcatctgccaataatgacccaatgctaaggtga

SEQ ID NO: 110765 - DNA, 153 bp, Glycine max
  Peptide Sequence Number=SeqID_227543
gattcgtccgaatctgaatctatggacacatcttgggcgtcgaggaagccatcaacggagatgttgccattgggtttgcatcatagagaaggccatgtgagatgtgtcatcttaaacagtggcagtagcgtggccatgctttcaggctcatga

SEQ ID NO: 110766 - DNA, 219 bp, Glycine max
  Peptide Sequence Number=SeqID_227544
atgtcttgggttgctatttgtgctccaaaaagtaagggaggcttgggattgaggaagatgatggaagctaatcttgcctttatgatcagggctatttggcagttatcctcttatgagatgtccttatgttcaagaaatatactggaaggacttcttgaactactagagaataaagaatgtgctcactggaaagctaagtatgtatctggctggatctaa

SEQ ID NO: 110767 - DNA, 132 bp, Glycine max
  Peptide Sequence Number=SeqID_227545
atgaaaatcgaagacccaaaaggaggaattcaaaagggtatgaatgaattggattgggagagtaaaccttggaggatttcccaggccctcagacctgtgggaatgcttatttcatgtggacaagaaagctga

SEQ ID NO: 110768 - DNA, 603 bp, Glycine max
  Peptide Sequence Number=SeqID_227546
atgactatgcatgctgatgccaagaccgatgaagtgtactcgcaaatgaccttgcaacctctgaatcttgttttaactaagaccgtgtttgtggtaagaccaaaaggaggcatactagccagcagagctggtcaccccaatggcgcaagcactcatgggggattctctgtgcctcgtagggcagttgaaaaagtgtttcctccattggatttctctcaacaacctcctgctcaagaattaattgcaagggatatgcatggtaatgagtggaaattcaggcatatcttccggggccagcccaaaaggcatctacttacaaccggatggagtgtctttgtggctgctaaaagactagttgttgaaaggattttaaaaattaaaacatggctttggcttggattgcaagttggctgggatgaatccacaactggagataggcaacctagagtgtctctatgggaaattgagccattaactacatttcctatgtacccatctcgattcccccttaggcttcaatggccatggcctctaggactgccttcgttccatggtgagcgtcttgtcacctatagggggaatttttattatttggaaacttga

SEQ ID NO: 110769 - DNA, 234 bp, Glycine max
  Peptide Sequence Number=SeqID_227547
atgtatttcataacgagagttcagttgggcatgggggacttcttagacgaaatgttaacaatgatgagtcagaccaaatcaaatgaaaatggagaggagagctttgaggagttgcaacagctttttgaagacatgtttcaagcatatattggattggatggaggcccttctcttgcttcttctgattcctcaacttcatcttcttacatgacttatagtgaaagttctagttaa

SEQ ID NO: 110770 - DNA, 444 bp, Glycine max
  Peptide Sequence Number=SeqID_227548
atggcacatcacggagcctatgagtgtggctattatgtcatgcattggatgtggaacataatcgtcgggcagttgaagactaattggacgctgtggttcaatgatggcacgtcgctagacatcaacatcatggcaacattacgaaaaaaatgggcagaatattttgtaaaacttagaagcatccaattgaatgaaactgctaagaattttggtgacgaaaagaaaaacccttcagatgaggatgatgttgctgcaaatggaaacaaggaaaatcctactaatgaagctgaacaaaaagagcctgagaataaggagatgactctcaaggaatatgaaaaagtactagaagagagaaggaaggctttccacacacttaagactgaggagaaaaagggaggtgataaggacaagcgtagagagacacttgacaaggaagataaataa

SEQ ID NO: 110771 - DNA, 3378 bp, Glycine max
  Peptide Sequence Number=SeqID_227549
atggagcccacaacacatcatgcttgcgcaacgactcaacaaatgccaaccaagtggatcatggattttggtgcaacccaccatctcacgaatgacctagacaatatgcacttagcaaattcataccatgggcaagatcagctcatcgttggtgacgatacaacccttcccataacatacactgcacttaaacacaagggtaaacacgggttagagaaaaggttgttcataatgcagaacaacggatccggaatcgccacttcacaattacctatctttaaaggcataaattatcagttttggagcttgaaaatgaaaacattattcaagtctcaagaactgtggggttttgttgaagatggatttgaagatgctcaacctctagaacctgatcagcaattgagagagaagagaaagaaagattccaaggcattgtttatgatacaacaggccttggatgatgaaatctttcccagaattgcctcagcaaccacatccaagatggcgtgggatactctaaagaaagagtatctagttctaatgacggacaaagaatctgtccaagaatacttgtcacgtgtatccaccgtggtacaacaaatgcggtcatatggagaaacaatgaccaatgagcatgtggttggaaaagttctaagaagtctcacaagcaaatatgatcatgttgtagcgactattaaagagtcaaaggacatggcagattacacctttgatgaactcatgggatccttgcaagctcatgtggagagggtcaatagaaatggtgagaagaaggaagagaaggcattccatgtgaaaggagaatcctcaaacaaggaaaagacatggcaattaagtggaagaggccataaagaagctagctgctggaagaagcaggaggatgaacaaaagggtgatcaaaagtccaattttgtagagaatgagcaaaagttgttcttagcacaaagtgcagctgacaatgatgtaggaggtggcgtgtggtatgttaacagtgggtgctccaaccatatgtcaagtgccaagtctatgttcaaagaactaaatgaatctttaaagagcaaggtgaggcttggagaagcaaagcaacttgaagtggaaggaagagccacaattgcgatcaaaactgagcaaggaaacgctaagctcttatatgataaatccaaagcagttgttgtaaagattgttatgggaagaaacaaaatgttccctcttgatttatctggcagtgtgagcaaagcactgacagttaaaggagatgatgatgccaagctgttgcatctgaggtatggtcatttgaatatgcagggactgaagcttctgagttccaaagacatggtgcaaagattgcctaaaattggtgaccttgagttgtatgaaggatgcttatatcgaaagcagtcaaaaggatcatttcctagtggcagagcttgtagagcaagtgaaagtttagagctgctgcatactgatctctgtggaccaatgcagacagtttctcttggtggaagtaagtatttcttgctcataactaatgactacagtagaatgagttgggtctactttctaaaggctaagtctgaagcctttgaaaactttaagatttttaaggctatggttgagaaacaatttggtttatgtgtgaaagccttaagaacagatcgtggtggtgaatttttgtcaaatgaattcatcacattttgtgaggagcaaggaataagaagagaattgactgcaccatatactccagagcaaaatggagtagctgagagaaagaacaagactgttgtagagatgacaagaaccatgctcaaagctagaggtgtaccaaacaacttctggtgtgaagctgtagctactgtagtgtacatcctcaatgtctctcctacaaaggcagtcatgaacatgacaccatttgaagcatggagaggaaaaaaaccatctgtaagtcatttaagagttttcggttgtacaacttatgctttggtggatttgagatctaaactagatgataaatctgtgaaatgtgtattcattggctatgctgctcaatccaaggcatatagactgtataaccctcttattggcaagattatggtcagtagaaacgttgtgtttgatgagaatgcaggctggaattgggagcaaagagaaagttgtgacaatattcaacaaaaaatagttgggactgatagttcaggggaggactcaattgtgccaacaaatgatcagcagtctccaagtcgtcctacatcaccattatcttcaaatcacagctcatcatcttcttcaagtccttcattatcaagttcatcgaatgattctgcaccaagaagatacatgactcttgctgacttgtatgcaaactatgactttgcactgatggcagcaaatccaaccagttttgatgaagctaaagatgaaaatgagacttggaaattggttgatcttcccgaagagaagaatgttattggacttaagtgggtattcaaaactaagttcaatacaaatgggagtattcagaagcacaaagccatgttggtggcaaaagggtatgcacaaaaagaaggaatcgattttgaggagacattctcaccagtggcaagatttgaaactgcgagagtggtattagctttggccgctcaatggaaatttgatgtgtttcagctggatgtaaaatccgcatttctcaatggagacttacaagaaaaagtttttgttgagcaacctcttggctttgtcaaagatggtgaagaaggaaagagaagtgagaatgaaccaactctctatgtgaaaaaggaaggcttgaatggattcattgttgtctgtctttatgtcgacgacatcatctactttaactcctctcagaagctgctaaatgagttcaaagcatcaatgatggagcaatttgagatgacaaacttgggactgcttcaatatttcttgggtctagaagtaaaaactcctatgaatcctaatgagaagctgcagaagaaggatggcacaggaaaagctgatgaaaagctgttcaaaagtcatgtaggaggtctgaattatctcactcacacacgtcctgacattgctcatagtgtaagtgtggtatccagatacatgcgctctccaacaaagcaacaactaggtgcagcaaaaaggattttgaagtatgttgcaggatcaactcgttttggaatcttgtatgaacatgtcagtgaattcaagttagttggctacacagacagtgactgggcaggcagtttggatgacaagaaaagtacatcagggtcagtttttagttttggcttaggagctatcacttggagctcaaagaagcaggatactatggctctgtcatcatctgaagcataa

SEQ ID NO: 110772 - DNA, 258 bp, Glycine max
  Peptide Sequence Number=SeqID_227550
atggagatgctcatccatggagtgagtgcccttcgagtagcgagtgagtcacttgttgagattcatgattctagcatgtgtcttgttggcatgccttttgctaagggtgtcccatgcttgcttggatgtctgaacgttgtcgagcatgttgatcctggtgtttccagtacgtgtaatcagagtgagagggttaggcacgagttggtgccatcaacaaagccgattaagtcataccacacgaggagggcattgatttga

SEQ ID NO: 110773 - DNA, 468 bp, Glycine max
  Peptide Sequence Number=SeqID_227551
atggagtacgtcgatgtcacacgagttggtgctgagacgctcttcgagaagcctctcggcttcctcctcagtgaagacggcgtcagactcggcaacggggggagtgaacggggcaacgatgatgggggggggtgtttcttgggtgcgaaacacggggtcgttacggcaaaggggaagaaggaaagtgaggtggcgataaagagcgaaaggagaaggaagtggataagggagtgggaaatgggtaaggccctagaagactggttgtcaatgaggataagtggatgttttgaagcattgaaagctgttttcggcttatggatattgttatttgacaaagtgatcatggtgtgcaagttttgtgatgtagtattctcaagtggaaggttcatggtggttgcatggtcattttgtggtgtggttgtgggtggtggtggtaatttaaggattgagatattggtgacaggttga

SEQ ID NO: 110774 - DNA, 921 bp, Glycine max
  Peptide Sequence Number=SeqID_227552
atggtggtcacggtggattttgactgctgtgacatgatgaaaggcatgcatatgatgcattccttgctgtttgttctttttctcaaggtgtgtactattcctttggacactgccaaagttaggcttcagcttcaaaagcaagctgcaactggtgatgtagtctccttacctaaatataagggtatgctgggaacagttgcaaccattgccagggaagaaggtctttcagcactctggaagggcattgtgccagggttacatcgtcaatgtttgtatggaggcttaagaattgggttatatgaccctgttaagactttctatgtggggaaagaccatgttggagatgttccattgtcaaagaaaattcttgctgcatttacaactggtgcttttgcaattgcagtggcaaatccaactgatcttgtcaaagttagacttcaagcagaaggaaaattacctcctggtgttcccaggcggtactctggatctttaaatgcttattcaacaattgtgagacaggaaggagttggggctctttggactgggcttggccccaatatagcaagaaatggtatcatcaatgctgctgaattagccagctatgatcaagtgaaacagactattttgaaaattcccggattcactgacaatgttgtaactcatctccttgctggtcttggggcagggttttttgcggtctgtattggctccccagttgatgtggttaagtcaagaatgatgggagattctagttacaggaacacccttgattgttttatcaaaacattgaagaatgatggacccttagccttttataaagggttcctcccaaattttggacggctgggatcttggaatgtgatcatgtttctaaccttagaacagactaaaaggttcgtcaaaagtttagagttgtcctga

SEQ ID NO: 110775 - DNA, 1086 bp, Glycine max
  Peptide Sequence Number=SeqID_227553
atggtggtggagagtatacctttagggagtttgaagatttctgttagaaatgtggcattcaacatgaatataactattgcagcttacttgctcaacaattgtcctaccaagagactaaaggagaaagatagagctagcaatagtcaaaatccaactgtttcaattcaattacaagacgttcacttggaatatgagcagaacataagggaatcaagtgatgagattgaagcaacaactaataagaaatccacgcttgaagaattagaagcaattgagaggaatcacacctgggaattgactaagctacatcttcacaagaaagccatagatcaaaagccaggggtggactatactaaagaatttgctccagtaaggttggagatagtgagattggtgatagctttggctagtagaaatggttgggccctattccacatggatgtgaaatcaacatttctaaatggattcttggatcagatggtttatgtcactcaacctccagattttgagatcaaagggaaggaaaggatggtctacaagttgaataaggccttgtatggtcttaaacaagcacctaaagcttggaataaaaggattgattcatttcttattcagaatgaattcaccaagtgcacaatggaatatggtgtatatgtgaaaaggaaaactgagggaatacttctgatttgcctatatgttgatgatttgcttgtgagtggcagcaatagtgaagaaatagagaaattcaaaactaagatgatgactgagtttgagaattcagacttaggaaaactgaaatatgtagttgatgtattgaagagattcaacatgattgagtgcaatcaagctaccacaccaatagaagtgaatttgaagctagatgttgcaagtgataatgatgaagaggttgatccaaccttgtttaagcaattaattggttgtctaaggtacttatgcaatagtagaccagacattgcattctctgttagacaagaaaaacactttaagttacatattcaagttcttagaggcaccaatttcatggtgttctatgaagcaaccagtggtggcactctcaaaatgtga

SEQ ID NO: 110776 - DNA, 267 bp, Glycine max
  Peptide Sequence Number=SeqID_227554
atgttcatggttaaagcaataccatcaaggtcaatcaacacattgttagagagcatattttcagacacaaagcaaaggtgttgcttagagagcacattttcaggtactaacctggggaggaagtcgcgagggaacaagccacaaaaccaaataaggcttcaagtcgcgaggtatggagaagacgaaacgatgatgacgtcgcagcagaacacaggtggggcaatgacgggatcgcagaagtacactggggagcaccttcgtgagtga

SEQ ID NO: 110777 - DNA, 573 bp, Glycine max
  Peptide Sequence Number=SeqID_227555
atgaaatctaagaaggagaaggggtctgcaaagggtggctcttcaaacaagggcaaacaaacaacacgttctccctcaccaccaccctctacaaaggctactccttggtttttagaggagcactacgaggtttcctacaagtacaactatgtaaaggagtttattaaaccaatgtttttgaacttggaatggttgaagactcaatggttaatctttcctaaacttcttgagtaccatggtttgaataagctagtggagatgaagggtactttctacttggagttggtaaaagttttctacactactacccatattgatggtgagactggatatttgtatgctaaagtgaaagggaagacgattgtaacaacccctgaggtttgggaagacattgttggttggtctttagaagggatgctagtcaacgacaaaggcaagggcaaggaaagatttggcacaagccccttgttgctggaacacaaacttttggggaagatgaagcttaattgggtcagtgttgtggtggataatatgatgaataccaagaggattggatccttcaagtgtccttag

SEQ ID NO: 110778 - DNA, 261 bp, Glycine max
  Peptide Sequence Number=SeqID_227556
atgaatgatgagaatgagagaagagtcactgttggaccttttacgcctattctgaacatagatccatctctagaacttgtgtcggtgttaccccacaagttaactcaggtgtctcattcactagataggtattcctcttctaggtatgatccctcacatacttctcttattgatactctatctagcatatttgttcttacatgttattcacaagcaattaatgatgcatgttgggtgaaagcaatgcaagatgagccatag

SEQ ID NO: 110779 - DNA, 210 bp, Glycine max
  Peptide Sequence Number=SeqID_227557
atggctcgaaactctacttcaatagagtttgacaacaaattatcacctgacgatagtgtggatgagtatgtcagaatcggcgaaagcactacaattaaatgctcaacaacttttgtgaagggtgtgaacaagatatttagagatgagtatctaagaaggcctaacaacaacaacattaatcgcctactacaaattggagaggcaacatag

SEQ ID NO: 110780 - DNA, 765 bp, Glycine max
  Peptide Sequence Number=SeqID_227558
atggcatacaggaagaggaaaagcactgcttctaaacctcaagctcattatgataccaggcgattccattctttggacgcttggaatagatacaccgataacattctcggccggaatatccttccggagagaaatgtgcaaatttatcatactgagtttgacgagtttaaagtggaattggagaggcgtaatctacacaaacgcctcgccaatctccaagatggaagtatagatgtagctatggtgaaggagttttatgctaatttatacagcacagaggaggaagcacccaagcaagccagagtacgaggacacttgatcaaaatagatgcagacagcctgaatgagttccttcagacgccagtggtattggaagagggggaatctttacccatttactctagattttgcaggttgaggactaatcctcaagagattgaagctaggctttgtattccccacaaggggttagttttgaatgctaagggccagccatggaagcttcttagaaaagatctgacgacactggcccagacatggagtgtcttctcttactccaacctagctcccacatcccacacctcaaatctaaatatggatagagctaggttggtctatggcttggtgactaacatggatatgaacatcggagcccttatctcaggtcagatttcttctattgctcagagtaactcttctaggctcagatttccagccttgatcactaccctatgcagagctagaggagttacctctgacatctaa

SEQ ID NO: 110781 - DNA, 339 bp, Glycine max
  Peptide Sequence Number=SeqID_227559
atgggagaaataaaggaggtgcaagagcggatgaaggctgatatggaggccatgaaagagcaaatggccacaatgatggaggtcatgatgagcatcaagaagataatggaagtcaatgcggctgcaattgccacaaccagcaccgttgctgaggtcagggaggccaagaattgggaagtacaggcatcctccattttgtgcaaattcaaaacaagcacgccttctagccatatggcttgcctcccaactatataccacccaacgtggtgcacgctccctatgagaatgtcaataacttcgcacccatactcattgagagccaacaatgtaacaccctga

SEQ ID NO: 110782 - DNA, 162 bp, Glycine max
  Peptide Sequence Number=SeqID_227560
atgaaagtggaggcgaatgaggcttgcaccaattcgggaatcagattgcagagcctgctgaacagcattgctcacgatagaagacacattggggcatgtgctagaatagaagatgaagttgccattggttattatttagaagtgccaactagacttaattag

SEQ ID NO: 110783 - DNA, 422 bp, Glycine max
  Peptide Sequence Number=SeqID_227561
gaacgctttaaatgagattgctgctgaggttgagcatctatgttatctcggcaacaatcctttttcttgtggttgtgtgatgagaagcacacacggtcttcctcgtggatggttatgtgaggccgaagtgagcatcaaggaagaggttgagaccatatctaaaagatttgaggaacttgatgtcaacactaaaggtgcaccaaagaaatcgatgaaaagaaggcaaatatccacaaagcatgatctgtcttactgggagtatgttgatgcttttcattctgttcaaagcagcaactcttcagtgaaacatagtgcatcatcttctaaaccgccgaagccaacaaggatcatcccgatgttggatcaatttgcaccatttatacagggtttcattcacaacgttgtggatgtgaaagcggacg

SEQ ID NO: 110784 - DNA, 1623 bp, Glycine max
  Peptide Sequence Number=SeqID_227562
atgatgaaactgttgtttattctggatccactagacgccctggtcacttataaagataccagccttgcgatgatgcgcgctgcgcaggcgcgtggccatgagctctgggtatgtgagcaacacgactggcagttacagcacgatgttgtcactgtggatgcacagacttttgcattcaatatcgatggcagctggaaaaccagtgataaatccaccgtctccccggccgattttgacgcggtgcttatgcgtaaagacccgccattcgataatgaatacttgtacagcacttacctgcttgaactggcgcaacaacagggtgcacggattatcaatgatccggcctctatccgcggctggaacgaaaaactgtctgtcgcgcgttttccacaatttgcgccaccgtttatcgtcactagccaacaagacaaaatactagccttcctgagcgagcatggcgatattatcgtcaaacccctggacggcatgggtggcagtggcattttccggttacgtaaagatgatcctaatatttacgccatcctggaaacactcacgcagtttcaaacgcaaaccatcatgatccagcgctatatccctgacattgttaaaggtgacaagcgtatcctggtcatcaacggtgagcctttgccatatgcactggcgcgtatccctaaaacaggcgaaactcgtggcaatctggccgcaggtggcaaaggtttggctcaaccattgagcccacgtgataaggaaattgctgagaccgtgggtaaaatactcaagcagcacggcctgtttttagtcgggctggatgtgattggcgactacctgactgaagtcaatgtgaccagcccgaccgggatggtggaaattgcagcgcaatcgaaagactggacgccaagctgcgacccggccatgatgatgattgaggcactagagcaactcgagtatgtcatgcgcgtgttggtgctgggttctggtgtgataggagtcacgagtgcttattacctggcattaaaaggctttgatgtcaccgtcattgaccgccagcctgctgtcggcctcgaaaccagttttgccaatgctggccagatctcgccgggctactcagcgccatgggctgggcctgatgtgccgttcaaggccctcaaatggttattccagcgtcatgcaccgttatccctccggccagacttcagtctatggcaattgcaatggatcgcacactttttacgtaattgctcgctggagcgctacgagcttaataaatcccgcatggtaaacttggccgaatacagccgcgattgcctgcgtgcactacgcgtcagtaccggcatccagtacgaacagcggagtcgcggcacattgcaagtcttccgcacccagaaacagctcgatgctgaagccaaggatatcgccgtcctgagtcgtatgggcgtacctttccagcatgtagaccccgagggttgtgcgcgcatagaacccgccttgaccaccgttaaagaccaactgctgggtggattgcacttgcctgatgatgaaaccggtgactgccagctttttacaacgcagctggcggcagaagcaacaaagctgggtgtgcaattcaggcaaaacactcac

SEQ ID NO: 110785 - DNA, 228 bp, Glycine max
  Peptide Sequence Number=SeqID_227563
atgcggagatacccaagcagttatccgtacaaacggtttctgtcatcctggcccgtgaagtcaggtggtaggcgagggtaccgtatggttttccacacctttcgtcaaccaggggcaaacgagcccgttgatgcgcagagactaacgtcgtcttctacgccttttgtcatacagggacagcgagtcgggtggttcttactctcgtcatccggagacattcaagcctga

SEQ ID NO: 110786 - DNA, 903 bp, Glycine max
  Peptide Sequence Number=SeqID_227564
atgtgcgctgttgtgatcttagacccctgggtaatatccaggcagacgttacacccaaagaaaagtcgaaaaggcactgtagaaggtatgctgggctctagctttggtaagctcaacctaggggacagcttcgcaggaacagaagaggaagctgctaacaccaaagaggtaacctgctataataccctacatgatgatcgaaggcacaggaatcacatagagggaaagtatttgaatggtggagcgaaagtagctgctgaccagacctttatcggggaagaagagggacatgtcacgcagtctctctctccttctttatcggggcagattcaacaaggaattgggccaggttgcattaagggcccaatttcgactcaaggagggtgtaataaagaagacatccacccagttgagcttttgggggtgcaagctgtgcagaataaaaaagagggtgggctaagtaatgatttaggcccaattttgaaaactgacgggtgccataagaaggaatccctacctgtaatccaatccataaaagagactccagacaagtattctaaagtttactttcgacaacaaaactctctctttaaggcccgactctcacagattgaggaaaagcatcctcaacttcaagatggcatccaggctctagcagatcaacttgccaatcaggataaggtcaaaaatcagagttacgtggactcagaaaggaggttaaaaagcataattgagtgcagtgataaggtgttgcaagaggctcaacaattatggcatctcggagaaaacttaggcatggagacagttacagataacctacatttccttcacagttatgcttctatggagtgtagagacagaaatgaagctaaggagttggggaataggaaacctcttaaatga

SEQ ID NO: 110787 - DNA, 668 bp, Glycine max
  Peptide Sequence Number=SeqID_227565
ggcgaggatgacaaagtatgtgagaagtacagaataagtaaagagaagtggacccagtcttgtcagagctgtagagacccttcatgggaggatgttcaaaagatggagcaaaccattcaaaaacaaaacactacccctcacgtattgtctagtgggggattccttggaggagcaggcctgtggacatcaggatgtacagatttctgccattgggtgaccagaacacccgggtcgtgtccgtgctactggagacgacctagagtagctgacacaaaagatcagagaacagttggaggagtcgatcactcaacaattaatgatgtccttcagctagatgcactctcagatgtagtcgtagatgcaatcacagtcctcctcgactggttgctcttggaagagtttatgagggtgaaggtcggtgttgagaaagtccaagatgctgatgctcacattcatgtacccattcaagaggataaacaggtagctgagggaatgacgaaacctgtagatatgtcggatcctaacatcgatcccttgtacctaatgacattgaccattctgcaactttttctcaagccgttgcagaacgcggggaacaccttcgctagtgatgggctaatggcagtgagtcagagtcgtgagggagaggatcgtcgcgaggctgaagg

SEQ ID NO: 110788 - DNA, 558 bp, Glycine max
  Peptide Sequence Number=SeqID_227566
atggcacagaagaagagcactccaatcactcctaccacatccagaaggagcaaagttgcaatcccttccaagaagaggaaagaaatttcctcatctgattctgatgatgatgtcgaactagatgttcccgacatcaagaaggccaagacatcagggaaaaaggtgcctggaaatgtccctgatgcaccattggacaacatttcattccactccattggcaatattgaaaggtggaaatttgtatatcaacgcagacttgctgtagaaagagaactgggaagagatgccttggattacaaggagatcatggacctcatcaaggctgctggactgctgaagactatcagtaatttttacaagttcaagaatcgaaagtttattaaatggtccaacgccttaaatgacctttcattcaataaaaacatatcttgcaaaaaggataaaaacaacttaaccaaacactttgttcacaaagaactacataggtctgatttccttatcgcaattaaggaatacataggagcaagggaaacaccctcgtcgaccgcaaaaagatag

SEQ ID NO: 110789 - DNA, 198 bp, Glycine max
  Peptide Sequence Number=SeqID_227567
atgatcatccatgacttggtgcttgtcatgtttgttaacatagcagcctcaatgggagttgtcgcaacgggcccttcgcgggtgagtgagggcaaggttcatgggtgcgcttttcaaaggaggaaagatgcgcggagtcgtcaccaacgtttatttgtggaaaacgtcggaaaaaccgaaagaaaccggtcaaaatga

SEQ ID NO: 110790 - DNA, 563 bp, Glycine max
  Peptide Sequence Number=SeqID_227568
atggcttcctcgaacccaaacgccaacaatgcacgacggatattgcatctcatgaagacgttgaacggaagaatgagcggaaacgtgctggtgcggagaggtgctgaggagccttggctaccactgtattgtagcatacatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 110791 - DNA, 168 bp, Glycine max
  Peptide Sequence Number=SeqID_227569
atgaaaaagctcttcgatgatatgtatgaaatgcctccgaggaagcttttcgcaaagagatttaggagggacgccgcgaccgaaggaaccagcgccgctcccgagtttgacaaccatcgtttcaggagcgcagagctccaacagcgtttcgaggccatcaaaggatag

SEQ ID NO: 110792 - DNA, 228 bp, Glycine max
  Peptide Sequence Number=SeqID_227570
atgaaggttgaacaaatctttgcttgccatcatattagcgaagagagaaaagttccattggccgcccttaactttcaaggggaacgaaggattcatggggatactctagtagagtattggaatgatctgaagagtgcccttaggaagaggcacattccctcctactatgaaaaggcttgccgggttcggtttcaattaagcgctcggggcatcctatggactaagtga

SEQ ID NO: 110793 - DNA, 497 bp, Glycine max
  Peptide Sequence Number=SeqID_227571
gaaaatgatagatctcatccagcacaagcagttgcagcccagaaacgcacattgctatataatcatggaggctgcacgagttctgcaccaagtccgggattgaagaagttgatctctattgttcagagaggaatctctggtgtgatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 110794 - DNA, 186 bp, Glycine max
  Peptide Sequence Number=SeqID_227572
atgtggtatttgtggagccaattctgcataatggattatgagcatgcaggtgttggggctatagagtttattatatgccattcagaggtctcaattgcacttgcagaagagaagaagatacctgagctattcaagacatttccaaatgcaacaaagtatctcaagagatcaaactcagagctttga

SEQ ID NO: 110795 - DNA, 408 bp, Glycine max
  Peptide Sequence Number=SeqID_227573
atgctgattgaaagagttagggttaggaatgacattataattcaagggctgaccattcttgctccagttgactctccaaacactgatggaatagatccagttcaatttgggtctgctggcatgttcatatttgcgatggattctataaagaagggtatgagccattacgtgttcatcgtctatcgtaatgccatcgcctctgtatctcttgctcccttcgcatttgttcttgaaaggaaagttaggcccaagatgactttccggaataatgttggaccagtgcatcgccctcttgggcatgaaattcacgtcggcatctttcctatctgctgttatgaactccgctcactctgttacttttgtgatggctgtcattctaagatttgtttgctacctttgaacctttaa

SEQ ID NO: 110796 - DNA, 324 bp, Glycine max
  Peptide Sequence Number=SeqID_227574
atggcttttcagttggcatttaaaaccaaagaaacaatgcttgatccttaccatagtttccttacaccaaaaatggtagaagcacttagtttcactcaagatttgttaaaaggggaaccctcaccagtgtttacaaatgaggattttgaggaaattgagaaatttgaggaaattgagaaatttgaggaaggtgtcgttttaagtatgtttgcttcctctcactacaagaaaaatgacctatacctacagacaaaaactgtcactataagtaaaaaatccgtaggtaaatgtttagatcttagagagagcttagaacatacataa

SEQ ID NO: 110797 - DNA, 180 bp, Glycine max
  Peptide Sequence Number=SeqID_227575
agtctagagacagagaatgaagcttcattgaaagaactgtggaaagcacctgtagcagatgatgagagtgatgagcacaatgacggcgacaacgacgaagactatttcattgaagcctttgggaagagacggcaccgtcgggcgccatttgggggaggagattctaattgtggtgcctag

SEQ ID NO: 110798 - DNA, 857 bp, Glycine max
  Peptide Sequence Number=SeqID_227576
ggctacggcggggtgcaaatcccgcgcgtgggcgatgaggtggtggtggactttatcaacggtgatccggaccgtccgatcattaccgggcgggtgtacaacgacgcgagcatgccgccgtgggcgctgccggcggcggcgacgcagatgggctttatgagccggacaaaagacggctcggtcgacaacgccaacgccctgcggtttgaggacaaggcgggcgcggagcaggcgggcgttaaaggggacgtcatttgcctgacgggtaacagtcgcagcgataaagtggttaacaactttattatttcagcgggcaatacgttgaggctggagtgtggtgaaagcgccattgaattatcaaaagatggcagcgttaatatcattggtaataactttaacttcaccgcaaaacagaacgcgcagataaacacgcttggcggtgaactgcatctgaatcctgccggtggaagcaatgccatcgatcctcctgggtcatcccatcagagtgaaatccagcaggaagtggatacctgggatgcaactttacctttaattacgactgaagatgtttcacgtgataaagcgcttggggcgcttgtgggactggctgttggggacgccgtcggcaccactcttgagtttaagaaaagagacagtgaacatgtagctgatatgattggtggcggaccttttcaattaaaacctggtgaatggacagatgatacgtccatggcattatgcctggcagagacttatctttcagaaaacagaatgcacaccgatgtgcttagaaaatatctcctgaaatggtatcttgacggagagaatagcagtaatggtcggtgcttcgatatcgg

SEQ ID NO: 110799 - DNA, 246 bp, Glycine max
  Peptide Sequence Number=SeqID_227577
atgttgtttgcgatccaagtccacacacctccactgttgggatttgcaaagaattgtctgtggagggagaaatatgcatcgcacgaagcattacaaaatggaggcttcaatcccttctctttctctctaacgtttgggaactctatcagagcaatcagaggaaaaattgaggaatctcagaaaattgctagagatgccgttatcgctgtcggaagacacgtgatcccgcttagaagtaagggatga

SEQ ID NO: 110800 - DNA, 279 bp, Glycine max
  Peptide Sequence Number=SeqID_227578
atggattatggtattgaatatagtggatttttagttgtactagaaaggtatagcgatgctaattggatctctgatttagatgacacaaaatccactagcgattatgtatctacacttggggtgacatatacacttaagacatactgtggtaaagcaactactaaagaacgaaccaattttcatagattatgtgaagctagaaggaaacttagcaaatcctctgacaaaacccctagggagaaatatgatattagaaacatcgaggggaatgagacttaa

SEQ ID NO: 110801 - DNA, 231 bp, Glycine max
  Peptide Sequence Number=SeqID_227579
atgatccttgatgcctcaactggagggactatgatgtccaagagtctagaggaagtcgttgtaatcattgactccatagtagccagtgattatcaaagtgttcatgatagagctctgactcaaagaaaaggtccttctaacaacacgtatggaggttcttcaattaagggtacacaacaacaacaagctcaaccagatagaatgtccaagatggaagataccttaacctag

SEQ ID NO: 110802 - DNA, 306 bp, Glycine max
  Peptide Sequence Number=SeqID_227580
atggttccaagtacattcagagttggtttgccaagcaagacattgtgcgaggtatctacatccaccaaaacatatggaactattaatgattgggaaagttttctcgagctgaatgtggtcagcagatcacacgtcatatgcaaaaccaccagcagtagtgttaattacacctcaaacaacaccaggggattttcttcttacctttgttctccttctcctacaagttgttggttattgttgcctcaacctccagcatatccacctctaaaatcaccttttctaccacctctacctcctcttctataa

SEQ ID NO: 110803 - DNA, 321 bp, Glycine max
  Peptide Sequence Number=SeqID_227581
atgccacgccaaaatgagtttgttggttactcgttcataggaaaaaatcccaaaaattttgacattccttccggatgtaccatggatgaactgaaggatttgatcaagcaagttgcgcctcaagagattcccccttatggtattcatgaaacacaaacgcggaatggagaaaggaagagagagaggagacaccacttcaaggagaagatgagtctagaagaagctcaccaccataggaggccatcgataagagcttggaggaagaaggagatgaatgaagggagagggagagaagagcacgaaattttgtgctctaaatga

SEQ ID NO: 110804 - DNA, 159 bp, Glycine max
  Peptide Sequence Number=SeqID_227582
atgctaataaaccttagtggtaaaaattcaattctcactgagcaaagtacacactcaggaccagaagaagatgcccagtgtggcagtagtggttgggtggtcaccgaaggtgggtgggcgggtggcggtacaagcgaagatgttggaaacaaaggctag

SEQ ID NO: 110805 - DNA, 232 bp, Glycine max
  Peptide Sequence Number=SeqID_227583
atggacgaagatcaatggacgtatgacaatacaatgtctgaagaaattgatatggattatgaaaataaacaagaatgtgatgatgttctgccatgggctcgatcggttgcccatgaaaacggatttgttgcagtcattatgaggaataaaaaatttgttagaagagacactgggagtaggaaatgtggttgtcccttcaagcttcgtgggaaaccagtgattggaggggaag

SEQ ID NO: 110806 - DNA, 312 bp, Glycine max
  Peptide Sequence Number=SeqID_227584
atgtggattctagagatattacaagctctcaaaatgaaggcttcagaggggacccttactcaagcacaacctatcactttgcaccttaatacgcttggacaacatgctgaccttgctcaatctcacctgtatggtctcctacatgatcatatgcccctcgttgcagacacaatagaacccactcagccaatggttgagatgttggaggagaggttcaaagttgttgagggtagtaattatggcaggacggaagcggcagatctttgtttggttctcgatgtaatcattcctctgaagtttaaagcaccatag

SEQ ID NO: 110807 - DNA, 1020 bp, Glycine max
  Peptide Sequence Number=SeqID_227585
atggataggcaattgatgcaaattggttatttcgaaagtgatgtatcggtagttgactccattttgaactttccaaaatccttagtggtacattatgcaaaatgcactactagcttagcctttagtggaccaaagatcatcactatacaagttctgaaagcttttccttacaaggataataaagcagtgccttggagatatgaagtcaaagtgtgtgttgatggttctgatgaaaaacaatccaagaatgccagctcagaagctaccaatattagaaatgttgttgggattggtagtatgactcggagcggccgaatctactatcctagtgaatcaaggaccaaaccatataaagaaacaaatggtgaagaagttgtgaggagttcagaggaacaaaggaaagaaatttctgatgaagaggcttgcgaattcctaaagcttataaaacaaaatgaatacatagtgatggaccaacttaatcgcacccctaccaaaatatcatttttgtccctgatgttgaactctgaaccccataggaagaaggtattgttgaagatattgaatgacgctcatgtcattcatgacatctctaaggagaaatttgaaggtattgtaggtaatgttagtgcaagcaattacctaacattcactaatgaagagatgccagtagaagaagcagggcataataaagccctacatatatcaatgaaatgcatggaccatgtcttggcaagagttctatttgataacggttcctcgtctcatagagaagtgattggggaaataagtctgcctatccagattggtctaattacctttgaggtagtatttcatatgatggacattgcgccaatgcatagttgtcttctaggaaggccttggattcatggtgatctactagccagtaagccatcatccattccttatattgaagctactaaggaagccttggagacctcattccaagggcttgaaattgcgaatgctatttatgcgaaggaagggaaggcgactacctaa

SEQ ID NO: 110808 - DNA, 1155 bp, Glycine max
  Peptide Sequence Number=SeqID_227586
atgactaaagaggatgaggagaaaaccacattcatcacgccttggggcaccttttgctataaagtcatgtcatttgggctaaagaacattggggcaacatatcaaaggacgatggtgactttattccatgacatgatacataaggaggtcaaggtttacatggatgacatgatcactaagttaaaaaaggcagaagatcatgtagtccatatacagaaattgtttgagcggctaaggaagatcaaactaagactaaatccagccaaatacacttttggcatcaaatctggaaaattgttaggtttcatcgtcaaccaaagaggaattgaagtggatactgacaatgtccgtgcaatgttggaaatgccgcccccttacacagaaaaggagattcgagggcaacatgatggttgtggaaggaaagagcatgctatacactatttgagcaagaagttcattggttttaaaggtagagctctggaagattatttagcacaccaacctattgaagattatcagtcaatgcaatgtgaattccccgatgaaggcataatggaaatgtttggcaacaaagatttgtcaaaagaaagaagatggatcatgtggtttgatggtgcttccaacatcatgggccatgggataggagttatattactctccccaaagaagcagtatatcccaatcacgattaggctatgctttaattctactagcaatatagcagagtatgcgacatgtgaatgggaaactcgagatgcaaagctaattccttaccaaacccgcatcaaggaattggtgaaacaatttgatgaaatcacgtttgagctcattccttgtgaagataaccaattggcagatgcactagcaactttatcatccatgttcaaattgagcaaggataaggacatgccacttataaggatccaacatcatgatcaacctacatatttccacttggtagaagaggatgtgttgtataagaaaaatcatgatatggtgttgcttagatgtgtagatgtcattgaagtgcaaaagatcttcagagaagttcatgaagggtcctttggcactcataccaatgggtacactatggcaagaaagatcttgaaggctagatattactggttaaccatggagacaaactgctataattaa

SEQ ID NO: 110809 - DNA, 510 bp, Glycine max
  Peptide Sequence Number=SeqID_227587
atgtcaggcttgagttcaagtgttgaatacatttgccaggtagattttgggcttgtagcaagtgctaggtcgattctaggcttgaatgttggtgctaggccgttttcgagaatgaatgatggtgttgagtcggcttcagcctcgcttgctagtgtcagactcaaatgttggtgctgggtcgattccaggctttgctattggtgttgggtcaattctaggctttggctactggtgccgattcggtttcgggctttgattgttggtgtcgggttggttccaggctttgacctggtgttaggtcaatttcaggctttgactgttggtgtcaggtcagttctaggcttagttgttggtgtcgggtcaattccgggctttaaagatagaatgttgatgttagaccgcttggtcgttgaaactgaaatgatcgtgccaggtaagtattggcttaaagagaaagggctagttaactttgtaactaaaggaacctatgctacacctttgaaggtctaa

SEQ ID NO: 110810 - DNA, 246 bp, Glycine max
  Peptide Sequence Number=SeqID_227588
atggatccatactcccaatttggaagacgtgggagaaggggcggtggtcaacgaagttggagaaagcgtagtggaggagcggattccaagcaggagcaacctttctctgtcaaaatccacgacattcacgcatgcgaggagggccaccacggtgtctctgatggcagcggaatgaagagtcagagaagctacaacggcgtttcacaggaagaggaattgattttggatttgggttggggtcgctga

SEQ ID NO: 110811 - DNA, 2500 bp, Glycine max
  Peptide Sequence Number=SeqID_227589
ctctccaccttggtccttggctccttctgcgcacactaagcacttcattgagttcattttactgttcgtattcgtaccaaaatcacaaccaccactacgagtttctctctctagaaccgccgaagcgaagaagagagaagagagaagagagaagagaatcacggttggctccgccatggacgcggcatcgcagctcgtctcctgcggaatcgatcccttccctcgcgccacctctccttccccgcgccaccgccgcaaaagcaaccttctcaacctccgccaacgctccagccgcgtcttcgccgtatccgccgagccgaaacccgcgccgccgaagaccgctgtcaacggagcaaattcgaggccgcctccgacaagagctgtcaacggcgtctccacgagaattggagatgtttcgaaggagattaagagagtgagggcgcaaatggaagaggacgaacagttagcgacgctcatgagaggtcttcgaggccagaatttgagggattcgctattcgctgaggacgatgttgaacttcgtctcgttgaggtagatgagagtagtgagtttttacctttggtgtatgatcctgccagcatttctgcgtattggggaaaacgtccacgctccgttgcaactcgcattgttcagttgttatccgttgcaggaggttttctatctcgtattgcctgggatgtgattaacaagaaggttaaagagaatgaagttgctagggctattgagttacgtgaaattgtgacatctttgggtccagcatacataaaacttgggcaagcattgagcattcgacctgatatactgtcacctgtagcaatgacggagctgcagaagctttgtgataaagttccttcatttgcagatgatgtggctatggctctaattgaggaggagcttggtcagccatggcaaaacatctattctgaactatcatcttctcccattgcagctgcatctcttggacaggaacctgggtttggctcttcggaagtttcctcaggcaagttaaattcttgtgagcagagacttaaagtctccattgatgtggttgggttggttgatgagtgggctgctcgattttttgaggagttagactatgtaaatgaaggtgaaaatggaaaccgttttgctgaaatgatgaggaaagacctaccacaggcaaaatggattgacggagagaagctgtcacagagcacagaaaatgatgttggagaactggttaatgttggagtcatctgctatctaaaacagcttcttgatactggattttttcatgctgatccacacccggggaatttgatccgcactcctgatggaaaacttgcaatacttgactttgggcttgttacaaaactgactgatgatcaaaagtatggaatgatcgaagcaattgctcatctcatccatcgggattatccagccatagtaaaagactttgttaaacttggtttcattccagatggtgtcaatttggagcctatcttgccagttcttgccaaggtttttgatcaggccttagaaggtggaggggcaaaaaacatcaattttcaggagctggcatcggatttagctcaaattacctttgattatccttttaggatacccccatactttgcccttataattagagccattggggttctggaagggatagctttagtaggaaattctgaatttgccattgttgatgaggcctatccttatattgcgcagaggctcctcacggatgaatctcctcggctaagggatgctctacgttacactatatatggtaaatctggagtttttgatgctgaaagatttattgatgtcatgcaagcctttgaaaattttattactgctgccaaaagtggtggtggagaggatatgaatggcaatatggcagagcttgggattcttactactagtcagtcagaatatttgttgtcaggattccaatctgttatgcctcaatcaccgcagccagtgcaaacaagagcagctttagcatttttgttgtccgatagggggaattttttccgagaatttcttttggatgagtttgtggtttctaaatatttgaccaacattattgctggtggaatgcagattgttaagggcattgatgcagtaacaagggaacaactggtaagaacaatgtccttactaggagttcagaatgcaacccctgttttcagtatggtacctactgtgggaccctttaagcctgcggctcttatacccaccataactgaagaagatgaagttatattgaacaatgtccggatggtggtggagttcttgaccgcaggaagttccctatcaagaacatctgatcaggcgctgaatattcctcagattatccaagagcttctcccagtgttaccaggcatctctgttaaagtgcttcctgagagaaagagaaatgcgaatcctaaagaagaagagataaatgtggcggtggaggctaagatatatcctaaaggaatgacgacgagatag

SEQ ID NO: 110812 - DNA, 279 bp, Glycine max
  Peptide Sequence Number=SeqID_227590
atgaatgacttcaacctcaagatggtggagaataatttacccttccatgttgcgaatttcttaaggcaagctaaatttgatttagttattcttgagttcttgggtggagttattactgaatgcaaaggtctgatccatcaacttcacaagaacacaatgaagattggaaaaggttggaagcgttattacaaatataacaaactacagaagacagaaaaaattctctttacctttgatgctgcaatgggaaaggtggttagagtgacaaaagttaactaa

SEQ ID NO: 110813 - DNA, 333 bp, Glycine max
  Peptide Sequence Number=SeqID_227591
atgtatgtggcgatcactccatactgccatccacatcaatgtataagaccattaagacctgggaggattggagctcgtagagagagtaggcatggtttatgcagtattgcgaactacgtgttacacctgtcatacccgagtccacttcatgccaacaaaaacttcggatgcagtgcttgttatcgtagaccacacgttacctgccataacccatggggatctacatctctctcaaagctcaactattatgaggactttcatgtgtatcttggactagaagagcttcgctatgatcaggaattcttgtggactttagtggagtatgatggatag

SEQ ID NO: 110814 - DNA, 327 bp, Glycine max
  Peptide Sequence Number=SeqID_227592
gttgccttgctagactatggacaagtgaaggatctcccagatcagttgaggcttgcctatgctaatctagttcttgcgattgctaatggtgacccattaagagctgcagagagctataggagaactttgaccgaccttgagggagagacttacgatatcgcacgccggagcagagtgaataagtgcgcgagggagggtagagtggtgaggaacttggagagaggtcgagggagaatgagaacgaagaacaactgtagagaggtagggcagagtggtggggaacttggagaaaggttgagggagaatgagaacaaagaacagttgtag

SEQ ID NO: 110815 - DNA, 279 bp, Glycine max
  Peptide Sequence Number=SeqID_227593
atgtccaacattttacagacggaatggaaatgcaaaattgatggcatatgtgggatgtttcatgcaaaagtaaataaagatactaaatgcttggtggttggtggatcactcaattatgaagctgaggtgcggaaggcaagagtgatctataggaggatgaaaataccaatagtcagagaggactatttgattgacggcttagcaagaaagaaaaggcttccatttgatatgtacaaggttgaaatgattggtgaggcttctagcatggtcaccatttaa

SEQ ID NO: 110816 - DNA, 1044 bp, Glycine max
  Peptide Sequence Number=SeqID_227594
atgaatatagggttagtggtaatagtggctgtggtattgtggagtggggttgcagctgcacaagcacaacgagtaccttgctactttatttttggagactcttcggcagataatgggaacaacaaccagctttggtcaaatgcaagagctaattaccttccttatgggattgactcctctgttggcccaactggaaggttttccaatgggaaaactactgttgatgtaatcgctgagcttttggggttggccggtttcatacgtccctatgcaagtgctggagcccgagacatattttacggagtcaattatgcttcagcagcttccggaattagagacgaaactggacaacaattgggaagccgtatcagtcttagagggcaggtgcaaaaccacataaggacggcgtaccagatgttaaattcactgggagatgtgaacagaactttaacttacctgggcaggtgcatttattcaattggagtgggtggcgatgattatcttaacaactatttcatgcctcaattctatcccaccagcaggcagtacacaccagagcagtatgctaatcttcttctccaatcatatgctcaactactcgaggttctgtacaactatggggcaaggaaaatggtattatttgggattagtccgataggttgcaccccttatgcattggctcaaagcagcccagatggtagaacatgtgtggaaagactgaattctgcaacccaattattcaacaccggattgagatctcttgttgatcaactcaacaaccggattccgaatgcaagattcatctatgtaaacgtttatggtgtcagagtcacaaatgttgggtgctgtagggtagcaagcaacaacggtcaaagtacatgtgtgcccctgcaaaccccatgcttgaacaggaacgagtacctgtattgggatgcatctaatccaacagagaccgccaatactatcattgctaggagagcttacaatgctcaatctacatcggatgctttccctattgatattaatcgcttagctcagatctaa

SEQ ID NO: 110817 - DNA, 444 bp, Glycine max
  Peptide Sequence Number=SeqID_227595
atggatcccaatgcaatcatcttaagtcttggagacaaggtattaagacagatcttgaaagagaagacaacaattggaattaggccgaaactagaaggttgcagccctaatgcactggccgtctggcccagaacagctcatatgcttacggatgcaagattcatctatacaaacgtttatggtatctttcaagatgtcttaagcaacccatcttcctatggatttagggtcacaaatgctggatgctgtggggtaggaaggaacaatggtcaagttacatgcctgcctctgcaaaccccatgcaggaacaggaatgctttcctgttttgggatgcatttcatccaactgaggctgccaatactatcattggtaggagagcttacaatgctcattctgcatcagatgcttaccctgttgatatcaatcgcttagctcagatctaa

SEQ ID NO: 110818 - DNA, 264 bp, Glycine max
  Peptide Sequence Number=SeqID_227596
atggagatagacttgcacaacaacaaccagcttcttcgagcaaagatagctgaaagtgagaggaaccaccataacatggctgtgttgcctggaggctcaaactatgactctatgcagtcttctcagcaacaatttgactctcgtggctacttccaagtcactggattacaacccaataatcagtatgcacggcaagatcagatgtcccttcaattagtcttatatgttgttcttctcgtgacaaagggtgacgatggggagtga

SEQ ID NO: 110819 - DNA, 297 bp, Glycine max
  Peptide Sequence Number=SeqID_227597
atggtgaaagataaattcaagtctttcaccaaaggtcgtttaattgtgaaaacactcatcaatgatttgaattattgtccagactttgacgactttaattacattgtcaaagcaaccatcgagaggtacaaaaaagcaagttcagattcgtctggcgctggatctgcttctgaggctaatgctcagttttaccagcaagaagcagataaacttcgtcaacaaattagtaacctgcagaataacaacaggcaagttgaatgtctttttcatgcactaggacaagaaaagtctcattaa

SEQ ID NO: 110820 - DNA, 833 bp, Glycine max
  Peptide Sequence Number=SeqID_227598
atggaatcgaaaaaccctgcgaggtttacgctggggaagcagtcgtcgctggccccagaacgccataacaaagaagcagagctccaaaacgatggagaagttgttgatcagggtgtgaggttgatgtattcggcattcgaaggcgatgtagatggaatttgtgaggcgttggagtttggtgtgagtgtgaattacaaggatattgataatcgcactgctcttcatgtcgcagtgtgtgagggattcactgatgttgttgatttgttgctccagaaaggtgccgaagttgaccccaaagatcgatgggggagcacgcctcttgcagatgctattttttacaaaaagaatgacgtgatcaaactattggagaagcatggagcaaagcttctgatggcccctatgcatgttaatcatgcacgtgaagtcccagagtatgaaatcaatcctaaagagcttgattttaccaacagtgtggagataacaaaggggactttctgtattgcactgtggcgtggaacagaggttgcagtaaaaaagcttggggaggatgtaattagtgatgaggagaaagtgaaggctttcagagatgagcttgctctgttccagaaaatccggcatccaaatgtcgtccaatttctgggtgctgtgacccagagtagtccaatgatgattgtgacggaatatcttcccaaggttttttgtcctacaatttcatggaccatggtttttggggctttgcttgggaattgggatggagatcttcgtgatttcttgaaaagaaaaggagctttgaaaccatcgacagctgtgagatttgcacttgatattgctag

SEQ ID NO: 110821 - DNA, 216 bp, Glycine max
  Peptide Sequence Number=SeqID_227599
atggaatgctcacttcatcatcaattagcaccttatgtacctattctggttgcatctggtttaacgcaacaaacttttgcaaaaggtgatcaatgcaaagccgacaaagattgttatccatattgttcacatcgcccagattgccctacgttgtgtcttggtggatattgcctttgcaattgccttcctacagaagtgcatatacaacagaactaa

SEQ ID NO: 110822 - DNA, 225 bp, Glycine max
  Peptide Sequence Number=SeqID_227600
atggctatatatatgtttttgttgcaagtatctgatagagacgtaaatttgttctggagttttcttcggtgccaatttgactgggatacgaacaccatgctatgcaacaaatttatagtacttgcaattactattactaaaagagttcaacctgtccagggacggattctacgctacacaagttgtgttgatcttgcaccatgcacaagtaacaaggtctgttag

SEQ ID NO: 110823 - DNA, 327 bp, Glycine max
  Peptide Sequence Number=SeqID_227601
atggcatttaaagcctttgactttctgcagtttgcagtgttgttccaagaattagcacctttatcaacacacatgtctctccaacaaccaaatcaagaggtgccattgcaagaactagaaaccacattttctcaactaagcaaacaaaacttaatactctcactcacccttgatgagttctattgcaagaatggaaagagcttacgatccatgaacatggatgatttcctttctagcatttggaactctgatgataacaaccaagttaactcaccactacccacccttgatgaagctgcaaagggtaaaagtgtactagcaacataa

SEQ ID NO: 110824 - DNA, 1650 bp, Glycine max
  Peptide Sequence Number=SeqID_227602
atgattggttttgagaatttgggaacattttcactagctgtgaactcggtgccatacttcagtgggataatgcattatagtataccagatgcagctaacatgctcaccaactacatgggaaccggttacatactcgccattccagtggctgttcttgctgacacatggattggcagatacagatctgttttaatttctggggtattcgagtttttgggacttgcattgcttacagcacaagcacactatcccagcctcaagccacccctttgcaacatttatgatataactgctcactgtgaaacacctagtggtggccaagaagctcttctgttcattgggctatacctgttggcttttggcagtgcaggagtgaaagctgcactaccatcacatggtgcagatcagtttgatgaaaaggaccctcgagaagcgaggctaatgtccaccttcttcaacaccctcttgttggccatttgcttgggtggtgcattcagcttaacgttcattgtgtggatacaaatcaacaagggatgggattggggctttggtattggcaccattgctatatttttaggtattgttctctttgcagctggattgccactatatagatttcgtgttggtcaaggaacaaatgctttcattgagatcattcaggtctacgttgctacaatccgcaatagaaatcttcctcttcctgaagatccaatagaactgtacgagattgaacaggacaaggaagctgctgaggaaatagagttcctacctcatagagacactttaaggttcttagacagagcagccatccaaataaaacaaggtgtgcaatctgagaaaccaccaagcccatggaaactctgtagggtcacccaagtagaaaatgccaaaattgttcttggcatgaccccaatattctgctgcacaattataatgaccctttgcctagctcagctgcaaaccttttcaatccaacaaggctacaccatggacaccactttcaccaagcattttcacatcccacccgcatccctcccaatcatcccaatttctttcctaatcattattatgcccatctatgatttcatttttgtgcctgttatgcgcaaaatcaccggcattccaaccggtgtcacacacttgcagcgcataggagttggtctagtactctcttgcatatcaatggctgtggcttcaattatagaggtgaaaaggaaaagagtggccagagacaacaacatgcttgatgcggtgccaatacttatgccaccattgcccataagtacattttggctttcttttcagtacttcatatttggcatagctgacatgtttacctatgtggggctgcttcagtttttctattcagaggcaccaaaagggcttaagtctacatcaacctgcttcctttggagctctatggcacttgggtattttgctagtaccatagtggtaaaatgcgtgaatggagccaccaagcatatcactagtagtggtggctggttagcagggaacaatattaatagaaaccatctcaatttgttctacttgttcctttccatagtgagcttgatcaacttctttatctatttaatcgtttcaatgaggtacaagtacagatctcaacctggtggcaattcgaagaagtga

SEQ ID NO: 110825 - DNA, 942 bp, Glycine max
  misc_feature (66)..(66): n is a, c, g, or t
  Peptide Sequence Number=SeqID_227603
atgacaacacagtctctctacaatcagccacgtaagcatccatgcatgtctacgtggaaccaaaanctcaacccacgttctccatcttcggcttatatatatgactcacacgcttcagagaagataactgagtcaatcttgcaacgattaacaatggcttcaaccgacaagtcaccggacccaacgccggcgaagggtccggatccaactccggggaagccgatgagtgttggtcagcacgtgatcgacaagagtgcaatgatggtgcagtcgctggaccccattaagcagatgagtcagcacgtgtgctccttcgctatctacagccatgacatgtctcgccagatagagacacatcactactgctccagactccaccagaacttcatacaatgtgctgtctatgattccgatgaatccaaagctcgtctcctcggggtggagtacatcgttcctgctgatgtctttgaagcctttcctccggaggagcagaaactttggcattctcatgcttatgagattaaatcaggcctgttggtgaatcctagagttcctgaggttgttgccatgccagagctcgaaaaccttgcccaaacttacggcaaattctggtgtacatggcaggttgacagagaattacatgtgttctcaagagggaaagtatttgtgaaaaatggaaatgcaggggataggcttcctatgggtgcacctgccctgatgatgtctccacaagcagcgagtcctggtttggtgagggcagaactggtgcttgagagggatgccaagtacaatttttcctcaaagagcctgaaaagctcaagattggagattcctgagccagagatgatcaaccccttggctgattattggaagcaacatggcaaaggatttgtcattgacatcgaggagactgagatgaagttgaggccaccttttccttga

SEQ ID NO: 110826 - DNA, 630 bp, Glycine max
  Peptide Sequence Number=SeqID_227604
atggcgaaatatttcaatgagaggtcaggcataacaggacatattccactgggaagcttcaattccatgttcaattttactgggtgctggatggctgatgcagcagccaccaaatcccttgccatggttggatatttcattcctctggttgaagttaaactaaacaaactaaatttggtcttgactgatgaagtaaagcacgctgttccttactcttgggatccaacatccttggctagttttattgagaattatggtacccatattgttacatctgcaactgttggtggaagagacgtagtgtacatcaggcagcaccaatcatcttctttgtctgcttcagacattgagacctatgtaaaggacattggagatgataggtttcacaacgttaaacacttttcgggtcctggtcctttaaagtataaggagaaggatgttactgtcatatttaggaggagaggaggggatgatcttgagcaaagtcatactaaatgggtggaaactgtaaaattggcacctgatgtcattaacatgaactttacacccattgtttctcttcttgaaggagtgcctggcataaaacatttggctcgtgctattgatctatatctgcagtgtgagttctaa

SEQ ID NO: 110827 - DNA, 870 bp, Glycine max
  Peptide Sequence Number=SeqID_227605
atgaaccagaaaactgagggcaagtcttggcgcaatgacaaaccacctatcgaagacctacagtatttcttggatttccaaataactcaagtttgggcaccagagcaaaataatctacaaagaaaggaacctgtctgtcagtctcttcagttcagcttgatgggacctaagctttttgtcagtccagatcagaagacgagggttgttttcaggtcatcaacaacaaaggtaacagttggacgcaagcctgtcactggacttaggcttagcctagagggcagcaaacagaatcgacttgctattcatttgcagcatttagtctccctcccgaagaaccttcaacctcactgggacacacacatggccataggtgctcccaagtggcatggtcccgaggagcaagacagccgttggtttgaaccaatcaagtggaagaacttctcccatgtaagcactgcaccaattgagtacaccgaaactagcattggggacctgtccggtgttcacattgtcacaggtgcccagcttggtgtttgggactttggtgccaaaaatgtgttacacctcaagctccttttctctaaggtaccgggatgtacaatacggcggtccgtgtgggatcacaatccctccgctcctgttgctcagagaccagatggtgcttcatcatcattgatgaagaaaacctccgaagataaaaaggaagatagttcaatccacattggaaaactggcaaaaattgtggacatgacagaaatgtccaaaggcccccaagatattcctggtcattggttggttaccggggctaagcttggagttgaaaaaggaaaaattgtgctgcggataaaatactctttgcttaactattga

SEQ ID NO: 110828 - DNA, 309 bp, Glycine max
  Peptide Sequence Number=SeqID_227606
atgggatcgagtcaaaagccttcgcttaaaaagaggttctatcaagtcaaaatcaagagcttagaggtcactagtttacgagagttggggcaattaatgggtcaacttcaacagcaagccttccgcaaagcctatggtaggcccgtctatccgctacaaggtcaccgctcgtgcgtcgaaaaaggaaaggcgaattgggaccaactcttggctagcatggaggggcgtctgttaatttgttccctcgctagaaggaaggaagaatcaggattctatcttcatgcgaaggatgtccaaatgttcccttga

SEQ ID NO: 110829 - DNA, 741 bp, Glycine max
  Peptide Sequence Number=SeqID_227607
atgccgctgaaattccccctgtcgatatgtcttctcggcacgttgctcgtcacctccgcgcaggcgcagcaggcggtgaagggcgtcgtcgaattgttcacatcgcagggatgtgcatcctgccccccggcggatgaggccctgcgcaagatgatccagaagggcgacgtcgtcggtctctcctatcatgtcgattattggaactatctcggctggacggattcgctcgcatccaaggaaaataccgaacggcaatacggttacatgcgtgcactcggccgcaacggggtctacacgccgcaggccattctgaacggccgtgaccacgtaaagggcgcggatgtgcgcgggatctatgacaggctcgactcgttcaagcatgagggcaagggattgaacgtacccgtctcgtcaaaatttgcgggtgatgaggtggagatcgatatcggtgcgggcagcggcaaggccgatgtcgtcgtcgcatattttacccgggagcagaccgtggatgtgcagaagggtgaaaaccaggggaaaaaaatgtcctactggcacagcgtttatgacgtgcagacggtcggcatgtgggacggttcgccgatgacggtaaagctgccggcgagcgtggtggccaaggtaaaaaagggcggctgcgccgtgctgttgcagacggcgaatgcaagcggtgatcccgcggcaattgtcggtgcaagtattttattggggaacgaaacgccataa

SEQ ID NO: 110830 - DNA, 225 bp, Glycine max
  Peptide Sequence Number=SeqID_227608
atgagtgaaatagaggacgtacaggaacatatgaaggtcgatatggaggccatgaaagggcaaatggccacaatgatggaaggcatgatgagtatgaaaacaaatgatggagaagtggacccaactcactcatcgagcctcaatcaagtaaatcctccagtctcagatatggtaggtcagggaggagaagcattgggaagtacaggtagtccccatgttgtgtag

SEQ ID NO: 110831 - DNA, 387 bp, Glycine max
  Peptide Sequence Number=SeqID_227609
atgggggttacctttaaacagaatatccttcagcaggccagactttaccggacaatgaacgggaaactaaaggtgaacaataccgctacctggaacggaagtttttatcatctttcggataaagatggagctagtggctcgctgaaacagtcaattttcagttcgacggcaagtttgtattttaatgaaccgggaaatataaaatccgttttttcggagaaattccaaaaaatgattcctgtccggaagattacttcgggaaagtacagaatcgatctgcccaacggaaactccactacttatacctacagcaatggaatttgtactttggtggaagccgatacggattttgcgaacttaaaatttgttcttgatcagaaccgataa

SEQ ID NO: 110832 - DNA, 201 bp, Glycine max
  Peptide Sequence Number=SeqID_227610
atgagctctggtaataatgcacctgcgcaaacgaaaaatccaaacgctgattcccaaaatctgaatctgcaacaagtatccgctcctgtgaatgttcaggagaagctctcacctaataaaaatgtgaggattgaagcagacggcaaaacctacaaagtaatagtggacagatgggagagtgatagtctggttgcgcatccg

SEQ ID NO: 110833 - DNA, 657 bp, Glycine max
  Peptide Sequence Number=SeqID_227611
atgaactcgttatatggtagatttggcatcaatcctcaaagcacaaaaaccgagatgtgcaataaatctaaacgtgaccgtatatttagacgccctgagtttatagacgatgtctttattagagaggatctatacatggtatcttatctaaccaatccgggtaaggggccttcttattgggaccccccgaagaactccgcggtacaactagccgcagcgatcactgccggctcaaggatctatatgtacaagtatatttcaagagaagactgcttatatacagacaccgactctattgtccttggtaatccacttccggaggaagatgtttcctcttctgtattaggtaaatttaaattagaagataagatcttggagggattctttttagcacctaaatgctatagctataccacagaagagtcagatggcaataagaaggtctataagtacaagggaccgggtagaaatgttataactccagaatggtataaagaacagtacgccgacccttcccaaagtctgataaagaaggtaacttatcaatttcgacccgattggaaagaactctcggttaaaaagaaagagagtacaaccactcttagaactctcagtaactccaagagaatacctttctttaatgaaaaaggtaagtat

SEQ ID NO: 110834 - DNA, 726 bp, Glycine max
  Peptide Sequence Number=SeqID_227612
atggcctctgggaaacgcaagagtatcggttcaagacccacagctcaatatgatacatggagatttcgctccttagatgcatggaaccggtacacgaataatgtattggggagaaacatcttgccagagaggaaggtggagctctaccatactgagtttgatgattttaagactgagttggagaggcgtaatctccataaatgcctcaccaatttggttgatgggagcatagatgtggctttggtgaaagagttctatgcaaacctatacagctctgagggtccttcaccaaagcaagccagggtcagaggccatctagtgaagatcgacgttgatagcctcaacacattcctagagacacctgtggtgttggaagagggtgagactttgcccatatactccagatattgcaggctaccttcagatcctagggagattaaggctaccctatgcataccaggccgagggtttatcttgaatgttgagggccatcctgggaggatcttagcccaggtttggagtgttctctcatactccaacctagccgccacatctcacacatctgacctgataatggatagagctaggctgatcttcggcttagtctcccgcatggacatgaacatagaagctctcatttttggccagatgacttctatagcccagtctaactcttctagacttggttttcttgctctaatcaccaccctatgtcgagccagaggg

SEQ ID NO: 110835 - DNA, 309 bp, Glycine max
  Peptide Sequence Number=SeqID_227613
atgaagaatctggaagggaatctgtcacgcaggcacgtgctcagtgtgtcatcaactcgctcagcgagtcgtttgtcaccttccagacttagcgcgagtttggcgctgagcgattattcacttactcacgctaagcgcaagaatggcgctaagcgcaacgtcgagcaccttattattgcatgcttgtggcttgatcacccatgtgtgtgtactgttaagggctttagcattgaaagatgtattgtctccttagaacttgatagagcaggattaggttaccgtatgtctggacacagagcggtaatttag

SEQ ID NO: 110836 - DNA, 384 bp, Glycine max
  Peptide Sequence Number=SeqID_227614
atggcttcccaaccaaagcaagtaagggttcgagggcacctgataaaattttatgctgattccctcaacacctttttggagactctagtggtcgtggagcaaagggggatcttgccctcttactccaagtttgctagattaaggcttgatcctcaagagcttgcagcccggttgtgtctccctgggagaggatttgtacttaatgtcgagggtctgtcatggaagctcttgaggaaagatcttactactctagcccaaacctggagtgttctatcttattctaacttggccccgacatcccatacttctaatcttaatctggatagggacaaatttcactcattgctcaatccaactcctcgcggcttggatttccagccctga

SEQ ID NO: 110837 - DNA, 273 bp, Glycine max
  Peptide Sequence Number=SeqID_227615
atgagaaaactaacaaaaccacccatcatatctcccaaaaccccatacccacgaaatttaagggagaaagaagtccacccaaacctgaattttcgaagtcccactcgtagccacgcacttcacgaccccgaaaatgcccttctttcgcgatttggagcagaaatgagcaccaaaggttggagctttgttggggtttcaatggagaatggaggagaaggaaaaagcaacgtgaggaagagagaaagctgtctgaaaaaaatgagggctgagtga

SEQ ID NO: 110838 - DNA, 651 bp, Glycine max
  Peptide Sequence Number=SeqID_227616
atgtgctgtccgcatagaccgatgcattatcagcatgcattggcggaggcgaccgcattgacccagcaaagaaagtccctgtgggaaatgaagaaacagcaatctgcccgccgtgcacatctggatgatgaagtcatttcacgtgaaaaccgtgaagataccgatctgggtgccatggccgccaaagctgaatatgaagctgccgtggcccaggtagaaaaaatcaaactcgacctcgagcgtaccgtggtacgttcgcctgtggatggctgggtatccaacctgctggtgcgcccgggggatttcgcccaggtgggtgcggccaaactggcggtgatcgatcagcactcattctgggtctatggctattttgaagaacataaactgagcatgatcaatgtgggggatcaggccgagattcaactgctgggcagtcatactaagctcaaaggccatgtggaaagcatcgcccatggcattaccgaccgcgataacccgaccgatatccgtttgctggcgaacgtgaacccgacctttaactgggtgcggctggcgcagcgcatcccggtgcgtatccacctcgaccagattccggctgccatgccgctggttgccggaatgacgtgctcggtggtgatccggcacggatag

SEQ ID NO: 110839 - DNA, 237 bp, Glycine max
  Peptide Sequence Number=SeqID_227617
atggggcttcgaataaaagtggagaatggagaattggcgaacaacgctaggcaatcaattcgcggggctccagactcgttggcaatcaatttgcggggctccaaactcgttggtggaggatgcatgattgacaatcaattcatggggctccgaataaaagtggagaatggagaattggcgaacagcgctaggcaatcaatttgcggggctctagactctttggtggaggatgcatga

SEQ ID NO: 110840 - DNA, 186 bp, Glycine max
  Peptide Sequence Number=SeqID_227618
atggttgtagattgtggtagtggtaggcaccagaaatggatgatcaccatgaacaatggtgactgtcatttgaaggctggagatgaggtcatctttttctacaacattgaccaacatttatgggaggtcctctataggaagcaagttacatgggatgacacagaggatgaagctgactcaccttga

SEQ ID NO: 110841 - DNA, 288 bp, Glycine max
  Peptide Sequence Number=SeqID_227619
atgcacaacagggacagtggaggaatcaccctggaaactagttcaacaaagaccagtgtgttggcggataggccatcaagcaactttagtgctaacactgagaagaatccaaaggaaaaatgtaaagctataatgacaaggagcagaatggcaattcaggctgatgaaggtagagctgaagagaaggtggggggatataaacaacagttgacagctgagccggcactggaaccagtttctgattttgttgaacttaaggaagttgtggaagatgaagatgaccaatag

SEQ ID NO: 110842 - DNA, 606 bp, Glycine max
  Peptide Sequence Number=SeqID_227620
atggatacctcagagccctacattggggcaatgaaaggcaccatgcgtgagcctcaggcgaacctaggggtaggtccaaaatttcttacatctaatgtccaatcttgtgaatttgggatgatcgaccctctcgatgagtcaatcacttgctttctcataagggtggacccttgggtactagtacttatcaccctaagaggactgcacgtcctcgccttaagagggctacatgtcctcgccataagggggatacaagtcctagccttaagagggctgcacgtcctcgccttcagagggctacacgtcctcgactttagagggctacacgtcctcaccttaagagggctgcacgccctcgccatcagagggctacacgccctcaccttcagaggcttgcacgcccatcgccttcagagggctgcacacccttgccttcagagggctacatgtcctcaccttcagagggctacacgtcctcgccttcagaggactccacgtcctcgccttcagaggactgcacgtcctcgccttcagaggtctgcacgcccttgctttcaaagggctacatgtccttaccttcagagggatacacgtcctcgcctttag

SEQ ID NO: 110843 - DNA, 839 bp, Glycine max
  Peptide Sequence Number=SeqID_227621
tttagaggactacacgtccttacctctagaggactacacgtcctcgccttcaaaggtctccgcgtccacgcctacattaaactacacgtcctcgcctacagaggactacatatcctcaccttcagagcactacacgccctcacctatagagggctgcacgccgtcaccttcagaggactacacgtcctcgccttcagaggactacacaggctacacgtcctcgccttcagaaaactacacgtcctcgccttcagagggctacacgccctagcctttagaggactacacatcctcgccatcagaggaccatacatcctcgcctttagagggctacactccctcaccttaagaggactacacgccctctccttcagaggactacacgtcctcgccatcagaggaccacatctcctcacctttagagggctacatgccctcgccttcagaggactgcatgtcctctccttcagaggactacacaccctcgccttcagaaggctacatgtcttcaccttcagagggatacatgtcctcgcctttagaggactgcacgtccgcaccttcagagggcttcacgccctcgccatgagagggctacactccctcacctttagaggactacacaccctcgcctttagaggactacacgtcctcaccttcagaggactacacgtcctcgccttcagaagggtacatgccctcgcctttagagggctatacgccctcgccttcagaggactacatgtcctcgccttcagagggctccagccctcgcctttagagagctacatgcccttgcctttagaaaactacacgccctcgcttgcagaggactacac

SEQ ID NO: 110844 - DNA, 438 bp, Glycine max
  Peptide Sequence Number=SeqID_227622
atgatgtccccatgcaatgtgatcctatccatttttttcttggtgtgtacaagaacaccactactgtccctagcccagaacacccctcaagactttcttgatgtgcacaatcaggctcgtgccgaggttggcgtgggtccactctcatggaaccacacccttcaagcctacgctcaaagttatgccaataagagaatcccagactgcaacctcgaacactccatgggacccttcggcgagaacatctccgaagggtacgccgaaatgaagggttcagatgctgtcaaattctggctcactgagaagccttactatgaccaccactccaacgcttgtgtccatgatgagtgcctgcattatactcagattgtgtggcgtgattctgttcatcttggctattccccaccggggaacattgaaggggaacgaccttattga

SEQ ID NO: 110845 - DNA, 234 bp, Glycine max
  Peptide Sequence Number=SeqID_227623
atgaccagattggagttattggctctcaatgggtatgacagcggagttatcgacattctcatcaggagcctatgcaacattggatggtgtatagttgggaggcaagccatatggtgggaaggaatgcttgctctggacctgcacgaaatgggggctacccgtactccccaatgcttcgcctctctggcctaccatattcgagactggacgatttacttgattgaggccagatgg

SEQ ID NO: 110846 - DNA, 239 bp, Glycine max
  Peptide Sequence Number=SeqID_227624
tcccgaacccgtcgactgtaaaaaaaactgctcgagctgcttccgcggcgagagcgggtcgtcgcgtgccggtcgggggacagattgggaacgggcccttcggggcctcttccccgggcgtcgaacagtcaactcagaactgtgctctgaatgtcaaagtgaagaaattcaaccaagcgcgggtaaacggcgggagtaactatgactctcttaaggtagccaaatgcctcgtcatctaa

SEQ ID NO: 110847 - DNA, 147 bp, Glycine max
  Peptide Sequence Number=SeqID_227625
atggagcttggaagaagaggaaatggtggcctcttaaatccaagccaagatgaagagcaaaaagtgtcatttttgaagaatttcatagtgccactcgcccaagctagcaatcaactcgcttgggctaatgaggttactttagcttga

SEQ ID NO: 110848 - DNA, 568 bp, Glycine max
  Peptide Sequence Number=SeqID_227626
atggcttcgaagaagcttccagccaagaggtcgagaaaagatgccgctggagagggttccaatgcggccccacaggtggacatgaattctgatgggcataggttctggagtgaggaacaccagcgacgctttgaggccattaaaggctggtcgttcctcaaagagagaagagtccggctgagggacgaagagtatgctgagtttcaagaggaaattgtccggaggcaatgggctcagcttgtatcacccatggctaagtacgatcccgagatagtcatggagttttatgccaacgcctggcccacagaggatggagaggagttaggcctcgggcttcgacgaggaggccatcagccagttgttgtgcgttctggggcaggactttgcccgaagcgtagaggggagacggctggtctacaccatcctgactcagggatcacgccttctagacacccagtggacccgaagaagtccaacagggccctgggatttcctgctttgatcatgggcctttgccaattctatggagtgccgatcactcccaccaagctcatccggcctcccatca

SEQ ID NO: 110849 - DNA, 219 bp, Glycine max
  Peptide Sequence Number=SeqID_227627
atggctatatcaaggaaacaaacacatagtgtgtttgttttgtgcccttattttaggaacctaatgggagggactaaagggactaccagcgacaacatatcattaaagagaaaaactctagatgaggcttcactgtcattaagcgagtcggagattcagcatgaccacagatcaacctccacttcctatgtttcaatggacccgggtatagggccctaa

SEQ ID NO: 110850 - DNA, 902 bp, Glycine max
  Peptide Sequence Number=SeqID_227628
gggtgaatgttgaagggtgctggattcatgaaccaggtcgagttaaagaggagactaggctatttttcaaaaggagatttcaggaacctgagagggagagactgaggctggatggggttagattcaagtccattgatcagcagcataatgctttgttggtggctcgtttcaaagaggatgaagttagggcagcaatccggaattgtgatacgttgatccctaaagtaaatgacccacaaggcctcaatgattacagacctatctccttgataggttgtatcaacaaaattgtcgcaaaagtgctgtctaacaggcttaagaaggtgcttccttgcatcatcgatgaacatcaatctacttttatggagggtaggcagctactacatagtgtggttgtagctagcaaagctgtagaagaagcaaagagacgcaataagagttgcttggtctttaaagtagactatgaaaaggcctatgactctagaggtctaaggcaaggagacccactgactcctttcttgttcaacattgtagccgaggggcttcctagcttgatgagagaagcccaggaacagaagccctatgaagggattaagataggaaaggatgaggcggacattagcttacttcagtatggtcccaaagaacgtggccatcaaattggtgaggctgcaacgatgggcggcatagaatggaaaattggaagtggaacaaaggttaaattgtgggaagatgcttggctgactgatgggaagtcgctggcagaaaaatactctcgtatatacagtatatctcagcagcaacagaattcaattcagcagatggggattgcaacagcaggaggatgggaatggctagacccttgtggggttacacagtgggaagtgcttacaaagagttag

SEQ ID NO: 110851 - DNA, 1584 bp, Glycine max
  Peptide Sequence Number=SeqID_227629
atgtggacgaacttggccaagcgagcttcctcaaccctaaggaataacttccgtgtttcttctttatctccgagattttgtaagccccaaacatgtaaaacatttcagggtttccctgaagtcggggtgagtcagtccaagtttgtgtttcacgagggtttttcttgttcttcttcttggtcgtggtcttggatggtgctgggcagaggtcatgctagcgttgcggaggctattgagtcgacggacaccgaagatgactacgatgaggttcagaaattgttggaggaaatggcgaaggcagaacacaaagtggacagcagcagctacaagtacaagttgctgaagaggaggcagatagaatcggagacggaggcgtgggcagaagcagcaagagagtacggggaactgttggaggacatgcgtgacaagaagcttgctcccaatttgccgtacatgaagtcactctttctgggttggtttgagcccctaagaaatgcaattctcgctgatcaagacctttgcaaggatagcaagtgcaggatgagccatgctccttatttcaatgacttgcccgctgacatgatggctgtggtcaccatgcacaagttgatggccttgttgatgaccaatgctaatggggttggcaccgctcgggtcattcaagccgcttgtcaaataggtgaagctgttgagaacgaggctaggatataccaatttatgaagagggagaaggagaacaaatcatctcatcttgcaccggtagaacaaagtggaaaactgaccgaagagaacggggaaatggaacaaaagcagagcagacttcggaaaagagttgctggtttgatgaaaaaacagaagaagctacaagcgatgggaataatcgggagacaagatgattggaaaacttggggacaagaagctcaagtaaaggttggttctcgattgatgcaactgttaatagaaacagcctacattcaaccgcctaccaatcagattggagatggtccaccagatatccaccctgcatttagacatacccttagaacactttcaaatgagtcacagagggaaactaggagatatggtgttattgaatgtgatcctctggtgcaaaatggccttgaaaagtctgcaaggcacatggtcatcccctatatgccaatgttggtgccacctataaactggacagggtatgacaaaggagcatacttgtttttgccatcgtatgttatgagagtacatggagcaaagcagcaacgtgaagcagttaagagggctcccaagagtcaacttgatcctgtttttgaggcccttaatacccttggcaataccaaatggagggtaaacaaaagggtgctctgtgtgatagatcaaatatgggctaatggaggacgcctggctgatttggtggatcgtgaaaatacatggaaagtgtctgtggttcataggtttttggatatccgacagcttcaagagcccagtcagaccttcttcagagacttcttttgtgaaagcagagcccactttagatcgggaactctgattccatatgagaaaataagggaattttctgaatgtgcttga

SEQ ID NO: 110852 - DNA, 639 bp, Glycine max
  Peptide Sequence Number=SeqID_227630
atgtctgccgtcagtcttgagaacgtctccaaaatctactcgccgcgccgcagcggctggagcaagctcaccgggcgcgcgtccggcgccggtttccaggcgctcaacgatgtcagcctgaatatcgagcacggcgagttcttcggcctgctcggtcccaatggcgccggcaagaccaccctgatttccatcctggccgggctggcgcacgccaccagcggccgcgccaccgtctgtggctacgacgtcgtggccgactacaagtcggcacggcgggcgctgggcgtcgtgccccaggaactggtctatgacccgttcttcacggcgctggtgcaccgcccgcccgtgatcgtgctggacgagcccaccgcgggcgtggacgtggacctgcgccgcaccctgtgggagttcatctcgcgcctgaacaaggccggccacaccatcatgctgaccacccactacctggaagaagcggaggccctgtgcggccgcatcgccatgctcaagggcggccgcatcgtggcgctggacaccacccaggcactgttggcgcgcgtcggcggcgttgacctcgaagacgccttcgtgcgcatcatgcaccaggacgacgccttgcaacccgaagagatttcgcaatga

SEQ ID NO: 110853 - DNA, 1237 bp, Glycine max
  Peptide Sequence Number=SeqID_227631
atgtgtagaaaaggaatcgaaagtggcctatcgatgttccacacgctggagaaatggagtccctctctgagggctggtttcaaactggtttgggtgatgtgctgggggattcctcttcatgcttgggatccggaaaccatcacaaagatcgtgcaggggattggggaagtgatggatgttgatgaagatgtaggagagctccacagattggatagggcagagataagttgtgggtctcacagctgcaactgtaacagaggggattacaaagaatcatctgaagaaatatcatcagagtggagcgacttaggattcaacatccagtcggaggaagatcaggaggacggcaagactccagcatcaaacaatgtctcggatgctgagggagacgcaagggctatggactgtggaatgcaattattgtctgctgggtattacccacactctgcaacaacggttgacactacagaacagcaggagggggacaaggagaatagcagaaagcaaaatatggcagcagaaagtaaccatataggggaagcaggtatcgggctgaaggaagttgtcatgtgggaaggaaactccaaggataaaaaggccacaacatcaacaatttcagcttcaacatcaagaagctggaacgattctaggaacactgatcaacatggaggaaagggaccagagcataaatcagaggaagggaagcaacgtagtgatgcaactttcaaaatggaaaagaaggtgacgggcaatggttacatatatttggaaggtacttgggctggggatggtggaaaagtgactataatcaatatctactccccgaacttcaattgcattagaaggcaatctgaaagagtaggagtgtgtgaaaggagtcagaatgggggcagcatgaaggaattcaatgattggattattgacttggatgttgacgatgtacctagtgttgggagaaaattcacttggaagatcaaaaattacaaaggcaactacaagaggagttatggtgggcagcaagatcagttttatccaagatcaagatggatcatagttgtcaatagcggcccggccgctatcgcggcggagcatggcggagcggtgcgggttgcggaaatagcggccgctatagcggcggggcggagcggagcggcacccattcgcgacggacacgtgtgtagcgacacagtttcgggtcgcggccgctatcgcggcggagcatggcggagcggtgcgg

SEQ ID NO: 110854 - DNA, 678 bp, Glycine max
  Peptide Sequence Number=SeqID_227632
atggacattgttggaggaaacttccttggcctttctccacacatcatagcagctgaactgagaggtcatgagaaattcactgaaaaagtgacaaatagggggttgggaaggtgccaaatagtcgctgatgagtgggaataccagaaggtggctcacgcgccggtgaagaaacggcatgtggcgatggacaacggtgggttaggtggtgttttggtcgtcagagggaggcaactttgggggtgtggtcgtgtcggggtcatggttaaacggcagagaacagcttttcccccaaattttgttcactctcttgatggttctcacatgatgatgactgcagttgcttgtaaaaaagcagggttgaactttgcaggggttcatgattcatattggacacatgcgtgtgatgttgatgaaatgaacaggatactcagggaaaagtttgttgaactctatgatgctccaatattggaaaatttgttggagagcttccaaaagacttttcccgcattgaactttcctcccttacctgaacgaggagactttgatcttcaggaggttttgggtccaatagcatggaatttgtatatatacatgtatatctacatgcatgggattgtgaaagccccaaccatggagaagaaagaagtgtgtgaagcaagaactgggttgccaaattag

SEQ ID NO: 110855 - DNA, 222 bp, Glycine max
  Peptide Sequence Number=SeqID_227633
atgatattattaattctgaaaaagttaatctttaatgcagttacaaaggagtttgggcatggcaaaattgtcttagttcagttccctcttttccttttttttttaattctgcctcaccatcaatttgctgctcttatttttttgaagttgggagctgctgcagtcaatcttgttggtggagaccagcctgctgatgtttactcaggaattgctgccaggtaa

SEQ ID NO: 110856 - DNA, 1656 bp, Glycine max
  Peptide Sequence Number=SeqID_227634
atgacaacaaaaacaacttctctcctcctccttcatgtaattctcctcgccacggcggaagccgccgccgccggcggccactggaaggtcctccagcaaagcatcggcattgtggccatgcacatgcagctcctccacaccgacacggtggtgatcttcgaccgcaccgacttcggcctctccaacctctccctccctgacggcctctgccgccacgacgccgccgagatggccgtgaaaaccgactgcaccgcccactccctcgaatacgacgtctcctccaacaccttccgccccctcttcctccagaccaatgtctggtgctcctccgcctccgttgcctccgacggaaccctaatccaaaccggcggcttcaacgacggcgagaagaaagtccgtaccttctctccctgccccaccaccgccgccacctgcgactggctcgaactcccctccgacaccctctccgcccgccgctggtactccaccaaccacctcctccccgacggccgccaaatcatcatcggcggccgaagacaattcaactacgaattcttccccaaaacccacaccagagccaaaaacgcttactctctccccttcctcgttcaaaccaacgaccctcacgaagaaaacaacttatatcccttcgttttcctcaacgtggactccaccctcttcatcttcgccaacaacagagccattctcttcgacttcaccaaaaacgccgtcgttcgaaccttccctaccgttccacatggcgaccccaggtgctaccccagcaccggttcagctgttctcttacccttacgtaatccatattctgaagctgaggttttagtttgtggcggagccccgagagggtcttataacgaagccaaaaagggtaactttctcggagccttgaatacctgtgcccggatcaaaataaccgacccggatcctaaatgggtcatcgagactatgccaaaggcgagagtcatgggtgacatgattctcctcccgaacggcaacgttttgattattaacggtgccggttcggggagtgctggctgggaattcgcgcgcgatccggttttgaatccggttgtttataacccggataaatcgaccggatcgcgcttcgaaatcctagttgagtcgaacactccccgaatgtatcactccactgccatcttgcttcgtgatgggagggtgcttgtggctgggagcaaccctcacattggttataatttcagcaacgtgatgtttccaacggagcttagtgtggaggcgttttatcctccatatttggaaagtgggtacgatgatgtgcgtccgaggattgtgtttcctgagagtgaagcccgaacgaaagttacgtatggtgagaaggtgaaggttcgggtccaagtggcgggtgggtcgttggttcggagtttggtgcgggtgacggtttcggcgccgccatttaacacgcactcgttctcgatgaatcagaggatgctggtgttggaacctatcaacgtgacaaatattgtgggaggaccaacaccaacgtatgagattgaggttaccacaccgggttcacccgttcttgcaccacccggttattatctactctttgtggtccaccaagaaattccaagccaaggaatttggatccagatactttaa

SEQ ID NO: 110857 - DNA, 1680 bp, Glycine max
  Peptide Sequence Number=SeqID_227635
atggaaggtgttgatcagagtaatatgaatcgaaatagttgtgtatttggttcatcttcatcttcatcatcagggggtgctcttagacccccaaatcgattgaatagtaatgttatgcttattaatcaaatgggtgttactgagaaccagaaaccctatggtataccaccctcacaccctaataccaatatttcaccttcatcagcttatcctcagttttttgcctcccaatcccaatccaattcggtttcccagcgtttgagttctcccaatttgagtcctgcttcgtcccattccaggtctttgtctcagccctcttttttctctctggattccttgcccccattgagtccttccccttataaagaaccttccttttctgactcaatttcgactgatgtgtctgctgaggaaagcttggctaactctcatgcccccttgccgaatcgtggccacgctcttcagcttggccattctcttcctcctcgtaaaggacataggcgctctagcagtgattcccctttaggaattgctgattttattcagtctgtccctcagtctgtttcctctaagacttggagcgaccgtgaaaatttggcttctaggggagggaactctggttttgagaagccgattcagttagtgttaaaggaaccaatgaaggatatggactgcgttgatggctttggtggagaacctatggttgggaggaaagaggatgatgcactggatgatttgtttagtgcatatatgaatttggacaatattgatggcctgaatttttctggtatggaagacaaggatttggatagcagaactagtggttcaaaaacagttgagagcagtgataatgaagttgagagtcatgcatatggcaaagtgattggtgctcaaggggctatttcacgctgttctgaagagaggagggaaggagtgaagaggagttctaatggagacgttgcacctggttcccgacaccggagaagtttctcattggacagctccataggaaattttcatattggagatgaattgcctaagcttcctccttcgcagaaccgatttggtcaacactcgcctagcagttcaatagatggtaagacatctgaaacaagcatggagtttggaaatggtgaattcagctcagaggagctaaagaaaataaaggagaacgataaacttgctgaaattgccatggctgatcctaagcgtgcaaaaaggattttggctaatcgtctatcagctgctcgctcaaaagagaggaagatgcggtacatttctgaattagagctcaaagttcaaacacttcagactgagacaaccacattgtctactcagtttaccaaattacagatgaataattcagagcttaaaagtgagaataatgagtacaaattaaggattcaagccttggaacagcagtcccaactgaaagatgctctgaatgagaccttggatgctgaagtgcggcgtttaagatgcacggtcgcagaacttggtggagagtctcttctctcaagtcgcatggctcaacagcttgctattagccaacaagtgtttcagttaaaggaacagcagcaccctaaccagcttagacatgttcaagtgcacaatacccattcccaggagcagacacagactcagtctcagcgccacaatggcaaagctactgcttactga

SEQ ID NO: 110858 - DNA, 3243 bp, Glycine max
  Peptide Sequence Number=SeqID_227636
atggcggtagataatcccgaggatggattaaagaagctggaatacttgtcgctggtgtcgaaggtgtgcaccgagttggagtcccacaccggcaccggcgacaaggttcttgccgagttcatcactgagttgggtcgatcatcggaaaatgttgaggaattcgacgcgaaattgaaggagaatggcgcggagatgccggattactttgtccgaacgctcctcaccattatccacgccattctccctcccaagtcgaaggattcgaagaaggagaaagacagtgtcagtggcaagaccaccaagttcaaggctctggctatcgcggacaacagggaccgcgccaaggagcttcagaaggagttagaatccgaggccagagaaaagcaaaagccagaaattgaggaagatgatgggtacagagatagaagagataggcgcagagataggtatggaagaaacagagatgaagaagatgttaggagggattatagcagaagaggcagagatagagatgatgaagatgatagaagggattatggcagaagaggaagagatagagatgatgaagatgatagaagggatcacggccgaaggggaagagataaacatgatagggacagagacagagatcgagatagatatgagaggcacaggagagatgagcaccaagaggatgggcatggaagggagaatggagatgaagatggtaataggaagggttcacggcatggttctggtgaacttgaattatatgcagtttataaagggagaatctccagagtaatggagactgggtgctttgtccagttggatgacttcagagggaaggaggggttggtccatgtctcgcagatggccacccggaggattaccaatgccaaagatgttgtcaagcgtgatcaagaagtgtatgtaaaagtgatctcagtttcaggtcagaagttgtctctttccatgagagacgttgatcaacatactggtaaggatctccttccgttgaagaagagctccgaggatgatgcaatgaggatgaatccgcaggattcaaaaggtgggcctgctgccaggacggggctttcaggtatcaggattgtggaagaagatgatgctggttcttcacggagacctctgaaaagaatgagctctccagagagatgggaagcgaaacagttgattgcttcgggtgtcttgagtgtttcagagtatccaacttatgatgatgagggggatggattgctgtaccaagaggaaggtgcagaggaggagcttgagattgagttgaatgaggatgaacctgcattcttgcaagggcagagcagatactcaatggatatgtctcctgttaagatttttaagaatccagaaggttcgctgggtcgagctgctgcactccagtctgcacttataaaggaacgtagggaagtgcgagaacaacaacaacgcacaatgcttgattcaattccaaaggatctcaatcggccttgggaagaccctatgccggagtcaggtgaaaggcatcttgcccaggagcttaggggtgttggcttatcagcctatgatatgccggaatggaagaaggatgcctatgggaaaaccattacctttgggcaaaggtcaaagctttctattcaggagcagaggcagagtttgccaatttacaagttaaaaaaggaattgattcaggctgtgcatgataatcaggtcttggtggttattggagaaactggttcaggtaagactactcaagtcacacagtatcttgctgaagcgggttacaccacaagaggcaaaattggatgtactcaaccccgtagggtggctgcaatgtcagttgcaaagagagttgcagaagagtttggttgtcgattgggagaggaagttggttatgccattcggtttgaggattgcactggaccagataccgttatcaagtacatgacggatggtatgcttcttagggaaatattggttgatgagaatctgtcacagtactctgttataatgcttgatgaagcccatgaaagaactatacatactgatgttctttttggactgctgaagcagctagtgaagcgtagacctgaattaagattgattgtcacatctgctactctggacgctgagaaattttcaggatatttctttaactgtaacatctttactattcctggtagaacttttcctgtggaaatactatacactaaacagcctgaaagtgattatttagatgcagctttaatcactgtcctacagatccacttgacagagcctgagggagacattcttctctttttgactggtcaagaagagattgattttgcttgccaatctctctatgagagaatgaaaggattaggtaagaatgttccagagctgatcattttaccggtttatagtgcccttcctagtgaaatgcagtctaggatatttgaccctgctcctcctgggaaaaggaaagtggttgtggctactaacattgctgaggcttctttaactattgatgggatattttatgtgattgatcctggatttgctaagcaaaatgtttataatccgaagcaaggacttgattctttggtgataactccaatttcacaagcatcagccaaacaaagagctggacgtgcagggcgtactggacctgggaagtgttatcgtctctacactgagagtgcatataggaatgagatgtctcctactacaattcctgagattcaaaggataaatctggggatgactactcttaatatgaaagctatggggataaatgatctgctgtcttttgattttatggatccaccatcaccccaagccttgatatctgccatggagcagctttacagtcttggagcactcgacgaagagggccttttaactaaattagggaggaaaatggcagaatttcctttggatccaccgttatctaagatgttgcttgccagcgtggaccttggatgcagtgatgagattttgaccataattgccatgatccagaccggcaatattttttacaggccaagggaaaagcaagcccaagcagatcagaagagggcaaagtttttccagccagagggtgaccatcttaccctacttgctgtttatgaggcttggaaagccaagaatttttccgggccctggtgttttgaaaacttcgttcaatcccgatcattgagaagagcacaggatgtcaggaaacaacttctcaccattatggataagtatgatatctatctattcttctaa

SEQ ID NO: 110859 - DNA, 174 bp, Glycine max
  Peptide Sequence Number=SeqID_227637
atgtcatgctgccttggttcaaataacgagcatttcatcttggaaagcaagaaagctgatcttgctttgaaggttaatagtgcatctttcaatggggatatgtatcagctaagaggtttaattcgagctggagttgatcccaacaaggaagactatgatggaaggtcacctttg

SEQ ID NO: 110860 - DNA, 336 bp, Glycine max
  Peptide Sequence Number=SeqID_227638
atgtggagattgtgtttaatcacatacatgtttattaaggctccaaacctaatagcagaacctagaaagggcagagttgagaggactgaggtaaaaaaaacattctggaaaggatgcaggacgcaacttggagaaggtgcaggaagcaacagccgactcacatatgacccacatgaaatttacctactagcatccacttcatattccttgttacctaaatttacttctcaagcccaatttgctgcaaagaagcttgtcttagcttattgggccatggaacttgggtgcttaataattactccggaaatttttaccaggcttaaggccttgatttga

SEQ ID NO: 110861 - DNA, 153 bp, Glycine max
  Peptide Sequence Number=SeqID_227639
atggcatggaatcatcagggctcaggaggagtgagctcatcctacccctctgctgctgctgctggctcctctggttcaggctcctgggctgcagaggccccaccccctctagaaggagaaggttgggctcctggccaggccacctgcgcttaa

SEQ ID NO: 110862 - DNA, 489 bp, Glycine max
  Peptide Sequence Number=SeqID_227640
atggcttccgtggaagaaaagattaaaactggaggaggaatgattgttggtggtcaaactcttgctgctgagatgaaactgttgaaagaaatgcaggaacattctggggtcagaaagactttgaattcagagttatggcatgcttgtgcaggccctcttgtgtcattaccccaggttgggagccttgtgttttacttccctcagggacatagtgagcaggtggcagcttctactagaagaacagcaacatcacagattccaaactaccccaatcttccatatcagttgctgtgtcaagttcaaaatgtcacacttcatgcagacaaggagacagatgaaatctatgctcaaatgactttgcaaccactgaattctgaaagagaagtctttcccatatccgactttgggcacaagcacagtaaacatcccagtgagttcttctgcaaaactttgactgctagtgacacgagcacgcacggtggcttttcg

SEQ ID NO: 110863 - DNA, 438 bp, Glycine max
  Peptide Sequence Number=SeqID_227641
atgggaaggggtagggttcagctgaagaggatagagaacaagatcaatcggcaggtaactttctccaaaaggagagctgggttactcaagaaagcacacgagatctctgtgctctgtgacgctgaggtcgctttgattgtcttctcccacaaaggaaagctctttgaatatgccaccgattcttggtgtgacagtattttgttacttgtcaagctcattttcgagtctcgacctcagagtatgagctggttcattaacacgtatttacacatagctaggtgtcatgctcattttgaagctcaagtcctttcacgccctttcacatatcatagcctggaagcaagaatgttgcatccttttctgtttaatcggggactagtatgcttgtccctttcagcagctgatgggtgcagtttcctagatgaacggtgtacataa

SEQ ID NO: 110864 - DNA, 525 bp, Glycine max
  Peptide Sequence Number=SeqID_227642
atggagaagatactggaacgctatgaaaggtatgcctatgcagagagacaacttgttgcaaatgattccgagtcacagggaaattggaccattgagtatactagactcaaggcaaagattgaccttttgcagagaaaccataggcactatatgggagaagatttaggttcaatgagcctcaaagagcttcagagtctggagcagcagttagatactgctctcaagcaaattcgtacccgcagaaaccaactcatgtacgagtccatttcggagcttcaaaagaaggagaaagtgatacaggagcagaataacatgcttgcaaagaagatcaaggagaaagaaaaggttgcagcgcagcaagcacaatgggagcatccaaaccacggagttaatgcatctttcttgctaccgcagccacttttgaacatgggtggcaattaccgtgaggaagcatcagaagtagggaggaatgaacttgacctgactctggaaccattatattcctgtcaccttggatgcttttga

SEQ ID NO: 110865 - DNA, 231 bp, Glycine max
  Peptide Sequence Number=SeqID_227643
atggtgctagaacttttattcagagatgtttttgctggtatcgacccagatttagacgctcaagtagaatttggagcattcccaaaaacttggagatccaactacaaaaaaacagtaatgagcccccaatatggagggctcattacttcaactagtccccatgttcttcaaatggatctcttagttgttgcgagggttgcccaaaggcaatatataaggcatacccagtaa

SEQ ID NO: 110866 - DNA, 246 bp, Glycine max
  Peptide Sequence Number=SeqID_227644
atgttacaaaactttacagattgcgcattaacgcttcctttcgattcccgacatgtcacggaacttcacggattgcctaacgatgggtgtcaagtacctcgaagtggtcaagcgaaggttgcatcccaccaaacagatggtcaccggacgaaattagagtatgacaagcgtcatgtgatgatagttctaacaagcttttctttgtgggttgatgaactctgtcgcgtagaatggcatgatcgctag

SEQ ID NO: 110867 - DNA, 285 bp, Glycine max
  Peptide Sequence Number=SeqID_227645
atgtctcctcaagctctagaaacctcacaatcactcaaagtctcatccaatgctccacaagatagcttcctcttcaagctcataatgctcgctcagccaggaggttcaagcggtgcgcttagcgaattgattcttgctgagcacatcattgacaactcatctgcttctaggatcttccacgcgcttagccatgatctgttgcgctcagcggatggctcgccccgccagagaattggcttagcgagcggctcaaaatcagcacttccaccaaacttgcctaattag

SEQ ID NO: 110868 - DNA, 438 bp, Glycine max
  Peptide Sequence Number=SeqID_227646
atggttgttgagtatcgtggtgtgcacgtaaggcctagtgttggtgatctgagggaagaaaaataccattcagaaggctacatttatttaaaaattatttgtgattatgcacaaaatgcggtcgagactacatttttagctactgccatttgcaaatgtggtggaaatgaggagaaagggaaaacactatacaatgcatacagattgaatggacagcgactttctgtttgcatgaccacatggaccatgtgtcgcaacctacccatcagcgggaaggcgacgcgagggctcatgggtgcgtcttccaagggaagaaggcgcacggagtctccacaaatgtttattcagggaaaacatcgagaaaaccaaaacgtgtggtctatgaactttaagtgtgaaaggttcgggagttgtttttacgcacagggaaggtattag

SEQ ID NO: 110869 - DNA, 882 bp, Glycine max
  Peptide Sequence Number=SeqID_227647
atggttatcagcttatgcttgccaatagttcttacttcacatgaagtggaagacattcttacacaaggactgattagaccttattttgaattcataatcaagttaagcaagactagagtactccacgatgggaacacaacaaaacacgtgagatcaatatgctatgctttcttgttattgctgagtttcagaccactcattacaaaggcacaaacaccgatttacgctggaagttattgccaaaacaccacccaaccacctctcagcagtgcataccaaaccaatcttaatagaatcgtcacatggatgtcctctgatgcagctacaagcaaaggttataactacaccagcataggcaacaacagtcctgcgtatggcctctatgattgccacagtgacgtggttggatacttttgtcaattatgtgtttctactgctgccagagaagttcgtctgcgctgccccaataggatttctgctgtagtttggtatgattcctgcattctaagacatacccaacatggcatcacatattttggaacaaaaaacatatccaacatggaagagattcagaaaggtgaggattttgtgagaagtttgatcagaaaagcaactgtggagaccaaccagctgtactatatggaaggcttcaatgtgagctcctctcagagaaggtatggctgggtgcaatgcagtagagatctctcaaatgaagggtgcagacagtgtttggaggccatgttagcagaatatcccaaatgttgtgaacaaaagttgggatggatggtttggtgtcaaagttgtctgataagatatgaggatcatatattctaccaacttaaccaaaaagtggcgccgtctgtggggacgggatcaagataa

SEQ ID NO: 110870 - DNA, 585 bp, Glycine max
  Peptide Sequence Number=SeqID_227648
atggcattagcagatgtcattaatactcaacaaacagcaatgacctcccaagtagacagaggaaaactatcaacaatatctgcaggatatgttgatctaagaaacgcttctgaaacatgtgcatattaccaagctactatgtggaaaaatatactttattcacagctgttttcgaagataaaagaaatgcttgatgaatacagtatgtttgctaagtcttttaggctgaccgaagaaagatatgataactatcagataaagaatcttaatctacagttgattgcagacaggaaaaagaatggaaggatttataatttgcccacagtttcaaaggtggttgcaattattgttgatgatgtaagtcaacctatcagtcgagacataatacttgaaaaacaaagtgggcgattacaaagaatcaacgagcttcatccaagttatcttggattgaaacatcctttaatgtttccttgtggtgaagatgggtactgcagtgatatcaaccatagagatttggatgattctcatcaaagaaagagaaacagactaactaacatagctccatgtggagcttttaggccttag

SEQ ID NO: 110871 - DNA, 255 bp, Glycine max
  Peptide Sequence Number=SeqID_227649
atggatagtatcaacaagtctacaaaatggcggtgcgcgaaagagaaaacctcatcaaaaccccaaaacccaaatatagttggccaaggcggcgctcgacggtgtgaacacccttactcaccaccgacgctgaagtcgagtacaacaacgacaacaggcgtgggagtgacgacgagcgagaccacgagatcgatggtgagggagactgcgagagcggcagtgagggacactgggagagtgacaaggagggactag

SEQ ID NO: 110872 - DNA, 504 bp, Glycine max
  Peptide Sequence Number=SeqID_227650
atgtggctgatacggtattgtgtgaactcattgacaaggtcaggtagcacaatttggactatttcttgggtggccaatcaatctgcatctaggcgtgatggtggtagtgatgaggatcctgaagtagcaaagtttaaagagcaagcatatgcaccatctgaagattcaagacaatatgaagaattcaacacaagaacagaagagacaaatgataacattgattataacactgacatggaagtgaatgagcctgagatagacacgacaactcaaaacacgtcttcggcaaaggaaaatggacagaggaagagaggtgtatctgctcaagacccaactagcattactgcatgtgtagcaaagttgaaagatctaccaggacttgagcgtgggagtgaactattttacaaagccactaaacttatgaaaaaaagggcaaacaaaatcacctttgttgctttagaagagcctgagctacaacttggatggatcaagtctgaaacttaa

SEQ ID NO: 110873 - DNA, 729 bp, Glycine max
  Peptide Sequence Number=SeqID_227651
atgaggagaagaataatgaagttcctcaacatttctgacaatgactacttcatggttttcacaacaaacagaacctcagcttttaagcttgtggcagactcatatccattccaatctagcaagaagcttctgacagtttatgactatgagaatgaggcagtggaagcaatgattagttgctcagagaagagaggagccaaggcacatagcagcacctgcaaaaccaaaagaaggtgtttggatcaagtggactctttgggattgataatgatcaccaatagaaggaggtaccttataaattggctggtgaactccatgatgaagctgaagcaccctaatgcagaggggggacctgctttggctttcaatgtgtttgattggaaaggtgaaaaggttgagcctgtccttgtacagaagcttgctgataggaacaatatatctctcagctatggatttctccatcatgtttggtttgcagataagtatgcagaagacaaggggaaagttctacagaccaaagaaggaagagtccaaggagttaccaccaacaagaagaaagatagagatgagctaggagtaactatggttactgctgcattaagcttcctggctaattttgaagatgtatataaactatggacttttgttgccaggttccttgatgctgattttgtggagaaggagagatggagattcacaactctcaatcagaaaacaattgaagtttaa

SEQ ID NO: 110874 - DNA, 5718 bp, Glycine max
  Peptide Sequence Number=SeqID_227652
atggacggagaggatattaggtctgggaccaagaagaagcgatccaagaaggaaattggtttcgacgacgatgacgagcccattgggtcaatctttaagctgaagaggtccaagaagaagggtagtggtggtagtagtgatgctgctgttgttagggagaaagaggatttggggggtatggatgataatgataccttggctagctttaggaagaggttgaagggtcctaagagagatcagggatctggggtcacaagaggagcaagtcctgctttgcatgtgtcggatgaagatttggttgctttgggacctaagggtaaggatgagaaagtggtggtgcccgtgcctggtgatgaggacatgcagatgcagggttgttctgatcaacaacacatggaggattcattgtccgcgattttcaataaggcacagtttagttctaccaggaaatctcgtggcaggggttcaaggcagaaaagggggattcagaatgtggatagtgaaggttttgtggaaactgtggattctgtggttggaagtagatctggatctgcttttggctcgaaattggttgggggaaatgtcgagtctgcggatgctttgcctcaagcatctgaaccggttgttgcatctgtggtggatgaccagaagtgcggtgatgactgttttcaagaggaagctgtgaagggcaatcgtaatttggacattccagatggaccatctcagtcgagcaatgtctgccatggatataggcagcaattgtcttgtgtacaagttggagatatttcttgtcattctgaccaaaaggttggattgcaggaaagtgttctcagtgatggtttaaataagttacctaccacgtcgcatgatgtctctctctcaaaagtgggggaaggcaaaagaggatttactgagataggagagtcggagaacagactgacggatgaacaagcaaaagtgtgcaacagtgcttcagaacctgatgtttctacttctgctggggaaaaaaatgtcttaacttcttgccacaccgaacccttgattaaatcaactgaaaatatattgaatgagaataataatatggttgctagaaaagttttccaggaatcctcatgtaatggagctctgaagttatctggatgccatatggaagtagatggaggtggaaaatcagaaactgagattgtttctgatagaaatttctgtgattatagtagttcagatacaaaggctgaagtgcaagattttgttttagggttttcacctaaaacaaataatgtaacggtcagtggtagtttatcttctatggtgtctaatgaagccaataaagctgaattgactgcccattcaaatcacccagagaaacctctagaagcttgcaatattccaaaagactatactgcttcaattctgaaatgtagttcagtgttagatccaattcaatctgatggatcatctcttcagtcttctattccagatgaaaatgggaactctgcagaatactgtgcccctgcgtctgattttgctgataacgagggtaagatatcaagcattccacgggcggtgcgaaaggccaaaatgcgtaagcatggagacatgacatatgagggagatgctgattgggaaattttaattgatgatcaagctctaaatgaaagtcaagttatgacagatggtgaccgcactcttagagcaagattgaagcatgattcctctttgaatactggtgaagactctgaaaatgttgctgttgtagcagtatcagctgggctgaaagctcgtaaagttggtccaattgagaaaataaagtttaaggagatcttgaagcggaaaggtggtcttaaggaatatttagattgcagaaatcagattttaagtctttggaacagagatgtcacacgtattttgcctcttgctgaatgtggagttagtgatactcattctgagcatggaagtcctcgtttttctcttattagggaggtctatgcatttctcgatcaatatggttatataaatgttggaattgcctctcagaaggagaatgttggaagtagtgcaaggcattgttatagactggtaaaagaaaagggttttgaggaaagtctcgcagcttcaatggctgaccctgaagatggagtttcctttcttgttggtcagaccaaaatgtcagatacttccaatgagattaacaatggtctaacaaaggattgtgatgacctaactactgaagctgcagaaggcatgaggcatgctaatgaaatgaagacggatttatcaaacatgacacaccaggcagaaagaaaaaaaattgattaccaggaaaatgacagttctgttccgtcttccaacttccctgattgcagattgacttctcaggtagctgaagagaaaatcaatgactctaccagcataaaatctgccttagatgctctggtaggtgatcatctgcagtctgatttagatcctaggaagagagtaattgtcattggagcaggtcctgctgggctaactgctgctcgccacttgcaacgtcaaggatttgctgtaactgtgcttgaggctaggagtaggataggaggtcgtgtatttactgatcactcgtcactttctgtccctgttgatcttggtgctagcattataactggtgttgaggctgatgtggccactgagagaagaccagatccttcctcattgatttgtgctcagttgggtcttgagttgacagtgttgaacagtgattgccctctttatgacatagtgacaggacaaaaagttcctgcagatatggatgaagcactagaagctgagtataatagtcttattgatgacatggtattggttgttgctcagaaaggggaacaagcaatgagaatgtctcttgaagatggtttagaatatgctcttaagattcgccgtatggcacgctctgaaagcagtgaagaaactgaacaaaataattctgcagatagtccgtttgattccaaaaaggacagtactgtggaaaaaaaatttggtgaggagattttgagccctcaggaaaggagggttatggattggcactttgctcatttggagtatggttgtgcagctttgcttaaggatgtttctcttccctactggaatcaagatgatgtgtatggaggttttgggggagctcattgtatgataaaagggggttacagctctgttgctgagtctctgggagaaggacttacaattcacttgaaccatgttgtaacaaatgtgtcatatggtatcaaggaacctggccagaataataaagtcaaagtttctacagcaaatggcaatgagttctttggcgatgctgtccttgtgactgttccacttggttgtttgaaggctgaaactatacaattctccccacctttgccacagtggaaatgttcttctgttcagcgtcttggttatggagttctaaataaagtggttttggaatttcctagtgtattttgggatgatgctgtggactactttggagcaactgctgaggagagaagcagtagaggtcactgctttatgttctggaatgtcaggaaaacagttggggctcctgttcttatatcattagtggttggtaaggcagccatagacggtcaaagcttgagctcttatgatcatgttaaccatgcattgaaggttctccgtaaactttttggggaggactcagttcctgatcctgttgcatatgttgtcactgattggggtagggatccttttagttatggttcttattcttatgttgctgttggagcatctggagaagactatgatataatagggagaccagttgataactgtttgttttttgctggtgaagcaacctgcaaagagcacccagatactgttggtggtgcaatgatgagtggactacgagaggctgttcgcataattgacatattgagcagtggaaatgattatattgcagaggtggaggcattggaagctgctcggggacagttagacactgaaagggatgaagttagggatataataaagagacttgatgcattagagctttctaacataatgtacaagaactctttagatggtgctcaaattttaacccgggaagctttgttaaaggaaatgttcaataatacaaaaaccactgctgggcgcttacatgtggccaaacaattgctaactcttcctgttggaaacttgaagtcttttgctggaagtaaagagggactagccattctcaattcatggatactgattaggaacttcatgattcatatctcaatgcaggactcaatggggaaggatggtacccaactcttgaggcactgtttgcgtctacttgtccgtgtttcgactgatcttcttgctgtacgattgtcaggaatggggaaaactgtgaaggaaaaagtttgtgtacatactagccgtgatattcgtgctatagcaagtcagttggtcaatgtatggcttgaagttttccgcaaggaaaaagcttctaatggtggattgaagatatcaagacaaacaactgctgtagatttatcaaagagaaaatctgtgaaagattcagcctcgggaaagccacctctgagcacatatcatggtaccattgagaataaaggaggcttgctgaatcctacctctgctggaagcaattcagcttccactgcacatgtgaagaaattgcacagcaaacaaggaagacaaccagcagcatatgactcaaggcatgaggtcagttcgtccaggtctaaaggttcaatagacacagtagttgctgagaaggaggataacctctgcactgtatctgaagaagaacaggctgctatagctgctgctgaagctgcccgtgctaaagctcttgctgctgctgaggcatatgcctctgcagaagccagatgtaatacgctgttacagcttccaaagataccctcattccacaaatttgctagacgtgaacagacttcacaaaatgatgagtatgatagtagaaaaagatggcctggtggtgtctatggaaggcaggattgtatttcagagattgattctaggaattgcagggttagggactggtctgttgatttctccgctgcttgtgtcaaccttgataattccagaatgccagttgataatctctcacagaggagtcattcaaatgagattgccagccatttgaatttcagagagcactcaggagaaagtgttgctggggacagcagtatatatacaaaagcttggattgatacagctggtggtattgcaattaaagaccatcacgccatagagagatggcaatctcaagcagctgcagctgattcttatttttctaacccaactattcatttgaaggatgaggaggattcaaatgcctgttcaaagttacccagctggaagcatgatggtattgcaaatgagagctctatttcacaggttactgtaagtaaggaggctcaaaaaggtcattcacgaggagcagatcacattaaacaggctgttgtggactatgttgcatcactacttatgcccctgtataaggcaaggaaactagacaaggatggatacaaggctataatgaagaaaagtgcaacaaaggtcatggagcaagccacagatgcagaaaaagccatggctgttcgtgagtttctagattttaagcgaaagaataagattcgctcctttgtggatgtattgattgagagacacatgacaacgaaaccagacatgaaatcttaa

SEQ ID NO: 110875 - DNA, 255 bp, Glycine max
  Peptide Sequence Number=SeqID_227653
atgtgggctgatgggttaagtcacctagctcgacctaccgtttttggtgagctagcaggcctagtgccatttcaatcactcccatttttcactcagacttcactctcacctcactcagtcttcagtcgtgcccagttcgccgtcgcaaaggcaccatcgtgcctagttcgtcatctaggagttctccatcaccggctcatcgtcgaaggctttctcagtcatagggtcgttgcacatgccgctgctgtcacataa

SEQ ID NO: 110876 - DNA, 288 bp, Glycine max
  Peptide Sequence Number=SeqID_227654
atgaagaacttgtggctttgtttcagttacttgtttcctgcagcaatcattcttgttctgcttactccttccgcggttgcacaactctcaccaagtgagggtagaattctattccaagttcagaagcttcttgagtaccctcaagcccttgaagggtggaatagatggaccaacttgtgcttcttcccttcctcacattccctcaagatagtttgctccaatggtcatgtcacggaacttacaatcattggaatcatatgctgcatatatttctcctacactaattaa

SEQ ID NO: 110877 - DNA, 150 bp, Glycine max
  Peptide Sequence Number=SeqID_227655
atggatgccctaagagctttatggagtgccgcatttcctgaagaagaactccatggcttgatttctgagcagtggaaggacatgggctggcaagggttgatgtggggggaaaaatctaataagcaacaatttagccgaaatcctttgtga

SEQ ID NO: 110878 - DNA, 432 bp, Glycine max
  Peptide Sequence Number=SeqID_227656
atggataagagcttgaaggtaggagaagatgagtggagggagagggagagaaggagcatgggattttgtgcctcaaataagaaaacaaagacggtgatatacaaacccgtctttgaattgcggaaacactacttcgacgatgttgctttggtgaacactgtggtggttggtgcggcattatcacgtgactggaacaacactctcgtgacctcaaaagacttagttgcacgccctagcaagtcgaacaacactctcgtcactcagttaatcgtgactcacctctctcccttcctcggtcatcatcactcctttgtcaccccgacttacagtggtcatcgtgactcaggtcactccttccgcggtggtgcacccctagcctatcgtgactcaggtcaccccttcccgtgcgtgtttgcccaaactaaaccctag

SEQ ID NO: 110879 - DNA, 222 bp, Glycine max
  Peptide Sequence Number=SeqID_227657
atgtgttcagaggttaaacaatttttttacatcgctgctaaggcgaggaacgatgtagaaagcgcaccttactacatcgctgacgttgggcccgttgtagaaagcgcaccttactacatcagttctgacgtagacactgatgtagaaaacaagttttcaaactcgttgttgatgtcatcccagtattcgaaagtcatccttctacatcggtggtttggatga

SEQ ID NO: 110880 - DNA, 597 bp, Glycine max
  Peptide Sequence Number=SeqID_227658
atgacggacaaaagaaaagttttaggaaaaaataatgaggaaacaagaagttattttacatggaatttggaaatggaacgtatattggctgatgtacttagagatcaaaggaatttgggcaacaagggtgacgaaggttggaaagataatgtcaaaaaccgtatcaaattattatggagatcgtggtatggtattgtaagtgacatccttggccagagtggatttgattgggatggcactaagcacatgatcacagttgagaatgaaaatgcttggaatgaatattgcacttcacataaatcggctaaaccatttcgattcaaggtgcttcaaaactgggatgatatagtggatttgtgtgctaaagatagagccaccggtcatggagctgaaactgctatggatgctgatgaagcgatgagtagagaaacaaatgaagtggaattcatggggttaggtgctactgccatagatttagaagaaccaagctctaatacaaaagaaaaaagacaaggttcgacttcttctggcacacatcctcacaagagaaagatgaaagatgggagaaaaagaagaaataacagcttctttggataa

SEQ ID NO: 110881 - DNA, 156 bp, Glycine max
  Peptide Sequence Number=SeqID_227659
atgggctcaaaaatttaccctaaggttcatgagaatcctaggactttcttcagcagttctagctcaatcattttggagtctcttgctcatgactctggacactcatctagtaataccttttggctcatgcgctcagatgttaggataactcaatga

SEQ ID NO: 110882 - DNA, 492 bp, Glycine max
  Peptide Sequence Number=SeqID_227660
atgtccacgctcctaggaggtttctttcatagactgccaacaaacttgtcaggtcataaggtgatgaacatgaaatgtagcgtgacctcgggattgaaattcctgatttggacaacgaggcgaccaaatctgtctataaatttgcagagtgactcgtcgtcttcctgttgtagactagctagagcagcaaaagttgggagtatagaggttatccaggctgaggaacacatccaggtgtttatccaggttggtggtcccgtcataatgttccaggttgagcggtttccaaccaagagggtgcaattcacattgggtgtgctcgtgaattgtgtggccgaagggagatttttaccatggctccacagtgggcaccaaatgtacttcctaaaatttggagccgatttgacgtcaggattgtctgctgtcataatacactctagtgattcccttgatggtggactcgcaggtatcctccatctgatgctcaattaa

SEQ ID NO: 110883 - DNA, 270 bp, Glycine max
  Peptide Sequence Number=SeqID_227661
atgtccctcctcctccttctcccccaccatatcctattcctccacctcctccttgttagcatcagccttcttgttgccaaagaagagaaggtaaaagctactgatgactcgcttagcgaggcagtttggcttagcgaggcatccagctcgtttagcggatgggaaaccctagaagaggataagttagagatctgtgcgcccagcgcacaaccagcccgcctagtgaggatgttgtctcttctcacgcttagtgcgcccaagctcacttag

SEQ ID NO: 110884 - DNA, 900 bp, Glycine max
  Peptide Sequence Number=SeqID_227662
atgatgtttgacaggctggacaaaagtgtgagaaaagagaaactagccctaggatcaactcacacaagtcgaacaagagacaaaaataggacacacgttagcctcttccaaggggagcaaggtatcacctacaaaggcgtgacctccaaccccaacaagagcaaaaagatgaacccactcaatagattaaagaagcgtcatcttcatgccatcaaagatcttgatgtcaactatgtcaacatacaatcactgagaagtcttcctcccatagccttcaccaacagagatttcaaaggcatcaaccccattaaccaagacaaccatatggttgtctctattgtcattgctaacttcatggtgtctaaagtccctatctaccaaggaagttaccctgggaagagagtggaaaccagaggttacatggacctgatgaccaccttctgtctgggcaagctctcatggagtttcactataagatatttggttgttgatgcaaacacttcttattttgctttgattgggaggaaaacattgaatgagctcgaagccatagtctctacaccacatctcaagatgaagatccctaccttgattggagaaattgtcactatcaaggtaggccagaagcaagcccaacaatgctatgctgtgagcctaaaggtggcctcttatcctcccatcagagagtcaagcaagcctcattccccctttggtggcagcaatagtcaagtcatgagcattgtcgaagaattccccataaggaccctaaccctctacaagacaaccaggggtaatcctgatgacacatttgacgtagatcctggggatgacaccatcgacaaaggcctaaaaccaatagaagatatttttatgctacaacttggacctaaacccggataa

SEQ ID NO: 110885 - DNA, 300 bp, Glycine max
  Peptide Sequence Number=SeqID_227663
atgaagtcattcacaagttgtttacagaactggcttattggtacaatatccaaaaaggcttttatagggccaagtcaaaaactaactgattttgatatggcttcttattcatttccatcttctgaaaggttttgcttaatgcctatgagttatttggaaaacaaagaggaggacaaggattcaattgtgattttcttgcttgacatgctggagattgtgagcaaagacataatggatgaagacattgagggtttgctagattcaagccatggtgggtcttacggaaaagatgaaagataa

SEQ ID NO: 110886 - DNA, 222 bp, Glycine max
  Peptide Sequence Number=SeqID_227664
atgtctcctccacctctaggacctcacagtcactcacaaacttatctcaagctctcaggacgacttccttttcaagctctgattcgtcctcgcgctcagccgaggagtgttgtgctcagcggatggctcgctaagccagtagattggcttagcgagaggttgaaaattagcacttcacaaactcgcccaattaacctgaaattgagagaaaatgattattaa

SEQ ID NO: 110887 - DNA, 996 bp, Glycine max
  Peptide Sequence Number=SeqID_227665
atgactaagttcatgaggcctactctagagattgaaggccttgtggctgaaagcggattaagtcctttgatcgcatgttccctagatacgggcgatcgaggactaatgtttgcttttgtggaatgctggtataaggaaactagtagttttcatttgtctgtcagagagctgactatcaccttggatgacatggcgtcattgctacatttgcctattatagaggtgttccacaacttcgagcaacttcatgtcgatgacactatcgatatgttggtggaattacttaagagtgggacttacgcttggggcgctgctacacttgtgcatatgtatgataatttaaatgtagcgtcaaagagcacaatgagacaacttgcaggatatatgactttgttacaatgttggatctacgatcatttcctgtctattggttttgcactagctatcaaggattatgacgagaggagaccgcgtgcatgccgatgggcctctggcaaggcactactcgtgttgacgtatcgtaggcatctggatagactggcccctgatgttgtgtgtaggattccgtatggtgaccatcattcatttagaaaatttgagtttgggtacatccaaactattccaccacatcctattgcgccttcgacttctcttgaagaaatggatgctagatggatgcagttcagtgactacattgcacctgtatggcaaatttgtgtagtgcctaaccattgtttgttagattacatagagtggttctacatgatttcacattcatttatgactccagcacaaccagcagatcctcctagagttacgctggttcaacaatatgacacatttgttgaaccaaatgtgcatcagcaatcggtcgcgacagcggcacctgatgaagcagacgttgatgtgcattgtcctggacatgcagtggatggttatgtagcaattgctgataagttggagaggctactgaacctgagtatcctgactgaatga

SEQ ID NO: 110888 - DNA, 1626 bp, Glycine max
  Peptide Sequence Number=SeqID_227666
atggatgcaacactactcaatgtgaaatcagtatattcctttgctgtcctgctattgctaagcatcaaatcacttgatacaaaggcacaatcaccaaactacatgggagatgactgccataacaccacccaaaaacctctcagcggtgaataccaaaccaaccttaacagcatactctcatggctatccacagatgcagccacaagcaaaggttataaccactacagctttggcaacaacacctctggaaatcatgctgtgtatggcctctatgattgccgcggcgacgtggttggatacttttgccaattctgtgtctctactgctgccagagaaattcttcagcgctgccccaatagagtgtctgctttcatatggtatgatttctgcatgctaaagtactctaatgaaaacttctttgggaatgttacagtagacccatcatggcatgttgttggaacaaaagatgtgtctagtgcagaagagattcagaaaggtgaagattttatgagaagtttgatcagaaaagcgactctggtgaccaaccagttgtactatatgggtggcttcaatttgagttcctctcagagaaggtatggcttggtgcaatgcagtagagatctcacaaatgacgggtgtagacaatgtttggagaccatgttagcacaaatttccaaatgttgtgaaaaaaagttggggtggtttgctgggtctgcaagttgtctcatgaagtatgatgactccatgttctacctttttcacaaccaatcatctacagttcctgaggcatatagaaaaatagctaaacaagggattaagatgtcaaaaatcttgatcattagcttcagtgtgattgggtcaataactctactatgtttcagtgtttattgcttctggtgcaggagtcgtcctagaaaagatggacttatacctcacacagttcgtctatcctcatatcaaaatgttcaaactgaggaaacattgaatccagacctgcctacaatcccattaatcacaattcagcagagtactgataacttttcagaagcatctaaactaggggaaggtggatatggccctgtttacaagggaattctaccagatggaagacaaattgcggtcaaaagactctcacaagcttctggtcaaggctcagaagagttcaagaacgaagtaatgtttatagctaaattgcaacatcgcaaccttgtaagacttttggcatgctgcttggaggaaaatgaaaagatacttgtatatgagtatttgtcgaatgcaagtctcaactttcacctgtttgacttgtgtatggagacaagtcaaagagtgctggtacgggcacaagtggttgtgagtatggtggaaatttattgtatattgtcagaagatgatgagaagaaaaagcaacttgattggaaactaagattaagcattatcaatggaatagcaagaggtattttataccttcacgaggactctcgactcagagtaattcatagagatctcaaagctagcaatgttctattagaccatgatatgaatcccaaaatatcagattttggactggcaagagcattttcaaagggccagaaacaagcaaatacaaaccgagtaatgggcacttag

SEQ ID NO: 110889 - DNA, 2013 bp, Glycine max
  Peptide Sequence Number=SeqID_227667
atggagggaaaactactaaatgtgagatcaatatattcctttcttttcctgctattgctaagcttcaaaccacatgttacaaaggcacaatcacccaactatgtgggagatgattgccaaaataccacccaacaaaaagctctcagcagtgcatacaaaaccaaccttaacagtgtcctctcatggctctccacagatgcagccacaagcaaaggctacaaccacaacagctttggcaacaacacctctggaggagatgcttctgatgctgtgtatggcctctatgattgccgtggtgacatagtcggatacttttgtcaattctgtgtctctacagcttccagagaagttcttcagcgctgccccaatagagtatctgcaattgtgtggtatgatttctgcatcctgaggtactctaatgagaacttctttgggaatgtcacagtgtatccatcatggcacgccgttcgaccgaaaatcgtgtctagtaaagaagagattcagaaaggtttggattttatgagaggtttgatcagaaaagcaactgtggagaccaatcttttgtactttatggatggcttcaatttgagttccactcagagaaggtatggcttggtgcaatgcagtagagatctcacaaatgatggatgcagagagtgtttggaggctatgttagcacatgttcccaaatgttgtgaacaaaatttggggtggcaagttttggctgcaagctgtctcataaagtatgatgattatattttctacctttttcgcactcaagcatctgatacacaaacagccaaacaaaggggtgctagtaagtcaagaataatattgatcattggcttaagtgtgctgggggcagtagctttactgtgttttagtgtttattgcttctggttcaggaaaagaactagaagaggaagaggaaaagatgggaggatacctgataccatacatcaatcatcatatcacaatgttcaaactgaggaaacactgaatacagacctgcctacaatcccattaatcacaattctaaagagtactgataacttttcagaagcatctaagttaggggaaggtggatatggccctgtttacaagggaattctaccagatggaagacaaattgcagtcaagagactctcacaagcttctggtcaaggctcagaagagttcaagaatgaagtgatgtttatagccaaattgcaacatcgcaaccttgtaagacttttggcgtgctgcttggagggacatgaaaagatacttgtatatgagtatttgtcgaatgcaagtctcgactttcacctgtttgatgagagaaaaaaaaggcaactcgattggaatctaagattaagcattatcaatggcatagcaaaaggtcttttataccttcatgaggactctagactcaaagttattcatagagatctcaaagctagtaacattctgttagatgatgaaatgaatcccaaaatatcagattttggattggcaagggcatttgaaaaaggccagaaccaggcaaatacaaaacgagtaatgggcacctatggatacatgtctccagagtatgctatggaaggattgttttcagtgaaatctgatgtcttcagctatggagttcttgttctagaaatcatttgtgggaaaaagaacagtggtttctatctatcagaatgtggccaaagtcttactttatatgcttggaaattatggtgtgcaggaaaatgtttggaactattggatccagtgctggaggaatcttgcatagagagtgaagttgtgaagtgcatacacattggtctgttgtgtgttcaagaagatgcagcagatagaccaactatgtccactgttgttgtaatgctagcaagtgataaaatgccccttccaaaacctaaccagcctgcattttcagtcggaagaatgaccttagaggatgcctctacatcaaaaagttccaagaatctttccattaatgatgtaacagtctctaacattttaccaaggtaa

SEQ ID NO: 110890 - DNA, 1014 bp, Glycine max
  Peptide Sequence Number=SeqID_227668
atgggatctcaaggtggggcagtgcaagagccaaagactactactactaccactaccccttttgttaggcaagggcccttgtataatctgacccttgatgaggtgcataaccagcttgggaatttggggaagccacttggcagcatgaatcttgatgagttgctgaagagtgtgtggagtgctgaagctagtggtggtgaggcctctggcttggactttggtgttggtggtggtgatgctaacatgcagcatggtgaggctgctgctttcggctcctctctgaatcctcatgtgagcctaactttgtctagggatcttagcaggaaaactgttcatgaggtttggagagatatgcaactgaagaaggtcactaatagggataagaaaatccaggaaaggcaagctacactgggtgagatgactctggaggacttcttggtgaaggctggagtgattgctgaagctttgcctaccaccaaggacagggccatgtcaggggttgattcaaatggggcttcctcacaacatggtcattggttgcaataccagcagctcccttcttcggtgcagcagccgaatgtgatggggggttatgtggcaggccatgccattcagcagcctttccaggttggagtgaatctggttttggatgcagcatactctgagacaccggcttctttaaagggtgcgttgtctgatacacaaactctgggtcgaaaaaggggtgtctctggtattgtggtggagaaaactgtggagaggaggcagaagaggatgattaaaaatagggaatctgctgctcggtcacgggcaagaagacaggcatacacacaagaactggagattaaagtttcacgattagaagaggagaatgaaaggcttagaagactgaattcacatctcttcatggcttgcggcctgccatcttggcaggaaagtgtatggctgaaatgcttgttgctagaaaagatttcatctggccaaagcttgtctctagtgtactattggttgtga

SEQ ID NO: 110891 - DNA, 327 bp, Glycine max
  Peptide Sequence Number=SeqID_227669
atggcacacaaactgaggcaggaatttagcatttcaaaagccaaaaagttcagaagcttctccctcactctcacgttgctttttctccctttctcctccaccattgaagcctccatcaaagctccaaactttacccaccatttctactccaaatcgcaaaaggaagccattttcggagtcgtgaagcgcacctcaacgttgtgggacttcaaatttcagagtggtacctggagatatgtcgcgggggtcaggagaccttggggacgtcaggtggggtgctattgcccaaaaccaagcttgaccaatcccgacccaacccgggcatag

SEQ ID NO: 110892 - DNA, 708 bp, Glycine max
  Peptide Sequence Number=SeqID_227670
atggataagagcttgaagataggagaagatgagtggagggagaatgagagaaaggccatgaaattttgtgcctcaaatgaggaacggatgatagctcattttgagtccattcacattgacctatgggatatggtagaaaatggaaatcacattccatatgacaatgagttaaatgaaatccctaggagccagtggacggaggagcaaaaactcaaatttctactcaacttcaaggctcctaacgacgaaggaattaagaaagaaaagtctttagctatcaactgtcaaaagatcaagaagacctccttgtccaaagagcaagtgtccagaagcttattcaaagcccttaaagctaaaaactcttttgatgaagaatctaaggaagagtctgatgaagatgaagttgccttcatctcacagaagattcacaagatgtggaaaaacaaaggtgaatccagatggaagaactcctcaaaaagcacgctcaatgaaaagaaagataaagacaaaagctctatagtatgctatgaatgcaagaaacttggacacttcaaatttgaatgcccagaacaagacaagtctcaagacaagaagaaatactataagaccaaggaaaagaaaggtctcatgagcccttgtaaagatctagatgacacctcatctaatgaagaagaagccaacctatgtctgatggcagatagtctctga

SEQ ID NO: 110893 - DNA, 285 bp, Glycine max
  Peptide Sequence Number=SeqID_227671
atggtggcgtcttcaacatttttctacatcacttcctcagcaaacagagccttcagagattccaaacaacattatctggattttcttgaaactccttgccaaccaaggcaactaacctcgcatgctcaacaagcttcttcatcatcttctcactttttgctcaagggggtgaaggttttagttgaggttgaggtgatggaggaggtgaagactgaagtggaagggctagtgaagactgaagtggaagggctagtgaagatgaagattaaggggttggagtcttaa

SEQ ID NO: 110894 - DNA, 534 bp, Glycine max
  Peptide Sequence Number=SeqID_227672
atggtggtgagcttgttcttgacacatcttctccttgccattgatcttcaagaagcaaagaactccattgataaagaagatccaaggcctacaagctccacatggagctacatcataacctcctctaattttacttgttttgagagtgacaaactaggtcacataaaatttgaatgctctattttcttaaagaaacaacaaggaggagaaaaggagacaaaatgtcatagtaagaagaagaagttttacacaacatgggatgagaatgcttcccgtacttcaaaaagcacagtaagcacttttgattccaaaactgatcttgatgaaaactttgataagcttttagatgccttcaatgaaatgcatgaagaggctcaaaagttatctcaagccaacaactctctcaagggaaagttgagatgtgatgtggataaaatagtgagtagtcaaaaagagttatctagtttaaaattgaaaaatgaggtacttgaaaaaccactagaaaactcttcttgcagtgacaaaactatctag

SEQ ID NO: 110895 - DNA, 639 bp, Glycine max
  Peptide Sequence Number=SeqID_227673
atggcttacaagaagaaaactagtcaaatgacgtctgatgctgcaaaggaaattggagacatgatcgattccttggaggaacagatctcacagagaagctttgtcgcccatggacgtcaggatgtactaattgctctcattcggcgacaagagcaccatggttgtgttcatgctactgtagtcagtgtgacgatcaaacactactttagaccggcttcaaaggactttcacacctcttcctccatgtctcagatgcagtcgcaaatgcaatcacagggactctcacttcctcctgagtttgaggttggtctttctgtggctcgtttcagcacaaaggaaagttgtgtcgatccctcagggcaggacccaaaaataggagactcggacaaatgtggcttatatgtcgatgacagtcctcccctattggttgttgttggaagagttgataaggagtccacgactttccacaacattcctttgggcaatgatcaactcaaggttagtgttgaggaagttcgagatgcggatgctcgcattcctgtacccactcaagaggttcagttagtgggccagacacttaacacctttcttgcttggctggcatatctcgtaaagcctttttcacaacaggataagtag

SEQ ID NO: 110896 - DNA, 171 bp, Glycine max
  Peptide Sequence Number=SeqID_227674
atgcctcaagttgcaaggcctaatgacggaacttcctcagttgactctagtagtgtcaacgaagctgcaactgtatctaggagagttttctccccttctgctgttcttggcatgcaatggaaacttggaagccccttccaaaatcagaatgatgtgttgaagtatgagtag

SEQ ID NO: 110897 - DNA, 285 bp, Glycine max
  Peptide Sequence Number=SeqID_227675
atgtttctcttggttattttggatgctgaagggactgaatcaaggggcccattgctagaaaccatgttaccagaaacaagaggactactaatctataaggaactccgaacagaatttggaccaggcatggatgatgcaatggctggtggactcaacaagttaggcatgggaacattcatagaaacaggagtagcaaaattctctgttggtgttgttgctgtaggactaactatactacttttaggaggtggagttcctgcaacaatatcagaattgctatcctag

SEQ ID NO: 110898 - DNA, 159 bp, Glycine max
  Peptide Sequence Number=SeqID_227676
atggccatcaaagggattaagagaccgtgggtctcttggtgtagaggattcttgaacacaaaggaagggttgtccttgtgtggttcagactttgtcaaaggagtttttacaaaagagagtggaaaaatctcaagtgggttgcttgaggactggaagtag

SEQ ID NO: 110899 - DNA, 1116 bp, Glycine max
  Peptide Sequence Number=SeqID_227677
gatggcggctttccgagcggccacaccaatgccgcctatcttgccgcgattgcctatgcttatgccgtgccggagcgtttttccgagttgctgacggcggcttcgcaactgggcgaaagccgcatcgtcgccggcatgcattcccccgtcgatgtgatcggtggccgcataacggcaactgcgatcgccgctgccgtcttgcaggatccaaagaacgcagaggtcaaaaaggcggcgcattacgacctgcaggcctatttcgtaaaacgcctgccgcagggccagtctctgatccagttcgcccatagcgcgggtctggaaagcgacccctatgccgatgcggcgaaaaaccaggccgattatcgccggcgcatgacctattccttcagccgcaacacggctgggggccatgcacccatggtggtgccgaagggcgccgaggttctgctcgaaacacgcctgccttatcttaatgccgcacaacgtcgcgccgtgctgttttccaccggcatcaaggcgggttatccgctgctcgatgacagcaacggctggggacgcatcaatctggtggctgccgccggaggttacggcgcttttgacggcgatgtcgaggtgacgatggacgccgccgccggcggtttcaatgcggcggacagatggacgaacgatattaccggggcagggcgtctcgtcaaatctggcagcggagcgctgactctcggcggccataacagctatggcggcggcaccattctcagggagggaacgctggtggcgtcgtccgccgatgcgcttggaaccggcggcgtgctggtcagcggcggcacgctttcgctcggcggagagacggatcttgtcatcggcggcgactatgcgcagtcgggcggcacgctggcggtcgatccgaaaaaggctgcgcttcggatcaagggcaatgcggtgctggacggcgcgacgctgaagctcgctttcgatggaggcgcgccagccgccggcacgcggttcgaggtgatctccgccaacggtctgaccgggacattcgccacgatagatgcgggcaatgtgaaggtacggccggtctataccggctcggcactgtcggtggtggtcgaatag

SEQ ID NO: 110900 - DNA, 393 bp, Glycine max
  Peptide Sequence Number=SeqID_227678
atggctggtgctcgccgtggcgctgctggcgctgtgcgccgcctgcgccttattgcccggcagcgcgcgcagccggttgctgctgctgttcagcgcgctgggcgtgatcttcctgattgtggaagggcacgcgattggctacagcggctggagctggctgtggctggaaaatcgcttcggcgcgctgccgcagggacagccagcgatgggcgctggcgcgcttctgctgctgaccgtgtttttgctgctgttctcgtttgcgctggccgaacgcggcgtgctgaaaggcgatgcctttgtggtggcgtcgctggtgctgctgactgcgctggtcagcatcttcgtactctatccggtgctcagcatgtttgtggtgtcggtgcaggacgttga

SEQ ID NO: 110901 - DNA, 330 bp, Glycine max
  Peptide Sequence Number=SeqID_227679
atggctgccgatctgccacagtgccggcgcgctggcttcatcacgccacaggttaaacagccagccgctatcgaaaaagcctgcttccaggctgtaccacggcagcagcaacagcgcgacggcgcccagcagcagcgcgcccgtcagacggcgattattggcgttcatgtgttacctcaatgcgggatcatcgcgccatccttagcgctgtcggaaccggcaaaccgccgtcagcggcagcgtccggcgatgcggcattactgcgcgctggcgccgatctctttatcccagcggctcagcagcgctttacgtttggcggaatcaccgtag

SEQ ID NO: 110902 - DNA, 234 bp, Glycine max
  Peptide Sequence Number=SeqID_227680
atggtcgaaacagccttggtctcccacgagcggcaacacccactgcccaaaaccgccgacccgcgtgtccaaatcgctggcaacttcgcccccgtgccggagcacccggcgcatcagtccctcccggtgaccggaaaaatccccaaatgcattgagggcgtctacgtccgcaacggcgcgaaccgactctacgagcccgtcgctgggcaccacttcatcgacggcgacggcatg

SEQ ID NO: 110903 - DNA, 1458 bp, Glycine max
  Peptide Sequence Number=SeqID_227681
atgcgcgacgggcactgggacaaagcgcagcacaaatcgctggagctggaaggacgcacgctcggcctggtcggtctgggtgccatcggcagccgcgtagcgcgcatcggccaggccttcggtatgcaggtgctggcctacgatccttatgcgcaaaccttgccggctggctgtgaagcggttgaatcactggatgaactgtacagccgtgccgatgtggtgtcgctgcactgtccgctgacggaccgcaatcaccagatgatcaacgcggccgccctcgcccgttttaagcctggcgcgattctggtcaacaccgcgcgcggcggactgattgacgatcaggcggtggcgaccgcgctgcaaaacggcacgctgcgtgccgccggactggacagcttcaccagcgagccgctgaatgcaccgcatttgtggcagtcgcttaacaacgtgattattacgccgcacattggcggcgtgagcgacaatgcttacgtgcgcatgggcaccggagcaggaggcggtatcatgaccgtgcttaccgtaccggaggtgcgcgagttaacgctgttttcgcgcctgcctgaagcgtttcgccggccggacgccggcaatgtctgggctgccgccaatcgcggcggccagcttaccgactcctttctcgaaggcccggtgtggcatccctccggctgtctgtatgtcaccgacattccctatggccgcatctttcgcgttgatatgagcggcaactgggagctggtggtgcagtatgacggtgagcccaacggcatgaagctgaccgatccggacacgctgatcatcaccgattaccgtaacggcctgatgaagctgtcaatcagcagcgccactatcacgccgtggctgacgcggcgtaatagcgaaagctttcgcggcgtcaacgatttaacgcctgacagtcgcggcaatctctattttaccgatcagggccagaccgggctgcacgatgccagcggacgcgtctatcggctcagtccggatggccggctggacctgctgctggataactgcccgagcccgaacggcctggtgctgtcgccggatgagaaaatcctctacgtggcgatgacgcgcggcaactgcgtgtggcgcgtgccgctgctggcggatggttcggtgagcaaagttggactgttctttacctcgcacggacccagcgggccggacgggctgaccatcaatcagcgcggtgaactgctgatcgccaatcccggcctggggcgcgtctggcgtcttaacgatctggctgaaccggaagagattctgctcagtccgctgggtcgctccaccaccaacctgtgcttcggcggggccgaccttaatcagctgtttatcaccgaatcggtcagcggcagcatcctgacctgcacccagaacacgccaggccgcgcgttgccggccatcgatacctcgtttctctga

SEQ ID NO: 110904 - DNA, 714 bp, Glycine max
  Peptide Sequence Number=SeqID_227682
atgggaaatgaaggcgttaatgcggtggagaaggcgttgtcgctgctggattgttttaagccgggcgaagagagcctgtcgctgactgcgctgtcgcagctttccggctatcacaaaaccactgtctatcgtctgatgaactcgctggaaaggatgggctatgtggtgcgcagtgacagcggggtctacacgctcggcccgcgtctgttatacctcggcaagctttatgagcaatcattccatctggccagcgtggtgcagccggaattgcaggcgctggcaacggcgaccaacgagagcgccagctggtacgtactggataacggccagcgtctgtgcctgtttcgtgctgaatcgtctgatggcctgcgtcatacgcgcctgccggggacaatttttccgctcgataactcagccatcagtaaggtgctgcgtttctggggcatgaatgaaaatctcttcgatgcgctgccgtcgctgccaatatttagctcaggcgcgcgcgatccgcacatcgcggcctttgccgtgccggtattcgccgaaaatgaccggctgaccgctgcgctggcgctgaccggcccggtttcgcgtctgacgctgaatcgcaaagatgaagagttaggtgtgttgatgcgcgaagcggctgcacgcctgtcagccaaactgggcgcgcgcaaagcattttgtgatgcggtttatgcggctaagtaa

SEQ ID NO: 110905 - DNA, 389 bp, Glycine max
  Peptide Sequence Number=SeqID_227683
atgtctgtgtctgcaaataacctgatcaaccgcaacatcgagcgcgtcagcgccctgtccgtcagccaggccgccgcatttcaggcggcgattctggccgatgtcgccggtcgtcgcggcaccctgcatggccgcgttaagccgctgtcgccgcagatgaaagtcgccgggccggccatcacggtggaagtgcgtccgggcgataacctggcgattcacgcggcgctggcgattgcccagccgggtgatgtgctggtagtagacggcaaaggcgacatcagttgcgcgctgctgggtgaaatcatggcaacccaggccgaagcgtccggcatcgccggcatcatcattgatggtgcggtgcgtgatgctgacgccctcgcgcagggcag

SEQ ID NO: 110906 - DNA, 246 bp, Glycine max
  Peptide Sequence Number=SeqID_227684
atgttattgcctagcgttgttcatgtgccctccaccttcgagtttggagctatgtttcacgattgcctaagtgtggatcctcaaggcaatcctccattctccccctttttcggagccccatcaatgttattgcctagcgctgttcatgtctcctcgaccttcgagttgggagctatatttcatgattgcctaagtgcggacgctcaaggcaatcctccattctccctctttttcggagccccgtga

SEQ ID NO: 110907 - DNA, 618 bp, Glycine max
  Peptide Sequence Number=SeqID_227685
atgcctcaggtgtggagtatcaggtacaaagtgaaggatgatgacgagtgtggcagtgatgaaaacgcaaagaaaggtcccctagtgaaggtcttatggtatcctcctatcattctaaggtttaagcatttgtttgctaatggagatgatgcaaaagaccttacttggcatacagatgggagaaattgcgatggaatgttccaccatctggaagattcttttgaatggaagaaaattaatcatttttatccatattttgtgaaagagacaagaaatcttaggcttgaacttgccattgatggaatgaatccctttggcagtttaagcactaagccaagacaactaagaaatgacatcaatgtttatcgaagtcccttgattgaagacttgagaaagtggtgggatgagggggttgacatgtttgatgggaatcaaaataagacattcaagttgtgtgcaatgatattttgtaccattaatgactttctagcatgtgagaatttgagtggatacaatgttcttgagcaggttgaagacatcaatactatatttggaaagaccaaaaagaagctgacaagtaaaacttgcatgtggaagaagaggtttgggttcatttaa

SEQ ID NO: 110908 - DNA, 156 bp, Glycine max
  Peptide Sequence Number=SeqID_227686
atggatttgtggaaggccgttgagaaggcaaagaagctcagaggcttcatcgctgagaagagatgcgctcctctaatgctctgtttggcatggcactctgctggaacctttgacaagggcacaaacactggtggacccttcgaacattgctattag

SEQ ID NO: 110909 - DNA, 1393 bp, Glycine max
  Peptide Sequence Number=SeqID_227687
atgaatgcactgaccctcccagagcccattgccgcgtacttcgcggccgagcatgaccccgaagccctcgggcgttgcttcaccaccaaggcgatcctcaaggacgacgggcacacgctcaccggcgtcaacgcgatcaaggccttcctggccgaggcatcggccaagcagcccgatcctgctgacctaccgtttcgaactgcaacgaggcctgattgcagcgctggagatcactgcatgagcttcgatcttcaactcggtggcctgcgggccgtggtaaccggcggcacgttgggtgtgggggctgcggtggtcaggaccctggccgaggccggggcccgggtgatgacgtctgcgcgcagcttgccggcacggccggtcgaaggggtcgcgtacgtggcagccgatctgtcgacggccgagggcaccggcatcttcgcccaggccgttctgcaggcgtgggacggtgccgacatcctgatcaatgtgcttgggggatcaaagacaccaggcggcggcttcgcggcgatcagtgatgcgcattggtttgccgagctgaacctcaatctgatgccggcggttcgtctggatcgcgccttgctgccggccatgctcgcgcagcgcgctggcgtgatcatccatgtcagttcgatccagcgcatgctgcctctgccggagtccaccaccgcgtacgccgcggccaaagcggcacttacgacgtacagcaagtcgctttcaagagaggtcaccgccaagggcgtgcgcgtgctgagcgttgcgccgggctggatcgagacagaggcttcccgggaatttgcagaacggatcgcggcagaagcaggaaccgattatgaagggggcaagaggctggtcatggactggcttggggggatcccggtggggcgccccgcggcaccgcaggaggtggccgatctgatcacgcgtcgtcccgctgccaccgcccagaaagaaagccccgctcatgcggaggctttcctttgtccgcgattcctgcggagttgtgccccgcagcatcagctttcgtgcaccgcgacttgcaaacagacaatttcctcccctatggtgcaatcgattgcattgcagtggatgtccgtccattcgatcagaccggccccgccgacggggctcacgcggcgcgatgcgctgcgcatcgcagttgccggcagcattggcctgggggccgcgacaatcgcgggcacgctgcccgcatccgccgccaccgcgccgctcaaaggcaacctgaagcactccgtcgcccgctggaccttcccgcagctgtccgtcgcccagctctgcgcgacggtgaaggacatcggcttcgccgcgatcgacctggtcggcccggaagactggccgacgttgaaggcccatg

SEQ ID NO: 110910 - DNA, 240 bp, Glycine max
  Peptide Sequence Number=SeqID_227688
atggagcggtatttccagcacttggttcgccagcaggcggccaaccacaggggcaggtgcagatccatgagtgtctctactagctcagcctcagtcagcaaagccaaggtttcgctccttttgcgtgccctacttcagatcagttcagggctgagttgcatgcccggagattggctgagcccaggcaggggaggcgcccgcagaggctcccagcgatgcagaggaggcccgcatggatga

SEQ ID NO: 110911 - DNA, 564 bp, Glycine max
  Peptide Sequence Number=SeqID_227689
atggatgactggaacattccagaaatccctcaggatcaactatacgttcctgaaacaattaaagacaaacacaaatttgattacataatcaaaacagtagaaaacaatattcctctaggacaagatataggggaagagtttcatttactttcaaaaaattcaatttatgaacatagccgtaagtataaatatctacacattggctgtgtacaagtagtcatcaagcccttgattgacatgggcatagatgcaacagttttaatgtgtctaagagatattaggcataataaatttgaagactccctaattggaacagtcgaaactagccttggacaaggtccaatatattttaattgttatccaaacaaaacagtgagtctgatggacagaaacattcttgactctctgttcttaaatatccactttcatggccttgacatgaaagaaggatcaatcctagcgactttgatttataggatccagtacaaggtcatgaatacttgtgcatctagagtcctgttgcaaccacaaaagggagaacaaccttatttatcactgatatga

SEQ ID NO: 110912 - DNA, 288 bp, Glycine max
  Peptide Sequence Number=SeqID_227690
atgccagccgacgtcggccaggaaaagatgacagatcgaggtctgaagaagaagcatgaccggatgactccgatcgaacatttccaaatcgacatcgtccaaccaacattgcgcaatttctttcacaaacgctggccgataatatttctttacggtaaaggtcggctaggttttttcgtgcgagctcaaccaaagttgtgtttcggccgacaccggcatgttctcgtttactctgccaggaacacattaacccacctcggcaaaacaaccattattctccgatactga

SEQ ID NO: 110913 - DNA, 1568 bp, Glycine max
  Peptide Sequence Number=SeqID_227691
tatttcctgccgcgggcgaacctgactttgaccggcggtttcgcgcatccgctcaaaggccgccaaatcgaactgatcctatgagcaatttcctggaagcctccggctggaccgtcctgccggcgggcgagcacgccatccgcgccatatcgcccatgaccttgggcctggacggacagcacgcggccttcttcatcgcgcatcccgacgagtccacgttctacctgaccgacgcctgtgagaccgcgatgcacgcgtccagctacggcatcgacctggcggccaagcgcatcgacatcctgaacgaaacgccgggcgtcagcctggcccacttcgaccgcgacggcgccatcgtggcgtcgggccccaacgagcagttgcaggaagccctgtgggacgcggtcaagctggcgatggcgctgtcgttccagtgcgccaagtggatgcccaagttcagccagctgcgcttccgcgcgcaggtcgggcgcgcgctgacggcaggggtgggcgtgaaccgcatggtcaagggcgcccgcgccaagggcagcagcggccacacggcggacttcgccttcgcggtgcgcgcggccggcagcacggcgctgacgtacatcgagccgatagcgctgaaggccggcaagaaaatggactggacgcaggtctaccagacccacggcaagatgtcggacgtgaaaatggccgatgcgcgcaactcgcgcatggtgatcctggaggatggcgcgtcggccgaggaactcaagaaagccgtgaccatcctggaacagtcggccagcgtgctgacgctggccaagacccgcgactggcgggcggccgtcgacgatttcgcggccgtgcaggatggcggcatgcaccgcttcgcgcggactgaagacaaaaccaccttcggcaaagcgtggcacgggatattcgtcgccgccttccagcacggcgccagcctggaccaccatgaccgatgcgatgaaaacggggccgctcggcaacgcttggacttcatcgcccgcgccccgggacaccatggccgtcagccgccggacgccaccccggccgcgtcgacccgtcccggggatttccctaaagctgttgcgaaagcgcactatccggcgcccgcatccccgtggcccgcaggtagcccggcaaggtccagccccggcccagcaggaacatgcgggtatgcagatcgtccagcacccgcggcgtcaccgccggccccaggtaggtcagccgcttgcgccgcagccccgcgtccaggccccagcgatagaccgccgtggccagccccatgccctggtagggcgccgcgtacttcgaatgcggcgcgcgcaccgaagcaacatgccagggatgtcggtttgaacctctggcaatccatgtgcgcggtccgaaggacgattcatgcgatcgtggatggcatcgagttcggtctccacttcgcgcggagcgtgattgacgtcgatgcgcagttccgtcgcgataggcaaggcgcggcggaaagcgtgcagggccagcgtaggcaaggccacctcctgtacagggcaaatgcccgatga

SEQ ID NO: 110914 - DNA, 825 bp, Glycine max
  Peptide Sequence Number=SeqID_227692
atgtgtcaggagaaattggtacaagaagccgtggatacacttcttgataatggaatccgcggacaaccgatgagggacggtcataataaggtttacaaatcattttctgatataattgagggcaaagagggaagatttcgcgagactctacttgggaaacgggttgattattcgggtcgttctgtcattgttgtaggtccatcactttcattacatagatgtggattgccccgcgaaatagcaatagaacttttccagacatttctaattcgtggtctaattcgaaaacattttgcttcgaacataggaattgctaagagtaaaattcgggaaaaagaaccgattgtatgggaaatacttcaagaagttatgcagggacatcccgtattgctgaatagagcgccgactctgcatagattaggtatacaggcattccaacccattttagtagaggggcgtgctatttgtttgcatccattagtttgtaagggattcaatgcagactttgatggggatcaaatggctgttcatgtgcctttatctttagaagctcaagcagaagctcgtttacttatgttttctcatacgaacctcctgtctccggctattggggatcctatttccgtaccaactcaagatatgcttattggactttacatattaacgagcgggaatcgtcgagcttatcaacaaaaaagaataaacttcgatagtcctttgtggctccggtggcgactagatcaacgcattatttcgtcaagagaagttcctatcgaagttcactatgaatctttagatcatatagatggttggtatctaagataa

SEQ ID NO: 110915 - DNA, 135 bp, Glycine max
  Peptide Sequence Number=SeqID_227693
atgaaaataaaagagcacaagcttagtgcgaagaaggtccatgaagaagctcaacagcgcaaatctcatgctaagcgcatgatcaccgtcacacttgctaagcccaagtttcgtttagctcgtgagattgcgtga

SEQ ID NO: 110916 - DNA, 189 bp, Glycine max
  Peptide Sequence Number=SeqID_227694
atggaactcactcctcttgatttgccatatccctcgccttgccttctaagtacttccgtgggaagaaacccgaagaaaagatacggtttccttcccccaagaggacatcctagaatctcctcaaattcttcaacgttcggtactaattcgaagtctccaaatgtgaagcatctcaagggctggtcgtag

SEQ ID NO: 110917 - DNA, 307 bp, Glycine max
  Peptide Sequence Number=SeqID_227695
catgcaacagggacatgcagttatcctcatagctaggttccctgaccctaactatggtgttaaaacgggttcccctcagtgtggggtttcaacggagaacaacggcggtttgtggtggctaatggtggctgtgagtgatagagagaaggcttggaacgctggaaatggctttggaagaaagaaaggagaagaaatggcgtttttcctaagctacttggactacaaggctcaaaacgtacaagtgagcaatgctttcgggaacggaaacgtcacgcacactccagacatcttctcaaagatcccaacg

SEQ ID NO: 110918 - DNA, 726 bp, Glycine max
  Peptide Sequence Number=SeqID_227696
gtgcataatattcccattgttgttgatcattccttgttttattcattgactaaactgcccagtcaaggtgttccttttgagggcactcttgtggataattggaaatttgattattcaagtcatgatgctcacagaatagtctgcaatgaccaggctgacatgaccgtcagattacttgttgggtcatttacttttgattgtcgcatcatgcactatatcattgttcgtattttgcttcctcggtcttcaaatcttgcccaagcctctgaggaggatttgattctattgtgggcccttcaaactggtcgtcagattgattgggcccatctagttcggtatcggatgcataaggcattacgggtcaatgcacctctcctgtatccccaccttgttactctttttcttcatcatttcaatgttcctttggatgatgaaccatatgtcaaggttaaaaggtctttctccattggtgccggtgttgttacctcctttgacttgccaccacctattcctgatgaacgtaccccatctcctccaccacaaagggatgcttcttcttctctgttgactaaagtcctcacaaagctcagcgatcttcgagcatttgtgggtgagcattttgatgcgatggatactcgcttggatgggatggatactcgtatcactaagcttgaagatgatatgagcttcatcaggcgttgcttcaatcccccggccgactcttag

SEQ ID NO: 110919 - DNA, 285 bp, Glycine max
  Peptide Sequence Number=SeqID_227697
atggtagccataatcccagcaaggattcctcaacctccattttcccaaggatacaactcaaatgcgacatgtgcttatcatggaggagttctggggcattctattgagcattgtatgaccttgaaacataagttcctttcacttttccttgctacaaggtcattacaaaagacggtaatagatacctcagagccctacattggggcaatgagaggcaccatgcatgagcctcaagcgaacctagggggagataaaaaattctcgcctggtaggttgaaaacctaa

SEQ ID NO: 110920 - DNA, 552 bp, Glycine max
  Peptide Sequence Number=SeqID_227698
atttgcactcctgaggctgatcctcaggagttggctgctaagctctgtatcccagggaagggattcgagcttaatgctgatgggcagcccctgaagattttgaggaagaacttgaccaccttagctcagacatggagtgttctttccttatctaacttgattcccacctcccacacttctgatgtcactcttgacagggctagactcatttatggcattattatgaagatggatatgaatgtggggtacctaatctccctcactgctcagcatgacacatccagacttggattcccggccttgattacagctttatctaaggctaggggagccctttccacaacaccatcagaggtactagcaccttcttcttctacacttcctccttcttcctccacagagatcccagtgattcctcctgcactcatacagataccactaccacctcctctttctataggtctagcagattttattttcactcctcagatgcttcaatccatgctccagagcatccatagagggcagtccatcatcatgcagagcctttag

SEQ ID NO: 110921 - DNA, 198 bp, Glycine max
  Peptide Sequence Number=SeqID_227699
atgaccaagagtatcggcaagcgaaatggaggagaccgtcggcatcagctcctgcagacgcatcaaatcgtccagacccttttgcggattgagatttacggcgctattgagcgcatcgtcgcgggcaaagtatttcgtcgcgcgcgccagaatgtagtcattttcgcgcagcagcgattcggtgtagttcaccgcaag

SEQ ID NO: 110922 - DNA, 295 bp, Glycine max
  Peptide Sequence Number=SeqID_227700
atggtgaagcggttgtgccgtgccgccgcccgcgataaagatgatgcatcaaggaacatacataagggcgatgaaactatgaagaatatcgttttatgctgtgccgcaggaatgtccaccagcatgctggtgcaacgcatgaaagaggccgcgcaaaagaaaggcatcgaagtctcgatcaaagctgtgccggtagcggagttcaaagataacctggctgaggcggatattatcctgctcggcccacaggtgaagtacgagcaggcgaaactacaggcgctagccgacccggtcg

SEQ ID NO: 110923 - DNA, 1152 bp, Glycine max
  Peptide Sequence Number=SeqID_227701
atggaaggcgatgagagccgcacgtttgatccaaaaacgcgcccctggtttattcgccaggcggaagccagtaccttcagcctctataccactccttaccttgattacttcacccaccaccctaccgttaccgtctaccggcctgtcatttcaccgcagggaaggctcaaaggtagtctggcatttcatatggatctgacctcaatgggctacgcgttacggcagattgtctcgccggtacagggcgagttttttgtcgtgcaacgcgacggcaaagtggttatccatcccgataccggcgcgctatttaaaacctacgttagcgcggaactgatggacaaaatgaccagcgcggaaggccaactttatgatgaggaacataaggcctggtactactactattcctttaccaaccctgactggttcgttattttccgcgtcaccgatgccacccttgatgacctgacgcgctatgaaaccgatattgtcgcctgggggttcgccctcgccgccattgtcatcgtcctgttcgggctatatctgcgccacgcttcgcgtaccgtactgatgaacatcattaacgccattaagaccggcgacgtcaaacgcgcgccgcggctggaagccatgctcagcaaagcgatcgagagcaataaacagcgtgagctcacctatgtccgccaggccaccatcgatgcgctaaccggctgcaaaaatcgccgcgccttcgacagcgatatcgccgccctgatgaacgatcaccagcctttcgccctcgcgttggtcgatatcgacaactttaaatcaattaatgatacctggggccacctcaatggcgacatcgtgctgcgcaacgtcgcgcgtgaagggatacagatcctgcagccgcaggagatctcgctttaccgctacggcggcgaagagtttgccgttatcttccctgccgaacatatcgacaacgcactcaccattctggagagctggcgccttaacgttgccagccgaacctggcgcgaagaaggattaaccgtcacctttagcgccggcctcggggaatggaatatggagccgctggaaaaactggtcgttagcgtggatgaagcgttgtataaggccaaacagcagggcaagaatcgaatcgttcgcgcctga

SEQ ID NO: 110924 - DNA, 411 bp, Glycine max
  Peptide Sequence Number=SeqID_227702
gtaaaaaagggtgctcaacctcatgatgatgaaggacacttaccagtaggagaggattcctctctccttcagagtatcttggacaggtttgatggacttcaaaccttttttggcgaaaggtttgatgctttggaacaacaagtggacatgcgtttcgacggaatggactcaaggatcaccaagggttgtcatcatcaaaaaaggggagattgtagaagcaagcttcatgataatgaatcaagtagttttgatgatgacaaaaagcccaaaagaatgatgtcaagattgagtcaacaagttcaagaaatcaagaagattcaagattcaagagaagttgatttcaagattcaagaaaagacatcaagaagaatcaagattcaagagaagatgaattcacaagggaagtattga

SEQ ID NO: 110925 - DNA, 519 bp, Glycine max
  Peptide Sequence Number=SeqID_227703
atgaccagaagacttcttgtcggttcattggcttttgagagtcgcatcctccattaccttattgttcgcatcttactccctagatcttcaaaccttgctcaggcattacgattgaatgccccattgccttatcctcatcttgttacctttttccttcaaaacttcaacatccctcttgattttgaaccttatgttccaatcaagaaatcattccttataggcgcttcagtcatagcatcctttggttacataaaggagcatgatggctcttgggtgaagaaaggtgctagaaatgttggtgaagaaggacatgaaggagaagattcatctcttctttcgaagattatggaaaagtttgatggtcttcaaacctttgttggtgagatgtttgataccttggaattgcaagtggatatgcgcttcaatgaaatggagtcaagaatgacaaagtttaaagaagatgtatcttacattcggtcaagcttcgatcttccaccaccgccgccaccatcatcttag

SEQ ID NO: 110926 - DNA, 168 bp, Glycine max
  Peptide Sequence Number=SeqID_227704
atgaaaaaaaggaagattttggcatcaggaacagcccaagacgcgctcaacgtgaaaacatgcacccctactaagcgagaaagcgatgcgctaagcgtgaatacaggcacctgcactaagcgagtagagcgcgctaagcgcgagtgctcgacagagggtgatccttaa

SEQ ID NO: 110927 - DNA, 270 bp, Glycine max
  Peptide Sequence Number=SeqID_227705
atgtcatcggactcgccgtctctggatgacaaaggtgtgggaccatatggttcccccgcatgtcatcggactcgtcgtctctggatggcaaaggtgcagatgacaacgttagtctctgcgtgtcaacgggctcgcttgcctctggttgacaaatggtgcgagaccatatggttcccccgcatgtcatcggactcgccgtctctggatgacaaaggtgcagatgacaacgttagtctctgcgtgtcaacgggctcgcttgcctctggttga

SEQ ID NO: 110928 - DNA, 348 bp, Glycine max
  Peptide Sequence Number=SeqID_227706
atggagtcaaaggtagctagaagaagtgcttactacttcattgctcaactaaacaacatcaaagagagaggaaaatggtctcctttgatcaccaacaccaaacctcaagcttctaggatttggggttatggaagggtttatgacccttacaagcccatctcctcaagccgaaactcactaagcccacacaaacataagcatgcatcaccatgcatgatccggctaagtcaattgcctattccttgtattaagggatatgcattagcaatcattatactagaggataagtacaaggctggcttagaagaatgcaagaacaacctccatgggagatttcttcttacttaa

SEQ ID NO: 110929 - DNA, 170 bp, Glycine max
  Peptide Sequence Number=SeqID_227707
atggatgatgcaatgttgaaacgttcatttgggcattacacgagagttattgtggatgttgatttggagggtcaactacggcttattggtcatatgattgctacatgcaagaggtgtgtgcaagagcctaagcatggagtagaggaggataggcaacaaaaggttttcaa

SEQ ID NO: 110930 - DNA, 249 bp, Glycine max
  Peptide Sequence Number=SeqID_227708
gatgtcacacatagaccacgtcttttctggtttttccgacgttttcctcgaataaacgttggtggcgactccgcgcattttcctttcttggaagatgcacccgtgagccctcgcgtcgtcctcccgccgaaggaagtttctggtgctgagcgcgccatcttagacgcgctaagcccaggcatctcgctaagcactgccaccactgactggagggaagatcaagggattcacacgcccattaggcactaa

SEQ ID NO: 110931 - DNA, 360 bp, Glycine max
  Peptide Sequence Number=SeqID_227709
ctgccgctggtgcatctgcactggtacgacaaagaagtccgcgccggacgtaaggtcggccacctgaatctgaccgacagcgatccggcacgtctcaccgccgcactcaatgcgctgttctgcggtgttcccctcacccttgccctctcccacagggagaggggattatacggtgcgatttttcagttagacgctcaccttaacatcctaaagttacaggctcgaacggctccctctcccgtgggagagggaatcatgcgctgcgattttctgtttaacgctcacctgaacgttctgaagtgcaaaatcacgcatacgggctcgatcggccccctctcccgtgggagagggctggggtga

SEQ ID NO: 110932 - DNA, 621 bp, Glycine max
  Peptide Sequence Number=SeqID_227710
atggaggtcgagctggccgaccgtctgggcgtcaggctcggcgacaggctgacatttagcggcgatacgcagcagttcagtgcgacgatcaccagtctgcgcaaggtcgactgggagagcctgcggccaaacttcttatttatcttcccgccgggtgcgctcgatcagcagccacaaacctggctgaccagcttccgcatggcgaacgatcccgcgctgctggcgcagctcaaccgcgcgttcccgacgctgagcctgctggatgtcggcagcatgctgaagcagattggacaggtgctggcgcaggtgagccaggcgctggagatcatggtgattctggtgacggtttgcggtgtgttgctgctgctggcgcagatccaggtcggcatgcgccagcgccggcaggagctggtggtgtatcgcacgctcggtgccagccagcgcctgctgcgcggtacgctgtggtgtgagtttgcgctgcttggcgtagtcgcgggaatcgcggcggcgctgggggcggaagcggcactgtggggacttcagcgcggtttgacgctgcctgatgccctcaccccagccctctcccacgggagagggggccgatcgagcccgtatgcgtga

SEQ ID NO: 110933 - DNA, 2400 bp, Glycine max
  Peptide Sequence Number=SeqID_227711
atggagctgattgcgcatccgcactggttctggctcacgctgggcggtttactgctggcagcggagatgctcggcaccaacggttacctgctgtggagcggtgtggcggcggtgctggtcgggatcattgagtggctgtttccgttctcgtggaccagccagggcatgttgttcgccgctctaacgctgctgtgcgtgtttttctggtatcgctggatgcgctttcgcgaaagtgcgcagcagccgaatacacttaatcagcgcggcagccagctgattggccagcacctgacgttagacagtgcgctaaaagacggcgtcggcgcaggaagatttgccggcgggcacaccggtgatcgtgaccggcgtgtcaggcatcacgctgctgattcagccgcgtttgccaccctcctgatgaccgcagcccgccaggtgattgatgatgggacattcggcaccgtcatcgcccgggcaggctgcagccagttccagcagacgcgcgcgcatcgcgtgcagctcttcaatatgcgccgcgatctcatccgccttctgcagggtgcgcgctttaacatcggcactgtggcgcgccgggttattaaacagcgcgaccagttcgcgacactcctcgagcgtgaagcccacctgccgcgcctggcgcagaaaattgagctcatccaggtggtgcgcgccataactgcgatagccgttgtcactgccgatgtggaacaggccgaggtaacgcagcaggaagcgcgcgtcaccggcgcagccagcgccagcgatctgattgccactgttgagcaggctggttatcacgccacgctgaaaaatgaggcgtccagcccaaagcctgatccgttgccagctcaggagccgcagccggaggcgctgacaacggagtcgcagccggcagaagagaatcttgcggtgcaccatctgctgataggcgggatgagctgcgccagctgtgtcagtcgcgtcgagcaggcgttacagaaagtgcccggcgtgagccaggcgcgcgtcaatctgggtgagcgcagcgcgctggtgctgggcgatgccgtaccctcagcgctggtcagcgccgtagacgaggcaggttattctgcggaagtgatcgaagatgaacaaacccggcgcgagcgccagcaggtcagcgcacagcaggcgatgcgccgctttagctggcaggcggcgctggcgctgatcgtcggcgtgccgatgatggtctggggcatgctcggtgatcacatgatgctaaacgacagcaatcagacgctctggcgcgtgctcggtgccgtcacgctggcggtgatggcgcttgccggcggccacttctatcgcagcgcgtggcgcagcctgcgtcatgctaccgccaccatggacacgctggtggcgctcggtactggtgcggcctggatctactcaatgagcgtcgcgctgtggccggcatttttcccgccgcaggcgcgccacctttattttgaagccagcgtgatgatcatcggcctgattaacctcggccatgcgctggaacagcgcgcgcgccagcgcgcctcacaggcgctggagcggctgctggatttaaccccggcgcaggcctgcgtgatcactgccgaaggggaaaagccgctgccgctgagcgaaatcacaccgggcatgacgctcaaactggtcaccggcgatcgcgtaccggtggacggcgaagtcagccgcggcgaagcctggcttgatgaagcaatgctcaccggcgaagcgctgccgcagtcgcgccgtcctggcgataagatttatgccgggacgctggtgcaggacggatcgctacagttcaccgcccgcgccaccggcagccataccacgctggcccgtattatcaacttggtgcgtcaggcgcagagcagcaagccggaaatgggccggctggccgatcgcatctcggcggtgtttgtgccggtggtggtggcgattgccctgctcagcggagcggtctggtatgttgtcgggccgcagccgcagctggcctatacgctggtgattgtcactacggtgctgattatcgcctgcccatgtgcgctgggcttagccacgccgatgtcggtgatcgcgggcgtcggccgcgccgccgagctgggcgtgctggtgcgcgatgccgatgcgctgcagcgggccagtgaagttgacaccattgtgtttgataaaaccggcaccctgacccagggtacgccgcaggtcagcgaggtgctgctgtacagcgactgggatcgtcagcaggtactgcaggcggccgcccagctggagctgggatcggggcatcctctggcgaaggccatcgtcgccgccgcaccgaccgtcagtgacgcccgcgttgcgcaatttcgtacaatacgcggcaaaggc

SEQ ID NO: 110934 - DNA, 765 bp, Glycine max
  Peptide Sequence Number=SeqID_227712
atggaggggaaaaagatggacgaatactcaccgaaacggcatgatattgcccagcttaaatttctgtgtgagaacctgtttgacgaaactatggaatcaatacccaggatcttcaacggtggcaacgttcagcaaaacgcttatttaatctgtttgccgaagagtgcgcttatctccagcaacccagccattccttttagcatcagagtgagaccgaacaagtatgaattacccgatgatgagttagcggtattttactccgcagccgatcaccgtctggccgagctgaccatgaacaagctctatgacaaagtgcccggatctgtctggaagcaggcaaaggagtgccgatacggtgctgtgccgcattgcgcgcagggccggcggcaaaaccctgctgatagccgcaatcgcatgctaaagtggcgcttttcccgcagacgaggtgcgtcagtgagtgaacagagcaatttttccgagcgcgtctggcaaattgttgccgctattcctgccggtaaagtgacgacttacggcgatgtcgcgctgctggccggttcaccgcgtgccgcacgtcaggtgggcggcgtgctgcggcgcctgccgccaggcagtaaactgccgtggttccgcgtgattaatcgtcatggtcgtatttcgctgcagggcgatgatctttttcgtcagcgcgatgcgctggaagccgaaggtattgaagtgagtgatgcgggagaaattgaactggcgaagtatcgctgggagtattaa

SEQ ID NO: 110935 - DNA, 888 bp, Glycine max
  Peptide Sequence Number=SeqID_227713
atgagtagcactctgagctattcgcaaacaggaaatgtgggtatcaacactaccactcccgggagcacactcactgtgaacggttcatttgccgctacgtacagatccgttacagcaagtggaaatgtcgcccctacggattactatctggcctacagcagcaatacgaacggaactttgacgctacctgccgccattactggttccggtaactttgcaggacgaacctatcatttcaaaaatacagggacagccgtattatctattgcagccaacggagcagaattaatcgacaatcaaacaggagcaggcgttggcactgttaatgttcccgcaggttactatgcattttttataagtaaaggaacaacgacaggaacaacatgggagcttattttgctttcaagctctgacagcttgcccgcagccaccaccagttatccgttttctacagtaagcaccacaagcagacaggatcttaccgccagcaccggtccttacatcagaagggaaatcaattatcctcagggaacagtaatcaacacgggaaatgtactgaatatcagtaacggtcggtttactgcaccttcaaacggatattatatgttttatggttccacccaatttgataacggaaatattccgggtacaccaagtttcgactgggttgtattgtatcttatgaaaaactatgcggtgagcacagacaatattttggtacaatctttccaacctgctccaggtacactgacgggaagaaatgtatcgtgtatcacgtatcttaataaagatgaaacagtaagcatggcagcagccgccggagtaaccggaagtccaatataccaggttgtcgtaagctccttttacggatataaaatcgcgaattaa

SEQ ID NO: 110936 - DNA, 208 bp, Glycine max
  Peptide Sequence Number=SeqID_227714
atgcccgccagcaccattgatatcgacaatgatagtgacgacaacgataacaacaacaattatgatgatagaagtgatgctagtgaccatcatggtggtagctgcaatggtggtggcaacaatgacgatgaaggtcatgaaggtggagttcgctgccggtatggtggctgcaacgatattcatagtggtggcaataacaatcatgatg

SEQ ID NO: 110937 - DNA, 511 bp, Glycine max
  Peptide Sequence Number=SeqID_227715
gtccagaggggttgcttctgacagcctagtcttcgaacgcttgagctcgatcattaacttggcctatatcaggaagaactgttggaaccttgttgatctgacaattactattagaggggctaggagagcgagggcaaggccagcctggcctgggactcagcctccccttcacagggaggacgaaggtctcaccgctcaggtaccacaacagagggaggatgagtcatccgagacttccactccagagcccctgatcagaagaaagagggtagttgaaacacaagaagttgtagccactttggagaaatctcttgaggccacttctgagccttcagaaccagtgacagatacaacttcatttcagcaggcagcagacctctccactcctgaggatcagactacaccagtcctgtttcccaacacctctcctccagctacccctgtgcttcacttaacagatgaggaggatgttcagacacaggatacccaggacagatcacaggatttttaa

SEQ ID NO: 110938 - DNA, 198 bp, Glycine max
  Peptide Sequence Number=SeqID_227716
atgtgggatggaggtgaagatatcaagccaaggtaccttggtgatgacatgggaatcacattacatgcatgggatgtggagagcatcaagaagatcgtgacagggattggggaagtggtggacattgatgatgatgttgaagacattcaccctcggacagagcacgagtgctcatcaaaacaccagagcaacccttaa

SEQ ID NO: 110939 - DNA, 312 bp, Glycine max
  Peptide Sequence Number=SeqID_227717
atggtaaaaacaataaatacaaaatctcatggggaaagtgaaagacatctaacgatagccaatagcagtgatgttgttgttgttattgatagcaatggtgatggtggcagtgttgttgtttttggtggcaatagttttgatggtgacggtggtgaggtcaacggtggtggtagtgatgatagtcatgatgatgttgtggttgttggtggtggtagtgtcgttgccgatggagatggtggttgtgcaatgatagcaatggaaaggaccatgtcaaatatagagagtgtgcattcttttaaaattaaaaactaa

SEQ ID NO: 110940 - DNA, 512 bp, Glycine max
  Peptide Sequence Number=SeqID_227718
atggcgcgggacgttattgccggcgtcggtcatcatatcgggcgcatgctggcgatgatggtcaacatctttaatcctcaacaaattcttatcggttcaccgcttaaccaggcggcggacgtgctgttcccggcggtcagcagcaccattcgccagcaggccctgccggcgtacaggctaacgccagcccgccttaagtttgcgctaacgcaagctctcgcctgggacaaatccttaaactgcctcctttgcagcgcgcagcacacgccggaagggctccgtaataaagatgccgtactgctgcagcaggcatccggcctcacgctgaactacagcgacgtcaatcctgtgacgctggaagaggatgaaatcagcaccagcccggcgcagcgcatcgattatccgttactcaatcgcgggctggctggcttacaggatcgcgctgcacgtgtggtggtggaaggcacgggcggctggcgcagcctgatgaacgacttacggcccttgtcgca

SEQ ID NO: 110941 - DNA, 477 bp, Glycine max
  Peptide Sequence Number=SeqID_227719
atggagaataaagacacatatattccattttccatacgaggaaaccacagtgatggagaagtcgtcactagcattagtagtggtgatttggttgcttggtgtgaacctttattgggttctattcttcccataggctttgcatcgggaaatatgatcaagttatcatggatgaacaatgcattccaacaacttcctaatgatgcaaatgatgttgcttttgcacaacatgcacaagctcatattttgtcattcataggaggtttattgatgcaggatacatcaggctttagggacttaagtagtgaaaacattggaggatgtatgtttctcctcttatcatgggtgtgggattggatcacatgtatttctccatgcgtagaagaatacacaaatgatgaggctcacacaaggttaaggtttcctcttacgcgtataacgaatgaattgtgttacatgataggtggtctcgtcccatga

SEQ ID NO: 110942 - DNA, 282 bp, Glycine max
  Peptide Sequence Number=SeqID_227720
atggatatgtggaatgatcgtcactatcctataacatgttcacaatacatgcaatggtatatactgagaactatatgccacatatcacctcacgagttaccacctagtgaggaaacgaggaacaatggtgatgatgaaggcgatggatatgaagataataacaacaatgatgttggtagtctttggaccactaatgacggtgatgatactacaacaagggaaacccagcctgtaacatcctggaaatttctacccggaatttttgaaaacgatgtattttga

SEQ ID NO: 110943 - DNA, 144 bp, Glycine max
  Peptide Sequence Number=SeqID_227721
atggctgggacgccacacatccaactcaacatgatcgtagacgaaggcaataacaagcggaaccaactcaacaacaagaagaaggaagaccaagacgccacacgcgacaacctacatgtggaacatcagcccacaaatttataa

SEQ ID NO: 110944 - DNA, 1278 bp, Glycine max
  Peptide Sequence Number=SeqID_227722
atggctagaaccgaagaaaagcttcacattgtaatgtttccatggctagccttcggacacttaatcccaaaccttgaactggccaaactcattgctcaaaagggtcacaatatcagtttcgtgtccaccccaagaaacatagagcgtctccccaaactgtccccaaacctggcttcattcatcaaatttgtgaagcttccactgcccaaagtggacaaacttccagaaaacgcagaagccaccactgatgttccctacgacgtcgttcagtatctcaaaaaagcctacgacgatttggaagaacccttgacccgttttctcgaatcttccaaagttgattggctcttctacgacttaattcccttctgggcaggtactgtggcttctaaacttggtataaagagcgccttttacagcatttgtactccaccgtgtatgggcttccttggtcctccttcagttctcatgggtgaagatcccgtccggacaaaactcaaaggtttcaccgttactccgccgtggatctcttttccgactaccgtggcatatcgatacttcgagatgatgagaaactctgacgccgtctccgataatgactccggaatttctgacatgtaccgttttggtgcggttatcaagaactgtgatattgtagtgattagagggtgtaccgagttcgaaccagagtggtttcaagtgttggagaacatttatcagaaaccggttcttcctgtgggtcaactcatcaacagagagtttgagggagacgaggataacatcaccacgtggcagtggatgaaggattggttagacaagcaaccatgcgggagtgtggtgtacgtggcctttggaagcgaagcaaaaccaagtcaagatgaagtgacacagatagctctaggtttggaggaatcaaagactcggtttttctgggtgcttagggttcaacgtgggccatgggacccagatgtgttacggttaccagaagggttcgaagagcgaaccaaagggcgtggaatagtgtgcaccagttgggcaccacagttgaagatactgagccacgtagcagttggtgggtttttgactcattctggttggacctctgtagtggaggctgttcagaacgagaaacctctgatttttgttggaagagaagaagatggggtattcgggttcctcgggacgaacgtgatgggtcggatcacgagtgacgcgatcgctaactcaataaggttggttatggttgaggatggaaggaagggtctacagggagaagattaa

SEQ ID NO: 110945 - DNA, 313 bp, Glycine max
  Peptide Sequence Number=SeqID_227723
atggctagaaccgaagaaaagcttcacattgtaatgtttccatggctagccttcggacacttaatcccaaaccttgaactggccaaactcattgctcaaaagggtcacaatatcagtttcgtgtccaccccaagaaacatagagcgtctccccaaactgtccccaaacctggcttcattcatcaaatttgtgaagcttccactgcccaaagtggacaaacttccagaaaacgcagaagccaccactgatgttccctacgacgtcgttcagtatctcaaaaaagcctacgacgatttggaagaacccttgaccc

SEQ ID NO: 110946 - DNA, 782 bp, Glycine max
  Peptide Sequence Number=SeqID_227724
gaagtgtttggaggaaagggcaaaggccttggaaaatcaaggtgaatgggctttcttttattgacatcttggcgcttttgatctttggagttgtcctctttccgaatatggaagggttagtggacctagcagtgattgacgccattttggccatgtatgacacgttcgaccggggatgtgaaaagagcgacgcaagaattttttgttgtgcactggctctctatgtgtggctggtttcacacccttttctccaagaaggtaggcccgtctatccgctacaaggtcaccgctcgtgcgtcgaaaaaggaaaggcgaattgggaccaactcttggctagcatggaggggggttgtattaattataatctcgtcctcgccataagacagcttggctaccccatgagaggagtgccatcagacgaaagcatcacgcctttcatcgcacggggtttcggtgaccacaacgcgagggacagagagcttaggggaagcagtaatgggatcatcggcggctatcataagtggctgagagtccgaacacaaggattggattggctcccaaatctaaagactgtgagagacgatgaggttaaagcttcggaagaaagtgatgaggtacaagccctaaaggcagagcttgaaagagcccgggtagtcgaagagaagttcaagtccatagccatcaaactgaagccttggaacgaagaggtgaaaggaatcatcacgggtcaaaggcatgatctccgaagaggtgaaaggaatcatcacgggtcaaaggcatga

SEQ ID NO: 110947 - DNA, 480 bp, Glycine max
  Peptide Sequence Number=SeqID_227725
atgcagccagcgctccagctcggccagcacccggcccgacggcgagaccggccgcagcggcgactcttcgcgcagcgtgccggcggtttctccgtacaccgaggtggaactggtgaagatcacgcgcggcacgccgaaggccatcgcgctgtccaccagcatgcgcaccgcattgaaatagttctcgctgccttcgacggtgcggcgcgcgggcagcgtcaccaccagcgcatccacgcgcagcagcgattccagatcgtccggatcgcactccagctccggcgtcagctccagttgatagcattcgatgccgctcatccgcgcggcctcgacgccgtccggcgtggttttgctgccgaccacgtcatacccgcggcccatcagcgacagcgccaacggcatgcccagccaacccaaaccaataatggctacctttttcatcctcttcctctcctgaagatcgcagcgccctacccctaa

SEQ ID NO: 110948 - DNA, 225 bp, Glycine max
  Peptide Sequence Number=SeqID_227726
atgaaagcgaaaagctggcgcaaccttcagtggctaagcgcgaggaagaatccagaagaagatgagttgtcaagtttgctaagcgtaccgctccaagtcatcaagcacaccgcttcagctcatccgctaagcgaaacaagtgcgctaagccagaatccacttatgcacgctaaacgatccatatctgtgctaagcacacaagcacgaacaaggccacctatttaa

SEQ ID NO: 110949 - DNA, 258 bp, Glycine max
  Peptide Sequence Number=SeqID_227727
atgggtgaaggaatcccaacgagaggtgtacctagaagcttacttgaatcagtaagcagtatttatgcaaatgcttgcaaagaatccagtgcaataaagacattaaagaccatcgtggatcgtaaaaatgatcaaggtcctcctaagtggattgaagtaaatattcatgttcaaagcgaaggttatgagtgtgactattatgtcatgcattggatgtggaacatagtaagctggagtttaaagaatgattggagcatg

SEQ ID NO: 110950 - DNA, 366 bp, Glycine max
  Peptide Sequence Number=SeqID_227728
atggatttatccactacagaggaagagtacatggctaaggcagaagtaataatagataaaattgtcaaaaaacaagcaccaaggggaaagcaattacacactcagtcaaattttcaatggcggcgttgtccttcgccgcctgatgggattctccatggtggtggtattgttcttcgtcgtcgtgatggggttctctgcggtggtagcgttgttctttgcctctgtgatggggttttccgtggtggtggtgctgttcttcgttgccgtgatggggctctcctcagtggtttttgcgttagtgtagcagaagtgcagaacagcaaaagccaagatcgaatagaggtaaacgaaatgacaaatgagtga

SEQ ID NO: 110951 - DNA, 243 bp, Glycine max
  Peptide Sequence Number=SeqID_227729
atgaggctgatgagtcaggcttgtttctcaattctactgttgattctgttcttgttcaaaatctcatcatctactgctaatgggtatgcaaaatctcaaagctttagaactcagcctttgtcaaatcttagcccctttaaaggaaaatcacgacagaacacaggtgaaggtgatggtgaagcagttcttggtgatgagaaaaggataatctacactggtcctaatcctttgcataacagataa

SEQ ID NO: 110952 - DNA, 2754 bp, Glycine max
  Peptide Sequence Number=SeqID_227730
atgcttaccacagggataatccaacccagccatagccccttttcttcacccatcctgctcgtgaagaagaaggatggcacatggcgatgctgcgttgactaccgggctcttaacgcggtgaccgtcaaagatagattccctatgccaactatagatgaactactggatgatctgggccgtgcttcgtggttctcaaagttggatttacgtcaaggctttcatcagatacgaatggccgaggaagatgcgcacaaaacggcattccgaacacaccagggccattacgagttcctcgtgatgcccttcggcttgtgtaacgcgccttccacattccaagccgccatgaacgatgcccttcaaccttttctccgccgtttcgtcgccgtgttcttcgacgatattttagtgtatagccccgatctatcgtcccatgtgtcccatttggaagctgttctatcagcccttgcagatcgtgaatttctattgaagcaatccaagtgttcctttgcacagcgtgagcttaattacctgggccacataatttcctctcagggtgtggccccagatcccgacaagatcgcagcaatgctcgaatggcctctgcccacgtgttccacctctctccgcggattcttgggtttgacgggattctaccgtaaattcgtcaagggctacgccgcaattgcagcccccctcaactctcttcttcgcaaggacaaattcgcatggtcccctgacgcgcaccaagctttccggcaactgcaacaagctatgaccgaaactccggtgctggccaatcccaatttcttcataccctttacgcttgagacggacgcctctggcacagccatgggtgcggtccttctgcaagaaggtcacccaatcgcatactacagcaaagccctctgccccaggctacaacgagcctccgcctacgtccgggagctccacgccattacctccgcggtgcgtaaatggcgtcactacctgttggggaattcgttcataatcctaacgaaccacaagagtttgaaagatctcatgtctcaaacaatccaaacaccggagcagcagacgtacctatgtaaacttctgggctttgattacaccatcaaatacaaaccaggcgcagccaatgtcgtcgccgacgcactctcacgcatcagtcctgcagaggccacgtgccttactctaactgctccccatttcctctttttacaaaacctgcgtcaagctctgttactggacccccaatacgtggccctcctccaagatattcgtgatcaccctacgaatcatcccgacattaccactcatcaagacctccttttccgacacggccgcgtttggatcccattcgcaaccccattcactcgggttctattagaggagttccattcgtcgcccctcgggggtcataccggagtcacgaagacccttcatcggctccgccagaatttcgattggccccaccttaaggatgacgtccgtcggtatgtggcccaatgcgccacgtgtcaacagacgaagtatgacacgaagaagagtgcagggcttcttcaacctcttcccatcccttctcaggtctgggaagacttatcgctggacttcgtgaccgggcttccgttatcccaggggtacaccgtgatcttggtcgttgttgaccgattttcgaaagcggcccatttcggcgctcttcccacccatcacaccgcttacaaggtggcggttttattcctggacatggtatgtcggcaccacggattcccacgcagtttagtgtcggatagagatcctatcttcatcagcaacttctggcgcgagcttttccggttgagcggcaccaagctccggatgagcaccgcctaccacccgcagacggacgggcaaacggaggtgctcaatcgtaccctcgagcaataccttcgtgcctacgttcatgatcagccatcacgatggtaccgcttcctctcacttgccgaatggtcttataacacgactctgcattccagcaccgggatgactccgttcgaggtagtctatggcaaaccaccgcctacggtggcccactatctccaaggtcactcctcgaatgatgctgttgactcgctactcaccacgcgcgtgcaactccacgcccaattgacccgccgtctccaacgggcacaggaactcatgaagaccaccgccgatagacaccgccgcgatttatccttcgaggtgggtgactgggtatacgtccgcctccgaccataccggcagacgtcgatagcccccaaatactccaaattagccaaacggttttatggtccctttcagatttcggcgcgcattggcccagtagcctataaactcgcgttaccggcatcctcgcgcatccacccggtcttccacgtgtccctcttgaagctccaccaaggcccctccccagcctcaccagggacgctccctgagctctccaccgacaaccatcccattgttaatcctttcgcaattctagattggaaattggactcttcggtcacaccgccggtgaagcgtgtgctggtccagtgggatgatctccctccagaggagacatcttgggaatcttgggatgagttaaaagttcttcacaaccttgcggacaaggtcgttttcgacgaagggggtgttgatagtaacacagcaacagcagaccaacatcaacatatagatacaagtaggcccaagagagagtgtaagaaaccagcttacttgcgggatttcgtttag

SEQ ID NO: 110953 - DNA, 1161 bp, Glycine max
  Peptide Sequence Number=SeqID_227731
atggtggatatgatggatatctctttctccaacgaattctgctacatgagtgcatgtagtttcagccaagagatgtgcttctacagtgcaccaactagtcctagcaggctcaaactaagagcaccctttggttctcaaactggccccacaacaccaagagcagcaacacatgaggatgatgcagactccaatgtgaatgagtttgaatttgaaactagtcgcaggttcaatgttagtgtcggtgacttggacaccgagacaaaccaaaaggatgagaacctttttggtgattcattgcagactatggcatttgctgatgagctattctgtgatggtaaagtcttgccactgatgccacctctcaaacttcctccaaggatgcagcagaatggagatggtagcattatgagcactcacagctcaacactgacgtctccaagatccccaggatcggtgcttaggcttcggttttcgcggcaaagtttgtggaatgatgactttgatcccttcatggttgctttggagaaggtcagagaagaaaagagagggaatccaagtgcaagacatggtctgaggaggactagatcactttctccattcaggagcttcaacaagaagtctgaaaaaaatgtgggaatatcaaagtcaagtcaacttgagtcacattgttgtgacacagctcagctagtatgtgaacttaataaagagccattaaagcaagtgtcaggaagaataaatgtgctatctgagcccaaagggttgatgtttgcaaaacaggtcagactagtgggagtgagcaatgatactacaaccttggagaggacctcagtttccaaagttgctacggaaacaaagaaagatgaggggaaaagaggtggtttttggagaaggaataagagagaaaatataaagaagtttctctttgggactagtaacatgtggaaagccaatgctcatcacaagttagaagataaaatagcagcacaggagaaacaacccttggtgaggaaacttgacatgaaatctgtgaaagcaacagaatcaacacaatgggataaagatccaagaactggtgagttgaccaaaatgagattggtatgtcacaggccattgccaagattttttctctgcttgggttatgaggaagggaaagtgaagtga

SEQ ID NO: 110954 - DNA, 225 bp, Glycine max
  Peptide Sequence Number=SeqID_227732
atggttatgtcagacacggtggtggctatggaaaggttcagtttgaaggggattctgagcgtcgtggagaggttcctagtgactaacctcgcggtggtcctcacgctagtggtgattaacaaaagacggcgtcatcgacggtggggctcctctgggaaaggaaactgcttgagatttcaaagctacgttccccaacatcgtgatcattcaggtttgactacgtaa

SEQ ID NO: 110955 - DNA, 1068 bp, Glycine max
  Peptide Sequence Number=SeqID_227733
atggctcaagggattcaagtcaaggtggagaggtatttgttgaaagctttaagttcctccgagttggaagagaatgcagatgatgcttcaattggtctaaccactcagaatgttttggctgattggatgcttgtcatactcaaattgtgcaataaaccagaattacttctgaaccttcttaaggaagtccttgatatgattgagagtcaggaagatatgaagtataaagaagataacccaaatatgggggtttcacactcgagaactgagtttaggctttcttctttgtttgcatggcttgttggaattctcagtaaagttccttctgcggcagcaaatatgccaaaaagagttttgcatgaacttcttcgtagatgtcttctagtatcacaactttgcaacaagcagcttgtggattcagcacttcagcttgcagagctgatgaacgacagctacttgatggagaaagttcgaaagttctctcttattagtttgtccaatttagagagtgcagatgatgaaagccctttattgacttcaaagaacattttccaatttgaggaatccatgctcgaagcagctaaaaagctagagttagttaaacaacagataatgaaaaataaaaaaccaatggcaatggattgtgacaccgaaaaatcacagacttggactttggcaaaatcatggaacccgtgtccaattggcatgttgccccgtgctgttgggtcatctggttgtcttcctgttcttaacattattgatgatgaaaaacagaatcaaaatcaagtatcagaaaaggaagagaattggaaattgatcccacatggttccaagagagatgcctctttagaccttctgcaacttgataattcaactgtcaagaagatgagggagaccaaagaatttagtgaattaaacaatgaattgccattgcaagggggaaaaggatgtctcatggtaggcggagttcggaagaaacttacagaagaagagctactagtcattgagtcttctgactaccctgtagaaccctctaccttcacatattttggaaatgtctttgcctga

SEQ ID NO: 110956 - DNA, 1245 bp, Glycine max
  Peptide Sequence Number=SeqID_227734
atgccggagcaccacacacgccaggttaccaccgataaattggaagaagcggtgaaaaccctctcccaggacaactcagctctgaacaacaaaatcgataccattcacgcgtccctcaccgccaagattgacgcacttttcgatcgtttcgccaccatcgccgttaattcccctcagcccccaccgccaacaccagtacattcttcctcttcttcccatcgccatcacatgaaattggaagtgccacgcttcgacggccacgatcccctcgggtggatcttcaaaatatctcaattttttgactaccagggcattccagagaacgaacggctcaccgtcgcatccttctacatggaaggacccgcgttatcctggtatcagtggatgtgtcgcaacgggttcttcccgtcctggccaacgatgctacaggccctggaatcacgtttcgccccttccttctacgacgatcctcagggtgcattgtttaaactccagcaaaccggcaccgtcagtgaatacttaacggaattcgagcgcttggcaaatcgcaccatgggattacccccttcgtgcctgctaagctgcttcgtttccggcttgattccggaactccgccgggaggtccaagcactgcggccgttatctcttccccatgccacggaactcgcgcgtctacaagaggataagctcttagaccgccgccgtggccaacgctcgtcctccacaacccttccacccaaaacagggcatcctcaaccctcaaattccaccagagtaccaatcaagcgtcttacctctgaggaactcgcggtccgccgcgaacaagggctttgctatcactgtgaggagaagtggtcccacggccaccgctgcagacctcgtctccacctcttcattgcggacgatgacctcgagcctccggcagatttcaacacgggcgataccccgaatcccatcactgccgacctcgagattaccccacaaatcagtttgaacgctatggagggcactcccgccccccaaacgttccgactcctcggccagctgcgccgtcatcaagtgatcatcttgatagatggtggctcgactcataacttcattcaatccaggcttgcacgtttccttgccttatcgaccgtcccaacagccacccttagggttatggtaggcaacgggaacactctagaatgcaacactcagtcccttcagacttggtcttgggcgtccagtgacttaagcaactag

SEQ ID NO: 110957 - DNA, 831 bp, Glycine max
  Peptide Sequence Number=SeqID_227735
atggctttcacactagacaggtgtgaagatagcatggtgttcactatggaatctcacaagtcagtgcctgctccctttctgacaaagacataccaacttgttgatgaccctcgcactgaccacattgtgtcttggggtgatgatgaaactacatttgttgtgaggaggcccccagaatttgctagagatcttcttcccaactatttcaagcacaacaacttctcaagctttgttaggcagctaaatacctatggtttcaagaaggtagctgctgatagatgggagtttgcaaatgaatacttcagaaaaggagctaagcaccttttatgtgaaatccacaggaggaaaacccctcaccactatcaacaacactaccacatgcatgaccaaccaccacatcttcttcagccagaggaaaatatgtgctggattgatactcccccattaccatctcctaaaccaggcactgacatcttaacagcactttctgaggacaaccaaagactgaggagaaagaacttgatgctcttatcagaactcactcacatgaagaacctatacaatgacatcatatatttcatccaaaaccatgtaagtcctgcttcctatgatgaacaaagaagcagaagtgctattctgaagctgctggaattggattcatcaccaaatgttattagaccagccaagagccggattacggagaagtctttgggaacttctagtgacgagcctaatagttctgtgaagctctttggtgttcctctttgtggcaaaaagagattgcacccagagaagcattgtatagaagaggcttgtgttcagatcaactag

SEQ ID NO: 110958 - DNA, 183 bp, Glycine max
  Peptide Sequence Number=SeqID_227736
atggcgtttgtggtaagacaaccacaaagtctccttgacacaacaaaggttattgattttgttgccaaacaggtttcaccttacaagaaaataaggcgtgtagcatttgttaattccatacccaagaatgatgcgggaaagatactgaggaaggacttaaaacttgccctctctaggctgtaa

SEQ ID NO: 110959 - DNA, 423 bp, Glycine max
  Peptide Sequence Number=SeqID_227737
atgactatttatagaaaacagcctaggagagcagacaaattcgcccatgcgagttgcttgcttagagatgaaggatacggtttaactgagtccgcggttacccgaatcactccggaggaggctaatcgggtgggagcaacaggtaaactgataccaagtatagaagccaaaattgtgaacccggaaacaggggaagccatgtttcctggtgaacaaggagaattatggatcaaaggaccttatgttatgaaaggttatgctggtgacccaaaagcaacttcagaaactttggtggatgggtggttaaggactgataggttgaaagagttgatcaaatacaagggctacctggttgctccggcggagctagaagagttgcttctatctcatccagatataaatgatgctgcagttattccgtaa

SEQ ID NO: 110960 - DNA, 849 bp, Glycine max
  Peptide Sequence Number=SeqID_227738
atgaagcatactctaacatggaattcatcccttttgacaggagagatgtttaaggacattgttggcagtgcatattacattgcacctgaggtcttgaaaagaaaatacgggccagaagttgatatttggagtattggtgtcatgttatacattcttctatgcggtgtccctccattttgggcagaatcagaaaatgggatattcaatgcaatcctacgaggccatatagactttacaagcgatccatggccatccatttcccctgcagcaaaagatcttgtaaggaaaatgttgcattcggatcccaggcagaggctgacgtcctacgaagttttgaatcatccatggatcaaggaggatggagaagcaccagatacacctcttgacaatgcagtactgaataggctcaaacagttcagagcaatgaaccaattcaagaaagttgctctaagggtcatcgcaggctgcctatcagaggaagaaatcatgggattgaagcagatgttcaaggggatggacactgacaacagtggaaccattacaattgaagagctcaagcaagggcttgcaaaacaagggactaagctaacagaacaggaagttaagcaattaatggaagctgcagatgctgatggcaacggaaccatagattatgatgaattcattactgcaacaatgcacatgaaccgaatgaacaaagaagatcatctttatactgccttccaatactttgacaaagataacagcgggtacattacaatcgaagaattagagcaggcactcgttgagtttaacatgaatgatggcagggacatgaaggaaatcatttcagaagttgacgcagataat

SEQ ID NO: 110961 - DNA, 192 bp, Glycine max
  Peptide Sequence Number=SeqID_227739
atggaagggagaacagacaagggtaaaggggatatgtggaaagatataggtcaaggtggtgtgggtgttaaaaagggttgggaagaatatcagagggaggcattaattggaaagagtcttcggcgagtctcttgctttgaaagggtcaaaggatatggaacaactcagttcaaaggttttgcaagttgttaa

SEQ ID NO: 110962 - DNA, 471 bp, Glycine max
  Peptide Sequence Number=SeqID_227740
atggcttgtaaatttgctcctttacctgatagggaagaatcaattcttcaagacattcaacctgatgagctgcatatgaaaattcaagatcccagctttttggatgaggcacaattaattgatgtgcgagagcctgatgaagttttttggaatcttcctatgctgcttatttttattttagtagctgatctgttttttcttcatttaaatgacattctcaacatccacagggccaaagcatctttgccaggatttactgttcttcccctccgacaatttggaagctgggggcctgaaataactaccaaatttgaccctcaaaaggatacatatgtcatgtgtcatcatggcatgcggtcattacaagttgctaagtggttgcagtcacagggttttaggaaagtatacaatctttctgggggaatccatgcctatgctgtccaggttgatccatcagtccccacatattga

SEQ ID NO: 110963 - DNA, 685 bp, Glycine max
  Peptide Sequence Number=SeqID_227741
atgggcaactgttgctcaggtggcaccaatgacactgaggacaagggagaatccaaccaaccaaccaacaacaacaatggaggtggaggcggaggcacaactgcacccgcaaccaccccaccaccatcatctaagcccaaccatcctccttccaagcactcgaagccgcccgcgatcggccccgtgcttggaaggccgatggaggacgtgaaaagcacttacagcatggggaaagagctggggagagggcagtttggtgtgacacatttgtgcacacacaagagcacagggaagcaatatgcatgcaagaccattgccaagagaaaattggttaacaaggaggacatagaggatgttaagagggaagtgcaaatcatgcaccatctctcagggcaacctaacattgtggagcttgttaatgtgtatgaggacaaacaatctgttcatttggtgatggagttgtgtgctgggggtgaactctttgatcgtatcattgcaaagggacattacactgaacgtgctgcggcttccttgttgagaaccattgtgcagattgttcacactttccattccatgggggtcattcatagagatcttaagcctgagaatttccttctgttgaacaaggatgaaaatgcacccctcaaggccactgatttcggtctctctgttttttacaagcaag

SEQ ID NO: 110964 - DNA, 801 bp, Glycine max
  Peptide Sequence Number=SeqID_227742
atggcttcattatgccggcggttatccgccgccgcaccggccggtcacttccgattccatcggcccgccgggatttgcgcggttcgatacggttattccgtccggcggccaatgcggttggttgcggcggggaccaccgtgggcggcggcgcgtgggtgacatccgatgacgtcggagggagggaggagaaggtggggccctgctcctacgccgtggaggatcggagggtggcggaagatggcggaagcgatgcggtggtaggaagtaggaaccgggtggtggaagtggcggcggcggcggttgcaacggtggtgctgggtgttgggaaccgggttctgtataagttggctttggttccgttgaagcactaccctttcttccttgctcaacttgccactttcggatatgtaatagtgtactttgcgattttgtatattcgacaccatgcgggcattgttactgatgagatgttagatgctccaaaggctccatttatagttgttggtctattggaggctctcgctgctgccactggaatggccgcaggagcaattctctctggagcttcgattccaattttatctcagacttttctagtgtggcaaatactcctgtcaattatttttcttgggagaagatataaagtcaaccaattacttggatgctttcttgtaaccattggtgtagttgttactgtagcaagtggagctggtgctgggaatttattaaaggaaggtggaaattatctttttggattcatcccgaaaattgaaggttcgcacaatagtgaattgttttaa

SEQ ID NO: 110965 - DNA, 201 bp, Glycine max
  Peptide Sequence Number=SeqID_227743
atggtcattgcacttgatggtgcccatgttcgatacgttggatgttgtgtatgttcgtggggggcgaagtgcattgaccttgtcggatggcccattcgtgggggacaagcgtggttaaagaatctaagagttgagtcaggtgccatattgtatctgagagttgagtcaggatgtgagtatcgaataatgaatgttgtgtaa

SEQ ID NO: 110966 - DNA, 276 bp, Glycine max
  Peptide Sequence Number=SeqID_227744
atgagagtggaggaccagaaagtcaccatcaacttgttcgaggcaataaagcatccagtggagattccttcaggggagcatgcctttgaagatttgaagaaagaaaacccaacaaagaagcccaaggtggagttgaaagcttcacctactcatctaaagtatttgtttctagaaggaaatgaagccaagctagtcgtgataagcaatgacctatcatcagacgaagaagcacaattgataaaggttctcagaaagcacaaagaagctattgggtga

SEQ ID NO: 110967 - DNA, 222 bp, Glycine max
  Peptide Sequence Number=SeqID_227745
gtcccaacttctaagatattctaccatttgaatgctatcgttgttagcttagcagttgattctgatgaacctgaaaatttaccttggtctcttgggcttgtttacttgacttcaatgttcctaaaacacttgattgaaagtgctcaagatggtgatgtcaagttgtacctggctctctatgatagcgaatcaataccaaaaaatattttgagaggtatgtag

SEQ ID NO: 110968 - DNA, 872 bp, Glycine max
  Peptide Sequence Number=SeqID_227746
agtttgatgagttcaaggaggaactcgagagatgccactgggatgaggagttgactgactttatggacgacaatattgatgttgccattataaaagaattctatgcaaacctctatgaccctgaggacaaatctcctaagcagcctgatcctcaggagttggctgctaagctctgtatcccagggaggggattcgagcttaatgttgatggttatcctttgaagtttctgaggaagaacatggctactctagctcagacatggagtgttctttccttctctaacctgattcctacctcccacacatctgatgtcactcttgacaaagccaaactcatttatggcatcattatgaagattgatatgaacctggggtacctcatctcccatcagatctccctcatagcacaacatgacacatctagactaggattccctaccttgagagtaacttttagaggacccaggaaggccaggggtaagagatctgaggccccttccacttcagcatcagaggcaccaacaccttcttcttctacagtaccttcctcttcatccactcagattccagttattcctccaagcatgcacagggggcagtccatcatcatgcagagccttcagggcttgggcttgccctccattatgagcatggaggagtttaatgctcaggtggcctggccaggagaccagccctcttcttctggagggggtggggcctctgcagcccaggagccagagaccgaggagccaccagcaccagcagaggagcaaactattccagttcagaccccacaaccatctccatcctctgcacctgctcctgaggagacccaaacatcggcactggatttgaatgaagaccagccatag

SEQ ID NO: 110969 - DNA, 423 bp, Glycine max
  Peptide Sequence Number=SeqID_227747
atgaattccaaacagcttgctggcagctatttacttaaacaacagacaaccatcgacagccagaaatcaacagcatctaaagtaaacaacagacagccacagggatctgcaattatgcaattaagggaaaggtttagcagtggggttgaacttagaactgcggtccaggcagaagtagctaatccaaaaaatcctcaaagggggacatctaacaaaacgacacaattggataactctgccaccactaatcatctgaggaaagacacaagcaacaataaaggtcatggcaatgccaatcatgccacagagtccacacaaaagtcagcgtcacagactagaatagatgttaatgctgtagactttttattcaacaagttttgttttttgaaccaaatattgattgaagttcaacactttgattaa

SEQ ID NO: 110970 - DNA, 624 bp, Glycine max
  Peptide Sequence Number=SeqID_227748
atggggattctatacgcactggtaggtcgcggatcggtggtgctggcggagttcagcggcaccaccaccaacgccagcgcaatcgcgcgtcaaattctcgagaaaacccccggcaacaacgacatgcacgtttcttactctcaggatcgctacatcttccacgtcaaacgcaccgatggactcaccgttctctgcatggccgacgataccgccggcaggagaattccttttgcttttctcgaggacattcatcagaagttcgtgcggacttacggacgcgccgttcactccgctcagccttatggaatgaacgaggagttctctaggattttgagtcagcaaatggagtattactccagtgatcctaacgctgataggatcaatcgtctcaaaggtgaaatgtctcagctattcaaacaccgcgtacggaatgtcatgatagaaaacattgacaaagttttagatagaggtgatcggttggaattgctggtggataaaactgctaatatgcaaggaaacacatttcgcttcaggaaacaagctcgtcgtttcagaagcactgtctggtggagaaatgtcaagcttacgtatgttcttgatctaaacctcagtcttattagttga

SEQ ID NO: 110971 - DNA, 1872 bp, Glycine max
  Peptide Sequence Number=SeqID_227749
atgacagttttacactgtcatccaatcacaatccaacctttatggaataggctggaagtcttggaagaagcggtgagtgcccttccacagaggggtggtgaagtaaacctgacgttggggggtattgacttaaacaattcagggagtgttgtagttagagaagacaaaaagcttcttacagtattatttccagatggacgtgatgggcgagcattcacccttaaggctgagacatcagaagacctgcttgaatggaagacagctcttgaacaagccctcgcacaggcaccaagtgctgcccttgttatgggacacaatgggatttttcggagtgacgcaagtgattctattgaaggctctttccatcaatggagggacaaacgtccaattaagtctctggttgttggaagaccaattctgctggcactagaagatattgatggaggcccatctttccttgaaaaagctcttcagtttctagagaagtatggaactaaagttgaaggaatactgcgacagtctgcagacgtggaggaagtagataggagagttcaagaatatgaacaaggcaagactgaatttggtcctgaggaggatgcccatgttgttggtgactgtgttaagcatgttctaagggagctgccctcttctccagttcctgcttcatgctgcactgctttgttggaggcttataaaattgatcgcaaggaagctaggattaatgcaatgcgctgtgctatattggagacttttccagagccaaatcgacgtttgttacagagaattctgaagatgatgcatacaattggttctcattctcaggagaatagaatgactccatctgctattgctgcttgcatggcacccttgctcttacggcctctgctagctggagaatgtgaactggaggatgaatttgatgccagtggtgatagttcggcccagcttcttgctgctgctaatgctgctaataatgctcaagcaattattacaactttgttagaggagtatgagaatatatttgatgaagaaaatatacagagatgttccatgtcagcagattctcaggttgaaaacagtgggagtgaagattcaactgatgatgataatatagatgtgaaagaaaatggttaccatgatgcagagaatgaagttgatcaggagacagatgatgatgctgatcgtattcagagtggaaaattgagtgagagtagtggttatgctggcagtgatctttatgattacaaggcatttggaggtgatgattccgatgttggatcctccagtagtaaccatgctaagactgaaaatgctaatcttaatgctgttccagataccccactctctgaggatcaaaacaagcaaagaaagggcagtgaaaacccagttgatgagaatgatgcttcaaatttgttgccttcaactgaatcttatcgatccatgggtgagattttatcttctatggaccccggcaaccatttacccatgccagtgattgaatcaggttctggaaagcaaacaagtaaagctagtagtgctagtttcagttctaagcggtcgacattctggggaaggagcaatccaaggaagacaccgtcagtggaatcagttgattcttctggagaagaggagcttgctattcagagactggagattgcaaaaagtgatttgcaactcagaattgcaaaggaggctagaggcaatgcaattttgcaagcaagcttagagagaaggaagcaagctttgcatgagcggcgcttggcacttgaacaagataaactaaaaatggtttctaatgaattttccttgtgtattacaacttatgcaagatgtgggttgttaatagtggaaccgctttacattgatttatga

SEQ ID NO: 110972 - DNA, 672 bp, Glycine max
  Peptide Sequence Number=SeqID_227750
atgaagggttatgttgtcctaaatagaccatgggcttttgttcagtggctggagaaagcagatattgaggaagaatatattctgatggcagaacctgaccacatatttgtaaatcctttgcctaatttggctcatggaaccctgcccgcagcatttccatttttctatatgaactcatatgagaatgtagacataatcaggaaattctatcctgaggaaaagggtcctgttactgatgttgaaccaattggcaattctcctgtaatcattaagaagtctttgatggaggaaatagctccaacatgggtaaatatttcattgagaatgaaaaatgatccagagactgatgaaacttttggatgggtgcttgaaattttggcttatgcctgtccatgtataaaatgtgagtcttgcatgcttagttgttgtatgcctaagttatctactccttattacctcatccagggggaactgacatatgggaagattggagaatggcgttttgacaagagatatcatcttttgggtcctccacccaaaaacctccccttaccgcctccaggagttcctgaaacggtggtgcagctagtaaaaatggtcaatgaggctactgcaaacatacctgaatgggattcaataaataacagccgagggaaagatgataaaccataa

SEQ ID NO: 110973 - DNA, 495 bp, Glycine max
  Peptide Sequence Number=SeqID_227751
atggtttcctttgagatgaatgatcaaaagaagattggattaggattaactggctttggtatatttttctcattccttggaattatcttcttcttcgacaagggattgctagtcatgggaaatatcctgtttgtttctggagtgtccataaccattgggctaaaatccactatgcaattctttgtgaaacgaagtaatttcaagggaacaatctcatttggtgttgggttctttattctcatcatgggatggcctattttgggcatgattgttgaggcttacgggttcatcgtactattcagtggtttctggcctacactggctgttttcttacagaagattcctgttcttgatgtgaatgatagtgacatattgggtaaagaggaaaagcaacagtatttagtgaatgccaaactaaagtcttctgatgctgaatttagaaaaaagagctttaagttgtttgaccgctatagaggcaagcgaatgcccgtgtaa

SEQ ID NO: 110974 - DNA, 2259 bp, Glycine max
  Peptide Sequence Number=SeqID_227752
atgcttcaattaaggtatatactctacaatagtgagtttgcagcagcttctagttactatttacaagctgccactatttggccttcaagtggaaatccccatcatcagcttgctttgttggcttcatattctggggatgagctggcagctatttattgttattttcggagtttggctgtggatagtccatttacaactgccagggataatttgatagttgcatttgagaagaatcgtcaaagttactcccagttttctggtgatgttaaagctcttgcagtcaatggaagaggaaaaggggaagcaaagcttgtgaccaaggatactggtgtggaaacctctcgtagaaagggaggagcatccaatatacaagacacttacaaatccttctgcacatgccttgtccgtctaaatggaatcttaatcactcatacaagccttgagaccctcactgaagttctctctcttcttagcgctaacctgcgtgagcttctatcatcagggcaagacgaagagctgaattttggcacagatactcttcagaacaaacttgccattgtcagagttgtttccactatcatatttacagttcataatgtgaataaggaatctgaaggtcaaacatatgcagaaattgtacagcatgctgttctacttcagaatgcattcaccgtagctttcgaatttatgagtttagtagtagagagatgtatgcagctgagggatccttcttgtagttatctcttaccaggcattttggtttttgttgagtggttggcatgttatccatatcatgctgcaggcaatgatgtggatgagaatcaggcaactgttagatcaaaattttggaatcattgtgtatccttcttgaacaagctactttcagtttggtccatgtctattgaagatgatgaagaggagacttgctttaataacatgagcaggtatgaagaaggggaaactaaaaaccggcttgctctgtgggaggattttgagttaagaggatttggtccacttctccctgcacaaaccatcttggatttttcaaggaagaattccattggaagtgacagtgaaaaggaaagaaaagctcgggtcaaaaggattttagctgcaggaaaggctttagccaatgttgttaggattgatcagaaaatgatatattttgactcaaagggaaagaagtttgtaattggagttcagcctcaaatctcagatgattttgttatttcctcctattcaggtatgcctaatgcagaagatttattgaaagacaacatggtagtagacacaaaagtgggaattggtagtccagaccaccatcagtacattgaaggagaggaggatgatgaggttattgttttcaaacctataggagctgagaaacgagctgatgtggttgtttcctcatcacgggcaccccatgaaggcttagaatcagttccaacagcttctattgggaatataaaatttaatgttaattctacttctaaccctctgaatgatgtgaatcatcaaatttctttacctgcttctgttagtgctatggtgcctcaacaccagcaaccagttcagccacattcttcaaggtggttagaggaggaaatatccctttccaacagtttgaaaggtcttagattcttggagaatgggcatgtgatgaaacctgacttaccatttaaagcagctgtggcaatctctgactgtgctgcacttgcagtactagccattgcatcttctggaacattcactgaaaactctgttgtgaaaacatcatcaaccttgcaagctggtttgaaaaaatctccagtcaaccgaccttctaggcaccttggtcctcctcctggtttcagtcatgttcctcctaaacaatgtagtgaacccactgtttcagatttgattagtgggaatccaattatggacgattacagttggttggatggatatcagttgcctgcatcaaccaacggtttaggccctaatggtcctcttacttactctcagtcaaattctcgtcaagttggtaacaatggtttgagtgggacagtcagttttccttttcctggaaaacaaattccatctacactgcaggtggagaaacagaatggttggcaagattttcagacttcggagattttaaaggcacaccataatcagcagttgcagtcacagttgctcccaaatggaaatcagtattttactccactgcctgatcaatttcaaggacagtcaatctggacaggtcaatacttcacgtga

SEQ ID NO: 110975 - DNA, 273 bp, Glycine max
  Peptide Sequence Number=SeqID_227753
atgttgtcacaacctacccttcggcggaagggcgacgcgagggctcacgggtgcatcttccaagggaggaaaatgcgcggagtcgccaccaacgtttattcgaggaaaacatcagaaaaaccaaaaaaggtgtggtctacgaaaagtgtgaaaaggtttgggagttatttttatgcacggggaaggtccatgttaaccaataaaagcaaagaggaccgtttaaggcattggaccttaaaacggttttcagtgatttttgcggacaaagcttga

SEQ ID NO: 110976 - DNA, 1477 bp, Glycine max
  Peptide Sequence Number=SeqID_227754
tttctctaactctcttaagtgtcaaatcattgcattcgccatagcagttggaatcgccgttcatgcaggcaatcatctggcatgtgatttccccctcctcgtaaactcatctccagaaaaattttcacttatatcttcagatttccacaacaaaagacccacatacaaatcccttctgaccggcgtcgaaggcgtaaccggaatctcaatggttgttttgatggctatctctttcactttggccactcaccacttccggagaaacgcactcaggcttccttcacccttcaacagattgacaggtttcaatgcgttctggtactctcaccacctctttggtctggtctatgttctgcttctcgtccatggaacgttcttgtatttgacccatcggtggtaccagaaaacgacgtggatgtatatctctgttccactgttgctgtaccttgctgagcgtactctacgcactcgtagatcagcacattatacagtaaaaattctgaaggtttcaggactaccgggaaatgtattcagcttactgatgtccaagcctaatggatttaagtacaaaagtggacaatacatatttttacaatgcccaaaaatctctccgtttgaatggcacccattctccattacctcagccccaggagatgactgcctaagtgttcacattcgcacagtaggagactggacccaagaacttaagcatcttctcacaaaagaagatgacaaattaccttcagttaattgtcatgcaaagtttggtgaactaatgcaactggatcaaagaggacagccgagactgcttgttgatggcccttatggagctccagcacaagactaccagaattttgatgtactacttctcataggattaggaattggagcaactcctttcatcagcattctcagagatcttctcaataacaccagagcaatggatgaactagtggtgcaggagtcaaacacagaaacaagtcaaacaaccagatcagatgagagctccaatagctttacatcttcaaatgtaactccaggaggaagcaagagatcacgaaggactacgaatgcttatttctactgggtcactagggaacctggatcttttgaatggtttaaaggagtaatggacgaagttgcagaaatggaccacaaaggtcaaatcgagcttcataactatcttacaagtgtctatgaagagggggatgcgagatcaaccttaataaccatgatccaagcactgaaccatgcgaaacatggtgttgacattctgtcaggcactcgagtaaggacacactttgccaggcctaattggaaagaagttttcaccaagattgcctctaaacatccgttttctacagtaggggtgttctattgcgggatgccagtattagcgaaagagctaaagaagctatcacttgagctgagccacaagacaactacacgcttcgagtttcacaaggagtacttttga

SEQ ID NO: 110977 - DNA, 1619 bp, Glycine max
  misc_feature (1605)..(1605): n is a, c, g, or t
  Peptide Sequence Number=SeqID_227755
gcccgaacgcccgcgtgttcgtgctcgaccagatcaccgacgtcaccacccaggccaaggccgccatcgctgccgccggcaacgacccgctggcccgcagccgcgcgctggacgccttcgacaaggcccaggtcgcggcctgtgaagccgatgccggcttccgatgccgcctgtacagcttctcaggcggcaacacctaccgcctgttccgcaacatggaaatcaaggacgtgcgcctggtctacgcgcccccgggcagcgtcggcaagttcggcggcgacgtcgacaactggatgtggccgcgccacaccggcgatttctcgttctaccgcgcctacgtgggcaaggacggcaagccggccgccttcgccgccgacaacgtgccgtaccagcccaagcacttcctgaagttcgccgaccagccgctgggcgccgacgacttcgtgatggtggctggctacccgggccgcaccaatcgctatgcactggccggtgagttcaacgaaaccgccagcttcacctacccgaccatcgccaagcactacaacgcggtgctgaagatgatcgccgacgccggcaaggccgacgccgacgtcaaggtgaagtacgccgccaccgccgccagcatgaacaacgtggccaagaactacctgggccagctggaaggcttcaagcgcatcgacgccgctggtcagaagcaggctgaagaagccgccgtgctggcgtggctgaagaagcagggcgctgccggcaagccggcgctggccgcacacgcgcagctgctcaagcatctggataccagcaagtcgacccgcgaacgcgacctgttcgtcggccagttcaacaacacctcggccgttggcgcagcgatcaccctgtaccgcctgtcgatcgagcgcagcaagccggatgccgagcgcgaagccggttaccaggaacgcgacctgaccaccatcgaaggtggcctcaagcagatggaccgccgctacgtggtgaagatggaccagcagctgcaggcctactggctggagcagtacgtggcgctgccggccgcgcagcgtgacaacgaagtgctgaacaagtggctggccggcagcgatgccgctgcggtgaagtcgctggtggccaagctgggcggcaccggactgggcagcctggacacccgcctgaagtggttcaaggccgaccgtgccgcatttgaagccagcagcgatccggccatccagtacgccgtggctgtgatgccggcactgctgaagcaggaagagcagaagaagatccgcgaaggcgaatcgctgaccgcccgcccgctgtacctgcaggccgtggccgactacaagaagagccagggtgagttcgtctacccggacgccaacctgtcgctgcgcatcaccttcggcaacgtcatgggctatggcaaggacggcgtgaagtacaccccgttcaccaccctggaaggcgtggcggcgaaggaaaccggcgaagatccgttcgattcgccgaaggcgctgctcgatgcggtcaaggccaagcgttacggtggcctggaagacaagcgcattggttcggtgccggtgaacttcctgtccaacctggacatcaccnggtggcaacttcgg

SEQ ID NO: 110978 - DNA, 1042 bp, Glycine max
  Peptide Sequence Number=SeqID_227756
ggctgatgaaagcattgtcgcgacggatgcggatggtgttgtcgaaagcgggctggccgaagaaggtcgattccgtcttggtgtacttgccttcgaagaacaggcggtgcttgtcgttcaggtcgaagtgggcgacggtgttgacgctcaggcggtcgaacttcggctgcaggtcggcaacagcgttcagatcggtgaagtcacagttgacgcacgaggaagggctgaccactggcccatcgaaacggttgcggctgaagctgccatccggattgaagtgatagcggtactggtaggtgttgggcttggtgaaatcgaacgtgccaccggcttggaacgaaccgccgtaggaggtggagtagttgccgcccgggcgggccaggacggtctgcgggttgctctcgctcggcggcttggtgcgatcgaaattcggattgggcacggtcacgtcgtagcgtttaccgatcgaacggtcgccacggccgaaacgatcctgctggctgtactcgaccgccacggcgacattgcctcggccgtcggcgaaattggtgcccgcggtagccgacacgaagccgcgattgaagccgccttcgcccgcaatacccttctgcgcgcgggcctcgaagccctcgtagttcttcttcatgatgaagttgaccacgccggccacggcgtcggcgccatagatggccgatgcgccgccggtgatgacttcaacgcgctcgatccactccaccgggatggtgttgacgtcgaccgcggtgctgccgggattggcaccgacatggcgacggccgttgaccagcaccagggtacggtcgtagcccatgccgcgcaggtccatcaggcccaggccggcggtaccgatgtagcgagtggagttgccgagggtgaacgaaggtgccagctgcggcatcttgttcatcaggtcgctgatggtcagcgcgccggtctggcggatttcttcggcggtgatggcggtaaccggcgaggatgtcacgaagcccgtacgcgcgatgcgcgagccggtcacgctgacccg

SEQ ID NO: 110979 - DNA, 429 bp, Glycine max
  Peptide Sequence Number=SeqID_227757
atgaaaagtgaagaaaaagaagaaacattaagaaagtttagaactggagaaatacatatactacttgccactcaagtaattgagattggtgttgatgttccagatgcatctatgatggttgtgttgaactccaagatgtttggaattgcccaactagaccaactcagagggcgagttggacatggaacaaggccatcaaaatgtatatcggtagcatcagctgccagtagcctaaatcgtttgaaagtactagagcaatcatctgatgggttttatcttgctaatatggaccttctattgtggggacctggtgacttgcttggaaagaaacaatccggatatcttcctgagtttcctgttgccagattggaagttgatggaaatattttacaagatgcgcatgtagctgcactggtaattgttgaataa

SEQ ID NO: 110980 - DNA, 294 bp, Glycine max
  Peptide Sequence Number=SeqID_227758
atgatatatcatacaaaatttgatgaattcaagactgagttggaaagaaggaattggcacaaagagctgaccaattttctagatgggagcatcgatgttgctatagtgaaggagttttatgctagtttgtatgaccctgaagataaatctcctaagcaagtaagggttaggggtcacttgataaagtttgatgaggatgccctcaacactttcctcaagacgcctgtgattattgaggagggggagagcctatctgcctactctaggttttgtagactgaggccagatccatag

SEQ ID NO: 110981 - DNA, 288 bp, Glycine max
  Peptide Sequence Number=SeqID_227759
atgactcaaagtattaatgttaagcatgtgttaattgaagcatcccttcctgtatctttgcattctcttggtgtgttggatcttgatttggctcttcaagttgaaaaacctgctactattactgatgctagtaacaatgaagagaaaacccattataaggcctgggaaaagtcaaacaaaatttgtttgatgcttatgcacataagcataacaaataacattaagtctgctcttcccaaaactgaaagtgcaaaagaatttacgaaatctgtggaagagtgctcctaa

SEQ ID NO: 110982 - DNA, 2390 bp, Glycine max
  Peptide Sequence Number=SeqID_227760
gagagggagctgtaccttcgaatggtgcagtggagagtgaagttgaaccttcaaatggtgcagtggatagtgaagctgaatcttctaatgttgcagtggagagtgaagctgaatcttccaatgttgcagtggagagtgaagctgaatcttccaatggtgcagttgagagtgtggctgagccttcaaatgatgcagtggagagtggagctgaaccttcacaaggtgcagtggagagtgaagctgaaccttcaaatggtgcagtggagagtgaagctgatccttcaaatggtgtagctgagagtgaaaatgaaccttctgtggatgtgtgtgagacaaaaaacgatgcagtgaatagtgaagctgaaacttcaagcggtggactgcagagtgaaaaagaggcttctgttgtgtctgagatgaaaaacaatgcagtggagagtgaagctgaacactcaaagggtgcagtggagtgtgaagctcaaccttttgttgatgtgtctcagaagaaaactgacacaattgagggtgaagctgaactttcagtgaaaggtgggctttctgttgaaggtgaaggtagcaatcaaggagatgaagattcaagacctgcatcggatgctttggatggacagaatgtgggtgcagaggtagtggaaaagccattctactatttgatcagggttcccagatatgatgatgatggaaacatgaaagagaagataagaaatgctcttcaccaagtagaggagaagtctaaaattcgagatgctattcgagctgaaagccagactataaaggccagttgtaaggatttcgaccaagagtttagggctgcaattgcagctcatagagctgctcgggacttgctcaagtccaaacgccaggaaatggattcagttcaatccacaatgaacagattaaacaatgcaatttctgttggggatatagatggcaagataagaagcatggaacacatgatcgagcatgaaactttacctctaaataaagaaaagcaattgatacgcgagatcaaacaattgaagcagaatcgtgaggagttgtcttctaatatgaaaaggcaagatcaatcacaacaatctctagagaacaaggatgacaatattgaagagcactttaagcatttacagcttttgaagaaggaaatggaagtgcttagaaataatgttctgaagtcagatgcagaaacgaaagccgcaaagaagaaatataatgatgaatgtgataagctgaatgagttgctcgctcgatttagggctgctgatgacactcgtcaagaggcatatgctaagttactggctttgaaaaaacaattgcatgagaagagcaaaaatttctgggaatacagagatgctgcaactaaagcacaggaactagcagcaggagggaaaaaagaggagctgcaatgcttctgtgttgatgaggttgagagaatcatggagctatggaacaaaaatgatgagttcagaagggactatgtccgatgcaacactaggagtacgctgaggcgactgcaaaccctggatggccgatcacttggtcctgatgaagagcctcttgtaatgcctaatgcaataactgaaagggcttccaaaaatattcccatggtctcgaacacaactatggaacaagaaaagaaatctccaagagaatctgttaatgtaaaggatgaacctgattcgaaggttgtggcacaaagaactgaaacaagtcagacaactaaagctaaaaagcctaccaagcctgctcccttagagaagcatgtggctcgttggggtgatgagtctgatgaagatgaagataaagataaaaatgaagaagaacctgtgagaacaaaggaggaagaggagctgatactgaaggctgagaaggcaaggaaggaggaagaggaggcaaagttgaaggaaaagcggaggctagaggagattgaaaaagctaaggaggcactgcagagaaaaaagcgtaatgcagagaaggcccaacaaagggctgccttaaaggcacaaaaagaagctgaactgaaagagaaggaaagggagaagagagcaaagaagaaggaaagaagaaagacatcttctgctgtcactgctgagaatacagaacaagaatctgctcataccacagaaactctaacaagtgtggaagaaagtgacctgactgagaaaccagctgaggtaacaaaaaagccacagaaaccatctcaattcacaaggcagaccaaggtaaaatctgtacctgcagctcttcgcaaccgggctaagagaagaattcaaccatggatgtgggttctaattgcagttgtggttgttgttgccttgttttatgtgggcaatagcagctctttgagatcttcgcttgaaggctttggttactga

SEQ ID NO: 110983 - DNA, 369 bp, Glycine max
  Peptide Sequence Number=SeqID_227761
cggggcgggtttggggatgggttcggggcggatattgagaatcccatccccgaccccgaacccgaatttggctatcggggaaaatccgaccccgatcccgaccccggtcaactcagatcttctccgtcaaaatcagggcgggccccacgggttcgggccccacggattgtttcaacaaacaaagccttgattcaagatttcttcaagatcaagccttgcctcacaatgaaaggtttcaagtcattcaaggcacatgtaatcgattaccaatacatgattcctgaacacaagggatgggttgtctctgtgtggctcagactttgtaatggattttacaaagatagtggaaatctcaagtgggttgcttga

SEQ ID NO: 110984 - DNA, 329 bp, Glycine max
  Peptide Sequence Number=SeqID_227762
atgagtgaaatcgaagaagtacaggaacaaatgaaggctgatatggaggccatgaaggaacagatgacaacgatgatggaagcaatgatgagcatgaggaagatgacagaggataacactgctacaattttcaatcaagtgaatcgtccagtctcagatgtagtaggtcaaggagacgaggcaaagaaaaatgcgtataggcctcatcataatatcagcaattttgcacccgtactcatagagaatcaacaaccccaatctgatcatgcacatgtctctcaacctatgggggaaacacatgaagtcccccaagaccacactttgaccgg

SEQ ID NO: 110985 - DNA, 552 bp, Glycine max
  Peptide Sequence Number=SeqID_227763
atgacttgtaaaattacaacaaaaagggacgactattatatgcccttaaatgcttcacaagggacaatattgtatgaaatcatgaatgttgagttaaaagatgtcggtcttgatgtgcctaagccattaagaactaggaatgacggaagagatcaatcaaaatattgtcgctatctccacgcaatagggcatgacactgtcaactattttcaattgaaaaatgccattggaatcctcacacgttggggcaaactagacaaatatgcgcgagaccgagaaggtaattacaagcctcgatatgatcgattaaatagtgacaagcaaatagaaaggtctagaagtcccaaccgacatcaaataagagggcgctcaagggaatgctcctcgagatacaggtataggactccagaaagagaggtagaaaactatatgcagacaatacatcaagatggatatgattcgaaacataagtcagagcaactagaggaaaagcttgaggaatctcagggaaccactagagataccgttaacgcttctggactacacacgtga

SEQ ID NO: 110986 - DNA, 273 bp, Glycine max
  Peptide Sequence Number=SeqID_227764
atggacatcttaattgttccaagccataatgatcccttattggtgaaggatttcatcaataacaagaagtcaaagttgcttccttacaatgatggcctcattggtttctctagtctccatattgtggaagcaatgccttccaagggtacatccactaggttcaaagagaacaagggagggtacatcccttgtggatctttgcttgtaaaaggatttttacaaggttggaaaagaaatctcaaggaccgcaggtcgcttggggactggatgtag

SEQ ID NO: 110987 - DNA, 255 bp, Glycine max
  Peptide Sequence Number=SeqID_227765
atggtggcagtgttgggggccccctacaataatgaagggtgtcaatggagggaggagcaacttatggtcggagacaacatacttgttgtgacggtccttctacgatggtttcatcacggccaatgtgcttcattcagttgttcgctgccactccatgatttcgtcattgctggcttgctactaatgtcgttagtggctccactagtgttggatgcagttcaagttgccatgagaggcctttggtttggcacatga

SEQ ID NO: 110988 - DNA, 210 bp, Glycine max
  Peptide Sequence Number=SeqID_227766
atggaggatagaggatgggagaaaagtaaaggtgtggaaggacagatgttttggggtggggaggaggagttgttggttgctaagttgattgatgttgatacaaggaggtgggatatgaaaatggtgaaggaaatttttctagaatgggaaagtgaaaagatcttctcgatgcctctgagatatgcacagaatgaggactctcaattttag

SEQ ID NO: 110989 - DNA, 270 bp, Glycine max
  Peptide Sequence Number=SeqID_227767
atgggggtgcaaatagcaaccaggcccacttgggccctccagaagattcctccagaaggctgttgcttctggaggaagcaaccctgctcgcctgggcgagctggaaaatctgagccaaggctcttccgaaacgtttccgtgagtgatttcgcgaaggttttcgaccgttcttcgacgttcttcattcgttcttcatcgttcttcagtcttcaacggggtttaggttgcgacagttggcgactccactggggactgtttttagagagttag

SEQ ID NO: 110990 - DNA, 696 bp, Glycine max
  Peptide Sequence Number=SeqID_227768
atggagaaggtcacaccgtctgatccccgacctgctccaattattgaaaaaattaaacatgataactccagaaaggtagaaataaccttcaatagaagaaattcattttcatcaaggatagaagcctctaggtctgaatatgaatcggctagaaggtctttttcagtaagaactcgttcaatccctgtaggattaactagatctgagtcacataaccagttccctacggttaatctccaaggtctagatactacttctagtatacctagagcaacctacaatcaagaacaggaggatgaccaaaacattgataaggaaccacaacagagatggtttttccaaaattttaagggaacaaatagacaacagatccaagacaagttctatgaatttgtcgaaagagtaaaaatcaatattcttttctttgattggttccatgcttacaccatcatagaagatatagattacccatggaaacaagatatcataggtgatccaacaacaaatgtcataacaaactggcaattgaaagacgacgagttaatccaagcagatttaccccctgcaactcagtatcaacttcccaatatcaaagatagtagtaataaacctgtcatggcaattccattcaaaatgaaagacatcaatgaggaagtaacctatagggatattaggagcctaatggaaccaggctaa

SEQ ID NO: 110991 - DNA, 355 bp, Glycine max
  Peptide Sequence Number=SeqID_227769
tagagcgtacatctacttgggttgtgatactgagtacaagagagggtacatctcttgtggatcaattcaagtggagtgtacatccacttggttgttcaaagaaaacaaggaagcgtacatcccttgtggatctttgcttgtaaaggattttacaaggttattggaaatctcaagaaccggtggttgcttgggaactggatataggcacgggccacttgatccaacagactgcattgttccgcatcatgcatcgagcccacgtggattgttgagaaccacgttaatgggtattgaccgtaatgtttcgcatcgcacaccgtgcccacgtggattgttgagaaccacgttaatgggg

SEQ ID NO: 110992 - DNA, 279 bp, Glycine max
  Peptide Sequence Number=SeqID_227770
atggggaaatttgccttccctcgccatcactatagtggcaacaacgacgattatattggtggcaatggtgatggtcatggtggcaatcacattgttggtggttgtggggacgatcttgactggggattgggtctctgttacaataaatgtgtgattgtgtctgtcgaatttgtttacaatgtgtatttgatccttgttgatggttattcattgcctaggagacgacttcggaatactgtgagttggagtttatcattgcctgagtttgtcagcctctaa

SEQ ID NO: 110993 - DNA, 225 bp, Glycine max
  Peptide Sequence Number=SeqID_227771
atggagtacggaggaaattttgtgaaccaactcaatgtcgggcccttcaaagaagttaggaaaattcaacataaaacaaagccattgcttgtgtgtaggttgacttgggggtgccttcgggttccagcaaccatgggtgtcattgctaaggtacgaaccatcgaattaagtggtgtctccccttgccaatcgtccttggatgtacctcacaagtcgtgggcataa

SEQ ID NO: 110994 - DNA, 800 bp, Glycine max
  Peptide Sequence Number=SeqID_227772
atgggaaggtttagcaaggtcaccctcaatactaaaggattgcaccttgttgtttccccacaccacctaatcacaaccttaagaccagagcctttcttgaatagcttatgtaagaacccgacctcagatatggatgagttgcaccaaatggcggctaaatgggaagaaaatgaaacgagactcgttcaaggaaagaggtccctcacaaccaaggcacctactcccccaatggttgataagcagaaacactatcactttcatcagaactatgaccatactactgaagagtgcacaacattaaaagataagataaaagacttgatccgagatgggcacttgaaggattttcttcacaaaccaccagctacaaagaactcctatgaccatagaaggaaccatgttaggaccatagaagggaagatacccaacgtggttgatatgatagaagagatgacaatcgtgatacaagatgatgatttcaaaggcctagaccctatgcaagaagacctcatggtcatcacaatggaggtggacaattgcatggtgatgaaaacacttattaatcaagggagctcggttgatatcctctattggccaacgttccaaaagttagaaattcctgaggcagagatcaaaccctatgatgatcaaccgattggcttttcagggaaaggttcctacaacatcctattggaaagaccatctcgtatcgcgttgagagctatagtgtcaacacctcacttggcaatgaagtttccatctattgaagaaaggattactatttttattatgctcagggg

SEQ ID NO: 110995 - DNA, 252 bp, Glycine max
  Peptide Sequence Number=SeqID_227773
atgaaggcctcatcattatttgacttcgtcgccgttgacttcagcctctactcctttttcgctgtcaacatcatcggcgccagaggattgacggggaaaacatgtaggcttgagagttgtttgggttatatggatgcaaaggaatgttatcttgtggaggggtcttttgggtgggaagagaggttgttggcagatttggtaattggagaaatcttttggctttatgggaattcaaatgtaaagatgaaataa

SEQ ID NO: 110996 - DNA, 477 bp, Glycine max
  Peptide Sequence Number=SeqID_227774
atggcatcccaatcatcaagagatcaaacagatatcgaaaattgttttgatcgtgcgttggctggcttctattcagccattggcaagaatctcgaatcactccaacccgctagagtgattttagccattgttgatcctgcgctcattgttgtttccaaacgtgcttctgcgctcattgctagaaagtcaagtgtgttgaagcctccaactcagtttgcattagtcattgtattgagtcttgaattgtccgtttggatagtttggggagactggattcctttgaggagcaggcgacatagggatcctttgtcccccatggacgttaggatattctcaccgctactattagacgtccagagcaccctggacgtgtccatgctgctggagccggtgtcaccatcaaacaatacttcggatcgactccacggacgtcccgcagctcttcctcactggctcttgaagaattgcagtagctga

SEQ ID NO: 110997 - DNA, 264 bp, Glycine max
  Peptide Sequence Number=SeqID_227775
atgtcctatacaaaaattcaaaaggaaagatatgcagtggcacttgactcaaatggatttggatactgtggtgctttaggccatcgggatgagattgagaagacaactccagagttgttgactagtctcaagaatcaattggttgttcaggtctgtgcaaggaagaggaaaacatttgttctagttaattatggttcagtctatggctttggctccatgggatttggcagccttggattcttggatagaagggtatctgattaa

SEQ ID NO: 110998 - DNA, 204 bp, Glycine max
  Peptide Sequence Number=SeqID_227776
atggaaaattattgtccagtgttaagagtggtaaaattgacaggtgtgagaattggagggtatatttctttcgataatactgatggaggcacttctcgcctccgcagtagggcacaaccttttgctacttccccgatcggggaacctgtccaggtcactatgattctccccccccccccccaacttctgtttctgagggagtaa

SEQ ID NO: 110999 - DNA, 228 bp, Glycine max
  Peptide Sequence Number=SeqID_227777
atgggttcagccctttctggtgttgagaaatctcttgaaattagtgagaaaaattgtttcggtgaaaaaaatccaagccgaggtgcttccgtaacgctttcgagacatttccgtaagcaatttcgtggagattcttcaccgttcttcaccgttcttcatcgttcttcggtcttcaaccgccgcttttgtcgaccaccccaagagatcgttaatggtccaacgccttaa

SEQ ID NO: 111000 - DNA, 282 bp, Glycine max
  Peptide Sequence Number=SeqID_227778
atggcccaggtggtggaaggtaaggtcgaagctcaacacccaaaattcagacagacccaggtggttggaggctcctccatgatggacaagaggtcaagtgtcacccgagatgacctgggtcgcaacatcagtcgtgatggtgatggtgacaacattgagagttgtcaggtgtgtggaacattgcggtggagatggacggaagtaccttatattcatcagttgtatgatgtcagacaaatgggtttgtggggccgtgcaaatcttggcaacaaaacagtggat

SEQ ID NO: 111001 - DNA, 207 bp, Glycine max
  Peptide Sequence Number=SeqID_227779
atggaggaatcccatcgggaaaacaacaaatataacatttcccagtcaagagggtccactcctggcgatgaagaacacattggagaatggaggaatccaatcgggaaaataacaaagatcacatttcccggtgaagagggtccgctcttgacggtgaagaacacattggagaatggaggaatcccatcgggaaaacaacaaatataa

SEQ ID NO: 111002 - DNA, 550 bp, Glycine max
  Peptide Sequence Number=SeqID_227780
atgggattgaatcaagcaccgacttttaagaaaaggttctatcatgtcaaaatcaaaagcatagaagttgccagtttgcaaaaattagggcagcggatgaatcaactccaacgtcaagctttctgcaagacatatggaatgatctgggatttggttatgatagaagtgtttgttgaagccatttcatccttcgctcaatattacgatgagtcgctaagagatcttgggatgctcgctaggaggaagaaagccatatctcttttctgggttatatccctccatggagaggatagccaaagtggtcaaaatctcggcacaagaattggaccgggtgaatgggcttcgttcattaatgtcttagcgctactggtgttcagagtcgtcctctttccgaatgtggatgggctagtggatctagcggcaattgacaccttccttgcttatcaccacagcaaggaaagtccgatcgttgctgttttggccgatgcctatgacacatttgaccgaagatgcgagaagagcggggccaggattgtttgttgcacacccg

SEQ ID NO: 111003 - DNA, 207 bp, Glycine max
  Peptide Sequence Number=SeqID_227781
atggttttcggggcttccgcggctttccgtaatacttccgtaaaatttccgaaaaccctgggaaaatctaagccgaggcgcttccgaaacgcttccgtaagcgattctgtggaaattcttcatcgttcttcaccgttcttcatccgttcttcgttcgttcttcgttcttcaacggttttcttttcttccgtttttaacgtgctttaa

SEQ ID NO: 111004 - DNA, 377 bp, Glycine max
  Peptide Sequence Number=SeqID_227782
gtttcacatttataaaagagttcatctcccacagggacttgatgatgcaaacctaccccccaaaggtattggataaaagacttcaagaggattgggctagagctgctaaagaaggccttagggttctcatgaaccccacgcatcctctccaagcttcttatccaagggacattcttggtggtgaagctccttcttccaagggttattccctaatggttggggcctcctctaaactcttctacctttggcttccactgcatctccatggtggcaaatcaccattgaaggacctcattgaagctcaaagatccaacctccatagaagcttcaaatgcaagcttccatcatgtggtatcagagcatcttcatctaagtga

SEQ ID NO: 111005 - DNA, 279 bp, Glycine max
  Peptide Sequence Number=SeqID_227783
atgaagggaagaaggcataaatatgggtttaacaacaatgaacgtgagaaggcacaaaagaaaagggtggtggatgatgaaactgccgataaacatcagctggatgaaaggggaacgagcaacaatttgaaggttgtacattcaggaactaaagaattcaaaatagctagtaataagagggatttgtttttgggattttctgagcaccaagagcggctacgcaagaagcttgcacttgaggagggaaggatatttgcagctaatgaacaagtttcttga

SEQ ID NO: 111006 - DNA, 721 bp, Glycine max
  Peptide Sequence Number=SeqID_227784
atggacaagccaatgcaattagaatttctcaatcttgcatcaaataatctgtcaggagaaatacctgattgttggattaattggccatttctagtggaagtgaatttacaaagcaaccattttgttgggaacttccccccatccatgggttccttggctgagctgcagtcattagaaattcgtaacaacttgctctcgggaatatttcctaccagtttgaagaagactagccaattgatatccttggatcttggagaaaataatctttcaggatgtattccaacatgggttggagaaaagctctcaaatatgaaaatcctccgccttcgatcaaacagtttttccggtcacattccaaatgaaatatgtcagatgagtcttcttcaggttttagaccttgcaaaaaataatttgtctggcaatatacccagctgtttccgtaacttgagtgccatgacactagtgaaccggagtacatatccccttatctattctcatgcaccaaatgatacacgatactcttcggtatcaggtatagttagtgtgctactatggctaaaaggaagaggagatgagtatggaaacattctgggtttggtaacaagtattgatctgtcaagtaacaaattattaggagaaattcctagagaaatcacagatctaaatggattgaactttttgaacttgtcccacaaccaattgattggtcctattccagaag

SEQ ID NO: 111007 - DNA, 588 bp, Glycine max
  Peptide Sequence Number=SeqID_227785
atgcctcagattagccgtactgcgctggtgcctttcagcgtggaacagatgtatcaactcgtaaatgatgtgaagtcctatcccgatttcctgcctggctgcaccggtagccgagtgctggaggccgggccgacgcaaatgacggcggcggttgatgtgtccaaggccggcatcagcaagactttcacgacgcgtaatacgctgaccgataaccagagtatcctgatgagcctggtcgatggcccgttcaaaaagctgattggcggctggaagcgttcaccacgcgcgccaaagaggtgtatcgtgtcggctaatattgtggttgaagtcgcctatgcgttgccggaaaaacagtacctgcaacgcgtgaagctgcaggctggggcaacggtcgagcaggcgattatctccagcggtattctggcgctgcgcgaagatatcgatctggcgaaaaataaagtcggcatctacagccgtccggtcaagctgcatgacgaagtccatgatggcgaccgcgtagagatttatcgcccgctgattgctgacccgaaagagctgcgccggcagcgggctgaaaagcaacgctga

SEQ ID NO: 111008 - DNA, 141 bp, Glycine max
  Peptide Sequence Number=SeqID_227786
atggataagtctcttattggtggctctccttcttcatcaccttctgcttcctcaacaatttcttcaagttcaactgaatcatcaaccggttccagtgccaattcatcagccaactgtggtttaaatgctttcaccttctga

SEQ ID NO: 111009 - DNA, 219 bp, Glycine max
  Peptide Sequence Number=SeqID_227787
atgagttgtgcaggttcactaagcgcaccacttcatctcactaagtgcaccgcttcagtccatccgctaagcgagaaaggcacgaggcttcctggttatggaaagccattgcttgttacaattggtgcaaaaacaagtggtaaaggttggatgagatttagaggtgcaggggcaacaattggtgcagaggcaacaacaacacctaacatagacatttga

SEQ ID NO: 111010 - DNA, 396 bp, Glycine max
  Peptide Sequence Number=SeqID_227788
atgctggagacaaagttgaaaggaaaagcacaagtggaagctatcatttcattggcggaaaattggttacatggatatgccaaaagcaaggttcaactgtgttgtccaattttgaagcaggaatacatgtcaattgcaagttgttgtgctcaactcctttggataaagaaccagcttgaggactacaacatctatgagagtaaaaaacacaaacccaagcactctacaacctcaaatgaagctacatcaagggagaatgatgcatctgacgttgtcgttgtctactctaccagttcaagtcctattccactcaattatgcttttcccactactgtgactagagatcaaaaccaagagatgataggtcaagcaatggattcctttgccaaacgataa

SEQ ID NO: 111011 - DNA, 1938 bp, Glycine max
  Peptide Sequence Number=SeqID_227789
atggacaagtattgcacaaccgatacaatgtctccatcagcgaaatcaaaatccaagtcccaggagaaggcctctgcaagggggggtaaggaacaacataagacttctccaaagacttccaagtctccaactcatgggagtggcactcctgctagtgcacacaatcccatctcgggaacatttcaaactccagaaacatcattggttgcttcctctactcaagttcatgacaacagtcatttcccaaaaatagatgatgcagatgagcattctagaagtcctcaaggaatggtgtctgaatgtgattcggtttctaacaatggtagctgctctggtgaatcagaagagtctaaagagaaggtaacagtaacaaactcttctactcagccagacagtatacttggttgtgataatgatagaagggagaagatccgcttgaagaacgagaggaagcaccagaggcagagggaaaggagagcacaggagttgcatgaccgttgttgtgggtacctaatgtcaagaaagctagaatcacttgcacagaagttagtggcgatggggttctcttctgagcgagcgacgttggccttaatgttaaatgacggaaaattagagcaatcagtttcctggctatttgaagggagtgaagaacaatcacaaagcaaggatactactagccttataagtgagggtaatatgaaaattgacatacgtgatgagcttgctcagatatctgccctggaggtaaagtacaattgttcaaagcaagaggttgaaagagcagttgttgcttgtgaaggtgatcttcaaaaggcagaaaataccttaagaacacagaatcaggaatttcctacaacccaatcgaagtcagaagattctgctcaaaataatagtagtctggtgagatcacaaggatcaccagcagcatcggtttcaatgcagcacagagggaatgaaaatgactttaaccattacaacagggtaggtggttcggattccatgtttccggatgttgaaaccgggaatgtacattctctacaatcgaatcatccaaatttaatgactgagaaaagatggagtggtgttccaggatcaagcctgtctgctatgtttgccatggcaccatccatgcaagcagtgcctccatttgttaaaatggagggcggatggcctatttcccttgcaaatgaaggaagaatgattcaacaaggagtaggaagggagccggtaatgatgcaacatccacaattcacaaatgccaaacagaactctatgatgtctttaaattcctttccttcaggagcagcaggttggtatgcaaatagtattccaggtgctgacaatgtgagatcaaatgggaagttactacaaactcaaagcataagaagtgtgagcccaaatcatttggagcaattttgtcaagctccgtatagggaatattctcatttccttggaccagtagactactcatctgctggagtgggtggttattgcaagccaatgggtgcatcatcatcacctccacctacaattcctcctcggcatcaaggttcatggagcacgggcgcgtcttcaccatcgctcatggtgccaacttcccttggactattttctggtcatcagaatgcagccagaacattcaactcacattcacacatggattggaacactgtgggtttcatgccagaatttgactacagcagcatagattggagtttgaatgcgccatcttcttccgtgtcgggtggactgtggctagggatctcttcaatgttgagaaacagttatggggataggaggggcagtcaatgcatgagtggattgcaaatggctagggaaacttcatcatctggtggattgagagagtggaccactccttttgctgggaaggacatattcagagttcctaggcagtttgttacctctcctcctatgtag

SEQ ID NO: 111012 - DNA, 357 bp, Glycine max
  Peptide Sequence Number=SeqID_227790
atggggatttcggccatgccggcgaggagaatggagatgatggtgacgaacttgagaaccaatgcggcttattcatctcgacacagctccatcttcgtgcctccacaacttgagtttatcatcgattcccgaaggggaaattgtagggcacactactgcaaaatgtcgtctccaatccaccatatttatggtcctcgtcattttgaccgtcaccatttaccaatattcctccaattcggggtcattctcacggtggcaacgacaaccgcaagctcatcacaactcattcacaaccgcaaacccaatggtggattcaaatcgaatagtgacaaaataaatcaccctcaccaaacctga

SEQ ID NO: 111013 - DNA, 276 bp, Glycine max
  Peptide Sequence Number=SeqID_227791
atggaactgtggctggttgatggtgaagggggggtctacctagccctgggcccatcaggaatattctggagggaggttgctttaggtggaagctacctagctcgcctgggcgagctgggcggcaaccacctccctcatttttgctataaaatgctgtttggggttgaggggaaggggttcagcactttggatattcaattttcacttaaaattagtgaggagaagaagaaagaaggacaaaatccaagccgaggcacttccataatgcttccatga

SEQ ID NO: 111014 - DNA, 955 bp, Glycine max
  Peptide Sequence Number=SeqID_227792
tgctgttagtaaagagactagactagagagactagagaatgttgatgacttgatgagctaccaaatgattttcaacaagcacgacataagagtatgttactacaaacattgcaatgaaattattaccaatgcatatgaaaaacgggatacattgtacatgtgcacaggcttcaatgagaagtctccctatccagttgttgtgcttcaaacagtgatgaacctcatttggcagaagcagaactggatgacagtctttgcctccttgctttatcagctttttccaagtaatgttgatgagattggtgtttggtccctgcaagaaccaaaaacacctttactccaaacttcactaagagcccacccacccaaagtgaaaacctcattagaattagagcaagaggagcttgagaagatccctaaattcaaggcaatacctctaaataagaagatctttgaaagtaaaggggatattggagtattctgccttaccaagaaacatgttagcgaacctcaagaatttcactttgccacagacgaaaggattccgccacctgctgccatggctgatttatttggcaagctttctttgaattctgaaccttcacgtaatcacaacccaatcccaagaaacacgactccaaatccgtttcatcttcacacagagaaaagaggtgctgagaaagagaagaagctggccatggaccttctgcagaaacagtgggaagaggaaaacgcaaggattcccaaggctaatccatacccttacaccactgattaccctgtgatcccagcaaaaccagaaccaaagcaatgcacaagaccaaagccattccaattggagagcctggtgacacacgaggatgagatgcaaaaggaacacaaagaaagacacataatggaaaaagaagaggctcaaatgagagcattcaaggcacaaccaatcataaaagagtga

SEQ ID NO: 111015 - DNA, 195 bp, Glycine max
  Peptide Sequence Number=SeqID_227793
atgcatggtcatcaaactggaagtagaagacaacctcatctccgaccatcaattttttttcatgaagatgaaaagaagtcagccttcaaggtggatgtcctcctcctcccattcaacttcttttctaatcaaaagcttccattcatggtcataaaatcggaagtagaagacaacttcatctccttccattcatag

SEQ ID NO: 111016 - DNA, 2982 bp, Glycine max
  Peptide Sequence Number=SeqID_227794
atggatttgatgcagagaacaattgatatgttgattaagaaccaaacaacaaccaatggtggttcgaactcaaaaggtcgtaattctagcactccagtcgcgtcaccctcgccaatttcaataaattctggtgttaaggagatttcattgggttttccacattttgatggacatactccagtcatggaatggattttcaaggcagagaaattcttcaactatcataatactccaaatcaggatcgtgttgatatagcttcaattcattttgagaaagatgtaatttcgtggtttcaaatgctacagagaatggagacggtgaatacttggactgagcttcgacgtgcattggaatctcagtttggtcctttactttttgattgtcctatggcagagttattcaaacttcaacaacaaggtacaatggctgattattatttgaaatttatgtcattagctcatagatttgatggtttgactcctgaggccttacttaattgtttaattagtggattaaacaaggacatacgtagagatgtggttgctcaggctcctaatgatttgttacgtgttgttgctttggctaaattgtatgaggaaaagtatgttacagtgcctattactcatcctattccattttcacctagatactcaaacttgtcttcttctaatactcataataatgtccaaaaaaatccagtgaaaaatagtttacccccattgctgcctactccaaataatgatgatgctgagcttgaattttatgatagtgaagacatatttgatagtgtggctgataatgcgaaggtgattcttgaggatcatcacttgtcattgaatgctttaaaaggtggtatgggtgtaggtacaattcgatttatggcttatattggcaagctcctagttaaggttttggtggatgggggcagctcaaacaatttcttacagccaagagtggctaaatttctcaaattacctgtggaaccaacacctttttttaaggttatggtgggaaatgggaattatatggaagctgaaggaatgattagcaagttaactatcaaagctcaaaatgccaagtttcaattgcctgtacttttattaccagtatcagtggatggttatcaacctgttaaagtcaaaccttataggtaccctcacagccagaaggaggaaatagagaaattcgtgaatggtatgcttgaaaaaggaattattcagccaacacttaatgccataactatcaaggacacctttctaattccaactattgatgaattaattgatgaactttatggggcagtcttcttttctaagttggatttaagatccggttatcatcagattcttcttaattctaaagatagacacaaaaccgcttttagaacacatcatggacactatgaatggctagttatgccatttggtttgaccaatgccccaaccacttttcagagtttgatgagtgacattttcaaaggtgctttaagaagatttgttttggtattctttgatgatattcttatattcagtccttcatggaaggatcatttgtctcatttggaatttgtgttgagcattttgaagcaacatcagttgtttgctagattctctaaatgtgcttttggaccattaccaaattctcttaagcaattaagaggatttcagggcttgacaggatattatagacgatatgtgaaaggttatgctaccatagcaacaccattaactgatcttttaaagaatgactcgtttaagtggtctgcaagtgccactactgcccttaataagttgaaggaaatcatgacttcagctccagtcttagccattcctaacttcaaagaaccttttgtactagagactgatgcttcaggtactggaattagggcttacaagccgggtagggagaatgttcttgcggatgcattatccaaaagtttttctatggcatggtctgaagtagtaggagtgtggatgactcaagtagcaacattaatgaaggaggatgctattttggctgcactttataaacaatgtatagagggaactatgtcaggaactgaatatacagtgaataatggattgttgttttggaaaggcaagatgatgattccttcgaatgaagcattgaagcacaaaattattcatgagtttcatgtttctaagattggaggtcatgaaggagtcaccaaatcagtttccagaattcgtaaagaattttattggcctaaaatgcagcaagatataagggattttgtgaaaaagtatagtattttccaagaagccaagggcaccacattggctatgagttctgcttatcatcctccgtcggatggccaaacagaggtgttgaataagacactagagatgtacttgagatattttgtgtttgatcatcctaaaacctggtttgagatgcttccttgggctcaactttggtacaacactttctttcatcacaacattggtatgtctccctttaaggctgtttatggtagggatccaccatctgttattccttatgaatgtaatttgaaagatccactcaaatcagccttaccattacccttaacagtgggtgaaagtggtccaatggttcaacccatagcagtattggattcaagggtgttattgagagactcttcccaagtggaacaagtgttgattcaatgggaaattgctggtcctgaggaagctacatgggaggatgtgacttgggttaaggcaagttatcctcacttcaaccttgaggacaaggttgtttataaaggggagggtaatgtaacatgtgggaagcaggaaggaaaattggtgcgtgagtcagttacaaaggaaggacacgtggctgatgatctgcatgtaggggtcatgttgatggtgaacactcttcctgattgcttctctgatccttctgatatttccttcttctctataccttctctgaacctttctgctctccctaatcttcaggtgctattatga

SEQ ID NO: 111017 - DNA, 372 bp, Glycine max
  Peptide Sequence Number=SeqID_227795
atgcctatgagagttaactcaaatggtagaactgaactcccttcaaatggctctacccaacttgtaagccctcttccaatggcacacactcaccaaaacctcttatggtggcttcctaaccttcccacgacctcaatcatgctgcctgcagaccaagagcaacatggtgtcaacttccagattgattcaaggagttttgatgataacaaagatgatgacaaaaagctcaaaagtcaagatcacttcatgataacaaagatgatgacattcaagaatgagttcaagattgagtcaagaacacttcaaggatcaagaggaaatttgatttcaagaatcaagaatcaagaatcaagattcaagattcaagaataa

SEQ ID NO: 111018 - DNA, 1074 bp, Glycine max
  Peptide Sequence Number=SeqID_227796
atggctacatcctcagagacagaacctaagtcatttaaagaagcttcccaattagacaaatggatcaaagcaatgaatgctgaaattgaggctttagaggctaatcatacttggattttgactgacttccctcctaacaaatctgctattggatgtaaatgggtttataaagtaaaacacaaggttgatgggtcagtagaaagatataaggttaggttagtagccaaggggtatactcagattgagggtcaagactgccttgatactttttccacaatggttaagataactactgtgagattgttacttgctttagctattgttaacaactggcatttaaagcacttagatgtgaacaatgcctttttgcatggagaccttaatgaagaagtttacatgactttgcctcctggctcgttggtcgccttatttacctcaccaatacaaggcccgatatcatatgcaatgcaacacttaagtcaatttgtagctcatccttcttcagttcatcaacaagcagcctataggattcttagatacttgaaagcagaactaggttctagtatatttttctctgcttccagcatattgcatctcaaagcatttagtgactctgactgggcaggatgcattgatgctaggcgatctatcattggctactcagtttatgttggtaattcccttatttcttggaaatccaaaaagcaggccacggtctctagaagttcttccgaggctgagtatcgagcactagccagtgctacatatgaattacaatggttaacccacttgcttaatgattttgggattgtttacactcgactagctcttttgtttggtgacaattgctccgcttttcacattgttgttaatcctatctttcatgaacacacgaaacatattgagatagactgtcacattatgcgagagaaactgcattcaggccttatcaagttgctgaccattgcttttgctcaacaacttgcagacatatatactaaagcactttcaccaggcgccttcaattttcttcggtgcaagttgggaatgtcagatatacattctccaacttga

SEQ ID NO: 111019 - DNA, 681 bp, Glycine max
  Peptide Sequence Number=SeqID_227797
atgtttcaagttcagagactagtgatcatggccaagacattaaaatcactcagcaacagtatcaagcacttatgtctttgctggctgccaaccataatagttctcatggatcataggttaaccaaattggatataagcagtcagaggatgattggtaaagttgatgtagtggaaggtttgtacaagcttagaatacctgctgccaattcagttcccaaggctaacaacaatttcatttccattaaatatgtattgtcttgtaataaagaagtcattgatatttggcatttccgtttgggtcatccttcatatgataggatgcaattgttgaaacaaacttatcctatgttgacttgtgataaaacctttgtttgtgatacttgccataaagcaaaacagagaaaacttccatttcccaatagtgactcctatgcttctagtcctttctctttgatacatgtagatatttggggtccttgtaccacaactactttgaatggacataagtattttcttacaattatggatgatcatactaaatttgtttggatttttataatgacttcaaaagctcagactcaaactcatttacaagcctttgtttcctatgttgagaggcaatttaatacaaaagtgaaagctattcgatcagataatggtgcaaagtttatcatgaaatag

SEQ ID NO: 111020 - DNA, 273 bp, Glycine max
  Peptide Sequence Number=SeqID_227798
atgaagaaggctatagctagaggtagcaaggccaagcagaaagctaagaagaggcaagtggaagaaaaggccatagctggagtatctgttactagtcaacttgaagatacaaaggtcagcaaggccaaacagaggcgagacaaaagatctcaacaagaagcagaaagggagcagagaatccaagcagagcagagtgatattataagtgatcgtgtgattgagaacaagaaattggaaaacaagtttctagcctcttggcttgattgtttgtga

SEQ ID NO: 111021 - DNA, 246 bp, Glycine max
  Peptide Sequence Number=SeqID_227799
atgtcgcgcaacggcaaattggtgtcttggcctgtatttcttcaagctctcaaaacccgctttgccccatctcaatatgaggaccccaccggtgctttattcaagctaacccagagaggctctgttactgactacctctccaagtttgaagcactcgcgaattggatagtagggctcccccctcctttcctcctgagctgcttcattttcggccttgctccagaagaccaacgcaaggcctattag

SEQ ID NO: 111022 - DNA, 642 bp, Glycine max
  Peptide Sequence Number=SeqID_227800
atgattgaggcaacattggagatcttatccgtaagaggtaactttatgataaatggggcatacatccatcaagagggagaaaaatggggcactccaggcattcctcgtgaaacacataaacaactaggttacaagagcatattgccacaaggttcttcgtctcttagctactacttcaggaattcgcatcactgcttcaggatagagcaagaacattgtttgatagctggaaaggagttggaaatggtgatactgaatctcatgaagtggaggttgctaaggttgacaatgcaagtgacacgattgtcagcgaggaaaggcagccatctgcttcaaatgaagctggcaatgataatggttgcttgtgaagcaaaagcaccagattctatgaaagaaccatctttagagaaaaatgttgaacacaatgaggatgatgtttgtcataaattaactacttttgctagtatgaggacgcttgcatatgacaggagtggggaagatgatgcaactagcattacacaagtttttaaagctacagaaaatgataatgattgttgttctaatgccttgcagggcacatcagtcagtgacagtaacttgggaaagactgaagtgttagacatgtttgtctctggaacataa

SEQ ID NO: 111023 - DNA, 210 bp, Glycine max
  Peptide Sequence Number=SeqID_227801
atggttttgtggaggttggcggtgtgtgcagagtgtgactccgattgtcattgtgtgcgtggttgggtatggtgtttgggtggtgggtgtgaatttgggttcatggaggttagtggtggcttacggtggtgcgacgatgttgtttgggtaggtacagaggtacgtggtgttgtggatggtggtatgatgttgatggtgtcatgggtgggg

SEQ ID NO: 111024 - DNA, 168 bp, Glycine max
  Peptide Sequence Number=SeqID_227802
atggagttgatgatttcattcgagttgcaaatgaatcagggcacattcccagtccatgtgcaaaatgtaggaagcgttatagatgaagggaaacaaaagaaagcaagaaaggtgatgtttgactttattagatcctttttccctcaatcctcaaaaagcatggtatga

SEQ ID NO: 111025 - DNA, 1032 bp, Glycine max
  Peptide Sequence Number=SeqID_227803
atggaagaaggatttgccatcaacaaaccacctcaattcagagggataaaatatgactactggaaggagcatatgatagccgattttgaatatattcacatagatttattggatgtggagtacacaaaggtacacaacttcaagagtgccaaacaaatttgggacaccttagctataacatatgagggcacctcacagacttatgataattatgatcacattgacaaaattctaagaagtctatctaagaaatggagaccgcatgtaacaacactgagagcgttaaagaatcttgagtctatgtcccttgaggaacttgttggtaccctcaagattcatgaacaagagctccaacaagatgaaggtcttagaagagaaaaatctctggctctcaaaagtcagaagaataagaaagaaccattgtttagagaacaagtacaaagaagctcttccaaagagcttaaagttgatgattcatcatatgatgaatctgaagaagacttagatgaggataagctcaccttcatctctttcaaaattcataagatgtggagaaatgaaagtgggtctaagtggagaagttctttaagaagaatggcttgggacaagaaggacaaagacaaaagctccatagtctgctatgagtgcaaaaagcttggacacttgatcaagaagaactggatgacacctcatcagatgaagacgatgaagaagcaaacatatgccttggcttttgaaggatctgaatcagaccaggacgatgaggatcaagtagatggttcattggacgagttcgctcaagcatgtaaagcttgtgacactcctaaagaaaaaaagtccaagttgtgcattgagatagagacaaatgcccacgaaaaagttacccttcttaagaactttatggagttggaaaacaaaccaaaagatcttcaaaaggatctaaaggaacttaatgaactacgcattcataaaaatgaagaaagatatgatctttggagagaatgtgcacaagcacacaaagattatgtgtaa

SEQ ID NO: 111026 - DNA, 570 bp, Glycine max
  Peptide Sequence Number=SeqID_227804
atgaaaacagtgaaagtagtcctgatagtaagttgtttcttccctttgtcaataaaccacatcatatttagtcatttgataacttttgtttgtacaaaacaccctgatgaatgctgcaaagaaattcaaagtgttgaattggaggaatcaagtagagatgaccttgaatatgttgatccatcagatcagcaagcaaagacaataacttttagatttgaaaagaatatgaaagatgtaggtgtgggttcaatgttagaggcacctgaatgtcctgtagaatggcctctgcaattcaagtacattgaagttgtgaaggaagaaggattggagatatctcaaccagctcttgacccagattcgatagagatacatcatagaattacagttaaagcaaggactaagaaattttctgcaccaccgtatgtttcaatattgatgcatcaactctcacaggaaagcacacctcgcattgtgaggataggaaataatcctggctacccctgtggtggtactcacgttgttaaaatttatcttcttactctccaagccttaaatggtaattatttttaa

SEQ ID NO: 111027 - DNA, 315 bp, Glycine max
  Peptide Sequence Number=SeqID_227805
atgaccacagattcacctccactccttatgttcccatggacccggtccccagcggagtcaccaactgtcgcaacctacccttcggcgggagggcgacgcggggctcacgggtgcgtcttccaagaaaggaaaatgcgcggagtcgccaccaacgcttattcgaggaaaacgtcagaaaaatcggaaaggtgtggtctacgaactttaagtgtgaaaggttcgggagttgtttttatgcacggggaaggtgttggaacattaaacgatcttttgatttttcgaaaggcgagaaacgttaaggcattggaccattaa

SEQ ID NO: 111028 - DNA, 637 bp, Glycine max
  Peptide Sequence Number=SeqID_227806
aggactacacgtcctccccttcagaggactacacgtcctcaccttcaaaggactacacgtcctcgccttcagaggactacacgtcctcaccttcaaagggctgcgcgccctcaccttcagagggatacacgccctcgccttcagaggactacacgtcctcgccttcagagggctacacgccttcgccttcaaaggactacacgtcctcgccttcagagggttgcacgccctcgccttcagaagactacacatcctcaccctcagtggactacacgtcctcgccatcagagggctgcacgccctcgctttcagaggactacacgtcctcgccatcagagggctgcacgccctcaccttcagaggactacacgtcctcgccatcagaggactgcacgtcctcaccttcagagggctacacgccttcgcctttagaggactgcacgtcctcgtcttcagagggctacacgtcctcgcctttagagggctgcacgccctctccttcaaagggcaacactcccttggtcacctccctgatctcgaaggagggctgactatgcgagcaataccagagggaggctatcattcagccactatgtatactggggcaggatttcacccagccgctgcaaagagatga

SEQ ID NO: 111029 - DNA, 306 bp, Glycine max
  Peptide Sequence Number=SeqID_227807
atgtttctcttaaccaatgctttgaagggattgaacaataatcaaggatgtaagtccaaggaaactgctaaatggactccagttaaatattttactgatccaagaccattggaaccagagagaataaaggcaattcacattcagtgggcaagatgttttctaagtgttaaaaatgcaacactagaaatacactttcaacatcggttatttagggcattctacatcggctctaaaaccgatgttgaaagtgacgatgttgaatgtatcatcgttaacatcggttttcaaaaaccgatgttaacataa

SEQ ID NO: 111030 - DNA, 504 bp, Glycine max
  Peptide Sequence Number=SeqID_227808
atgacgatgaaggatcactttccaatccccaccattgacgaattgctcgatgaattaggcggttcatgttggttctccaagttggacttacttcaggggtatcatcagattttgaaggatgacaatgatatcaacaagatggcctttcagactcaccacgaccacttcgagttccagatgcaggtggagtacttagggcatatggcctcagcccagggcgttgcgccaatttttgcaaagattcaagctatggaacaatggccgcgtcccaaatcatacaaagctgtacgcagtttcttgggcctcgcgggattctatcggcgcttcatacatggttatgcatccatcatgacacctttaaccaccctgttaactcgtgacgagtttgactggcaacctgcggcccaacttgcctttgaccaattaaaagcaaccctgtcctctgctcttgttttagtgttgccgaacttctcaattccgtttgtcctggaagcgaatgcttaa

SEQ ID NO: 111031 - DNA, 459 bp, Glycine max
  Peptide Sequence Number=SeqID_227809
atgtcgacggacaatccttgctggatggtgcatgtgggagagactcagatcatttgtagtgttgcctgtacgtcgagggtgtcattccccttgggtgcgttcaggaaaggtgtgggaggattgctcgtcgttgtggggacaatgcatgtgtctgtcatagatgccgaacaaggatgggagtctgtgaggggggtctcgtgtctgaggtcagaccgagtcctaaccatggatgaatgtgagaggattgacaagaagtcgtggggtattttttaccggggccccatggagagcagacctgcaaaacaaaggactccgatgctcaagggttgttgcaaccttgtagataatagccaggagcttatagataatgttagagataaacatttgcttaaagataaaaggttggagataacctgtttgttggggactgctaagggccaggcgtccatgctcatgtag

SEQ ID NO: 111032 - DNA, 438 bp, Glycine max
  Peptide Sequence Number=SeqID_227810
atggaaaattttctggtcaatcgcgatgcaacgtttgagattatgcgaaagaagttagcaaaggctcaggaggcaatgaaacgatccgcggatgcaaggcgccgagatatcacctttagtagtggtgattgggtgatggtcaaattaacaccccaccggcaatcctctatgtctcaggtcccgtattcaaagttggcaaagcggttttatggcgcttatcagattctggaaaaggtgggaaaggttgcttataaattggacttgcctacagggtctcacattcatctgattgttcattgttctatcctcaaaatgtttaagcaatcttccctttgtcctttcttgcctttgcctacggcagctgtcaataatcaaccaatgctttgtcctttcactattattgttggcgcttgtgtaatgggatggcctttccgctga

SEQ ID NO: 111033 - DNA, 330 bp, Glycine max
  Peptide Sequence Number=SeqID_227811
atgaccctttcatcatggcaaaacaagctagacaagtattttacgtgcaagacccgtgtgatgaaaggtgagacagaggtcaccaaagcaatttacaaaagcaaaggtgaaacgaaagatattgagctggtagaggaggaacaggcacggattggtgctgatccttctaatgagacctccaataaatctgagaattataaggaggaagcacggaatgcaacacagaagcataaaccaaagaaggtagagagtgtcaacattgatgcaaaagcctttggtgatgactggaaaattctgattgctttatgcattctgaagctgaaccactag

SEQ ID NO: 111034 - DNA, 216 bp, Glycine max
  Peptide Sequence Number=SeqID_227812
atgaaagaaggttctgtgggtattgttgggtcctgcacaaagattaataggcctatggactttatcacaattgtggggggtcaaggatactcattacctgcagatatacagtatcttgatgctagatgggaaattcctattgtgcttcctctgcgtgattgttttgcccaagagatcaacatgctatgccgccttgatgggtttgtagtcctctag

SEQ ID NO: 111035 - DNA, 309 bp, Glycine max
  Peptide Sequence Number=SeqID_227813
atgggacctagttttgttgatgttgtcgtggggaggattactcaaggaactaaggttcttgcagaaagagggtatgaaaagatctttaggcaaacatttgagatagttccagaggagcagcttctcaaaacttatgcatgctacttgtctacctcggctagacctgtgatgggagtcttatatttgtcaacaactaagctggcattttgtagtgataacccactttcttaccaaaattctccaaccatatgggatcgacacaggtttaaaggagcactcaaaccgagtgtatttacccccaaggcctag

SEQ ID NO: 111036 - DNA, 186 bp, Glycine max
  Peptide Sequence Number=SeqID_227814
atgacccaaaagagaaaaaagagaagtggtggaggattggctgagtttgctgttgctaagaaaaaacattttgatcaatgctgcattaggtggtgtaggtcactattcactccaacgggcaaagctgggaagatgaatgtgagtaaggcacttttcaaaaaggcaattaattactggtggacatag

SEQ ID NO: 111037 - DNA, 252 bp, Glycine max
  Peptide Sequence Number=SeqID_227815
atggagattaatgaaatattcagtcctactttccaagcatgtgccagcagtgacccaatctgcatccccagatttaagaaagctaaatggttgttgaagtgctgtaaagaatcaaacactattagaaaatacactttcaacatcggttatttagaatattttacatcggttctaaaaccgatgttgaaggtgccaatgttgaatgtatcaataaccgatgttaacatgtatatgacaacatcgattctctaa

SEQ ID NO: 111038 - DNA, 507 bp, Glycine max
  Peptide Sequence Number=SeqID_227816
atgtccgaggcaaggcctaaaatgaagcaactgaggaggcagtatgggggaagaccaatcacccggttggcgagttgctcaaattcgttgagagatcttgaagatccgtcccatcacatcccttccgttaaaacgaggaacgtccaatttcactggagtgcattggacaagggtggcgctggaaacggaaagggatgtatgaagggtaaggtggttgagacggtcgaggatggaatcgaccttatcggccaggcaggatatggcttcctcaaggcggtcggtagtggttttgcgggtgccgtggtcggccatggcaagtcggaccaattgttagagcagagaaatataatttggttgcaactgatttctgatttctatttggcaccatttcctcaggccaatctcttaggtctcataatcctgcaaataagctggtcatgttgtcttcctcctgtgcctgttggtgtggtcttctggtggattgctaacaaagctttaacaacataa

SEQ ID NO: 111039 - DNA, 222 bp, Glycine max
  Peptide Sequence Number=SeqID_227817
atggcgacactggattccgacgtgatcgtgtttccagccggtgaagcctccagcagcggtggtccatcttcgtccaccaagaagctgaagcgattcaagatcaagaagtggaatgtgatattgtcatggataattctgctatttgtcggaaccatatcatggatctctgtattgagtgtcaggccaaccaagctagcaccactagcgaggaatgcactgtag

SEQ ID NO: 111040 - DNA, 321 bp, Glycine max
  Peptide Sequence Number=SeqID_227818
atgcctctcgggctcagtcagagttttcagcctccatggctgaggttagggcagtggagaagtgcaaagggagaaagggaagatgcttggaggggagctcgaaaggctttaggggatagggtttcagagaagaataaggtagcgcgtaagtggccttcggcattgccggagagtccaccatcaggattgcaagacaacaaaagggtaagtgttgtctccgtcagcactccaatcagctccataactaccatcatcagatctagattcacactggtgcgaatctgcaaggatagtggtgcaacaccgacagtgcgattttga

SEQ ID NO: 111041 - DNA, 1938 bp, Glycine max
  Peptide Sequence Number=SeqID_227819
atggctcttagaagagcatactattgccttcttacgcttttggtgttcgccctatgttttgagccattgttgggagacacagatgctcaaattttgatgaggttcaaagcttccttgtccaataacaatgccttaaacaactgggtgaatgagtctagtttatgtagttggagaggtttgttatgcaaccacactgaccaaacattttatggcttgagactacacaatatgagtctaggtgggaagattgatgtagacaccttgttggaattgccaactttgacaagctttagtgtcatgaacaatacatttgagggtccaatgcctgagttcaaaaagcttgtgaggttaagggcattgtttctgtccaacaataaattctctggcgatattccggatgatgcttttgagggcatgacaaaactgaaaagggttttcttggcagagaatggcttcacgggtcatattcctaagtcacttgctaacttgcctagactttgggatttggacttgcgtgggaatagttttggaggaagcataccagagtttcaacaaaaggatttcagaatgtttaatttgtcgcataaccaattggaaggttcaataccagaaagcttaagcaacaaggatccaagttcatttgctggcaacaaaggcctatgtggaaaaccgatgagtccgtgcaatgagattggtggcaacgagtctagatcagagattccctaccctgattcatctcaaagaaagggaaacaaataccgaatccttataaccgtcattatagtgatcgtagtggttgttgttgcttcaatagtagcacttctatttatccgtaaccactggagaaaaaggttgcaacccttaatattaagcaagcaggagaattccaagaacagtgtagacttcagggagtcacaatccattgatgtgacaagtgatttcaagaagggtggtgatggggcattgaactttgttagggaagacaaaggggggtttgatttgcaagacctgcttagagcctctgccgtggttcttggtagtggcagtttcgggtccacatacaaggctatgattttgaatggaccaactgtggttgtgaagaggtttaggcacatgaacaatgctgggaaacaagagttcattgagcacatgaaaaggcttggaagtttgacacaccctaatcttctcccccttgatgcattctactacagaaaagaagataagtttttggtttatgactatgccgaaaatggcagcttggccagtcatctacatgatagaaatggctcagtgctaaactggtcaacccgtttgaaaatcgtaaaaggagtagctagaggcttagcatacctctacgaaagcttccctggccaaaatctaccgcatggccatctcaagtcctccaatgttgttttggaccattcatttgagccacacttgacagagtatggccttgtgccagtgatgaccaagagtcatgctcagcggttcatggcggcctacaaggccccagaggtgaaccaatttggaaggccaaatgtgaaaagtgatgtgtggtgtctggggatcctcattctggagcttctaacagggaagttcccagcaaattatctgaggcatgggaagggtgggaacaattctgacttggcaacatgggtggactcagtagtgagggaagagtggactggtgaggtgtttgataaggacattatggggaccaggaatggggagggtgagatgctgaagctgctgaggattggaatgttttgctgcaaatggagtgtggagagtaggtgggattggagggaggcactggcaaagattgaggagttaaaggagaaggatagtgatgaagaatactcttcttatgtcagtgaaggggatttgtattcaaggactatgactgaagatgagttctctttttctgtcactaattga

SEQ ID NO: 111042 - DNA, 297 bp, Glycine max
  Peptide Sequence Number=SeqID_227820
atgatttggcttaaaccagagaggaagcatttggacctgttgcacccagagaggaagctatcagaattactaatgacactaatgcaggtggctccatttggtggttttaaacagtctggcctcggaatagaaggctccaaatatgggatgaatgaatatttagagtctttggttaacgaaaaagatgaatttcatgaggaggaagaatctgataagagtaaggataagagaagaatactcaatgcgttgttgttcagcaatattgacaatcagtggtgcagagtttgtgaattctag

SEQ ID NO: 111043 - DNA, 483 bp, Glycine max
  Peptide Sequence Number=SeqID_227821
atggtgaaagttggaacctcttacgtgccgatcaacgtctcattttcgccaaaagttggcccagggcttcccggtatcaacagagacaccaggatttatttattctgcgaagtgatcttccgtcacagctgtccctcctgttcagctactgacggggtgggttttcccagtcacgacgttgtaaaacgacggccagtgaattgtaatacgactcactatagggcgaattggagctccaccgcggtggcggccgctctagaactagtggatcccccgggctgcaggaattcgatcatttggcttaacttcaccagctccggaaaatccgaggctgtcctggaggctggagcagcgggcagggcaaggctggaggaggctcaaggagccagggcctcttgtccagccactggcagaggcactggggcagccatgtgggctccgtggcatctcgggaccttgcctgatatgaaggatgtcatttag

SEQ ID NO: 111044 - DNA, 351 bp, Glycine max
  Peptide Sequence Number=SeqID_227822
atggggatgagctcagacacaagatgggaatggagactgcaatggaggcgcttattctttgatgctgaaatagatatggttgccaagtttatgcaagatatagaagggctcacaatctgtccatacagacatgataagtgggtctggaggggggacaaaagcgggagctactcaatgggaagtcttgctgctttggtgggaatcgatgtcttggatggagatagtgggacctctcccacaaaacccgagggaacatttcctacaacactcctcttgcagggtgtcgggtatcagcaaaaagtgatggctgagttggtggatatccttaacaaggtgcatttggcaccatag

SEQ ID NO: 111045 - DNA, 228 bp, Glycine max
  Peptide Sequence Number=SeqID_227823
atgggtaaccatcctaaggatggacagcctgtcatattaaggcttgcaagagctgggttttgtgttagacatcggcgaacaattgcttctattcctaagaatgtgaagccaagtgatgtcaccctggaaaaagcccttgaatatttatctggtgatgatgtgagacgatctggtcgtccaaaaaaaggcaaatctaaagttgaagttgaagttattgaagcgttttaa

SEQ ID NO: 111046 - DNA, 768 bp, Glycine max
  Peptide Sequence Number=SeqID_227824
atgtgggtcaattggggcaaacagagcatgcaatttcaattagagaacaagtgggtggaattacaaggtgagggcaaaggagttgcagaacaggttgcttttcaaagtctgtttggtaaaccttaccacatgattgagggggaaccaaagggattatcgcctcaacgtggtaaagagcatgccattaccttgatggagggccaagggctagtgaatgtgaggccataccggtacccacaccatcacaagaatgaaatagagaagcaatcaaagtccattttcaagcccgataattttggtgaaaaggaaagacgagacaaggtgacggtaccggataaatttctcattcctgtaattgatgagttgttagatgaattgcatggggcacattatttctctaaactggacatgaaatcaagcccggattggaagtcccacattatgcacttaactgctgttttggatgttttgaagaaagaacggctggtggcaaaccggaagaagtgttacttcagtcaaacaaccatagaatacttgggtcatgtcatttccaaagattgtgtggccatggattccaataaagttaaaagtgtgattgagtggccggttccaaaaaatgtaaagagggtgtgcagcttcttacgactgaccggctactaccgcaaattcatcaaggactatgggaaattagctcctcgccctctgactgatttgactaagaatgatgggtttaaatggggagactcagaacagcttttgaatcattga

SEQ ID NO: 111047 - DNA, 309 bp, Glycine max
  Peptide Sequence Number=SeqID_227825
atgacaataggatttaaatccaatggtgtccacagaaattgcctaaattggatacagcttgataatgtttctgctggattaactgaatggaaaggcctccttagagactattggacacgatttaaatcatattgtgagcgtacttccaatgttcatattcatcaggtagagaagatgttggaaaagaaatttggcgattatttatttgcttctctcccagatcagagtcgggtgtgtccaaggagacaaaatagagggataatagacgaaaaccgtgttacagtacatagcggatgctcctttatgtag

SEQ ID NO: 111048 - DNA, 327 bp, Glycine max
  Peptide Sequence Number=SeqID_227826
atggcactattttcaaggagcatcactattttggagatgataaagtgcaacaacgatgacactattttcaaggagtatcactattttggagatggtatttgtctctctgatgaacatggtcatttcattaaagcaaaaacactatggcaactaggaatccccaatcctcaagaagttgatgactgggatttattgcaagctttaaaatggataccaaacatggatgtacattatattgtcattgagttagattacaagaccgtgatagatggtttgtcagcatgctctactgattttttagactttcattcttttagcaaaatgtag

SEQ ID NO: 111049 - DNA, 225 bp, Glycine max
  Peptide Sequence Number=SeqID_227827
attgactgtccttttgaaagaggtgataactcatgcaacctcatcctatcttttgcaaatctctccgggaactccctcagagagggaacctattgggtgagaacttctaatctgcccctaggttcacttgaggctcatgcacggtgcccctcattgccccagtgtaaggcttttgaggtaccaatcattgtcttgttttcacgacctcgtagtgaggaagaatga

SEQ ID NO: 111050 - DNA, 282 bp, Glycine max
  Peptide Sequence Number=SeqID_227828
atggactcctgttggttggagatggaagtggaattagaggcgcagactagagaagtaccagattcttggatttggaatagaactgcagaagggaaattttcggtagcatcaacatatgttttggttagtgaagagagcccttatctttccttctctgaaggtttctcttctgacggggataaagagaaaactgtaagcatttacgctgcttttcattgctctctacaaatggggaccataaccccttatattggtaactgtcatcagttaccccacatttga

SEQ ID NO: 111051 - DNA, 1166 bp, Glycine max
  Peptide Sequence Number=SeqID_227829
ttgaaatacttcccacccatcctgatctctcatctcctgttcctgtggctgttcctaattttggttcagacacatcttcagcatcttctgctgcttctgtttcacaacctatttcaggttctgatgtgtccaggtttgatacctccttgtctcactctacctctcaacaggctcagtctgcagcatccacttcccacagtgttgctccctcttctaattttgatactaatgctgatcagcctagttctgatgttccagcttcttctagtgcaccaacaggatctttctcttctagttctggtttagaaccaaaatcagtaaagcatgctcttgctgccccaaattggcttgctgccatggaacaagaatatcaggctcttatgaagaatcatacgtgggatattgttcccttgccctcggacaggaaagcagtaggttgcaaatgggtatttcgagtgaaagagaatgctgatggttctatcaataaatacaaggctcaattggttgctaaagtttttcaccaagtgcatggttttgattttcatgaaaccttttctcttgtggtgaagcctattactattcgacttattcttacccttgctctcactaatggctgggatctcttccaattggatgttaataatgcattcttgaatggtgttttggatgagacagtttatatggttcagcctccggaccctaccctttataggtctgttgtgggtgcgcttcagtatgctactctgactcggccagaaataagtttttctgtcaacaaggcactatctttcattgccttctcatacaacctgctgtttcctctagaccacttttttcttattgccctttgtgatgctgattgtgcttcagatgttgatcatcacaggtctacttcaggctcaatgatttgtcttgggcctaatctcatttcctggtcgtctcgcaagcagcaggttactgctcgttccattacagaggcagaatatagaagtattgctcagacttctgctgaactttcagttgccattgctcacaacccggttttccacagcagaaccaaacatatggaaatcgatgtgttctttgtgcatgaggctggatgtcctgggcgtgaatgggagtgttggaaagccaccttaattgcggaaccccctcgcttgccttag

SEQ ID NO: 111052 - DNA, 291 bp, Glycine max
  Peptide Sequence Number=SeqID_227830
atgacatcaaaatggagaaggaagaaagataagtggagacgccacttcaaggagaagatgagtcaagaagaagctcgccaccgtagtatgaagaataagaaggtttttgtggctggtgtctcgttaagcaaggcttgtgcgcttagcaagaatcatccgctaagcgaagcactcagcccgcttagcaagttgggagaatctggaggagaatctgccaagcatctaggcgctcagtgtgtcatcagctcgctcagcgagtcgtttgtcttctctcgcactaagcacgcctag

SEQ ID NO: 111053 - DNA, 618 bp, Glycine max
  Peptide Sequence Number=SeqID_227831
atgtacaacaatttaaatgatgcgtctaagagcagcaacaaacaacttgccagatgtatcacactattacagtgttggatttataagcattttccatttattgctgaggctattattgctaaagactatcatgaaacgaaaccatgtgcctgtcactggatctctgggaaggcattaccaatgtcgattgacaatcgtatagttagagagttcgaggtgatttcttgtttttctggacatatccgatggagtctcgttgctgtcatacaccgaccaaagagggttgtgcaacagtttaggtatgttcagactattcctccacactctccgggttcaagattatgcttagaagatattgacgatatatggatgcacttcttggagtaccttatagtgcccggggatctaatcagacatccacctatcgtgcaagatgacacatatgtcgaactagatattcctcagtacccgatggtgacaatagctatggaggaagcacctgcatatgcaccttcccatgtggagcagcctctacatgcagtggcttgccaagcaatagctgaaaggttggagtggttgatcaacctaaggatagtgactaaaggcatagaaacataa

SEQ ID NO: 111054 - DNA, 366 bp, Glycine max
  Peptide Sequence Number=SeqID_227832
atgaaagctattgaggagcaatttgttaggtcatacaagtccatgagcagtaccataatgataaagctttcaagcatgaggtttgacaacagtaaaggtgtgcaagaacacttgatggaaatgagggctattactgctaaactaaggcccttagaagttgaaatttctaaattttttcttgtccatttgattctcaactcacttcctccggaatatgaggaagagagattgaagcatgaggcacctgaaagtgctcatatgggctttccaaacctgcggaatctagtaggaagtgaacaaagcatctatgtgggaaatcggatgagttcacatgtggaggctattgaagttttaaacttgttttga

SEQ ID NO: 111055 - DNA, 2172 bp, Glycine max
  Peptide Sequence Number=SeqID_227833
atgaagttggtgtccagaaacattgtagaaactgggaagtcctttcaaaatctgtccaaaagtcccattggaattattacctcggtgactctgaggaagcttaatttatcttcaaacaaattgtatggccccttacctctcagggtaggccactgttccatcatagatttgagtaacaacacactatcaggtaatttctcaaggatccggtattggggtaactatgtggaagttgttcagctaagtagcaactcattgggaggaatgctaccaaatgaaacttctcaatttttaaggttaacttcacttaaggtatccaataactcattggagggctttctcccaccaattttgggaacatatccagaactagaagagattgatcttagcctcaaccagctctctgggttcctcctgccaagctttttcacctcaaccaaattgattaatcttgatctctccaacaataaattttctggatcaattcttattcaatttcaacctccaaataatccaatagtttctgctgaaaattgtagtctggtgtttcttgatctttcacacaacaacttgagtgggactcttccttcaaatatgagtaggcttcacaatttggcatatctcaatctatgcaacaaccaattggtaggtactattcctgatgaccttccagatgagttgagagtattgaatgtatcctttaataatctttctggtgttgtaccagaaagcttaaagcagtttcccgactctgcatttcatccaggaaatactatgctggtatttccacatttgcaaccatcaccaaaagatacttccaacctaggtttgagggaacatcggttacaaaaaaagtctgcaactaggattgccctgattgcatgtttggttgctggtggttttgtgatggcttttgtgggtataataatttattataaggttcatcatgaaaaagaaaggacttctaaacaaaatgaagcaaggggcatcacccaagagagtactttcacatcaaatatagaggaaccttatagaaatttggaagtattaccacctgctcaaagtgggtcttctgatgatgcaagaaacattcatccagtgggaaagaagccaatagattttggcccttctgaattaggtaagaacgaggaaggaacatctaccccaatgtctattttgtctccttcaaatccttcatcttcaaaaagctatcagtttgagaatcctggttccctcaaagtctcctctccagataaactggttggagacttgcatatatttgatggatccttggcgctaactgcggaagaactttcatgtgctccagcagaagttattggcaggagctgtcatggaacactctacaaagctacacttgattctggtcatgaattggctgtcaaatggttaagagaaggaataactaaaggaaaaaaggagttggctagggaaataaagaaacttgggactatcaagcatccaaacctggtttctgttcagggttactacttggggccaaaggaacatgagaaactgattatatcaaattacatgaatgcacaatctttggatatttatctccatgagacagataaaggaaatctccatcctttgtctcttgatgaaaggctcagggtggctgtagaggtggcacaatgtctgcatttcttacacgatgagaaagccatacctcatggcaatctcaaatccacaaacattttgctagaaactcccaacagaaatgttctcctcactgactacaccctgcacaggatactcactgcagctggtactgctgagcaagttctgaatgccggtgcactcggctatcggcctcccgagtttgctagatcaagcaaaccatgcccttccttgacaagtgatgtctatgcatttggagtgatcttgttagagctcctaacaggaagaaattctggagaaatagtttctgggattccaggggtggttgacctcattgactgggtgaggttcttagccgaacaaaaccgttctagccagtgctttgataggtctctagtggacaagaacaatggggaaagaccatctaaaattcttgatgacatgctaaaggtggctcttagatgcatccttccagcatctgataggcctgacctgaaaactgtctttggtgatctctcaacaataaggtag

SEQ ID NO: 111056 - DNA, 801 bp, Glycine max
  Peptide Sequence Number=SeqID_227834
atgagagcattaacctcttcttcttccactttcattccaaagcgttattccttcttcttcttcctctccattctcttcgctcttcgatcctcgtccgggggctgctccgaataccaccaccaccacgcgccgatggccacgataggaggcttacgcgactcccaaggctctcagaacagcgtccaaaccgaggccctcgctcgattcgccgtcgatgaacacaacaagaagcagaattcacttctggagttttctagggtggtgaggacacaggaacaggttgttgcgggaaccctgcatcaccttactctcgaagctattgaggcaggtgagaagaagctctatgaagccaaggtgtgggtgaaaccatggttgaatttcaaagaactccaagagttcaagcctgctggtgatgtaccatcatttacctctgctgatcttggtgtcaaaaagggtatggcattttctaaatcaatcatctgtggtctttatatgactaagaaacattctaattgggatggtcaccaacctggatggcaatctgtgccaacacatgaccctcaagttcaggatgcagcaaatcatgcgatcaagactatccagcaaaggtctaattcactagtaccctatgagcttcatgaggttgctgatgcaaaggctgaggtcattgatgactttgccaagtttaatctgcttctcaaagtcaagaggggacagaaggaagagaagttcaaggtagaggtacataagaataaccaaggtgggttccatctaaatcagatggaacaagatcattcctaa

SEQ ID NO: 111057 - DNA, 450 bp, Glycine max
  Peptide Sequence Number=SeqID_227835
atggaggccatcatcagttatagcatctctgaaacctttcatgagccagtttgggtggtcttagaagccaattttttgatctatagaaatgagatcattgatatccctaaagcactaggagggaaagcgaaagctatttttatgaacctccacagtaacaaaatttggggagaagttaagaagatgacgctaaaaagggatggagcaataatgtttgagatggtagggattagttgtgtatgttgtgggttcaagtgttggattgtggatgacatgatcttaggggatgaaagggggatgagaggcagtgctgccccgaagacaatcgcaaactccctcggacttgacgacgacgacgacaatggcggtgacctaaaatcccctccgaagaaacccgattccacatcgagccttattggcaagatctttgaagcaaaactttcagattag

SEQ ID NO: 111058 - DNA, 594 bp, Glycine max
  Peptide Sequence Number=SeqID_227836
atgaacagaccatggacaataccaaatctcggaagaggaaagttcatgcatatgatgaagcagaaaagtttgaagtttggaacaacgcttgaacattccaaacacgaaaccccgcttaatttagcttccaaagttgagctccaaatgaatcaaattgtgaaacacaagaaaacacttttgatagaagaaagcgtatactccaaattacacaccgccgtgagaggaaactcgaagccgcaaagtttgaagtttggaacaacgcttgaacattccaaacacgaaaccccgcttaatttagcttccaaagttgagctccaaatgaatcaaattgtgaaacacaagaaaacacttttgatagaagaaagcgtgtctatgatcttgatactccaaattacacaccgccgtgagaggaaactcgaagccgcaattctccaaaatatctaccttcttcaacttgggcatgctctaaaactcttcaacgtcgttgtaacaaactacgcggtgaacgatggtgtttaccatgtcttgaactgggagttgtgggtcaggcgtttcagagaagggtttcgtggtggaggtggaggacaaggatga

SEQ ID NO: 111059 - DNA, 279 bp, Glycine max
  Peptide Sequence Number=SeqID_227837
atgagcataccattgcacttcgcaatctacaataatgaaactcctttcaaactgacttatggtactgacgctatgattctagtggaggtcggtgaaccctcagcaagaaaagcccaatttgaagaagcactcaatgatgagaatctagccttggaacttgataagattgacgagagaatgagacaagaagcaaggaaagataatgctgaacgaaaacttgctatgaattgtgaagttacctttagaatcactacaacattagaaaatgaagcatactga

SEQ ID NO: 111060 - DNA, 372 bp, Glycine max
  Peptide Sequence Number=SeqID_227838
atggagaagcaaactactccaactcctcctaatcaacctcaaggtgaaaaaggtgttcctcagaacactttgtctaaaaaactaagtggagctatggcaatccgacatcatcaaggcccattgcgtagggttgatcatgttttgatgatgtcaaaaagaatttgcttgataatgagtgtcataatcaaaaagggggagaatgtgaatcatgtatgttttgataatgtcgaaaagaaatcacttgattgtcatcatcaaaaagggggagaatgtgaatactttgtaaaaggattttataaagagaaagcaaaatttcaagtgggttgcttgaggactggacgtaggcacaagggtgtggccgaaccagtataa

SEQ ID NO: 111061 - DNA, 261 bp, Glycine max
  Peptide Sequence Number=SeqID_227839
atggtttccatgaaggccattgaaaacgaaatgcttcctaaggccattgaaagtattaacaagaatttcaatgtcgtagttcaggacttggcagagaccaagaatattgttaaggcactaaatgatcaattgactgttggggaggaggagaagaaagctcttgaattagaaagggataatttgctaaaagagaaagagatttgtcagatcaacaatcttccaaactacaagcagaattttccaattagaataaagcaataa

SEQ ID NO: 111062 - DNA, 648 bp, Glycine max
  Peptide Sequence Number=SeqID_227840
atgaagtttccttcatgcacaggggaaattgtcattgtcaaggctgatcaggtcgacgctcatgaatgctatgtaaaatgttgcaagatagagccatacaacatgatgacattgagcctttccaaatcaacaaggaatcacatcaatgcacacaaattgactagaaaatggaaaaaaagtgtgaaaaaagtagtgcaaatgctcttaagaaacattgacatgcttgcttgcagcgtgtccgaaatgccaggcatcgaacccaacttcatttgccacaaacttggtgaagagaggagacaagttgtggaagcagaaattgacaaattgttgaaggttgacttcattcgtcaagttgactacaccactagtgaagtcactcctgatcaacaagctggtgagttggctgagatcttctcagaactcaaaaggcacaacaagaggttgaaccttgaaaattgcacttttatggtcaaaggtggacccatcaaacctcaatgcttaattgacttcgtggaagagcttcctcctaaatcgagcaacattgacagaggtaattggtggatgctctatgttgataaagtttgtcattccaagggaagccgagcaggaattacccttgaaggacctggagttatctcaattgagtaa

SEQ ID NO: 111063 - DNA, 120 bp, Glycine max
  Peptide Sequence Number=SeqID_227841
atgcaggagactagcaagagaactactctgagactgataggtgcacaggaggatttagtagaagctgccaaagaggaagccagctcattgagtaatataatcgcacaggccaccaagtaa

SEQ ID NO: 111064 - DNA, 267 bp, Glycine max
  Peptide Sequence Number=SeqID_227842
atgttctaccatcgcactcactgtcaaaaaggtcacactaaggtggttctcctccctatcaccaagtctatcaactactggtgcaagttgttttatgttgtacttcattaccagcaaagagtagacaatatcttcctaagtcaagcaaagcctgaagattgggatgttgagaaggcaacatttgaagaggctaagaagaagagggaagaggaagtaaatttttatcctgaaaacgcatctttgaaaatgtatctttggtggctctaa

SEQ ID NO: 111065 - DNA, 168 bp, Glycine max
  Peptide Sequence Number=SeqID_227843
atggtggtgaagcagaggtactttgatatggaggttttttcggtgaacgatgaccacccctcacatgacatggcgatcgggcagatgttcgtgaaggaggttacgggtgagggtgcccatgtttattatcttgccttggatcgacaagggtactggtatgtgctctaa

SEQ ID NO: 111066 - DNA, 168 bp, Glycine max
  Peptide Sequence Number=SeqID_227844
atggctggggagtggaaccacacctctggtcaatggaatggagacgctaatgacaaaggtattcaaacaagagaggattacagattctatgctattttagctgaataccctgaattcaacaacaaggataagatactactcttccaattttctgtcaagcatgaatag

SEQ ID NO: 111067 - DNA, 180 bp, Glycine max
  Peptide Sequence Number=SeqID_227845
atgatagaggtcttagatagtttttctgccactttgtcgggtctgcaaactcaaacctatgatgatgaagcttcaactgcaagttctggatttggttctgatgagaaaactatcaacgtagtttttaaacaaatgaagcctcaagttgatccttcaaagttagatgcaccaccacattag

SEQ ID NO: 111068 - DNA, 123 bp, Glycine max
  Peptide Sequence Number=SeqID_227846
atgcctaacgagagcttagacttctacctatttgtaagagtatcagaagaaaacacaaatagagttgttggtacacaaatagagtatgaagctggaaaagtgaaaaacgggttcttgcagtga

SEQ ID NO: 111069 - DNA, 1080 bp, Glycine max
  Peptide Sequence Number=SeqID_227847
atggtggggagacagaggcaaagtataagaaatacaaaagatgataaggacaggatcagtgagttacctattcacgttttcctccgaatattggaatttatgaacacaagagatgctgttcggctttgtgctttgtctaaaagttggaaggatttttggaaacgtttaactactctcagttttgattcctgggagtcaagtattgtcaatttcgagaagtttgtgtccgaggttctgtctggtcgagatggttccattcctctacttaatcttgagatcattctccgcaccgacctcgaacaactagatgatatcctgaaatatgccgtgtctcacaacatccagcaactgaaaatctttctttttgtgaaccatagattccattttgtgtttccctcttctattttttcttgtcagactttgacatttcttcgcctttctccttctttttggggtcctatttgggaacttcgcaaacctttgcagttgccagcgttagaaagtttgcatctcgagaatgtttgttttactgcaagttgcgatgactgcgctgagcccttttcgagttgcatctctttgaagtctttgatccttggagattgttctttgcataaaaatgctcaagtcctttgcattaataattctaacctgaatcgtgtttccctttgcctatcgagtgttgatgcttacaaaattgtgttttcgactccaaatctttgttctctcactatcaagaatgttgactgccatcaccaacttttctccacttgcagtctttcatttcttgaagttgatgttaacgcttatgtggatccatattctccattctttgtaagcttgctgcaagtgcttgttaatatcaagaaaattacactgtcctggagcacccttaggatgatgcaagaggttctaccttattgggattcagtgggaactcgacctccttgctttgctagattggaatcgttgaaactaaaaatagatccaagcagtaaaatatctgatgaaaaagtaaattgggtagtgaaatgtttacttcagaactctcctctacttagagttgatatcataaagtgctga

SEQ ID NO: 111070 - DNA, 690 bp, Glycine max
  Peptide Sequence Number=SeqID_227848
atgtcacgtgccgtctgcataatacagcaggggacgttcaccaggcccagaatccccctcaggtcgctgttgaacaccgtccgcgacacgaagagcgagatgtcagggcgcatgttgaacagcgtccgggaaaattccctcaccgccgccggcgccgatgaggatgagtttggagaagaggtccgggcggcggatggaggcgagcatgccgatcatggcggagatggagtggccgacgtaggcgcagcgggggacgcggagggcgtcgaggatgttgaggaggtcgtcgacgtaggcgtcgagggtggtataacggcggtagtcgaagtggtcggggttgacgctgccggcgcagacgaggtcgtagagaatgacgctgtagttgcgggtgaagtaagggagcacgcgctgccacgcggattggtccgtgccgaagccgtgggccaggacaaggtacttgtcgccggaaccttccacgcgaacgttcagggcgtcgagaatggaagtgcccataactatggagaaatttgtggcgtgtgtgtttattggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 111071 - DNA, 1215 bp, Glycine max
  Peptide Sequence Number=SeqID_227849
atggcaattagtgttatgaaggaggccaacatgaaagggcgtatggaacgagacgaggacctaactcttttcagggaattgcggaagcaccagaatgaacgtgtatccagcctcttccattgtgttaattctgaagagtttgaatgtggcactaatactgatagtggtagaatttcgtcagggaaaaaagaatatggactagagtttctggaaacaaacaaaaatgattatgattggttgaaaacaccaccagcaactcccctatttccatctcttgaaatggaacccagttctcaacttgtcgttcaaaaggagctaccaatctctcaggtcatctcaagactttttggtttttgtttgtacctaagcaagattattttagcctgtatgttcggatgttcctctaaagttcaaatcaatgacataaaggttggttttgccacacagtttgcatggagtactagggatgtggaagcacagccaaaacccaaatcaattgatggaaaggcaactaccaaatcaactaaagcaaaacttccaacaagatcaatgactacaagtcacaacaagcaaagaccaagcatcatcaagaacacaaatgaactacaacaaacaagcacaactcctcctaccattattaacaacaaaggcagcaatgcaaaaattaaacatgatgcagccaacaacactagatccaccccccaaaagcaaaccaacaatgttgatttccatgctttgagtatccagaaaagcatagaaacaaatgaatcacagagaaagtcaagatcagctagagttgtttctccatcggtgaagtcaagggttgtaaatctaagtaacattgtagaactctcaaatgagacaccaccaaatctaaggacggatcagaggtcgagttccacaacacggggacgaagcacaactcgatcttctacgattgcagggtttcaaaatcgtgatcctactccgcgaacttgcagaccatcaagatcaccatcaccaagcatggctaatggtggcttgaaccagttagacagaacccagaaaaaattgagggaacaaaaagaaacattcactctagcagcaggcactaatgaaaatagaccacattttaagggaagtaagatggtagagaaagtagtgaatgctagaaaatcaggtgtgaatcaaatggacagagaaaccaaagcaaaagctttcaaatatagggtatga

SEQ ID NO: 111072 - DNA, 342 bp, Glycine max
  Peptide Sequence Number=SeqID_227850
atggttcatcgaaagatgctgaacagtgttggattgaaaattcaagtcgcggaaaacggaaaagaagctgtagaaattcatcgctccggacaaagttttgacctaattctcatggatagggatatgcctgttatgaatggcattgaggccacaaagacacttcgatcaatggggattaatagcacgattactggtgtatcaacacgctcagtgacagcgcatatacgagaatttatggaagcaggactagatgactacctagagaagcccctgacccttgttaagcttacttcgatcattcacaagatgaacaaattaattaagtcagatttgagcatgtaa

SEQ ID NO: 111073 - DNA, 249 bp, Glycine max
  Peptide Sequence Number=SeqID_227851
atggatggccaatgggtgcggaagcaagacctttcaccttcgattccagatgaacgcacaccctccccaccactacaaagggattcctcatcttcactactgaatgatgttatcactgaacttagggatcttcaggccttttcttactctcacaatgaaactaatgttgatctcactctcgctcacggtgttgttaatgtctgtctcactctcgctcatggaggtgtcactgtcactctttctctcatg

SEQ ID NO: 111074 - DNA, 789 bp, Glycine max
  Peptide Sequence Number=SeqID_227852
atggctcaagctggtgaaactctttatgacaaaatcaatctgcaacaagttgatgttgaatcaacatctatttggcctccacgtgaaggaaggtacacctctaaaagatcccctagacagttctctaagtgttggaaaggattgatatctgcttctggattaatggaacttggccattggaagaaagattgtcctaagaaactcaagaaagaatctgttgtagttgttgttcaaagttgttattatcatatgtgtccacacaaaagttggtttgtgacctatgagaagaaatctagtggtaatgttttgatgggtaacaatgacccttgcaagacagtaaggatagatctaatcttagtgggaactatggattcaagaggttttacctattgtgttgaaggtggagtaaggaaaatcaaatggaaaggctggacaaaattcctaaaggcaatgcatactacaaaggccacactagacaacgtccattctgattgttgggcaccttcaagaatttcacccctaggaggacaaaggtacttcctctctatcatcgatgattactcaaggatgacatgggcagtcaacacaacatgctacttagtgaaccgttccctctccattaccatagatttcaagacccctggtgaggtatggtctaacaaacctattgattactcaatgctgaaagtgttcaaatgtcaagcatactatcatgcaaatgaacgtaagaagggtgtctttatgggctatgaaaatggagtcaaaggattcagaatttggtctttgtaa

SEQ ID NO: 111075 - DNA, 213 bp, Glycine max
  Peptide Sequence Number=SeqID_227853
atgacagatagaagcattggtttggactttggtaatgctatgaataggagttggaaggctaaatttgagaagtttttgccacccagctccacattttgccaccgaagatttggagccttgaaggtagggttggaagtacttctagacctatttaaggtcacataccttgagaaagtcatattaaacatgtcaggacgttgtctcatttactaa

SEQ ID NO: 111076 - DNA, 564 bp, Glycine max
  Peptide Sequence Number=SeqID_227854
atgcattgtctaccttgggcctcagtttcttcttctcgtcattcatcggcaaccaaggagaaaggaaagatgcagagagagaagataactcttgctcctgagcgaactacaattataagacgcaaagagagagggattagaagaagaattgtagttaaggaaggaagagagaagaaggagtacctcgcgagaaacctcttctgttcggcgttggcgatggaagatgaggaagcggaggccgtcgcagagttgaagcatgtccgacggaggatcgtggccgccgggagtccactacacgccgaggccgacaacgaggcgctcctggtcgacgaagtagcagttgaagtagagcgtggaggagatccaccgcttgaccacggaggcgttggcggcgatgatgacgatgatatagtttttggcgagatagacagtgtagatgtcgtagttgtaacaatgctctatgtatgtgacggaggctatggtttggaaaacatacttcctaagtgtagtagtcttaggcttcttccaaaggttcttactcgtctggtcagactcatcatctga

SEQ ID NO: 111077 - DNA, 3282 bp, Glycine max
  Peptide Sequence Number=SeqID_227855
atggcttgccatctattgtgctttttgtcaaaggaactcttgggtgattttgaggcatgtgctgaaatgtttataccagtccttttcaagctggttgtgattactgtgcttgtaattgcagagtctgcagataactgcattaaaacgatgctgcgcaactgcaaagttgctcgtgtgcttccccgtatagccgattgtgcaaaaaatgatcgcaatgcagtacttcgtgcaaggtgttgtgaatatgcttatttggtcctagaacattggcctgatgcacctgaaatacatcgatcagctgatttatatgaggatctgataaagtgttgtgtttcagacgcaatgagtgaggtacggtctactgcaaggatgtgctacagaatgtttgcaaaaacttggccagagcgttctcgtcgcctattttcatcctttgaccctgcgattcaacggttaataaatgaagaggatggaggaatacatcgacgacatgcttcaccttccattcgagatagaggtgcaccgacgtcattatctagccaggcctctgctccctctaatctacctggttatggaacttctgctattgttgctatggataaaagttcaagtatatcatcagggacatctatctcatctggcatacttctttcacaagctaagtcacttggtaagggtacagaacgtagtttggaaagcatgttacatgcaagcaaacagaaggtttctgctattgaaagcatgcttagaggcttggatttgtctgataagcataattcatcttctctccggtcaacaagtttggatctaggagttgaccctccatcatctcgtgatccacctttccctgcagctgtccccgcatctaatcatctgacaagctctttaacaacagaatcaactacttccggcatcaataaaggtagtaaccgaaatggtggtctcggtttgtctgacataatcactcagattcaagcttcgaaagattctgccaagttatcctatcgtagtaatgttggtattgagcctttatcatcatattcgagtaaaagggcatctgaaagacaagaaagaagttctctcgatgataaccatgatatgagggagactaggcgatatatgaaccccaacactgatagacagtatttggatgccccttatagagatggaaactttagggaatctcataatagttatgtgcctaatttccagagaccactattgagaaagaatgtggctggacgcatgtctgctggcaggaggagttttgatgataatcagctatctcttggagagatgtcgaattttgcagatggaccagcatctcttcatgaagctttgagtgaaggacttagttcaggttccgattggtctgctagggttgctgcctttaattatcttcattctttgttgcagcaaggtccgaagggaactctagaagttgttcagaattttgagaaggtaatgaagttgtttttccagcacttggatgatccccatcataaagttgcacaggctgctctttcaacacttgcagatattgttccagcatgccgaaagccttttgagggttatatggaaagaatattaccccatgtgttttctcggttaattgaccctaaagaacttgtcaggcagccgtgttcaacaactctggaagtggtcagcaaaacttacagtatagattctctcttacctgcattattacgctcactagatgaacaaaggtctccaaaggctaaattggctgttattgaatttgctatcaattcctttaacaaacatgctatgaacccagaaggtgctgctaatattggcatcctaaaattatggcttgctaagttaacccctttggttcatgacaaaaatacaaagcttaaagaagcagctattacatgcattatatcagtgtactctcactttgattcaactgctgttcttaatttcattctgagtttgtcagttgaagaacaaaattccttgagacgagcattgaaacaatacacccctcgcattgaagtagacctaataaactatctgcagaacaagaaagagaaacaacgttctaagtcttcctatgatccatctgatgttgtgggaacatcctctgaagatggatatgttggttactctaggaaagctcattaccttggtaggtattctgctggttcacttgatagtgatggtggcaggaaatggagttcccaagattcaacactgataaaagccagtcttggtcaagcatcttctggtgaaactcgggaacatctgtatcataattttgagactgatcctaatagtggcagccttggttcaaaaactaaggatcttgcttatgccgtcaatccaatgggtcaaaactttggctctcaaactagccaacatggacacatggacagtagcgtgagcttagagggtctttcaactcctcgtctagatgtaaacggtttgatgtcatcagagcatttaaatggtgctgaaggctatgcaaatgacaaagagcatccttctgaattggaacttaatcatcactcagctgaagatgtaaaaattaacaccatgacacacacaggacccagcattcctcaaattcttcatatgatatgcagtgggggtgatggaagccctatttcaagtaaacggactgctcttcaacaattggttgaagcttctataacaaatgatcattctgtttggaccaagtacttcaatcagattttgacagttgtgcttgaggtgctggatgattcagattcctcagtcaaagagcttgctctttcactgatagttgaaatgcttaaaaaccagaaaggtgccatggagaactctgttgagattgtaattgagaagctgcttcatgttacaaaagatatcattcctaaggtctcgaatgaagcagagcactgcctgaccattgttctatctcagtatgatccattcagatgtttaagtgtcattgtccctctgctggttaccgaggatgagaaaacactcgttatttgcataaattgcttaacaaagcttgtggggcggctttctcaggaagaactaatggctcagttaccctcgtttctgcctgcccttttcgaagcttttggtaaccagagtgcagatgttcggaagaccgttgttttctgtctcgtggatatttatatcatgcttgggagagcattcttgccatatttgcaagggcttaacagcacacagttgaagttggtcaccatttatgcaaatcgaatctcacaagccaggacaggcaaagcgattgatgccgttcaagactag

SEQ ID NO: 111078 - DNA, 662 bp, Glycine max
  Peptide Sequence Number=SeqID_227856
atgtatccggaggactatgaagttgaatctgatagattgattagacagtggatagctgaagggtttgtcaaacatgaaaccggaaaaacattggaagaagttgggcaacaatatttatcagggttggttcatagaagtttggtgcaagtatcctcatttggacttgatggaaacgttgaaaggtgtcgtgttcatgacttaatacacgacatgatccttagaaaagtcaaggatacagggtttcgtcagtatattgacgggcctgatcaatctgtatcaagtaagattgttcgacgcctgacaattgcaactgatgattttagtggaagtataggaagctcacccattcggtcaattcttatcatgacaggaaaagatgaaaacttatctcaagacttggttaacaaattccctacaaattacatgctactgaaggtacttgattttgaaggttctgcttttagttatgttcctgaaaatttggggaatttatgccacttgaagtatttaagctttcggtatacatggatagcaagtctaccaaaatccattggtaagctccagaatttggagaccttggatataagaggcacaggtgtgtctgagatgccagaggagattagtaagcttaaaaagctacgtcatcttctggcttattctag

SEQ ID NO: 111079 - DNA, 160 bp, Glycine max
  Peptide Sequence Number=SeqID_227857
ggaccaacaccagcaacaacaagtggtgaaaagcttcgatgcaggcaacaactacgatgcaagcctcttggcaatgaacatatctgccagcttagggcaactcaatcagcttcaacatcagagtgccaccggcgggggcgacgaccgcaaccgctcctag

SEQ ID NO: 111080 - DNA, 1245 bp, Glycine max
  Peptide Sequence Number=SeqID_227858
atgttggatagcgacgatgatagtagtagtgtgagttcatcatcaacttcacgaactgatcacatctccgtctcagggaacgaagaagtgcacttcgatcaagatggtctgctcgatcaagctctcgatgctttggacgaaaaaaggggttccacaagggagagagcgttgtcagtgatcattggggcattcactagcaacatgcagcatcattttgttgacaagaaatttgctactttattacatcagtgccttgcttcaataaaaaagggatccaaaaaggcatctgcaaaggagatagctttggcatcacatgccattggtttgttgaccctgactgttgggtgtagtgataatgcacgtgaaatatttgaggaatcggttcgtcctctagatgaatttctcacatctaaatcacatttgacaaaaattccttcaattgagcctgcgaagaccaagcccatttggctttcagaattgctggaatgcttggctataatcacatttgttggtgggaatggtctggaggaaacagagagatcgatggacatactgtggcgagtgattcatcccagattgggttccaatgtagttgcagtcaaaccttctgctccattaataactgctgtggtatctgcttggtcctttctcctatctaccatgcgtaatttgaagctaaattctaaaaattggcaaaattcaatatcttatttatcaagtcttctagacaaggaagaccggcctgtgcgtattgctgctggcgaagcactggctgtaatttttgagattggaattatagagaaattttctgctgattctaagggtgcaagtgatatgagtcaagaagagattaatctgcaggaaagttatacccatttacaaggattgaaagggaaggtcatcactcaagtcaaaaacctttctgttgaggctggtggaaaaggttctgctaagaaagatctgaataatcagaggaacttgttccgagatattgtagagttttttgagtgtggttactctcctgaaatttcaatgaaaattggtggtgattcactgcagacatcttcatggtcccaaatgatacagttgaactttctcaagcattttttagggggagggttcatcaagcatattcaggaaaatgagttccttcaagatgtatttaatttcaaaccaaagagaagatatcttaataacaatgaacatcggatgtctagtggtgagaaggttggtttctatgactga

SEQ ID NO: 111081 - DNA, 483 bp, Glycine max
  Peptide Sequence Number=SeqID_227859
atgtatgttttggatacactgactgacaaaaaagcaaggaaagtaaacaaaatttatggcgacaccaatgtatggggacaggttgatgaggttccttttgctctgttgcctcttgttggtggtggcatcccacgtcgacaacaacagcttttgtttttcctttcatttcagtttcttctgtataaatgttgctccaactctcaacccactttcttcacttcttccccataccactatcaccatcatgagtcaaggtggtcgattataaatattctttcctttcaacccatcgaggcaccattgccaatcaaccgagcagttaagcgggagatgccttttacaagaataaatagtgacaccctaacgcctcacttgggagtcaccttttacaagaacaaaactggagcagttaagttgaaaggttttcaagataaacctgggagtcgatcaagcacagtagacttgagatcggaacataattag

SEQ ID NO: 111082 - DNA, 2136 bp, Glycine max
  Peptide Sequence Number=SeqID_227860
atgttgtgtgcttgttcaggcgagcaattcaaatttgaagaggcgccaccgcggtcacctgactccttggcaacaagggatttctctgcaagtggcctttcttcaaggactggggattgggaatccaaatttgatgaaacacaagtggaagacgttgaatctactctaaaagaagctctctcattaaactatgaggaagctcgggctttgttggggaggcttgaatatcaaagagggaactttgatgctgcccttcaagtttttgagggtatagacataagggctttgaccccaaggatgataagggctatagctgaaagaaccaaacaaagaaaatcacgttccaaggtggacaatgtgcttcctaatgtgatgtcaatgcattcagttagcctgattcttgaggcaattttgcttaaatctaaatcctctgaagaacttgggcgatacactgaggctgcaaaggagtgcagaattgttgtggatacagttgagtctgctcttcctaatggaatgcctgagggtattggtgaagattgtaagttgcaagaaatgttccacgaagcattggagttgcttccaaatctatggatgaaggcaggtttgctagatgaagttgtcactgcttatcggcgggctctagtcaagccttggaatttggagccgcagaggttggcctgtgtacaaaaagatttagctaccacactactctatggaggtgttgaagtaaacctaccccctcagttgcaagtgaatggtataacaacacctatgagcggcactgaagaggctatacttttgctattaatactctcaggaaagatggcacttcaggaaatagattgggaccctgaaataatggatcatcttacattttcactttcagttactgggatgtttgaatcattggcagatcatgtagagaagatccttccgggagttcatgatcgagctgagcagtggtattttcttgctctttgttacagtgcagcaggacagaatgaagtagccttgaaccttttgaggaaggcttgtggtagttctgaagcaaagcatagaccccattttccttcatttttgtttggtgcaaagctgtgttctctaaatccaaaccatgctcgtgaaggaattaaattttcgcaggaagttattgatctagtgaagcatcaaaatgagcattttttgagtcagggccaaaaatttcttggcatttgccatggagctgctgctagaatatctgtactggattctgaaagaattatatttcaaaaagagtctttgaagtttctaaaggatgctgctctgaatggaaataataatgacccggaagtgatgctcactcttggattagaaaatgcaattcaaagaaatctaaatgcagcttatgacaatataatgatgtactcagacatgatggctggcagctcaagaagaggttggcagctgttagcactaacagtatcagcacagcagcggtttcaggatgccgaaactatagttgattttgctttagatgaggctggcgatatagatcagttagaactactgagactgaaagctgtacttcaaattactcagcagcaacccaagcaagcaattgagacctacagaatcttgctagctgtaattgaagcaagaaaagagcattggcttcaagctaagacattcaggcacgaggcattaacagaacagaagttggaaatggaagcctggcaggatttggctaccatttatgcagatctttgttcctttcttgatgcaaaagcttgtgttgacaaatcccagtcgatagaatttttttctcccagaagttggcacatcactggtttgttgtttgaagctcaatctttgcataaggaggcctttgtttccttctcagtttcattgtcaatagaaccagattacattccctgtatcatctccactgcaaaattgtttcttaaacttggcattccatcacttccaattgcaagaagctttttaatgaatgctttgagattagaccccacaaaccatgatgcatggtttaaccttggattggtttcaaaaatggaaggctcgttacaacaagcggcagactgctttcaagctgcatatgagctgaagctttcagctccagtgcaaaaatttgagtga

SEQ ID NO: 111083 - DNA, 276 bp, Glycine max
  Peptide Sequence Number=SeqID_227861
atggtgtggcatggttcacacataaccttgttgtcccttaagcatgtgctcaagggtttgattcctggtccctgcgtacaaaaaacatttgttgggagaggtgttgattggaattgtaggcaagagcaatttgagaattctgcagcaggacgagctgctcgtgcacagcaacaagcaatggcaaagcaatctgcaaacgccaacaaaggcgaaccagttctaaaggttggtttggtgttcaagatgccacttatgtttttggctactactaattga

SEQ ID NO: 111084 - DNA, 1368 bp, Glycine max
  Peptide Sequence Number=SeqID_227862
atgaataaagatcatggaaataacatgataaagggagctttgacttctggattttgcctggggctgcaaaatgttctatgtactgcagaaactagtgttttgttgagggaatgcaagctacagagtctggtacttagatgtatcagatccaaggaacaaattgatggattatgcaaacttcttgctcaacattgtagaacgttaacgtctctggaatttgttcactgtgcactctcaacagattttattaatgcaatatttggctctttagtcatagagagagtacaaaaacatgggatccaacatttgtcaatcattgccacaagttttctggaaccatgtacagtttctttacctagtggactcgtgtcgtttttgtcttcgggaaggtccttgtgctcattaaaattatctgagaaccaccatggatggacttttgccaaagatctttttgtgactcttctcaatctttcatctggcatatctgtccttgacctttctcggaatagactgacaaaagttctatgcacatgcttcaagatatcaggatggcttttttactacaggagatccttgagtggttcacatctgtcgtttggaaatggaaagtccttgaaactgttgcgtgtactcaatctgagggaaaacaatttaggaaaagatgatgtacaacatcttagatatgctcttgaacatgtgcctaacttggaggagctggatataagtgacaattcaattgaagatgaaggaatcaggaatttaattccctattttgttggagcatctgaaacctgtcctcgcataacttgtttgaaattagagaactgtgatctgtcctgtgttggagtgaatcttctcctacattacctttctactttcaaaggaccattaaagtctctttctattgctgagaattaccttggcagacaagtagttgaagcattgggaaatttttttcacaccccaatcgaagtacttgacattgcaggcattggattgggttctgacggttttcaagagcttcaaagtctaataaaagaggagattaagctggtgaaaattaatataagcaaaaatcgtggtgggactgaaactgccaaatttttgtccaaactcttgtcacaggctccacaactagttgatgtgaatgcagcctgtaatcttatgccaatagaatcactggccatcatctgctgtgcattaaagtttgcaaaaggtaatgttcagcaagtggacttgacaggacatatatgggactataagccagagcatgtttccccttacgctgaatttgtacataatggattacctatattggttcttccatcaccatcagtctctgctgctcctcacgaccatgatccttag

SEQ ID NO: 111085 - DNA, 2106 bp, Glycine max
  Peptide Sequence Number=SeqID_227863
atggcattggaagaagatcacccaacaacaacacttctcaagctccagtcagcatgttccgacctaaaaaccctccttcgagcctccgaggaaacacaagacaacctgggaaacacagactcaaggtttcatctcttacaaggctcactctccacagcctccagaggaatcgcccctttacaatccctagccatgtccaggaaagccctcgacacgagaatcaccagagccttgtccccagcacttacactcctcaacaccttcaagttcacagagtctctccagaacagcctcgtcgtgctctcgaccaagctgtcctcggagaagccgcatcatgtgcggcgtctccagaggcttctggagtacaccgagtgcgtggatcaactgaacgagggtttaaacaacataagcgatgaggtggaggtggtgatcatgaaacttcaggaggtggtggagttcataagccggacgaaggcggcggatcagtacagggaggcgaggctgagggaggcgctggggacgctgaaggggctgtatgagattgaggtggatgagatgaggtttcagggtttgctggatcaggcgttggtgcatgtgcaggatgagtttgaagggttgttgctgaggatcaagcataggaatttcggggatttggtgcaccaacatggtgatgatttcagggaattggggtctgaactggaaattcaagtcctcaggaaaatttcaaccactcttgctgccaatgattgcctagacatatgcattgatatatacgtcaaggcgagatatagaagggcagcgaaggcactaatgaagctaaaccccgattacctgcgaacatacaccccagaaggaatcgacgaaatggagtgggaaaccttagagacagccataaccctttggatccaacacttggaagtcgcagtgaagaaagtccttgttgcggaaaagaaactctgcgaaagagtcttgggcgatttcatggagggactaatctggccagaatgcttcattaagatctccgacaagatcatggccgtcttcttccgcttcggcgaaggcgttgcccggagcaacaaagagccccagaagctcttcaaactcttggacatgttcgagtccttggagaaactcaaacccgacatgtcacaaatattcgaaggcgaatctggtgtagacatatgcacaaggttccgcgagttggagaagctcatcatcgatgcttcgagcaaagttttcttggaattgggtctccaaatcgaaggcaacatcgacggtcttccaccccctcaagacggttccgttccaaaactcgtaagatacgctatcaactatctcaaatacctcaccacggttaattatagaacatcaatggctaaggttctccgaacacaacaaacatggaaagatagtagtagtagtagcaatgacatgtcttcggacgagggtttgttgaagcatgcaattagcaatgtcatggatgcgctgcaacggaacattgaggcaaagcgtttgtgttgcagggacaaggttttggtgcatgttttcacgatgaatacttattggtacatttacatgaggacgaagaatacggagcttggtgaggtgttgggtgagaagttcatgaaagaaggttacaaggctgtggcggaggaaagtgcttacttgtatcagaagcaagcgtgggggggtttggttagggttttggatggagatgatgtgagggaggaagggaaagggagtgtgggaagagtggtgagtgaaaagattgaggcttttttcaagggtttgaatgaggtttgtgagaggcatgttagaggggtgtatagtatacctgatgttgatttgagggaacaaatgagggaagcaacagtgaggcttgtggtgcctgtttatgctgagtttttggagggttattcggggttgttgcagaggaaagggtacccgagtgttgagagggtgaatgggttggtggggaaggcttttgatggaggaaagctgaagggaagaggttctgcttctagtgattggaatgttgcaaggaattctgggtctctggagagggatgttgttagatcacgcaacgatggtggtggtgatgtttga

SEQ ID NO: 111086 - DNA, 457 bp, Glycine max
  Peptide Sequence Number=SeqID_227864
gaatcttaatgttgctgaggatgatgattttggtaaggatgcaaatgaagatagtggagacctagtttcgggactttactgcaagattgtggttcagtttgagaaatatagagactctcatgatgcactgaaagttgtttgtggtcggccgattatgaggtttgttgggacagagatggattttttcggaattcaaggaatcaaactcaaggctacctgcctagagcatgacaaacatagggattcatgggctttaactcaatcctacaaaactggcttggcagcagatcattgcagaagtgaagctcccacacgtcaggcctacaactctcgccacagtccagataatgtgcgcccaaggagattcaaggcattgattgccacttgcattacgccttacggtgctagaacaactgaatggttggagtggaaatattatgcttctgaagcacactga

SEQ ID NO: 111087 - DNA, 562 bp, Glycine max
  Peptide Sequence Number=SeqID_227865
atgaaaggaagcttatggacaagctccaaaggcttagacaaagggagtatgagtgttgaagagtataagcaacaaatggaactactcgttttgagagttgggcttagggaggaggacagaaaaattattgctaggttccttagtggacttaatatggaagtgggggaaaaggttgagctccttccatatagggacctagatgacctagtccaactttgcataagggtagagcagcaacttaaaaggaagccgacttcaaaatattacaactctcactcttatccgaagaaagaccaaggtcaaggaatattaggggctgcatcttctaagcccaaagatgataaggggaagacaatagaaaagaaaacccctaaggctagtatacaagagaaaactagctctataaactactttaaatgtcttggaagaagacacattgtttctcaatgccctaccaagaaaaacatgattatgaggggccaagacatttatagtagccaagatgaggctactacttcaccttcctctaatgaaagtgaagaaacaaaaggggaagaatcta

SEQ ID NO: 111088 - DNA, 852 bp, Glycine max
  Peptide Sequence Number=SeqID_227866
atgctgaacctttttgtttgtggccctttccataacgagtatgatgatgaaccatgccttgcaagtcctaattcttctagccctagaaaatataaaagaaaaaacagtaagaacaacaacccttattccactcgcggcctagacaaattttctgagcttttggctgatcttgatgagaaaaggcagaagatttattctcagacgaaccctcatgacatctctttcgttcgctttgtgtactccaacactgatgatgacattgttcccgttgtggtcaaggtgaaaaacaacaacaaggatcatagacacagcaagagccaagaactcaaagtggtgagagcaagaacaacaacaacaacgttgactcataatacatcagaatcaacggacaagtctgcaacagctgataaaaaaaaccctgttgaagaaagaaagcaacacaagttagaaactcatgcaaaggtagctaagaagaagaacaacaacttttcttcggatatggggaagccttctttctatgttccagtggttgccatattgattttgttgctattggttgtgtttggaagatctgttacaactctttgcatttgtattttgtggtatgtgatgtccactttgaagggtagctcatcatcatcaaacacgctgaagtcgatgaagaagaaggatttaagtgaaaagaagattgtgatcaatgaagggacaaagaaaaagaactatgttagagggtggagtgaaaagatggtggtgagtgaagggagcaataagaagaaagattatggtagagggtggagtgaaaagaagatggcaagtactgatgggttaatttctccaagaagtggtgagtaa

SEQ ID NO: 111089 - DNA, 1095 bp, Glycine max
  Peptide Sequence Number=SeqID_227867
atgatcaagaccttgaatccttacccaaatccagcaaaaactgctgagatcatgtcaaggtaccggccaatagcaccaaagcctgaaacctctccaaactccatgagtgagggcccttcttcctcttctctctcccagaagatcaagcaatctccttaccttaggaatttatggccacagcttcaagccagacccaccaggaccagaaagagaggtagagctcctttgacactaccctcttcctccctcaagagacacaagacaacacatcatcatgtcctaggattttgtcccccttgtcatcatgttgttacatcatcatcatcatccccatccaaaaacctttccttgcagggatttgctcctccacaccctcttcctcatcatcttggagtgctcaattgcaccatggagaaaaacaacaccaatccaagcttagtgacacttccactccttccatgctctccaacattaacaaccaagccttgtgcgggtgaagtcataaacttgaacaccaaagcgagtgttcctgaagagaaagatctcttgcaacaacttcaaaaaccagtttccaacaacattattaatgtcataacacctcaaccaattcgccccattggttcttccataagcgttgtgtgcattagtgaagactcaactctgtcacctcttgctcaaacaccaaaaaaaccaaacgaggttgaacaagaggttgagaatgaagccttgccaactgtcatatcagactcaaaccacagaatcaggatggcgaattctgcatacaaggaaatggtgggccagccagtgtgtccttggcttgaatccatgggaaacctacttcaatgcaggaggatcagtggtgaggtgacactgaatctcagtgactcatcaactgttattccaacttcatcaaacggtttctcttgctgggtgaggatagagtggctgagtgaacacaacaataagaagaagaactgtatcaacgcattctgtgatgtgatgaagttggcttgtgaatccagggattatcttttcacatggaggttccacactcgtactaccagggaagcttctcaatcaagttgcaacgcttga

SEQ ID NO: 111090 - DNA, 189 bp, Glycine max
  Peptide Sequence Number=SeqID_227868
atgaggctgaggcagaatgatgagaggatttttattatctcctatgggaacactgttgttgacaaagagggtaaaggggggggggagagttataaaggaaggagggcgttggaagagagggggctaatgaagaaggacatgtggggattgggcattgaaagtgggtccatgcatggttacaccacatag

SEQ ID NO: 111091 - DNA, 1416 bp, Glycine max
  Peptide Sequence Number=SeqID_227869
atggcgaataacgagaaagacgcatgttcttccttcaccgatttcccagaggacattcaggtgtgcatcctctcgttcctgggcccaccggagatcgcaaccctagcctgcacttcgaagcgaatgggctctctctgcgccaccgactccaagctctggttctctatgtgcgagcgcaggtggggctcctacacccgcatcacccagtgggcccaaggaaaaaaccccactctctccttcaagcacctctacaacaccctccaccgctgggagaatctcctcggcttctggcgccgaagtggaaccggaatcccttccttgctcttcttcgagtggggcccatccttcatctccgcttctagggtttccccttccgcttccgactccaattccgtcacctacggtgtcaccaaaacgccgttcctctggatgagtctctccgaggagggacacgtggttacttatctcgatcccgacgggagaagtgattttaaacccgagattcggagcgaattggtggctgtggatgtgagtttcatggggaagacgcatcttgttgtggaggagaagcgggttaggggtggtgcttgtcatgattgtggagatgatgttgtggtggtggagagtggatcgccgccggagaaactgatggcggagatttaccagcatttcgcgaacccccggagtcccggaagtgatcggtccaggaggcagaggcgaagggagaaagagaggctggccgggaggaagtgggagcctcagcattttgtcaagattgtcaactgctcgccgactccggcgcggccttgcagggcctgtggaagcagttttcgggctcgccacaaccgaaattatggctgcattggccacatttgtccgctgctgcaatttgaaaccttgactatgggaatttgcggtgacatgagtttggcattttaccttgtggggtatgatgacattgggggcattgcctgccggcggattggggatcctcctgaccgtttttcgggacatgccccagttttctggacttctaatgctacgtttctggaatctcccttttctccggaggaagaatctttgtatgacagtcgtgttcatcttcgaccacttcaaccgggcaatgaagttcttgagcagttccctttctcggatagtgaagtggtaaatcaaattcagcagttccaattgtccgacaatgtggtagaccgaattcttcacataagttcaagttatgatttagttgttccagaccttgccggaacattgaatccaaggagtgcagaaggaaggatttggcagtaccgaaatggtacttttggatttggattcctttcggacaatttcgtcatagacatgaaacatattgtccacaatggttgtattgtggatactgtaaattcttctgctaattga

SEQ ID NO: 111092 - DNA, 354 bp, Glycine max
  Peptide Sequence Number=SeqID_227870
atgtcgggtcgtggaaagggaggcaagggtttgggaaagggaggagccaagaggcacaggaaggtgcttcgtgacaacatccagggtatcaccaaacccgcaattcggcgtttggctcgcagaggtggtgttaagagaatcagtggtctcatctacgaggagacacgtggcgtcctcaagatcttcctcgagaacgttattcgcgacgctgttacctacaccgagcacgctagaagaaagaccgttaccgctatggatgttgtttatgctctcaagaggcagggcaggactctctacggtttcggtgttttcgtgattgttgttgcgcctgtttttatcgggctcgaagtgtag

SEQ ID NO: 111093 - DNA, 2343 bp, Glycine max
  Peptide Sequence Number=SeqID_227871
atgtcaaaaacatcctcaattacaaccgcacgatcagagatgtggcgtggtcgtttaggctctgccctacgaaccaccttagcatgcaccgtcgcaggttgcacctccctttacggccccgcccctctccgccgctacctcgagttcccctccttcatgtacgtcacaaccgtcctcgtagtgtcggacgcgacactcggggacactgtacgaggtttctggcacgtcgtttgttcgaatattcaggtcatgatgctttctttgcttagtttgcagctcatagggcctcacaggtttaacagctgcgttgctgcgctggccatggcggcttcggcgttcgtcgttgggttgccggagtcgacgcacttggtcactaagcaacttgcatttggacagcttgtgaatgtttttgttagcacggtggtggatggtggacggaccggggtggccgttcacccagttcatgtggtgtgctctacagcctttggaggtgtcgctgctgtcctcgccatgttgcttccatttcctcgcctagcccactatgagacaaggaagttctatcgactatacgctaagaatacttgtgagaggttcgattgcaacatagaggccatctctgcctcggacaactcaactgcagttggtttcatcgctcaagccaagtccctctccacaacaggagccaagcttctccagattattagaagtaaacaggatggcatgcattgggaatggccacaaacaagaattttcaactcccattggattgacccagaagatgaactgcaacacttggagttaacaataagagctacggatattgccctatcaacttgtacctcttttcctgttggggtcattgatgaggagctcagaggtgtcttgctcaattgcagaggacacttcagcaaagtcttaggtcagcaagccaagtgctttgattcttttgatgcaaccataacttcagatatgaaaaaagaaattttgaccaaaaacctctctatagcctataaagatctcccaacctcgttttttttatactgtgtgcatcttctcctatatgactcacccattgcaaagaaaactgaccacgtgctgggaaaaactcagaaaagaggtgatttcaaatggagcgccagaaagaccagagaggttgtcatgaacttgattcccaacaaccacaacttggcttttgcattcaagtcctcactttcattaggcctcgctgtgtttttaggtttaacatataacaaggaaaatggatactgggcgggactcttaattgccttgtgtttcgtgcctggacggcatccaacattttctcttgcaaatgcacgaggacaaggaacagcaatgggatcaatctatgggatcctatgctgcttcgttttcaaaaaaattgtggatttcagtttcttacctcttttaccatggatctttttctcttcttttcttaagtatagtagaatgtatgggcaagctggtgggattgcagcagttacaggggccttgttagtagttggtatgaagcacaatgatcctcctagtcaatttgcacttgctagaatggtcgaggccacaataggcctcctttgctttgttattgtagagattatttttaatccctgcagagctgcaactctagcaaaatctgaactttctcaatgcttgagatcacttcatgattgcattggccagattgccatcattactcctaccaaaagagagatgccattttcaagctgtcaagaattgagagaaggacagaaaaagctgaaatctctagtgtgccaattagaagagttcacagcagaggctgaattggagccaaatttctggttcattccatttcataatgcctgctacagaaagatgctggaatcactatcaaagatggcagatctcttactttttgtggcatactcaatggaaaatatcatgctattgtcacagaaaaacggagcatttggggtggatctccatgatggagtaaacaagaatgtgaggatttttaaaaacaaagttagccccacattggaacaccttgaagagataacaaggaaaaagattcccgggaaacttgcaaatgagttgaataggaatattccttgtgatatcgaggcacaagaacatcccaatgcagaagcacttagggtctggagtggagatgaagttgttgatagcattacaggctcttttctcaaacatctagaggagatggctaacaaaactcataccaatatagatgaggagatgcttaaaagtcaaatgcttttccattacagctgcttgggattctgtactaataacttgatgagagaaacaatgaagattcagagtgaa

SEQ ID NO: 111094 - DNA, 165 bp, Glycine max
  Peptide Sequence Number=SeqID_227872
atggcgccgcggcgaatatctggctttggatttgtggctgttgtgaattgtgggatggtggtttcgctggtttgctatggaggttttcagtttgggtggagattaccgttagaaagagaaaaaatggagaaaggaaaagaagaagaacagaggagagacggttga

SEQ ID NO: 111095 - DNA, 1452 bp, Glycine max
  Peptide Sequence Number=SeqID_227873
atggagaatcaccacccatccacgctactgtccatggattctagtgcatcttcacatgaggaactggatttagagatgaacacacagatcataccccccgatatcaatttgcccctttcggccgagcgcagccctcctccacagccatggaattctgatccctgtgatattctggatgttggtcttggcactcaaggctatgagactgagacttttctcaaccttcccaaagctggaaggaagtgcaccaagcgcattgatagcatttggggtgcttggttcttcttccggttttacttcaagcccgtgttgcatgagaaatctaagaccaaggtcatcagggacagcagcggggtgtcggggtttgacaagaccgatctcaaccttgatgttttcatggttcagcatgacatggagaacatgtacatgtgggttttcaaggggaggccggacaatgcattgggtaagatgcagctgaggagttacatgaacgggcactctcgccaaggggagcgcccgtttccgttcagtgccgagaagggttttgttcgatcccacaggatgcagcggaagcattatagaggcctatcaaatccccaatgcgtgcatggcattgaggttgttccatcgcccaatctaatgggtctcgataaggatgagcagaagaggtggatggaactcaccggccgagacttgaatttcacaatccctcctgaagcaagtgatttcagttcgtggagaaaccttcctaacacagactttgggcttgaaaggccgcctgttccgatcaagagtgctcctaattctcatcctaagaaattgcttaatggaactgtgctgaatctgtctaaccatagcaatggtgatgccattgatctatctcctgtaaatggcaagaagaggaaagagttatttcttaatgatgaagactattacttgtctgttaatcctccatctgatcggattccagatatagagatgcaaccaaccgagcatccctggttgaatgactttagtggggtgatgaagaatgtttgtggccctgttactgctggaaaaactatttatgaggatgaagaaggttacatgattgttataagtcttccgtgtgtggatctttcaagtgtgaaagtttcttggaggaatactcttattcatggtatcattaaggtttcttgtgtgagcacatctgggaagccatatatcaagagacatgacaggacattcaaacttacagatccgtcatccgaacactgcccacctggtgagtttgttcgtgaaatccctctttcaactcgaattcctgaagatgccaatatagaagcatactatgatgggccaggatcagtgcttgagatcatggtgccaaaacttcgtgtgggatcagaagagcatgaagttcgtgtttgccttcgccctcatcttggagggaatgatcttatgttgacttga

SEQ ID NO: 111096 - DNA, 1353 bp, Glycine max
  Peptide Sequence Number=SeqID_227874
atggagattttggaagatccaaaactacgggatgatgcaatgagagaactctatgaagtatcattaaatggatgtgtgagtaccttaaaaacactgatccaaaaaggccctcttattctgagcagaatttcagtctacccctacactgaaaccccattacacatagcctctttgcttggacatttggacttctgtgaggttcttcttcagaatagtcccagtttaccgactgaattgaactcagaaggacgttgccctcttcatttagcttcagctaatgggcacacagaggttgtgaaagcgcttttgaggacaaaccctgaaatgtgtttggttggtgacaaagatgaaatgcttcctctccactttgctgcaatgagagggcgcgttggagcaatcaaggagctgatcaaagccaagccagactccattcgagagatgacaaagactaatgatggaacatcatcaccctcacaaacaaacaatgattctccatcctcatcagagtcattactaacaaacaatgatcatgaactagcacaagtctcacttcaacaaacatcaacaggcaatagtaatcctccatcatcaccagcatcacaaagcaatggtcatgtccaagcagtgacatcaaccgtagtcagcaatcaggaaacgactctgacaacatatccacaacaacaaccaacatcctcacaaacacaaagcgtaactattgaacttgcacaacaagatcctcctccacaagcctcagcacaactctcacagcttcaacaaacagcatcacaaagcaatgctcctgtcgtccaaccagcaaacatcacaacaagtgatcaacgacaacaaggacaagatgatacgtggagcaggttagagaggttcttcagaacatacctgctagaacaaggtaattggatagacaatgggtcaaggaagcatttgttggtggtagccactatgattgcaaccatggcttttacgtcggtgataaacccaccgggtggtgtatggcaaggtgatacaacacaagatgggtttgcttgccatgactatggtttctgtgaagcaggcaccgcggttatgggctatgtttggccactagcgtttgtaaaattcctttcctccaactctttgtctttctttttgtctctttgtgtgatgttggttctagtcatagggtttccggtagagaataacaaggtcgtaatgtggatgttggctgttttgattatcggtgcagctacgtgcatgatgttcacatactcaactgggctctcttatgaatactgcttggatgatcttgctcaccattttcagtttgattcaaacaagccgaataggattttggtttag

SEQ ID NO: 111097 - DNA, 540 bp, Glycine max
  Peptide Sequence Number=SeqID_227875
atgaatgaagcttcgatcaataacgcagaaagctacttatatctccacccaagcgagaaccccgctatagcccttgtctctccagtcttagactcaaccaattaccactcatggagtagatccatggtcactgtgctaagtgccaagaataaggtggaattcatagacgggagtgcacctgaaccactgaagacggacagaacctatggggcttggtgccggtgcaacaatatggtcgtgtcatggctagttcactcggtggccacctccatacgacaaagtatcctctggatggacaaagccgaggaaatttggcgtgacctgaagtccagatattcgcaaggagatcttcttcgaatctccgatcttcaacaagaggcgtctacgatgaaacaagggaccctctcagtcacggaatacttcacccgtttacgaataatatgggacgagattgagaacttcagacccgactcaatctgctcgtgcaacatcagatgttcctgtaatgcccttcaccatcatcgcacaacgcaagcttga

SEQ ID NO: 111098 - DNA, 219 bp, Glycine max
  Peptide Sequence Number=SeqID_227876
atggtgggagcaagtttgaaaaaggatcttagagtgtctagggttgtgtcaggagggtctcttaatgtcttcctttttcttctcattggagttatttcacaaagcacacttggagagcgcaatacaacgggtgcgatgatttacttcacgggtgaggtctccggttcaagtccaaaatggtccagctacgtcaatgaaaagaatagaaaactgatttga

SEQ ID NO: 111099 - DNA, 3798 bp, Glycine max
  Peptide Sequence Number=SeqID_227877
atgcaattcctacgaggtttgaatgatcaatatactaacattcgatcacacgtgcttcttatggatcccatacctgccatttccaaaatattctcttatgtagctcagcaagaaaggcaattgttaggcaacacaggtccaagaatcaacttcgaacccaaagatgtctccattaacgcggcaaaaaccatctgcgacttctgcggatgtgttggtcatgtagaaagcgtttgctataaaaagcatgggatacctgcaacttatgacggaaggcacaagaacaacaatggaaggaaaacttgtacacactgtggcaagatcggacacacagtggacgtttgctatcgtaaacacggatatccgccgggttacaaaccgttcggaggaaaaaccaccgtgaataacataatggcagtagaaggaagaaccactgatgatcatgctcagcaacacgagtcacaagaagttgttcacttctcccctgagcagtataaggcactactggccttaatccaacagccacaggcaggaaactcggcgtctaatcaacccaaacaggtggcgtcaatgtcctcaagcactattaatacatcactaaacccaggtacgtcactttccacacacacatatcccacctcctggattctagattcaggagcaacggaccatgtcacctgctctctacataatctatattcatatacaaaaatcgaatcaatcacggtgaaactccctaacggtcatcacgttcacgccactcactcaggaacagtacatttctcatccaatttaatcctacacgatgtactctacttacccacattcacgttcaatcttatttcaatctcaaaactcgtttcttccaataattacgaattaattttctcttccacatcttgtgttttacaggaaacgaacaaccatgtgaagattggtatagttgaagcaaggcatggcttatatcacctgataccaaaccaaatacccactaaagctgcaaactcgatcatcactcatcctcagtgtaatatcatccccatagacctatggcattttagaatgggacatccatcaattgagagattacaatgtatgagaaactattattccctttcaagaaatgatacaaattttgtctgcaacacatgccattatgcaaagcacaagaaaatgcctttttcttctagcaaatcacatgcattgcattcttttgatttactgcatatggacatatggggtccatgctcaaaattatccatgcatggtcacaagtattttctaaccatcgttgatgatcattcgcgtttcacatgggtatacctcatgaaaactaaagccgaaacgcgacacatcatcaccaacttcattgcttacattgaaacccaatatgacggcaagattaaaataataagaagcgataatggaatggaattcttcatgcatgattattatgcgtctaaggggatcatacaccaaaccacgtgtgtcgagaccccagaacaaaatggaatcgtagaacgtaagcatcaacacttgcttaatgttacacgatcacttctgtttcaggcaagcttaccacctaccttttggtgctatgctttgccacacgctacgtacttgatcaattgtatccctacgccatttttgcataatatttcaccttatgaaaaactgcacaaacatccatgtgatatctctaacattcgcgttttcagatgcctgtgttatattaacacactcaaagcaaatcgacaaaaatttgatcccaggggacatccatgcattttcattggttttaaagcacatacgaagggttatcttgtgtatgacttgcattcacatgatgttgcagtatctagaaatgttactttttacgaaaattattttccacaattgcctgaaacccaaccttcgaacaaaaacaactcagcgccatcgccgataccctttttcggcaaagaacttgacccaccggaagagagacaaatcccccaaacctcaataccaacacatccaccttgtaatgatcatttgagagaacaagctccttcacaatctaggcgttcaacacgatcaaaacgttccccaacctatctccaagattatcacagaagccttgcttcgtctacatcaacggcttcaatggttgttcgctatcctctaaactcggtactttcatactcacggctttcacctgcacatagaaattttgtaatgactatatcatcagccatagaacctgcatcatacgtcgaagcttctcgccatgactgttggattaaagctatgacagccgaattacaagctttgcaaatgaacaatacttggagactcatgcctcttcctcctcacaaaacagctatcggatgtcgctggatatataagatcaaatatcgagccgatgggtccatagaaagatacaaggcacgcttggttgccaagggttacactcaaacggaggggttggactacctcgacaccttctctccggtagcaaaactcacctccgtacgagttcttctagctttggccgcactcaacaaatggcacctgcggcaactggatgtcaacaatgtgttcctccatggggaacttgaagaagaggtatatatgcaagttccaccgggacttccagttgataacctgaggctggtctgtcgtcttcagcgttctctctacggccttaagcaagccagccggcaatggttcacgaagttgtcaagcttcctcacctcccatgacttccaacggtctaactcggatcattctcttttcttgcgaataaccggatccaccattaccatactcttagtgtatgtagacgacataattcttacagggaacagcttgacagagatacaagctataaccactcttttggaccaaaagtttagaattaaagatcttgggaacttgaagttctttctggggctggagattgctcgaacctctaaaggaattcatctatgtcagcgtaagtatgtattagatatcttatccgaatcaggcatgttgggttgcaaaccgcactcaacaccaatggattattcagtaaaactgcaaaagagctcgggtaaccctcttccgaacgaatcttcctcctcttatcgaagattaatagggaagctcatatatctgaccaacacgcggccagatatcgcatacgcagtccagcaactcagtcaatacatggcagctcctacaactgctcatcttcaggccgcttttcgtttactacgatacctcaaaggaacaccagggtctgggctctttttcgcagcaacgggtacaccacaactccgagctttcagtgactcggattgggcaggatgcaaagattctcgaaaatccaccacagggttccttgtgtatctatgctcttccctcgtttcatggcagtcgaagaaacaatccaccgtctcccgcaactcctccgaagctgagtatcgcgcccttgcatccacaacctgtgaacttcaatggctgacatatcttcttcaggatcttcgcgcaacattcgttcagccagctactttgtactgtgacaatcagtccgcaattcaaatagcaacaaatcccgtattccatgaacgcaccaagcatattgaaatcgattgccatcttgttcgtaacaaagtcacttcagggttcatcaagcttcttcccgtatcgtccagtctgcaactcgcggatatttttactaaacccttgaccccggttgttttccagcatctttgtaacaagctgggaatgataaacatacattcccagcttgaggggggcgtgttaacagtataa

SEQ ID NO: 111100 - DNA, 1884 bp, Glycine max
  Peptide Sequence Number=SeqID_227878
atggagattttggaagattcaaaactacgggaagatgcaatgagagaactctatgaagtatcattaaatggatgcgtgagtaccttaaacacactgatccaaaaagaccctcttattctgagcagaatttcactctacccctacactgaaaccccattacacatagcctctttgcttggacatttggacttctgtgaggttcttcttcagaatagtcccagtttagcgactgaattgaactcagaaggacgttgccctcttcatttagcttcagctaatgggcacacagtggttgtgaaagcgcttttgaggacaaaccctgaaatgtgtttggttggtgacaaagatgagatgcttcctctccactttgctgcaatgagagggcgcgttggagccatcgaggagttgatcaaagccaagccagactccattcgagagatgacaaagactgatgatggttcagttctgcacttgtgcgttcgctataaccatcttgaagccttgaaattgttagtggaatcattgagaagtgaacatcaattcctatattcactcaaagacaaagaggataatactttgctacgtttagcagtgaaacgcagacaaatcaagatcgttaaatacttgctatcactatccgaaatgagtacagaaataaatactttgaacaaggagggtttaatatctatggacacattggggcagtgtccaagagaattcatcagccaacacattttaactgaaggagttgaaaagtctgaaaatgaagttataacacaagaagcagtttcctcaacaaccctagtcagcaatcatcaaacgactctgtcaacatctagacaagaaccaacttcctcacaaagcagcataactattgtaattgtacaaccggatctttcactagcatcatcaccctcacaaaccaacaatgatcctcctccacaaacatcatcatcatcctcatcagagtcatcaccaaccaacaatgatcctgaaccagcacaagtttctcttcaaccgacacaaccatatagacaacaacaatcctcacaaacacaaagcgtaactattgaacttgtacaactagatcctcctccacaaccctcacctcaacaaattccatcaccatcacaaaccaatattaatcctgaacaaggacaaccctcaactcaacaaacaccaacaaacaatagtaatagtattccaccagcaacaccgagcaatggtcaagtccaaccactaacatcagaaaacatcatcacaagtgaaaaccaaggacatcctaatagatggaacaggttcgagaggttctgcagaacgtatctgctagacgacggtaactggatgatggacataaagacaagggagcaactaatggtagcagccactgtgatggcaaccatgacatttcagtcggcgataagcccaccgggcggtgtatggcaaggtgatacaacacaagatgggtttgcttgccctgactatggtttctgtcaagcagggaccgcggttgtgggctatgcttggtcacctgattttctcaaattcatttttctcaactcttcttctttcttcgcgtctctttgcgtgatgctggtgctcatgagcgggttgccgctggagaacaaggtcgtgatgaggatcttgacattttttatgatcgttgcggcttcgtgcatgctcctcacgtacatgtgggcgttggggatggttagtccgaatcatatttattatacaactaagaaactggggtatcttttggttggtatgtgggctttcttgcttgcgcttgttattttgcttcatgcaagccgattagtgttctggtttaggtcaccacgcacaccctcctccacaaatattgctccgccgagcctcccttaa

SEQ ID NO: 111101 - DNA, 633 bp, Glycine max
  Peptide Sequence Number=SeqID_227879
atgaaaagagaaaaatatgcctcctatagtagtcataacccttgcaagagcctaagtgaagaacttcatgactattacgaaggaaagcataggtcacatcttagacctcactcccatagaagagaaaatgaaataaagcctcaagaggctaacattaacctttcatacttccatgggaaggacaatgtagaggctaacttagattgggaaataagggtagagcaacaacttaaaaggaagtctacttcaaaatcttatggctctaacttttatccaaagaaagaccaaggtgaaggcatcttaggggtgactccttctaagcccaaagatgataaggggaagacaatagaaaagcaaccccttaaggctagtatgcaagagaaaactagctccatgaatagccaagatgaggctactacttcaccttcctctagtggaattgaagaagcaaaagaggaagaatctagtgaagaaatatatccccaagaagaaggacaacctttaatggttaaggaggagtgtaaggaggtaagtgtctcctccaagaggtacttggcacccatcgtcaggcaatttgtgaagttccgtgacatgccggaactcaaaaggaagcatcgttgcacaattcgtgag

SEQ ID NO: 111102 - DNA, 701 bp, Glycine max
  Peptide Sequence Number=SeqID_227880
atgtcccatactaatggattcgggtccacaacgatgggttcaaatgtaagatcggttcaggatcatgggatccttttctatcagataggaagggctgtttcacaaaatgtacttctaagtaattgctccatagatcctatatctatctatatgaagaagaaatcatgtgacgggggggattcttatttgtacaaatggtacttcgaacttggaacgagtatgaagaaattaacgatacttctttaccttttgagttgttctgccggatcggtcgctcaagacctttggtctctacccggacctgatgaaaaaaatgggatcacatcttatggactcgttgagaataattctgatctagttcatggcctattagaagtagaaggcgctctggtgggatcctcacgtacagaaaaagattgcagtcagtttgataaggatcgagtgacattgcttcttcggtccgaaccaaggaatcccttaaatatgattcaaaatggatcttattctatcgttgatcagagatttctctatgaaaaatatgaatcggagtttgaagaaggggggggagtcctcgacccacaacagatagaggaggattttttcaatcacatcgtttgggctcctagaatatggagcccttggggctttctattttattgtattgaaaggcccaatgaattgggatttccctattgggccag

SEQ ID NO: 111103 - DNA, 309 bp, Glycine max
  Peptide Sequence Number=SeqID_227881
atgacgcctcctctcacctcttctcctttatcttctgctgcatcaccatggtttccttatgattgtgaaaagctgaagaataagaaggttgcagtagctggtgtctcactaagcgaggcatatgcgcttagcgagcaacatccgctaagcgagacatcagctcgcttagcgagtgaggagaatctggaaaagaatctgccacgcatgcacgcgctcagcgtgccatcagctcgcccagcgagtcatttgtctcttctggcgcccaacgcgcctgactcgcttagccaaaaatcactaactcgcgcttag

SEQ ID NO: 111104 - DNA, 449 bp, Glycine max
  Peptide Sequence Number=SeqID_227882
cccatgtccacacgcacgagtaccgcgcctttcagttccgccccgcctccctctccttcgagccccgctccctcgacgtcgtcaacatcggccccgccttccgcggccactacggcgcctttgcccccaattccaacctcccgccgctcgactgtgggccccacgactcccccatgataagcgacggcggcgacgagactatgggaaaaatgaagcaggccaccaaggaccagagggagctcaaccaatgcgcggaggggttcgaggttgggaggctcagcagaatgatggggtctgaggccaagaactacaccgagggtttggaggaattgtatcagaagatgcttgtgaagattgagaacttgtctggcttggtggagaagagttctgctatggttattgagcagggtaactttgttgacttttacaataactgctttaatagttaa

SEQ ID NO: 111105 - DNA, 336 bp, Glycine max
  Peptide Sequence Number=SeqID_227883
atgcctaactctctaaaaatagtccgcagtggagtcgctaactattgcaacctacccttcgacggaagggcaacgcagggctcacgggtgcgtcatccaagggaggaagacgcgcggagtagccaccaacatttattcgaggaaattgtcggaaaaaccagaacgtgtggtctacgaactttaagtgtgaaaggtttgggatttgtttttacgcacggggaagaagcaagtttcatgatgatgaaccaagcaattttgacgatgccaaaagcccaagtgattgattcaagacttcaagatcaagcatcaagaatccaatccaagattcaagattga

SEQ ID NO: 111106 - DNA, 171 bp, Glycine max
  Peptide Sequence Number=SeqID_227884
atggccggtgtcggtcgatatatggccccgactgatatctttcagccgacattgcgcaatttcctttacaaacgctggccgataatgacggctaggtttttccgtgcgagctcaaccgggggttcgttccgaccgacacaggcatgttgttcttctcatttaggaggataa

SEQ ID NO: 111107 - DNA, 468 bp, Glycine max
  Peptide Sequence Number=SeqID_227885
atggttattgccgccgtgttgctggcttgtgcggcgggttctcagggggcgctggcggcatcggcgagcggcaaggcggcatcggcaaaagaaactattcaggcgccgcagacgaaaatgccggaggaggccaaaacggcggatacccacggcgcgcaggttagcatcaataatgccagcgcggaggagttagcacaggctatgaacggcgttgggctcaagaaagcgcaggcaatcgtcagctaccgcgaagaatatgggccgtttaagactctcgacgatcttaaacaggtccctgggatgggcagttcactgactcaaattaaagttcgcggttatcacctggatgtttaccagcacgttaacaatgctcgttatctggagtttctcgaagaggcgcgctgggatgggctggagagtagtccggcgtttcactggatgaccagccataacatcgcttttgtggtg

SEQ ID NO: 111108 - DNA, 291 bp, Glycine max
  Peptide Sequence Number=SeqID_227886
gagagcatagagtctgccattaagaatctggaagtccaagtgggccaactcgcaaaacaattagcggataggccgtcaagtagctttactgcaaatactgagaagaatctgaaggaagaatgtaaagttgtaatgacaaggagcagaatggaaattcaggctgatgaaggtagagctgaagagaaggtggagggatataaacaacaactggcagctgagccggcactggaactagtttctgactttgttgaacttgaggaagttgtggaagatgaagatgaccaacagtag

SEQ ID NO: 111109 - DNA, 327 bp, Glycine max
  Peptide Sequence Number=SeqID_227887
atgcttggaagtgcgcttagcgtgcctattgcgctacgcctgaactactctctgctaagcgccaatatgcttctgttttttagtcctttgaataaggctaagcgcaactgctatgctaagcccttgttgtctgtcaaggaggctaagcgcgccctgtgtgctaagcctaagggtcattcttctaaggctgagctaagcccagcatgctacgctaagcccaaaccctcttctgttttgaaaattatggcatcaaagaagagaaaggcacctgccacaccttcccaggtccgatatgaccgatctaggttcacttctcctgaggcctag

SEQ ID NO: 111110 - DNA, 657 bp, Glycine max
  Peptide Sequence Number=SeqID_227888
atgtcaggagcatacatccaagcacgcatggaccatgcgatatcctctcagccacgcaaggtcctaaaagcgcccgatcgcccgatcgcaatccgggagaattacatcacggactcgaggacactcttgactctcagaccacaaggagacgcccagtccgtggctgcttacaaagtacaagacggaagcggggttactcagtttacggccagtggtcggaaatacaacggtcgctcatgtcgagaatttcgggattcatcgggcctacccttgttcgagcttcataggaagttctcatttagagatgcttggtgcattacactgccgggcagtccaaccgcggagagtatagccaccggtgcaccgcgactggcaccgtttgggaaccttgtgtttacgttcaccaatgtagctgtcactgatgtgaaggggtcagtggacgataaaaaggtgacactggaggttgagagacatggacgtgtattggagtcatttgatattgtggatggtgacaggaaggttgctgaagtgcgcgagagcgtacagcacaacccgaaacttgctttgacgccgagtacacggcgcaactatcgacctgttctggatatcatcgtcactccaggtgtggacttatctttagtaagatctattccgtag

SEQ ID NO: 111111 - DNA, 567 bp, Glycine max
  Peptide Sequence Number=SeqID_227889
gatgaattacaagaacaaactaaacagggagcttttgtcccacatggtcgtcaagacatcctgaacactgccattggctgtccagagcatcctggacgtgttcgtatcgatggacatgaagacgagaacaaagaccgtatggaccagttgaaaatggagttggatgcgatcaagagtgaattatcccaaattcatacgcaacagtcagctcccccaagaccatctaaccctgacgtatttgttgcacgtgttagcaccaaagagagttgtgctgaagctgctaataacgttgttggtaatgagcggtctacatttgatacatgtagtatgggcttatacattgtttgtggtgacagtacacagctggtggctgggggaaaggtctttggagtaggtgacacgatacacattgttgcttatggagatgatgtactaagggtgtgtgttgacactgtatacgatggtgaagccattgtcccgttacccacttcagagattcaatatgtcagggacgccgtgaactcattcattggatggcccagacatctagtgaaacctttatcttat

SEQ ID NO: 111112 - DNA, 648 bp, Glycine max
  Peptide Sequence Number=SeqID_227890
atggtattcttggatgcactgcgtgacttgacacagagtagaggttacgcttggggcgctgctgcacttgtgcacatgtatgataatttaaatgacacatccaagagcactgtgagacagcttgtaggatatatcactctattacagtgttggatctatgagcaattttcgtctgttagtttcactgttcctgccgaggattacgatgagaagagacagcgtgcatgtcgatggacctctggcaaggcactgcccatttccacgtatcggaggcgtatggatagactgacccctgatgcggtgtgctggagtccgtacggtgaccaccgctcatttagagaatttgaggtcatctcattatttttcggccatttcaaatggggccccttggctgtcattcaccgaccagagagggttgtacaacagtttggctacatccagactattccgccacatcctattgcatcttcactctctattgaagaaattaatgatagacggatgcagtttggtgagtacattgcacctgtagggcaattatgtgcaattcctgaccactattctccagattacatggattggttttacatgatctcgcacccattcatgagtctagcacagccaagggatcctcctagagttccgttg

SEQ ID NO: 111113 - DNA, 678 bp, Glycine max
  Peptide Sequence Number=SeqID_227891
atggatgatcggcgtgggttccggcgtggccgtccggtcgccatgaatggcgaccctacaggattatgcacttttgtaggatgcgtatttatacgcacctggggatgtgcacggcagccagtaaaccttcagccatcgccgaagccggataaagggtggaaggcggggccgtggagtaaagcgtcacacgccatggatggcgtgtgccgagcgatcagggacgagacagcgtctttacggagcggtcccgtatttcaccctgaaactgcaaaaacgacagacgaaaaaaaacctgctttttgcaaagcaggtttcctgaatgatggtcggcgagagaggattacgcttctctgcgagaagcgccctgcgggccgttgctggcgcaacgttgtctcgctgcgctcggctcaaacctccttcggaggttctcatcctctatttgctacagacgaaaaaaaacctgctttttgcaaagcaggtttcttgaatgatggtcggcgagagaggattcgaacctccgacccactggtcccaaaccagttgcgctaccaagctgcgctactcgccgatgggggcgaatattactgccgtgactttagagcgtcaatcccttttcccgaaaatccgcctgattgcctggaaagcaagcagtgcattaaacacctgcctgctcaataa

SEQ ID NO: 111114 - DNA, 279 bp, Glycine max
  Peptide Sequence Number=SeqID_227892
ctgcaggtggtgttgaacaaagcggtgacgctgaaaggccagcccggcacagcagctggatacggtgatttccgccaatttccagacctcctggtcctcggttatttctggcgaaaggtggacggtaaactgctggcgctgcagatcaccctgcccgccgacaatcagcagcaggcgcagagcgatgtcgatgcgattgtgaagagtattactctgaagtatgtttgcaccaacggtagcggcgcgatttatcgcgcgttgttaaaaaccgcgcaataa

SEQ ID NO: 111115 - DNA, 147 bp, Glycine max
  Peptide Sequence Number=SeqID_227893
atggccctctataggttggcgttcgcttactcgaacccactcaagatattgggctgccctgcagcgacgtttttcgcctgtccagcaccgggaagggatgatgatctgtcgctcgtgaccctatcctctatttgcatccatccctaa

SEQ ID NO: 111116 - DNA, 360 bp, Glycine max
  Peptide Sequence Number=SeqID_227894
atggtggaaccatcgaagaagcgcaagggttcttcaataaaagccttttattctaaccttgaaattcaagaaagtaccttgatttctgaggtctatgggataaagattatcattaaccaatccctcttctatgatttgaccaaattgtctagtgatggtgtgccatttgaaggtgcactagatgatgattggaagtttgatttttctgtgcaagatgcccgccggttggtttgcaccaaccaagcggatatgaccggaagactgcttgccggttcattggctcttgaaagccgcatcctccatttatctaattgtctgtatcttactccccagatcttcaaaccttgcataggtttctga

SEQ ID NO: 111117 - DNA, 912 bp, Glycine max
  Peptide Sequence Number=SeqID_227895
atgcttaaaggagcaaagccacggaagacgattgccgttgaaggtctagcagacgttcgttttttcaatcagtggttctctgaaaatgagaaaatcagatttgtatcacttgatggtaagccgaatgtattacgcttgcacaaagactatttaaaaagcccattgaaatccgtcaaaggtatgtttttctgtgtagacattgattgggatttaatccatgggaaagcattacctctgaaagaggattttttaattaattcctactgccaaataaaaaacaagttctcatttaacgatcttgagtctttccttattaattcaagagcattgcaaaagctaattgcatcttatgatttagtgattgaagatttcaacgatttcaaaatgaagattgaagtatgctcgagaaaaattggtaaatacagagcagctgatgacattattaaaaataagtttatgcttagaaatagtgtattaaatggcgcttcagtagacgatttttttgatgcagaaaattttgaattcaatgagaagctcttcactgaaaacatgccaaggtgggctaattattcagaacacattgaagatttagtgcaggaagcagaaattttagatgatgctaataaagagttgtggtcactatcaagagggcatgatattacaacaatgctttcacttttcattgagaacaaagcgaaaattaaaacttctcccgaaaaaattgaaaaagaacttaggttaagttgcgaatatgccgatttcttaacaagtccaatgtacgagaagatgctagttcataatgtcacccagatgcggcgcgtttgccaccttttctgggagatctctgctgatgctggtgaccatgtcgaacaaagagcttcaccgcctttccgtcattcaggctgttattga

SEQ ID NO: 111118 - DNA, 562 bp, Glycine max
  Peptide Sequence Number=SeqID_227896
atggcggatagttttcttggggacatatcacagcagcaacttcatcccctaagggaggacacttggatttggaaacctgaacctgcaggagactactcaacaaaaagtggatatgatttgatatggggagagctgatggaggcaaaacaggaacaggattatggggcaatatggaaactcaaaatacccataaaaatagcagtaaataaagaggagtgggctgcacacttgttcttcaattgtagcaaaaccctccctttatggtgggaatcaatgtcttgggttaatcttatcactgtaatgccacaaaatcatagggaccattttatgcaacatggaatggaggtaacagatggagtcaggtccaaaacctggaaatgctggtggattgctttaacttggacaatatggcaccatagaaataaggtggtgttccaagatacaacttttcatggaaccaaactgttagaagatgccctattcctactatggtcgtggatcaaagcaatggacaaggattttactcttcattttaaccaatggtcctctaatcttaaggaag

SEQ ID NO: 111119 - DNA, 249 bp, Glycine max
  Peptide Sequence Number=SeqID_227897
ggatcgcgcctgcaaaacatccagtggacccgaagaagtccaacagggtcttggaattgtcaagctctaattacgggtctctttcagttttacggagtgcctgtcacctccagtaagggcatcaggccccctactaatcgagctttcatcaagaagtactgcgtctccaggcaggcgcagggcgaaacaccacaacagcctggggatggccagcagcgggcaacagacgcaccgccatcacctctatag

SEQ ID NO: 111120 - DNA, 375 bp, Glycine max
  Peptide Sequence Number=SeqID_227898
atgtacaaagataattggacccaaccttggcccatgggcttagaaatctaccctaatgttcatgagaaccctagggccttcttcagctactctagcccaatcctcttggagcctcgtgctcatagctctatggcggtgattatgaggtcagacacaaacactggtatgagaagaaggacttcatttgtgataattggttgtgagatgactggtcagtatgggtcgaggaagaaagattttgttagaagagatattgggagtatgaaatgtgggtgtcccttcaagcttcatggaaaaccagtggttggagggtgttcattttcccatatggttcctttttctacaattttcaacaaatatattcaagggaaatga

SEQ ID NO: 111121 - DNA, 159 bp, Glycine max
  Peptide Sequence Number=SeqID_227899
atgtcaccaagaaggtacatgccaaatgaaagtgaaccctccaacgagaacccaacgaagaactctcagaaggatccttttacactcaaagatgctaacctacgagtgaagatttgtcctaatgttcatcatctgaacctgaaaatgttggtgaattaa

SEQ ID NO: 111122 - DNA, 387 bp, Glycine max
  Peptide Sequence Number=SeqID_227900
atggttttcaaaaccttcctcataatggggactggaaagggaaaggtgattatgcgggagtacaccaagaagttggaaaattcttatgcgtttatagcagagctttggggagttttggagagcttaaaggtggttgcttccaagcatatcagatatctggaattacagattgattcaaggtgttttgatgataacaaagatgatgacaaaaaacccaagagaatgatttcaagattgagtcaagaacaattcaagaatcaagagaaagattcaagagaaagtttcatcaagaagattcaagattcaagattcaagaataatcaagatcaagattcaagactcaaagattcaagaatcaaaagaagacttaatcgagataagtattaa

SEQ ID NO: 111123 - DNA, 984 bp, Glycine max
  Peptide Sequence Number=SeqID_227901
atgaagaaagccagaaaggaggagtggtgcagaaacaagtttcgaggggctttgttaggcaacagtaatgagctcaaacttagaaaggccgagagagacaaatcaaggatggagaacgtgatgttagaggataagttgaggaattgtcagaggtcaaagggaagtttgaaagagcagttgagcaagacggaagagaatatgttgataatcattgataagtacaaagagaaggtgaaccaagctgctagtcatgggcagatgctgagagacgaacaagcgaagatgtcggccttgcggagtcaagagcttccaaggctattagctagagccaagacggtggctaacacatactctgctctcgatgaagtcgacatggaggccatgaaggagcatatgacaacgatgatggaagcaatgatgagcatgaggaagatgatggaggttaacactactacagttggtgttgcaagcactgctactgaggtggacctgattcacctgtctggtttcaatcgagtaggttgtccagtctcggatgtagtaggccaaggaggcgagtcggcagaaaatgcatgtgggcccctttatgttcaggttcagagaaagcattcttttttgccatatggtttgcctcccaattatacaccgcccactgttgtgtatgcttctggcaagaatgtcaacaattatgaaccaatactcattaagaatcaacaaccccaacctgatcatgcccatgctcctcaacccatggaggaaacacatgaagctccccaagaccacactctggccgatttcgggccccactctggatatgccattgaaggacatgcatttcctgggccttgcatagtacttgagaaggaaaggattgagcatatggaggagaggccgaggaccattgaagggggagaaaattatgcctttgttgacatggcagaattgtgcttggtatctaacgtggtcattcctccaaaattcaag

SEQ ID NO: 111124 - DNA, 840 bp, Glycine max
  Peptide Sequence Number=SeqID_227902
atggcggaaactctggcaagccaaggagagtgggtatcattcatggatgtattagcactactagtgttcgagatagtactatttcctaatgtagacagacttgtagatctagcagcaattgatgcatttcttgcttatcaccacagcaaggaaagctcggtcattgctgttttagcaaatgcatatgatacattcgacttaagatgcgagaaaagcagtgcgataattgtttgttgtacgcctgatctttatgtatggcttatatcccacgtctttaatcatggaagtagatctgtctatcccttacaaggtcatcacatgtgctcgagaaaggataaagcaaattgggaagaactcttggcaggcatgacaggagcatccattagttggttcccacggtggaaagaagggggggcaggagtattgtgctcatgtgaaggatttctaaatgtccctttgatggggacaaggggtttcattaataataaccctgtgttggccataagacagttaggatatcctatgagaggtgtgccatcggaggaaaccattacgcctttcatcgcacgagggttcaacaaagctaatacaaaaatacttcagaagatctgtaaggcatggaataaagtgggaagaaaagataaagaacttagaggaagaagcaatggtgtcataggcggctatcacaaatggttgaaatctagaacgcaagggataacttggctaaaaaagctaaagggtctaaatggggaagtggcagaagtgcctgaggagagtgaagaggtgcaagccttgaatgatgagctcaaaaagacaaaagtagcaaatgagaatctgaag

SEQ ID NO: 111125 - DNA, 285 bp, Glycine max
  Peptide Sequence Number=SeqID_227903
atgtctggccaagtgataagtgcagagaaaacgagtatttatttctcaaaaaatgttttttctcagctttgggcagaccttgctaatcagtctgggtttaaagaggtaggagccttgggtagatatacaggggcacctttattaggagttgctaaggtgtggccctttttgtctaaggaggaatggtgggctattggtaatggccagtcagttaacctttggtctgacaagtggatagatgataatactaggttaaagaattcctttaccttgtgtttggattag

SEQ ID NO: 111126 - DNA, 255 bp, Glycine max
  Peptide Sequence Number=SeqID_227904
atggatcaagtgcaatgtcagtcttttagcaaggtatatgggaagatctgggatttggcaatgatagaagtgtcagttgaagccattgcatctctcactcaatactatgatcaatcgcttagatgcttcactttcggggactttcagttaacaccaaccatagaggagttcgaggggatcttaggatgcctgataggaggaaggaagccatacctcttttctgggtactatccttctatggcgaaagtagcataa

SEQ ID NO: 111127 - DNA, 3060 bp, Glycine max
  Peptide Sequence Number=SeqID_227905
atggaaaaggtggctccgcctccgattctgatgcaccggaagcgcgatctatcgtacgacatcgtttcggcgggtccgaacgagagctggaggtgggagtgggacagcgtgcgtttcgcaggaaaaccaccgccgccgccaccactgtccccaaacaacgacgtcgttttcgaggcggaaagtgtcgttcctcctctacagttaaagctcggaggaacaacaagagtgaataacaataacatcaatatcaacgttagcaacaagagagttaggtcggggtcccccggaacggcgtcgtatccgatgtgccaggtggacaactgcagggaggatctgtcgaaggcgaaggactatcaccggaggcacaaggtgtgcgaggctcatagcaaagcctcgaaagcgcttctcgcgaatcaaatgcaaagattctgccagcagtgtagtaggtttcacccgctctcggagttcgatgaggggaagcggagctgccgccggagactcgccggacacaaccggcgccggcggaagacgcagccggaggatgttacctcggcgactcccgcgcctgctgccgccgcgaatttggaaatcttcaacttgttgactgctatagctggagcttcgcagggaaaatttgaggaaaaaaggtcacaagtttcggatagagagcagcttgttcagattctcaataagatacctttgcctgcagatcttgcaaccaagttgctggatgctgggagtggtaatgttaatgggaaaaaggatcatgtgcaattgcagacaccatcatcctcctatcaatgtcacgagtctcatgacctactgaaccacaccccggctgccccgttaactatggacttgcttgctgttctttccaccactctttctgggggttctgcccctgattccagtgcgtcaccctctcaaaaccgcagctgcagcagtgatggtggcagtgctgaccagacgagacaacagcaattcttttcggttggtggagaaagaagcagtagcagttcccagtctccagttgaagattcagattgtcaagaagttcgagttaatttaccactgcaactctttagctcctctccggaagatgacagcctgcctaaactagcatcttctagaaagtatttctcgtctgacagtagtaaccctgctgaagagagatcgccatcgtcttctcctcctattgtggagatgcagtttgatttgcaggatggggctagaggtctcaagccagagagtatatcctctggaagaggagttaatgcaaataaggaagccagccaaagtcatagttctaatatctctcttgatctatttaaagggtcaaataactggatccaacaacctagttcacttcagagtgttccattccaagctgggtatacatcttcgggctctgatcattcacctcccagtttgaattcagatgctcaggatcgcactgggagaataatgtttaaactatttgacaagcatcccagccatttcccaggaacactgcgagcacagatttacaattggctatccaataggccatcagacatggagagctacatacggcctggttgtgtggtcctatcaatttatgcttcaatgtcttctgctgactgggagagattagaagaaaacttccttcaacatgttcattctttaattcaaaattcagattctgatttttggagaaatggaaggtttctggttcattctggcagtcggttagtttcacacaaagatgggaagattcgcatatgcaaaccatggagaacatggaagtctccagagttgatatctgtgtcccctttggcaattgttagtggacaggaaacctctatttcattgaagggtagaaacttgtcaactcttggcacaaagattcactgtacaggtactggctcttatgcatcagcagaagtcataggttctgcacattctggtgtgatgtatgataagataaagttgagtggttttaaagttcaggatgtatcgcctggtgttctgggtcgctgttttattgaggttgaaaatggtttcaagggtaacagttttccagtgataatagctgatgagaccatttgcaaggaattgagaccacttgagtctgaatttgatgaggaggaaaaaatatgtgatgccatttcagaggagcatgaacatcattttggaaggccgagatcaagggaggaggctttgcacttcttgaatgagcttggctggctgttccaaagagaaagattctcttatgtgcatgaggttccatgttattcacttgacaggttcaaatttgtactcatatttgctgtggaaagaaactgttgcatgctaatcaaaacccttctggatgtgctggttggtaaacacttgcaaggggaatggttgtcaacggggtcagtggagatgttgaatgcaatccaactcttaaatagagcagtgaaaggaaaatacgtaggcatggttgatttgctcatccactattctataccaagcaaaaatggtacatccaggaaatatgtatttccaccaaatcttgagggtcctggtggtattacacccttgcacttggcggcatgcacatctggttctgagagtgtagttgactctttaacaagtgacccacaggagattggtttgaagtgctgggaatcccttgtggatgcaaacggacaaagtccacatgcctatgccatgatgaggaataatgactcttataatgcgctggtcgcccgtaaacttgctgacagacaaaggggtgaaatttcggtaacaattgcaaatgcaatagagcaacagtcactgagagtggagcttaagcaaaagcaaagttacttagtcaaacgaggtcagagttcttgtgccaagtgtgcgaatgcagaaattcgctacaacagaagagttccaggttcacatggtttgcttcaccgcccctttatttattcaatgctagctgttgcagctgtttgtgtatgtgtttgtgtgttcttccgtggtcgccctttcgtaggctcagttgctcccttcagttgggaaaatctggattatggcacaatgtaa

SEQ ID NO: 111128 - DNA, 228 bp, Glycine max
  Peptide Sequence Number=SeqID_227906
atgtggaattgtggccacaaagcacaaacaattatgaaagcagtaagcattgggaataaagagaattgtgattcgttttctgtttgttccgagattcagattgttatcccgtcagcctactacatccttccaatgcaagacgttcaagttagtgggacactagggataatgagatcttccgttagatttcagaaactgttagaagcaggattgagggtttgctactaa

SEQ ID NO: 111129 - DNA, 408 bp, Glycine max
  Peptide Sequence Number=SeqID_227907
caagggtggatattcgtcgatagtgggaatgaaatggagcatgaaacattccttgcaacttggttggcagagattgatttctctcccaatggcttggtgagcaaggagatgtcaccacacgttatgcaggatggtggaagtagtcaatactgtatcatcatcgtgattttgcaaagaatattactcagtgaaagagaagtctacgcaatgatgctggtgtttccacctgaattttctcctttgacaactattttatttggaaatccttcccaagacaccgttgaaccactgatggaggctttggaggaagattataaagatggaaatgagataaatgaatcaaggcagtttattgaaggagtattggatcttgaaaagagaatcaatagactagatacattgacttag

SEQ ID NO: 111130 - DNA, 279 bp, Glycine max
  Peptide Sequence Number=SeqID_227908
atggatgaagcaccaacaacaaaaagtgtagtgcaaaagcacccaccttgctaccatcaatccaatcatcaaggcattcaacataaaaattgtgagcacaaggcaggccatgaacttgcattagattgttttgattcaactcctgaagaatggaattggaattgggtcataggaaaagaaaattgggttgtggagtttcaagtgagacgagagagagaaagaagggtggaaatggtggagacggagggagggagaaataaggtttcagagtttgtttag

SEQ ID NO: 111131 - DNA, 282 bp, Glycine max
  Peptide Sequence Number=SeqID_227909
atgtcttggtggtctcctggttattcacttggcaccttcacgggacattcaacacctgttatgttagtagattttcatccaaataaagatgacctcatatgttcttgtgatggtgatgattttggacttgcaacttccatcgaagttgaaaggccactgacaaatagagtggtgacactttggtatagggctccagaacttcttttgggttcaaccgatcatggattcatcattgatctctggagtgcagggtgcctgatgggtcttaatgcacaaaaatag

SEQ ID NO: 111132 - DNA, 177 bp, Glycine max
  Peptide Sequence Number=SeqID_227910
atgccaccgcctaacattctaagacagttttctgggaaccgccttagaaggtgcttgccaactttgacaccacttcagttgtggtgccgcttaaggaggaatcacccaatgcctagcttcaagaggtgccatctagagggtcatcacccttgcctgctgatttacattgcgacatga

SEQ ID NO: 111133 - DNA, 4356 bp, Glycine max
  Peptide Sequence Number=SeqID_227911
atggagtgggttgtacataataaggaagtcaaacacaaaatcctctttcttgtggagatgctggaaccttttcttgatcctggcattgctgtaccaaaaagcaaaatagcttttggagatatagcttcttcatttccagaaaagcaggaacacaattgcacaattgctctaaatatcatccgtactgctgtacgaaagccagctgtgctgccttctttggaatcagaatggaggcatggatctgtggctcctagtgtgcttctctcgatattggaaccgcacatgttattgccacctgatgttgacctctgcaaatcagttttaagaccaactgatcatgaaactgcatctatttcacatctttcctctgccattaatggtggaggcgctttttccaagtcaaatggtcaagatgagtctgatggaaaaacaaatgtttcagaaatggctggaaaatctgattttgttgaagatcgtaatctactttttgccccacaggaactgcagagtatgacattgacaaatttctctaatattcctgatcaaaatagctctgtttctaacattggggatataagcttggaatccaaacatgtggctgagaaacacgccagccatcattttcctactaatatcttggatgctggccttggttttgaatacttcaacctgcaggctgattattttcaactattaaactaccatgattgtgaacttcgtgcttctgagtttagacgcctggctttagatttgcattctcagaatgatgtctctgttgaaagccatgatgctgcaattgatgctatgctgttagcagcagaatgccatgtaaatccttattttatgttgtctattggagcctcttcaaaactgatggaccttttgaacgttaatgaatttaaagtggtgcagtctcatgataaagttacgataaaaaaggcttctggaaagaataaacctaatttagaaactattgcacatatagaaagaaaaagagataaacttgtttttcaaatactacttgaggctgcagaattggacaggaaatatcatttacaagtatctaatggggaagatggggcttattctgctgaaggttttgatgaacaggttataaagctatctccccttgatgtacaatatgcagatgctctaaccttggttcgacaaaaccaagccctgctgtgtaactttttgatccaacagttgcagggagaccaaatctcaatgcatgaaattctcctgcagagtcttgtgtactttttacacacaggcaccaaattatgttgtcctccagaacatgtgattgatatcattttaaaatatgctgaagacttgaacaagttgctgacatcttttcatcacccgctgagggaaggtagtttgcatttgacaaaagaaagaatgcatggggtagagcgacgttggttactgctacaaagattggtaattgctgcaagtggtggaggtgaagaacaaacttttggaactaatgtccaaaataattacctctgtggaaatttaattccttcttcagcatggatgcagagaatttctcatttttctggttctttataccctttggttcgatttcttggttggatggcaatatctcgtaatgcaaaacagtatatgaaggaccgtattttccttgcatctgatctatctcagctgacatatttactttctatttttgccgatgacctagctgttgttgatgacgttgtcaataaaaagtatgaagaggtaaaaattgaagattcacggcttgaacatagttcttctgctaagagggaatttgagcgaggtaatcaatgtgatgaggaacgatctttttgtgcaatatatcctgaactctggaagttctttcctaatatgaaaaggcaattcaaatcttttggagaagccattttagaggctgttggtttgcagctgagatctgtttcttccactctggtgcctgatgttttgtgctggttttctgagttgtgtttgtggccattttcttttgcttcttcaattggaagtaataatttaaaaggctataatgcaaagaatgccagagcaataatcctttatatacttgaagctattatagttgaacacatggaagctatggttcctgagactcctaaactagtgcaagtgcttgtgtctctctcaagttctacatactgtgatgtgtcatttcttgattctgttttgcgtttgttgaagcctatcatttcttattctttgtctaagatctctcgtgatgaaaagctattggatggtgattcttgtcttaactttgaggagttgtgctttaacattcttttcatgaaactgaaacaaaagagtgagattgaacatagttctgaagataaagaatataatacagcgctggctatttttattttggcttcaatttttcctgatttatctatccgatatagaagggagtttttgcagtctttattgaaactggcaaactttgctgcttttgccccaacaacttctttctttgattttctcagtgcatttcaatgtgttatggataattgcaaattactattagtgaatgcattaacagaatttggtgtgattcctcttcagctgcctccttatcctcatagaaatgttggtggactttctgatgataacttgaaaccgaatccatggtttcttagtgatgtctgttgcacttcgtgtgtgaatgatgttcataatgtagaaagtaacaactctgatgttggtcattttcatttaccttctgatgatttagaaggcttttctaaggacatagagggtctcatttcagaacttaatccagctattgagtgctgttggaatcttcatcatcagataagtagaaaactaacgatagcatcagcagaatgttttgtcttttcaaaatgtttgacatcagtttctcaaaaatttcataaagctgaagatgatgaccaaaattcttcaccaactaaatcatctgacatattcacactccattggagatttggtcttcaaggactttgtgaattgattgttatgcttcaagaaagaagttgctgggaagtttcttgcttgatgcttgattgtttacttggagtaacctatagcttttgcctggatggtgtggtaggcataatatgttccacaataaagaatgtttcttgcagtgcgccaaaaatatcttggcgtttgcggagtgataagtggttatcttctttaattgctagaggcatttataatagtcaagaaagtgaggttcctcttatagatctattttgtactctgctagcccatgctgaaccggagcaacgtattatagcagttaagcatttaggaatacttcttggccaatgtacaaatggagaaagagctgtgatgaattttaaaatttgcactgacttcattcaaaataagttagttttatccattcctgattatgttctttctcgtctggtttctagtacttgggatgaagttgttgtgctggcatcatctgatttgtcattacaactaaggattcatgcaatggcacttctttcaaattacattccatttgctgagcgccatcatttgcaatcttttcttgtggcagctgatagcatttgctgtttgtgtaatgcgcaaccatcgcaagatggtcctatcctgcaactttcattagcacttattgcttatgcctgcttgtactcaccagctgaagatatttctttgattcctcaaaatttatgggaaaatgttgaaactttagggtcaacaaaacatgatggcaagcttggagacctcgaaaagaggacttgtcaagtcctgtgtagattgagggatgaaggagatgaggccaaagaggccctgaaagaagtactttctcagaattcttcaaagcagtatgacccggactttgctaatacacgtgaatctgttgtccaggtccttggcaacttaacagcagttcactcatactttgatttattcacaaggaaaattgaccaagatgatatggagcttgaggaggctgagttggagctagacattattcagaaggaacatgcattaccaggacgaatggatgattccaaagattggaatcagattccaggtcttccctcctacagaaaggatgtctcaaggcttcagcaaatcagagagtgcattcgttccctagaaaagtccaaacttaaagaagatatcatagctcgtaggcaaaagaaactacttatgagacatgcccgtcaaaaacatttggaagaagcaactttacgggaagcagatcttctgcaagaacttgatagggagagaacagctgaaatggaaaaagagttggaaggacaaagattgctcgatatagagcatgctaaaacaaaggaatga

SEQ ID NO: 111134 - DNA, 264 bp, Glycine max
  Peptide Sequence Number=SeqID_227912
atgagagaaattgcagtcgtggatactggtccacgtgatgactcactgttaagaatgcaacacctgcatgtgttggaaaatgtctggaatgatgaagcagattgtgttttacgatctaggagagcccaatgtcaacaagagaattattgggtcaaactggttttcttggtgttgcaaaaattccatttttccatgtatgataatacgttgatatatgcacttgttgagtgttggaggctagagacctacacctttcacatgtga

SEQ ID NO: 111135 - DNA, 1855 bp, Glycine max
  Peptide Sequence Number=SeqID_227913
ggagtgtttgttcgaagctggttccaaccaacagagcgagtgttgcgggagttacaaccatgatgctaactttagcgactcaaagtattgcaacaacttctccgcatgccgtttcaacattgagttccactccagtaacctatcgttgccccctgtctccactcactttaatttcccgctgccggcgcaggtaatggttcccattggcggcaaagacttcgtcatcttgggatcacaagttgttttagccgcgaaaacagaagaagagaagaatggagagagagggaatgaagtagcagaagtttacatagttcacatgatcagatcattgggtgatagcacaaagctattgaggctcgttctaatagcgtcacacggcaagactcgttgttccaacaatttcacgccatgcttctattttactcaccaagctgcgttggatatggattcccattcctacgccaacatgctccaacaagccatccgaaaccgcgaccccaacgcagggaagagcctccactgccacattctcaagcacggcgcgtctttggacttgttcgcccagaacattcttctcaacacctatgttcatttcggctttttggaggacgcttccaaactgttcgacgaaatgcccctcactaacaccgtttctttcgtcaccttggcccagggtttctcccgttcccaccaattccagcgcgcccgtcgcttgcttttaagagaaggatatgaggtgaaccagtttgttttcacgactcttctcaagttgctggtgagcatggatttggctgatacatgtttgagtgtgcatgcatatgtttataagcttggtcatcaggctgacgcgtttgttgggactgcgcttattgatgcttattctgtctgtggaaatgttgacgctgcgcgtcaagtttttgatggaatttattttaaggacatggtatcttggactgggatggtggcttgctatgctgagaattactgccatgaggattcgttgctacttttctgccagatgaggattatggggtataggccaaacaattttaccatttctgccgcacttaagtcctgtaatggtctagaagcatttaaggttgggaaaagtgttcatggatgtgctttgaaagtgtgttatgatagggatctttatgttggcattgcactgcttgaattgtacactaagtcaggagagattgccgaggcacagcagttttttgaagaaatgccaaaagatgatcttattccttggagtctcatgatatcacggtatgctcagagtgataaaagtaaagaggctttggagttgttttgtcgaatgaggcaatcatctgttgttgtccccaataattttacatttgccagtgtactgcaagcttgtgcatctttggttttgctgaatttgggaaaccaaattcattcttgtgtactgaaagttggtcttgactcaaatgtgtttgtttcaaatgccctcatggatgtttatgccaagtgtggtgaaattgagaactccgtgaaattattcacgggatcaacagagaaaaatgaggtagcttggaacactataattgttggttatgttcagttaggggatggggagaaagcattaaatttattttcaaatatgcttggactggacatacagccaactgaagtgacatactcaagtgttctgcgtgcctctgccagtttagtggcactagagccagggcgtcaaattcattccttaactatcaaaaccatgtataacaaggatagtgtagttgcaaattctttgatagatatgtatgctaaatgtggtagaattgacgatgctcgactaaccttcgataagatggataaacaagatgaa

SEQ ID NO: 111136 - DNA, 258 bp, Glycine max
  Peptide Sequence Number=SeqID_227914
atgtaccaatcatgtctaaaccaaggacaagcttcagaccaaagcaacataaaatctaggtatccaaaatccctcaatttaatggattttcaaggtttgagaagtgaaattgagaatgagagatgcgcttcacgactccgaaaatgccttcctttcgcgatttggagcagaaatggtgaccagaggttagagctttgttgggcaacaatggtggatgagagaaaagaagaagaaggctgcgtgagagagagggagtga

SEQ ID NO: 111137 - DNA, 336 bp, Glycine max
  Peptide Sequence Number=SeqID_227915
atgtggagagatcgtttggcagaggccttgaaggaaatgcagtcagaaggaaaggcagatcgggtgttccacctaatctctgctagtaatggaaccatagagagagagaaagatgatcaacctgttatcaagctgaatgaaatattagctgtatgcctatcaatgttatcaatggcgaatgccgggatgtggtggaaggccaaaattcccccatatagacatgcaattgctgcctatggcgctgccatggtaggcctaccttcacaaattgcctatggtggttggcaaaaatctgccatgccattccggtatagcagccatggggccaccatttaa

SEQ ID NO: 111138 - DNA, 438 bp, Glycine max
  Peptide Sequence Number=SeqID_227916
atggattctacaatcacctttacagatatcatgttctttatatgcagtaagttccaagccactcagcaaaaagttcaattaggaatcggaatagcggttagcttcttcattcaatcatggtgcatctcagaaagaggtcccctgtactgtgcaatgttcaaccctttggcaacagtcataactgctttgataagtgcaacattcctacaggaagaggtgtacgttggaagtttggtaggtgctgttggagttattgctggtttatatattgtgctttggggtaaagccaaagagtttgctgagattaaaccagaggcggcaccacaatcatcaaacttacaagatgatcatgatataagtagtaggatagatttggaacaaccccttctgtcagagaaattgtccgaacatgtaacagaagcagatagcaaggtgtag

SEQ ID NO: 111139 - DNA, 339 bp, Glycine max
  Peptide Sequence Number=SeqID_227917
atggtggcctgtgttaagggagatatgtgggagaagatggttatgaaaatggtgatagcgatgggttacgcagagaaggtagaggaagctagccatgatgaatcatgtagatttaatgagcaggtcatattcacttcaaatgaggttaaccgatacttaagaagatcaagaattctaaaaaacattctcaatttctattcagacataaccgccaaatttgacaggcacaggaggtttggcaagcatcggtttgaagacgacaagacgaaacctaagaagccggcaacggtggattggtggtggcggttaaggaagccatcaatagtggatatcaattaa

SEQ ID NO: 111140 - DNA, 303 bp, Glycine max
  Peptide Sequence Number=SeqID_227918
atgggtggtttagctagcaatcttcctctaattgttatggtgggtctgcaaattcattatgcagcacttgctatattcacaagagccgctttgttagatggattgagtacgacggtctttgtagtgtacaggcaaggcatagccactttggctttggcgcctatgtttttctctcctaagcgagtcacagcaaatcagaatgcatactttaaaggtttattttatgcatcctctactgcagctaccgctatgagtaatctgataccagcattaacgtttgtaattgcggcaattgcggggtaa

SEQ ID NO: 111141 - DNA, 505 bp, Glycine max
  Peptide Sequence Number=SeqID_227919
ggtacatcctttgtggtacaagtagagggtatatctacttgggttattactgagaacaagagaggatacatctcttgtggatcagttcaagtggagggtacatccaattggctgttcaaagagaacaagggagggtacatcccttgtggatctttgcttgtttgtggtgccattgtacttctcaatggtcaggttcttcagttggaaggaagagtcgcctccatgatgcctagaacgaaaggtttcttgaactacaacaattgtcttaccaaagtgttgaaggacggggttagcctcaggtttctgcgacctgtgcgactcctagaggtgagcattctcgcaccgaaggctgattactccattgttgttgtatttgtaccagttcttgttattgccatgaactcttgggtcttaggtgcacaagtgtctagaagagcaaagaggtggaatacctacaaaaggcactccaacgctcaaataagggttcgactcagagccattaatg

SEQ ID NO: 111142 - DNA, 540 bp, Glycine max
  Peptide Sequence Number=SeqID_227920
atgagtttgcccaggcaagctgatttcttcaccatgaagctatttggtggcccaggcgagctagaggctaacctgggcgagctagggtccaggaaaaccaaggaaaaaacccttttaccccccctttttttggtccttatagaaagaggtgaagatgatttctatgggatcattcaatacatatatgaggttgagtacaatactttaagctatcctaagaaagtggtggttatcctgaaaaagtggatgagcctaaagaacccctataacatgttcaagtataagaagaaatatatgactacaagaggttgtgacctgtcccgacccccatcctttcatggaaataaggggaaggagaaagcaaagccgaagaagccacgttatgtaattaaagtattctcacaaaaagatgcatcgagatcatctgttgaagccccatctgttacagcatccccatcaccatcctcagttgctgcaatcataccatctctagtttgttggacaagtgacctcaataacttaagaggaggggtgaattaa

SEQ ID NO: 111143 - DNA, 159 bp, Glycine max
  Peptide Sequence Number=SeqID_227921
atgaaaggccatgaaaatgatgccttcttccaatgctttaagtatttctacaagctttatgttgtgcaatgtccaatgtatgcaattactactctaaaaagaattattgttttcgttgaagttgccactattggtggtgatgtgcttgctagtgtctag

SEQ ID NO: 111144 - DNA, 150 bp, Glycine max
  Peptide Sequence Number=SeqID_227922
agactagccctcttgactctgcttgggaggaaagtattaggtctaggtgttggactgaagctgttggtggaaagaccaagggatgactatatggggctggagaccttgctcgtgattatcaaggtggagatagtagcctcacgcaattaa

SEQ ID NO: 111145 - DNA, 618 bp, Glycine max
  Peptide Sequence Number=SeqID_227923
atggagagggagatgataacaatgatagtagacatgctaccggtgttctactatgagaagatggtgggttacatgccttcaagctttgcagatttagtgtttgttggcgaaaggatcgaagtgggtgtgagaaaaggaaaatttgatcatgttgctttaatgaatagaaaacctgaggcaaatagagagaataagaaggagggagaaacccatgttgtgattgttgttcctacgtggccaaatttcccactagctcaacaatatcaatactcagccaatatcagtccttctcattactcaccactctaccagccaagaacacccaatcatccacaaaacccgtctactgcacatccgaggccaaacaccacccttaatacgggccaaacaccacccttaatacgaaccaaaacaccaaccagggaaggaattttccagaaaaaaagcctgtataattcaccccaatttcggtgtcgtatgctaacttactcctatatctactcaataatgcaatggttggctaaaattcgcggaggacaattgcttgtgaattctgacattgtcgagcgacactatgcatggggcaatttgaaggttgttgttagatgtctccaataa

SEQ ID NO: 111146 - DNA, 249 bp, Glycine max
  Peptide Sequence Number=SeqID_227924
atgaaggaaggatggttgaattttgaagaaaagcctatgcagatggataccgatcttttccaagttcaagccaattatgttgaacttgtccagattttgatggtaggggcttcaattggaatgtcaaaggttgaaacacctttatctgaagatgaagtcaatcaagctttggaagagttcgagaaagaagaggaatttttattcccacctgctggggatactttgttggagttcctaactaagaagtag

SEQ ID NO: 111147 - DNA, 591 bp, Glycine max
  Peptide Sequence Number=SeqID_227925
atgacccgttctgaagttgagcactttattttcttccttcattcttcatttggcccgtgcatttacttggtggtctatgtcgatgatattgtcattactggtgatgactctgatggcattaaggttgctcaatccatttcgggtattgtcatttcacaaaggaaatatgccctggacattctcacccagactggtatgcttgactgtcacccatgtgacactcatgtggatcccaacctcaagcttcttctaggtcacggagaaccactggaagacccggaaagatatcatacactcattagcagactcaattatgtcaatgttattagatcggacatcatatttgtcataaatgtggatcaccatcagacagatgatctacctctggctattgtgttcttgttggagctccaatttggagacacccagggcactaagcttatttgtgataatcatgccactcttcacaatgcttccaatttggtcttccatgaatggactaaacacatagagatagattttcattttgtgagagagagaaagtactctcaagtggcctcagatatcttaagaagggggggggggggttga

SEQ ID NO: 111148 - DNA, 180 bp, Glycine max
  Peptide Sequence Number=SeqID_227926
atgcctatttcaagaacctatttcgagaaaaaagctctggaggcagcaagaggagcagcttttgcaaagagacctagtgttgcacggccaaaggttcaggcacaaaacttaacttacccaccttcattgatacagctaatacagagcaatttgttagacaagtggcctcagatatcttaa

SEQ ID NO: 111149 - DNA, 186 bp, Glycine max
  Peptide Sequence Number=SeqID_227927
atggggtgttacagcgacaaccaacaacaatcttttctagaggcaaatgaaccaactcctatgtgccattgggaaatgggaagtttaggtgtaggaggcgttgttcgagggcctaatggagtaggagatgatgttaggggatcaatatgtggaaccactgatgtattttgtggccttcaccgataa

SEQ ID NO: 111150 - DNA, 171 bp, Glycine max
  Peptide Sequence Number=SeqID_227928
atggattccaaagctgttgtctacatttcacgacgctcaacggttgaaaagttcagaatcgtggttttactcggacagataggagtgtatgcggggaaaaaagagggttttgggaggaggagaagcaaaaatgaaattgagaagaagaggaagtgtagagactatcattag

SEQ ID NO: 111151 - DNA, 447 bp, Glycine max
  Peptide Sequence Number=SeqID_227929
atggggacaactagtttcaagcacaactccaacgacgtcatgagatccttttttcatgtgcttgctggtttatttggaaaccccataaatctaacgtaccaagttaaaaaggatccaagtccaatacatcgtcaacctcaaagattggtgacttggacttctcctgatggtgatatcatcaagctcaatgttgacggtagcagtcttggcaaccttaacatctctggtttcagaggtatcttgagcaactcgtgtggagaatggctcttgggtttcggtggtaattgtagttttacaacaaatatgcatgcagaacttgtgaatatttacaaaggcttacggagagcatgggaaacagattatcctccttggcataactatgcaaccatccttaacaagattaaagctcttattggtcatcacttatcaatgacaaacttctcttaa

SEQ ID NO: 111152 - DNA, 1155 bp, Glycine max
  Peptide Sequence Number=SeqID_227930
atggccatgaatagtgctgtgtcttctttcttaccttctttgagtgcttatgccaagggaaagaaggcgttgaatctgatagaacttcttgtgaataaactctttcttggtgaagcagttaatactaatggtcttaagattctacctttgcttataaatatacttttagaaccattgtttgggtatgcagagcctgatacagacatggaagattggctccagttggtgattgcctgttatcctttcagcacaataggtggtccacaaggattaaagccagcgagaagtatcagttctgatgagaggaaacttctttataaattattccagaagcaaaggcatgttgcttgtagatctgctatgttcaaccagcttacagtggtgcagatgcttctatcaaaacttatgattgtttcagtaggttattgctggaatgaattcaatgaagaagattgggactttctgctgtctaaccaaaggtgttggattcaatcagcagttgttatgatggaggatcattgtaaacttcaagaagctgaagacacagataattcaaatacatttaaatcaggaaaattggattctgttaaagatcggattctagagggagtccttcacctactattttgtactggtgtatctgaggctattgcaaatgcatgctacaaagaagctgcctcagttattgcatcatcaaggtttgcagcatattttgttctttcaaatgagcctgttttaagaattgctgtccttgaagataatgcttgtaactcaaacatatatgctgctagtgaagaggatatcagccgtcttgaggtgccaatggaagaaaaagttcatttgaaagaggaaatacctttcatggtagaaagggcaccttatgaggttcttgaaatggacttgcttgcacaccaacgatcattaccttcatcatcatctcagagggagagactgatccagtacatacaagactctgctactccagttattttggattgcctttttcagcatattcctgtagagatttccacagttcagattctaaagaagaaagatgcagagctttctggtggcttatcaagtggagctttagcagaagctataggaatttggaagcgcaatatcgataaagaaattgaaggtgttgaggagtga

SEQ ID NO: 111153 - DNA, 483 bp, Glycine max
  Peptide Sequence Number=SeqID_227931
atgtgtgagctggcaaactcgtcgcaaaaaccatggctagaggatcaagaggatcccaacaagagaggggtgatagacttgtacaacgccatactctccaatgacactgacacaatgcagcgccttctagctccagacctggagtggtggttccacggtccaccgtgtcaccgccaccacctcgttcccctcctcacgggctcctcgtcgaagcctttagtccctgatctcgtagttgggtttggatcagtgactattgctgaaggcttcgacgagagcaacttggtgtggtgggtacatgcatggaccaccactgacgaaggcatcatcacggaggttagagagtatgtcaacacttccgtcactgtcaccaagctcggtttgcatgtgaacaacgatgatgttgtttctgccacgtgtcagagtgtctggcagagcaagctctgcgatgagtctgttccgggactcattcttgccatctag

SEQ ID NO: 111154 - DNA, 372 bp, Glycine max
  Peptide Sequence Number=SeqID_227932
atggcagacaggtcacggcaggtgcgagctccactgcacagaatggacgttggtgagggaccgcgaggtttgagggagacctcgaggtttgagggagagaggggtttgagggagagtgaggtttcagggagagctcaaggtttgaggcaacaaaggttgagggagagaggggttagacctagggcagaacaatggtggagctacaaaagtgtttggtttaggagtttaattcgaaaggtcgaagtacgggccaggccccgaattcccttgacaactcccatccacatgcaacattatttgattgccagtagcttgaatatacgagacccatcttggtggcgtgcaagtcatattatccatgattttgattga

SEQ ID NO: 111155 - DNA, 174 bp, Glycine max
  Peptide Sequence Number=SeqID_227933
atgcaacagggacaaccatacatccccatagttgggtttcctgaccccaactacgggtcaaatacccctatcaaaataaaaggggctaaagggtgtttcgggttcttctacaaggaggtgtcatttcaaaatttcgatcacgctaatgtgactggggttcaacagaggtcatga

SEQ ID NO: 111156 - DNA, 276 bp, Glycine max
  Peptide Sequence Number=SeqID_227934
atgaaacaactaatgttggccttcagccagatgcagtcccaaggaattgtacatctagttgagccaaaggttgctccttctggtgcccatgtcattgataaacaggtactaccaaagggactgaagaagccagttgataggctggaatttgatgatgatcccatataccaaatgactttgatgatccccacaacttttcctcaagcccatgctggtgtcgtgggatgcaacttaatttgtttgggatctacaacgataatattccattgcatataa

SEQ ID NO: 111157 - DNA, 648 bp, Glycine max
  Peptide Sequence Number=SeqID_227935
atggaaaaccaacaaccagcgaacaagaccaccaatctcttgaaccacctcgtgaaggagctcctctacgccatcctcgaccacctcgacgaagacccttttgcccgaaagtccctctcccaatcctgcaagtccttccacgcgctcgaagccacgcaccgcaccaacctcaagccacgccgcctcgagttcctcccacgaaccctccaccgctaccgttcaatctcgcacctcgacctcacgctctgtccctgcgtcgacgataacacgttaaagtctctctccctcgcttggaactcttccctgcgttccattgacctctcgaagtcgaggctgttctcgcacgtggggctgtcggctctggccatgaactgcacgtgcctcgttgaggctgacttgtctaacaggcctgacctcactgacgtggccgccaaggcaatcgccgaggctgtgaacttggagaggctgtgcttgggacggtgtaagggaatcacggacttggggattgggtgcatagctgttaggtgtagtaagttgaggcacgttggattgaggtggtgcattcgggtaactgattttggggccggtttgattgctattaaatgcaaggagattcggagtttggatctttcttatttgccgctttga

SEQ ID NO: 111158 - DNA, 2454 bp, Glycine max
  Peptide Sequence Number=SeqID_227936
atggctctcgcggacataatcccaaattccaccttggccttaaacacgaccctatgggtttgcgagcacacaactaagtttcaacgtaattcaaagggaatattctacaacggcaaccctttaaactacacattatctgtggtctctctgcaggcctccttagtttgtttgtccactacatggttgcaatcctttcttatcccatttggggagaccaccttcattccacaagtgctgggagggttgctgacggggccatcaatactgggacaaattaaaaatcttgacaagttgctcttcgctccaaaacctttctacgtgtgtgaggcaatctctctttacgggaccttgttgttcctgttcttgatgggagtcaaaatagacatatctgtgctaatgagactgggaaaaaagaattgggccattggcttgtgttcttgtgtattgccactaatattaaccatatcttctgctttggttctacgccaaattctgaccccggaaacagacctctacaagaacctgttttacattgcagcattctcatcaactggttcctttcaagtcactgcaagtgttttggaagacttcaagctcctaaattcagaggttggtcgattggcaatctcttcatgtatgataaatgggttcatcagtgcggtgtggcagggtgtggtagtcgcacaccagcaaagagttatatggaaagtcgacataatcgcttccaaaatgatggcaatttctttgcttgctatggtgcttatcatcatatgtgttcttcgacctatcatgtcgtggatgatacgcaatacacccgaagggaagcccttgaaagagtcctacatagttgccatctaccttatgctgttaacgtgttcattgtatagtgaggtaagtggggagcactacattgttgggcctgtgcttcttggcctaacagtgccggatggcccaccacttggatcaggattggtagaaaggcttcaaaccttgacctcagcactgtttatgccattgttcttcttctctagtagtgccaaattcaagttgagtttagtcgatgcctatggctttgcaattgtgcagcctgtggccataattggcttctttgggaaactgctaggaaccatgttgccctcactctattgcaagatgtcactcaccgattctctctccttaggtctcatcatgagttcacaaggcatcacgcatttgcttcacttgcaaagtttgcaataccttcgaattatagatgatcgatcatatgctcaaatgtttatagctttaatatggttgacagcagcttccaatcccatagtgaaattcctgtatgacccatcaaagagttacttgtccttcaccaagaggaggaccattgagcatgctctttccaatgctgtacttcccttgatggcatgcatacactatgaagaagacaccctacccatgatcaattgtctagaaatgtcacactccacaattgagaatcccatttgcttccatgttctacacctcgttgagctaacaggcagaacaatcccagttttaatagatcatcaacacgagaacaaggccaataatacattgcactctaaacattcacaaagcataacaaatgtcttcaaatcatacgagcaacataacatgggcaacgtgatggtgaaactctacacatctatctcccctttcgagacaatgcacgatgagatatgcctgcaggccgcacaaaaaagagtttgcatgttgattgtgccatttcacaagcagtggagagatggtcaagttatggaatcagcacaccatgttagaacattgaacctccatttgcttcgaaccgcgccgtgctccgttgggatcctagttgaacgtggaaaattgactaggaacaaccctttaaattcggtgtccttctacagtgttggaattgtgtttatagaagggccagatgaccgtgaagccttggcatatgcaatgcgcatggctgatcactcgaatataaaggttacgttaattcggttaatggagccttgcatgaagagtagacaattgatgaatagagaccctgatggtgacttgattcacaagtttaaggttgactacatccaaatcaaacgccatgattacagagaggaagtcttgagagacagtgtggaaatggtcagtttcataaagtcactcgaaggttgctttgatttgattttggcgggtagatgtcacgaaaacgactcttcattgtttagtggatttaatgagtggaatgagtacccagaacttggttctgtatcagacatgttagtgtcttcagattctactttcgatggatccgtgttagtagttcaacaaaatagggtaggggttggtcatcatgatttgcatctagacaattccttcgctgccaagcacgaacccgcaaccattgtagatgtgcaccctaaggttatggcctttgtttaa

SEQ ID NO: 111159 - DNA, 504 bp, Glycine max
  Peptide Sequence Number=SeqID_227937
atgggtaacagcttaaggtgttgtttggcttgcgttcttccgtgtggagccctagacttgatccgcatagtgcacttgaacgggtacgtggaagaaatcacgcgtccaatcacggcgggggaagttcttaaagcgaatccaaaccatgtcttgagcaaaccgacctcccaaggcgtggttcgccggattctgatcctctcaccagataccgaactcaagagagggagcatatacttcttgatcccgacagcatcgctgccggaaaaaaagaaaagacgttgcagtgacgatggtggtaatgataatgatcatcgtaataagaatgaccttgtcaaagtgagaagaaatgctcacggcgggatcaccggagccgtcgcggcggattgtggcagcctcggttggagagcatctcagaagactagtttctttttattccggcagccggcgccggaatctggcttgccggtggggactgggaaccgaagatggttcaacaacacttga

SEQ ID NO: 111160 - DNA, 177 bp, Glycine max
  Peptide Sequence Number=SeqID_227938
atgttttttggtgaaggcattgcacgcaatggcgacaagggtgaatcgtgttcgttcaagagtgtaatgaattggaagctgatgagaagagattcgatgctggaaggagatggattcaagaagttcaccttgctaaggttgatggtggtggtgctcataggtttggatggtgtttga

SEQ ID NO: 111161 - DNA, 1227 bp, Glycine max
  Peptide Sequence Number=SeqID_227939
atgccttgtgctgctgctcactcaattaattgtactcaggttactactgatctagcaaaatgtctgcaaagtttttcaagactgcaatcggttaaacttgatagttgtttgggtacaaagtcaggattaaaagccatcggtaatttgggtgcctcactcaaagaactgaacttaagtaaatgtgttggagtcactgatgagaatctcccgttccttgtgcaaccacacaaagatctagagaagttagacataacatgctgtcacacgataacacatgcatccatatccagcctaacaaattcatgtttaaggcttacttcccttagaatggagtcttgtagcttggtcagcagagagggtttcttgtttattggacggtgtcaactgttggaagaattagatgtcacagatactgaaattgatgatcaagggcttcagtcaatctcaagatgtaccaaactttctagtctgaagttgggcatatgttcgatgataactgataatggacttaagcatattgcaagcagttgttcaaagctcaaacaacttgatctctataggagctcaagaataactgatgagggaattgttgcaattgccctcggttgtccttcacttgaggttgttaacattgcttataacagcaacaccacggatacatcattagagtttctttcaaaatgccagaaactaagaactctagaaatccgagggtgccctcgtatttcaccaaagggtctctcaaatattgttgccaggtgtaggtatcttgagatgctggacataaagaagtgtcacaaaattaatgatactggaatgattcagttggctcaacattctcaaaacctaaaacacataaagctgtcatattgctcagtaacagatgtggggctcattgcacttgctagcataagctgcttgcagcatatatccatttttcatgtggagggtttaacttcaaatggcctagcagctttccttttggcttgtcaaactttgactaaagtgaaattacatgcatgctttgagtcattaatacctcaacaaattctaaaatacatggaagctcgtggctgtgcgcttttttggagggataaaacgtttgaagcttccggcatatctaactacaagctgtgcacatttgtgacaggtgggactagatcgaaaaagatggaagctacatgctggaaggagtttgaaagttccataagcagaaaccaatgctag

SEQ ID NO: 111162 - DNA, 1602 bp, Glycine max
  Peptide Sequence Number=SeqID_227940
atggctcatgcgaacctaagctcgaatcctaccttgtccttaaacacgactcaatacatttgcgagcacgcaacaaagtttcaaccttattcaaaaggaatattctacagcgataaccctttgaaccacacgctaacaattatctctatgcaggcctccttagtctgtttgtcgtccacatggttgcaatttcttcttgtcccatttggggagactaccttcattccacaagtgctggcagggatgctaacgggaccatcaatacttggacaaattaaaaaccttaaagatttgttcttcaccccaaaacctttctacatatgcgagacaatctctctttacgggaccatgattttcctattcttgatggcagtcaaagtagatgtatctatggtaatgagaatggggaagaagatttgggtcattggtgtgtgttcttgtgtcttgccactcctatttaccatatgtgctgctttgattctacgacaaattttgtccccgaaaaccgaactctacaagtccttatttttcattgcggcattctcatcaactggctcctttcaagtcaccgcaagtgttttggaagacttcaagctcctaaattcagaggttggtcgattggcaatcccttcatctatgttgattggggagcactacatagttgggcctatgattttgggcttagcagtgccagaaggcccaccacttggatcaacattggtagaaaggttagataccttgacctcaacagtgcttatgccattattcttcttctccagtagtgccagattcaatttccatctagtcgatttctatggtttggcaattgtgcaaccagtggccatacttggtttctttgggaagctgctaggagccatgttaccctcactctattgcaagttgccactcaccgatgctctcatcttaggtctcatcatgagttcccaaggcctcactcagttgcttcacttgcaaagtttacaactctttcatattatagatgatcgaacatacgctcaaatgttgatagctttaatatggttgacagcagcttccaatcccgtagtgagatttctgtatgacccatctaaaagttacttgtccttaactagtaggaagaccattgagcatgctcctcccaataccgtgcttcccttgatggcatgcatacactcggaagaaaacaccctgcctatgatgaattttctagaaatgtcaaactccacaaatgagaaccccatttacttccatgttctacacctccttgagctaaaaggcagaacaatcccagttttaatagatcatcaacccaacaacaaggatactttgcattctaaagattcacagagcataataaatgccttcaaatcatacgagcaacagaacaagggcaacgtgatggtgacactctacacatccatttccccttatgagacaatgcacaatgagatatgcatgcaggccgcacaaaaaagagtgtgcatgttgattgtgccatttcacaggcaatggagagcaaatcaggccatggaatcaacattcgccattagagcattgaaccgccatttgctccgaacagcaccatgctccgtggaatcctag

SEQ ID NO: 111163 - DNA, 204 bp, Glycine max
  Peptide Sequence Number=SeqID_227941
atggctacaaaatctacaatgctttcaacaaatatgaagggtgtgaatcacattgttaacatggctaagagcccctacacttggattaaggaacacaaaaacaggatattggctctgccttccatgtcacaaaggcatattatgatgcctgttctcttgatttatgttcttaagagtcttgatagtataattttggctatgtaa

SEQ ID NO: 111164 - DNA, 873 bp, Glycine max
  Peptide Sequence Number=SeqID_227942
atgactaacttagggaaattgtcatattttcttgggttagaattcttgtggactgaatatgggattgtcatgcatcaaaggaaatatgctggtgaaattctgaagagatttcggatggaggattgcaatgttgcaatcacaccgacagaaacaaaccagaagcttgaagacaagcctgaggaagaaggtgttgatccaactggttacaaacagttggtaggctcactgagatacctctgcaatagcagaccagatatctgttatgccgtaggcgtgctgagtaaattcatgaataggccaaagaaatctcatttcttggctgccaagagggttctaaggtatgtgaagggaactatgcagtatggtgtgatgtttccaagtagtgttgatggtgctgagatgaaattgattggttactcagatgctgattggtgtggggaccggacagataggagaagcacatctggttacttgttcaaatttggtggagctgctgtgtcttggagctcaaagaaacaactagttactgctctctcaagctgtgaggcagagtatatatctggttcctttgctgcttgtcaagcaatttggttgaaatcactgcttgatgagttgaaatgtgaagtacagatgccactgtcattactgatagataataaatcagcaattagtcttgctaaaaacccagtctcacatgggcgtagcaagcacatcgaaacaaggtttcatttcatcagagaacaagtgaataatggagttctgaaattgatttactgtcccactgaagatcagttagcagacctgctgaccaaggctgttaaaccagacagattcataaagctaagggaagagattggagtcatttgtttttga

SEQ ID NO: 111165 - DNA, 890 bp, Glycine max
  Peptide Sequence Number=SeqID_227943
tacagaaaaagctatggagaattgttggatttttgtcaagtgtgattggactaatctgttacgcgttgagttcctctttcaaccacctatttggagagtggaacttcttgaagatcatcctttacgcagtgataagtttctctatcagcagcatcatgttacttttgaaaaaatggaaactttccaagagtttcatgctaaaagctcatgtgggtgttctggttttgttgatcacttctgtgtactcttttgtatccgacaaagctgtgaatggaaaaccagacatgttaagtttgatttcgtgttttgcctttgctttcatgtctctgtgtctgtcaaagcagattgaccttgggtttggagcagatctcctcaatttcttccttggatgcctaactgttcaactaatgcacatccatttgatgctctctattgttgcagccatattttgctattgtttcatgttttttcgttccaagttggattctcaatcacagattggaactgtagaagttgaagaccatgtaaacatagaaattgatgctgaagatggaaaaagagagtttgatgacaacagaagtgacttccaagctaatcatagccaccaacaagttccgttattaagaatggtgggtgatgggtacaattggagaaaatatgaagataaagtagtgaaaggaagtgcaaaccagttaagttactacaaatgcacacaacccacttgctatgtgaagaaaaaagttgagagaactatagagggggaaattgttgatatacactaccaggagcctgtcacctttccagatcaatcatttgcctctcagggcaatggagaattggattatcatgtgcagcaacagagaactcctcaatatccaaatgaaatatga

SEQ ID NO: 111166 - DNA, 456 bp, Glycine max
  Peptide Sequence Number=SeqID_227944
atggcttatacaatctacttcatcattttgatgcacttttgcacctttgttgttgtcacaacaagcattagcaatgacctgatgagaaccaagttcttatccattctagtcttcggcgattcaacggtagacacaggcaataacaactacatcaacactttagccaagggaaatcatttgccttatggtaaggatttccctggtcacatgcctactggtagattttgtaatggaaaattggttcctgacttcattgccactgtattgaacctcaaagacactgtccctcctttccttgatccaaatctatcagatgaagaacttctaataggtgttagcttcgcgtctgggggatcaggttttgatgatttcactacggctttaaccggtgccatagcagtagcaaattggatacttcaaagtagggttcgcttaaagctcaagcaaggactttag

SEQ ID NO: 111167 - DNA, 1986 bp, Glycine max
  Peptide Sequence Number=SeqID_227945
atggctgactcaggtagcggtatggagatttgttggttttgttcaactattgttggacttgtttgttacggtctcagctcctccttcaactacctatttggagagtggagcttgttgaagatctttctttacagtggttttagtctcttcatctgccttgggaatctgtttgcaaaggtatgtcgaccctcaacctcaacgagtctccgattcaaagctcattcatcattcttggttttgaccatcacatctgtgtattcctattttgctgacaaagctatgaatggaaaaccagatattaaatttgcattagctgttgttggagtaggattcagctattcccttattattcttcgttcctctttagacaccgcattgcaccataatcttggggcccaagttgatcaactggctagtactactgatacttctgcagtagtgcttttcgttgatcaactgggccgtactgatattgatgtagcagcagtgcaagatatcgttgtcgaagggcaacgggataatgcacaacgtgataatgctagtatgatgcaacaactcatggcttgcattgaagttcttaggcagggcaattcgaatctcaccaacatgcttttggagcatacaaaagaatactttgatgataaatcagaactagctggtgtggaccataactttgtgattgatgcgctaccatctggaaaaatcaacgaccttgaggaaaccataaagctcatggtggacgatggacttgagaaagagtgctgcgatgtgtactgtaattggcggagggaaagcttagagcagtgcataataaatttattacggttacaagggatcaacatcgaggaaaaacttgaacagagggaatttcaatattacattttaagatggattaaagctgtcaatgttgctcataggatactatttcccagtgagcgacgactctgtgattgcatcttctcgaggttctcttctgttgctgctctttgtttcaatgaggtttgtaggggagccctgattcaattgctcaattttgctgaagctgttgcaagtggaagcccttcagagtggcgtttgtccaaaatccttgacatgtttgagacattgcgtgacctgattcctgagtttcaatcgttgtttcctgagtcaatggtaaaggaagtaatgaaagtccatgacaaattaggtgaggcaagcagggtcattttcatgaacatggaaaatgtgattttccatatcccagagaccaaggtaattgccccggcagatggcagggttcacctaatgaccaaacacgtcattcgctacctcgtttttactagtcgggcacaaaagatcttggagcaaattttagaacaataccccaagtttgctaatgaagtggcaaaatctaattcagtttctgatcagattgatcaagtaattaagcgattggagacagaacttgtcacagtgtccaaaaactacgacaagcctgctttgcgttactttttcttgatgaataattggaggtgtgtagagctagaggcaattaagttgagattaaaccttggttgtttccataaagacacaacaaaagtgcaacaaaacctcgaactttatcaaagtagttcttggaatatggtgctaaactttttgaagctagagaacaacgagctagtggagcctaatgcgaacgcagagtcactgaaaggcagcctcaatttgttcaacatgcacttcaaggatatatgtagcactcaatctagatggcttgcctttgataagcagctaagtgaaaaaataataatgtcactccaacacatcttgttgccagcatatgggaacttcattgagaagttgcaagatgttcttggtatacatgcttctgagtatattaaatatggattgtttgatattaaagaccaactcaaccatttgtttcttggaagcatgccaatgaatcagtatctgaaagacaaggaaaaattgttaaagcttgcataa

SEQ ID NO: 111168 - DNA, 2349 bp, Glycine max
  Peptide Sequence Number=SeqID_227946
atggcgagatggctgaagaaggaagcagtatggagatatgtggggttcgtttcaactattcttggactactctgttatggtctcagctcctccttcaactctctcttcggagagtggagcttgttgaagatctttctttacagtgtttttagtctcttcatctgcctttggagtctttttccaaaggtatggcaatactcaactagtctccgactcaaagctcatttagcattcttggttttgaccattacatctgtgtattcctattttgcggataaagttgtgaatcgaaaaccagatgcatatagcttgatttcttctgctgcctttgctatcgtgtccctcagcctgtcaaggcaaactgagtgtggatttgaagtggattttctttattttttcctgggatgtctaatagtacaactcttgaagattaaattggcattagttattgttggagtaggtttcagctatgcccttattattcttcgttcctctttatataccacgccataccagaatcttggagtccaggatgagcattcagtagtgattgatgtcaattcgctacgtacagataatgctagtatcatgccacaactcatgacttgtatcagggcacttccgcagggcaattcaaatgtcaccaacatgctttctaagcttgtgaaggaataccttgaagataattccaaaccagtagtaattgacagtaactttgtgattgatgcgctaccttggggaaaaatcaatgaccttcgcaaaactataaagctggtaatcggcgttgggtttgcacaggagtgctacgaggtgtactgtaattggcggagggaaagcttaaaggagtgcttaataaatttattaggcttgccagagatcaatgtggagaaaagtagattgttggcatttgaagattacattcttagaagacgtattaaggctatccagacctcgaagcataatggagcgggaacatcttcactttctctgcagattgatcgaataatgaagcatttggagagaaaatgggtggcagagagcaaacatttgggagaaagacggtactttttcatgatgaataattggaggttggtggagctatgtgccgaaaagtcggggttagacgttgattgtttcaaaaaatacacagcaaaaattcaacaaaacctcaaactttatcaaagaagctcttggaatgtggtgctagacttgttgaagctagagaacgatgatcggtttgtggagcctaatgctaacgcagagtctatgaaagacaagctcaaattgttcaacaaccactttaaggatctatgtagcattcaatctagatgggttgcctttgatatgcagctaagggaacaaataatgaagtcgctagaaaacattttgttgccagcatatggaaacttcattgggaggttccaagatattcttgataccacatcataccagaatcttggagtccaggatgagcattcagtagtgattgatgtcaattcgctacgtacagataatgctagtatcatgccacaactcaggacttgtatcagggcacttcagcagggcaattcaaatgtcaccaacatgcttttggagcatgtgaaggaataccttcaagataattctaatctagcagttgatgatgggcgtgtaacatgcgtaaagtctgaagaagttttggagcgaaattctgttgagaatgaaggacacgtgtcagacgatatacatcacatggaagtcaggaaaggcaacggtgatcgtcgtgagttgtactaccattattctgtgaagattgttcgtgccttgcttctgttatttgtccaattcttttccttaacagattctgctatagtgcaagagataaacgtcaagcagaaatgggaagagaaacaattagaagagtacatcattagaagatggattaaagctcttaagtttagaataggagttttaccttgtcctctgttcctatcacaagtcgctcttaggatacaatttcccaatgaacaacgacttagtgatggcgtcttctctgggttttcttctatcgctgatctatgtttcacagaggtttgtaggggagccacgattcaattgctgaaatgtgttgatgaggttgtgagtgagagctctccgaagtggccattgtcaaaaatgcttgacatgcttcagacattgcgtggcctaattcctgagtttcaatcattgtttccagagtcaatggtaaaagaagtaatgacagtccaccacaaattaggagaaacatgcagggtcattttcatgaaaatggaagataatatattttgtaacccatctgtgaagataatttgttcggccagatgccactga

SEQ ID NO: 111169 - DNA, 372 bp, Glycine max
  Peptide Sequence Number=SeqID_227947
atgctccaaccatatgagatcagcataggcttaaaggagcactcaaacccggtgacccccaaggcctacactccgaagagtccgtcagggcctctccctcctgattcagacagctctgggtttctgcgggaaagaaaaaggctacaatgcgaagggtttttctctcagttcagacatgatatcaaaattcccaacggtgagaatgcacggaattgtgttgcgaacatgatactcaaatttcacaacgatccaacggtgaacgggttcgagatcgtcatttttctgagactggtttggtgggttgcgggaaaaagaaagggttttgagaggagaaggggaaaaacggaaatgaggccaaaaggaggcagctga

SEQ ID NO: 111170 - DNA, 3294 bp, Glycine max
  Peptide Sequence Number=SeqID_227948
atgaccggtccacacgattcatcatcacccaacctggaatccatcctcacccgtctcacagatactatgcagaccatgaacctcaaacttgacgaactgcttcatcgtccgacctctttcccttccccgcaacctgaaccacctccgccctcccctgttcctgccacacaacataaaatgaaattagaggttcccagatttgatggaacagaacctttaggttggatattcaaaatcaatcagtatttcgaatatcatggaacccctgagcgagaccatctcaccatagcttctttttatatggagggccgggcacttgcttggttccaatggatgtcaagcaatgcccagtttacctcatggcctggattcttacaagccctacaaaccagatttgctctgtcacaatacgaagacccaacaggtgttttatttaagttgacacagaaggggtcagtcaatcagtacctttcggaattcgaggacctcgcgaacagggtcatcggactgccatctccgttcctgctgagctgcttcatttccggtcttaacccggagattcgccgggaagtccaagctcatcagcccctcaccctggtccaggccgcgggcctcgcgaagcttcaggaagaaaagatttccgacaaccgccttccctcacgccctcgcgcaccacctccgcaacctaacccccttcgtgttctccctgcttccgctgaacctcgtcaaacccttccccctttgcttccggcccctccacgccctaccccgcctattatgaaacgtctcacgccggaggagctaacctcacgccgtgagcgtgggttatgcttcacctgcgatgaacgttaccatcgcggccatcgctgcgccgctagggctttcctcttagtgactgaagacgaggacccctcagactctaaaatagacccccctgacccgccacccgacccgcctcatgaacccgacccatttcaggcccaaataagccttaattcattttcgggccacctggcacctgaggctttgcgtatggtgggacttatggctgaccaccgtgtggtgctgctcattgacggcggcagcacccacaacttcgtgcagcccgtattagtgacccaattgggccttccctgccgccgtatttcaccattgcgcgtgatggttggcaatggccaacacttggattgcgcttgcgtctgcgaaggtgtttccatcatgattcaggacgtcatgttcaccatggacttacacgtactacctattgtcggcgccaacgtggtcttgggagtccagtggctcaagaccctgggccccattctcactgactacggctctctgcggatgcaattcttttatcaaaatcagttaatagaattaaaaggggagaacacgaatgactccgggttcatcactcaccatcaactccggcgactttgccggacacagacccaagcctcttatttccgtattgcgctcatcaccgacaaccctgaacctccaccaccacacaccttaacccccgaaatccaagccttacttacacgtttctcgaccctatttcagaacccctccggcttacctcctaaccgtgacaccgaccaccatatccacctccttccccacaccaatcccgtgaatgtccatccgtatagatatccccattaccagaagaaggagatcgagcagcaagtcaatgatatgttacaaaaaggactcatcagaccaagtacaagtcctttttcatcccccgttcttctcgtccgcaagacagacggctcttggagattctgcgttgattacagagcccttaacgccgtcacggttcgtgaccggtttccgattccgacaattgatgaattgttggacgaattgggcggtgctcagtacttctctaagcttgatttacttcaaggatatcaccaaatacgcatgcacgaccccgatatacctaagactgctttcagaacccaccatggacattacgaattcaaagtaatgccatttgggctctgcaatgcaccaagttcctttcaggccaccatgaatagcatattccgacagcacctccgccgctttatcatcgttttcttcgatgatatcttggtgtacagcacttcattcgaggctcatcttcaccatctgacaattactttccagctcctgcttgaccataattttgttcttaaactttctaaatgttcctttgcgcagaaacaggttgaatatcttggccatgttgtgtctcataagggggttgaaccagtagcctctaaaattgaagctattcgacaatggccgacaccacgctcggctaaagctgtcaagagttttctcggacttgccgggttttatcggcgatttatccgccactatgccaccatcgccgcccctttagttcgactaactacgacggacgcttttgcctggaccccccagactcaagacgcttttgatcagttgaagacggccctgtccaccgctccggtcttagctctcccggacttcacgtccccattcactgtggagactgacgcttccggtagtggcatgggagccgtgctcacccagaaaggccaccctgtggcgtttttcagcaaaccgtttcctcccaaactcgcagtggcttccacctatgtacgtgagctagttgccataaccaccgcggtcaaacggtggcggcaatacctgttaggacaacgtttcatcatcatcatggaccaccgcagtctcaaggaattactcacccaagtaattcaaactcccgagcaacataagtacttggctcgacttttgggatatgattatgtgattcagttccgttcaggacaccaaaacaaggtcgccgatgccttgtcccgacaacgggaaccaataccctctcaatgcttaattctttccgttccttctctgaccttcctgaatgaattacgacgccaattagaagctcaccctgagttctgccgccggaaacaggaaattagggacacaccttataatcatcctgcattctccattacccaggatttgattttaacaggagggcgcatttggcttcctagggacctcccaatcacggccacattacttcaggaatatcatactactccaaccgggggtcatgctggagtcacaaagacactggcccgaatttccgagaattttacttggtctggtctcagggaggacgtcaagcaattcgtggccaactgctttgattgccaagtcactaaataccagacacaaagggttgccgggctactatgtcccttaccggttccccatcggccctag

SEQ ID NO: 111171 - DNA, 315 bp, Glycine max
  Peptide Sequence Number=SeqID_227949
atggctcagccaatcatgcgctcagccagagaaggatggctcagccaattaggcaacatttggcttagcgcgccttttcttcacttagccaatcaagcgctcagccagagaaggatggctcagcgaactgcaaaaatcaaacttcaccaaacttgcttattttacctgaaattgaaatggaaaggattgcctagcaagtctttcaagcatctgatccatgaaaggaagtggataatggtccttccaggtggcatcattcagcttccgatagtcaatgtacattctccacccggtgacaatccttgtggatattaa

SEQ ID NO: 111172 - DNA, 610 bp, Glycine max
  Peptide Sequence Number=SeqID_227950
atgaacaaagacatcatttccggcaagtggtcgcagctgaagggcaaggcccaggccaagtggggcgatctgaccaacgacgatttcgatgtggccgagggcaatgccgagtatctggccggtcgcctgcaggaacgttatggctgggccaaggaccgcgccgagaaggaagtccgtgagttccaggacagcgtcagcaaggactacccggactacaagatcagcgcgccggcgggtccggcacgtagcggttggggaaggcctgcggctcgcgcggcaggcgcgagggtgaatccaccaggatgccgcgtgcgcgcaggttgcgggcgctgtcgtagcgcagctgcaggacttgggcggggctgcggctggcgcgttcgaagtcggtatcgcgtaccgacgactgttcgcgagcgccgtggccggtgcccagcgcaggggcctgcgacttgctggcatagccctcgatgcggctggcactggcgtcggccgccgcttcggccgtcggggccggtgctggcaggctacggcgcagatcggatccggacgccagcggcgcgcttcctcgaacacggccacgcccaccacgccgatgttgtccgggcggccg

SEQ ID NO: 111173 - DNA, 366 bp, Glycine max
  Peptide Sequence Number=SeqID_227951
atggttcactacgcttcgacagcatgcagtgaaaagcacgcacaaaagaaggccggggatgtccccggccctttctctttccgttccgcgccgggcttacttgcccttggcggcgtcctcaaccttttcaccggccttctgcacgtccttgccagcaccggccacggtgttgcaaccggccagcagggccaccgagaacatcgacaacagcatcagggcaactacgcgcttcatgggcttctccttgggttcgccgctataccgcttcattcgcggatgggattctttcgctcggcgggagggcaccaatgcccactgccgccgcgtgaagtgcaatctggcggcaggggcgtggagcgggcgtga

SEQ ID NO: 111174 - DNA, 510 bp, Glycine max
  Peptide Sequence Number=SeqID_227952
atgttagatagacatagaaaaagtcttgagaggggaagtaaagaaaacaagagagagaatgttgataactatcttttgcaggatatcaatggtacctatccaagaaggtctcataaccaaggcaccttgttaagggatgcttcattgggaagagctaaccacatagttgctcttgttcctagtaccctattgtattgtattctaccttggaataataatgtcattgatcatgaagaagaaacccataaagtttacatgctaggtattggagccttaaattcaagagcaaatatcattatagaaggagagaatgatagagatcgaggaaggcccccaaaaagagatgatagacataggaagaaggatcccttgattgggctaaaagaacttgagaaagggagagctcaaagggatggccatgtggttgggcttgaaataccaatgaaagcaagagtaaagagactaaaggagaatttaaaggttatcaacactttacatggtcaagcctaa

SEQ ID NO: 111175 - DNA, 219 bp, Glycine max
  Peptide Sequence Number=SeqID_227953
atgcattgtgttcccgtgtcctttatcatgaggttcttcatagtcatttacttattcatctacttccacaaacataagggagaccagtcagggtcatgctgttttgcgagaatgcttcaaccatatgggatcaacatagacttaaaggagcactcaaaccgggtgtatttaccccaaggcctacactccgaagagtccgtcaaggcctctccctcctga

SEQ ID NO: 111176 - DNA, 768 bp, Glycine max
  Peptide Sequence Number=SeqID_227954
atggagtggatcacgcaccaactacaagaaaggaggatgagacgacgtatgaggataagaaaaactagacaagcttatggtaaaaatgaagacaacgaggactggatcagtgagagagaagttgatggtgaaactgaggacgatggggacatgatcagtgagaggaaaagaaacattagagaagttgatgctgaaaatgaagacaacggagataggatcggtaaaaggaaaagaaacattagagaagttgatgctgaaaatgaacacaatggagacagaatcagtgagaggaaaaaaaacatcgctagagaagttgatggtgaaaatgaagaccacaggccagacaggatcagtgccttgcctgatagccttctgttccacatgataaattttatggacacaaaatctgctgttcaaacttgtgtcctgtctaaaagatggaacgacctttccaaatgtctcactaatctcacatttaattctgatctcccaagcgaaggcctggatagaagttttaagaaatttgagtcttgggttttgtctagtcgcgatgactcatatcccctacttaatcttaccattgagagttggatcgatgctgatgttcaagatagggtcataaaatatgctctgttgcacaatgtccagaagttgaaaatgaatataaattcaacaacctatagacccaattttaagtccctccctttaatctttcgcagtcagtctttgacatctcttgagctttccaataagttgagcccttctagg

SEQ ID NO: 111177 - DNA, 997 bp, Glycine max
  Peptide Sequence Number=SeqID_227955
atgacttctttgaccatccagatggcgagatggctgaagaaggaagcactatggagatatgtggggttcgtttcaactattcttggactactctgttatggtctcagctcctccttcaactctctcttcggagagtggagcttgttgaagatctttctttacagtatttttagtctcttcatctgcctttggagtctctttccaaaggtatggcaacactcaactaatctccgattcaaagctcatttagcattcttggttttgaccattacatctgtgtattcctattttgcggataaagttgtgaatggaaaaccagatgcatatagcttgatttcttctgctgcctttgctatcgtgtccctcagcctgtcaaggcaaactgagtgtggatttgaagtggattttttttattttttcctgggatgtctaatagtacaactcttgaagattaaattggcattagttattgttggagtaggttttagctatgcccttattattcttcgttcctctttatataccatgccataccagaatcttggagtccaagatgagcattcactagtgattgatgtaaattcgctacgtacagataatgctactatgatgccacaactcatgacttgtatcagggcacttcagcagggcaattcaaatgtcaccaacatgctttctaagcttgtgaaggaataccttgaagataattccaaaccagtagtaattgaccgtaactttgtgattgatgcgctaccttcgggaaaaatcaatgaccttcgcaaaaatataaagctggtaatgggcgttgggtttgcaaaggagtgctacgaggtgtactgtaactggaggagggaaagcttaaaggagtgcttaataaatttattaggcttgccagagattaatgtggaggagaaaagtagattgttggaatttgaaaattacattcttagaagacgtattgaggctatccaggtcgctcttggaacactaattccca

SEQ ID NO: 111178 - DNA, 438 bp, Glycine max
  Peptide Sequence Number=SeqID_227956
atggaaaccatatccaagcgatttgaagagctggatgtttgtggcaaagttactctaaagagtaaagtccaggaaattgcctatcctgatctaaaatctgtgtcctcctccagaaaagtcaaacgtagtgcatcatcttctgaccaagccattccaagaaggattatgccgatgttggatcaatttcattcgttcattcatgattccattgaaaacattgtcaatgtgatagctgacggtaactgtggatatcgcgtaattgctgcattattaggtatgggtgaagattcatggttgttggtgcacaaccattttcttaaagaacttgccaaatggtctgatgagtatatcaacctttttggtggcatagacaaatttgaggaattaaagaggtccctacttgttgatagattatccatagttactatggataagtga

SEQ ID NO: 111179 - DNA, 210 bp, Glycine max
  Peptide Sequence Number=SeqID_227957
atggcacgacggtggtggacagttcctcgaatccggcaatggaagcatcgaacagcggaggcgtggcacaaacgaaacaccaatgaaaccgcaccttcgtcttcttccttcttcatttctccttctctccgtgccaccattgttcatgccgcctgtcctgccactagtgacagctaccaagacagtcgtattcgtcttctccttcggtaa

SEQ ID NO: 111180 - DNA, 297 bp, Glycine max
  Peptide Sequence Number=SeqID_227958
atgatttttgaacgtcctgagctaaaattttcctcccatggaagaaaggttgagaaatttggcaatgattggggacttatgtctgctttcatggagaggcaacataaggaaaccaatagtttccatctgtcgataggagaggtgactatcaccttggatgatgtggcgtcatttctacattttcccattacaggcacgttccatagctttaagccttttcatgtggacaatgacgtcttcctcttagtcgaatttcttgaagtgagtactgaagaggcaagagttgagacagtataa

SEQ ID NO: 111181 - DNA, 231 bp, Glycine max
  Peptide Sequence Number=SeqID_227959
atgagtatgcaagttatcaaccagctaggagcaccggaagaagcacagcaggaacagatggccatatcttccaagtctgtgttttttataccaatcttagatggaatattgaattattttaaagtgttggattcttgggggcagatttgggatgttctgtcaaatgaagaagttgtggacattgtagcatctgcttcacagtctactgctgctagagcagtggttgagtga

SEQ ID NO: 111182 - DNA, 417 bp, Glycine max
  Peptide Sequence Number=SeqID_227960
atgaattctttgaccacacaaatcgtgacatggctgaagcagctcctccttcagctgtctatttggagaatggagcatgttgaagatcttcatcttcctttggagtctgtttccaaagacaccacatcatacgagaatcttcgagtccaagatgattctgtagtgattgatgtcaacaatgctaggatgatgcaacaactaatgacttgtatcagtgcgcttcagcgtggaaactcaaatctcaccaacatactttttgagtaccttgatgataaatctgaagtagcaggtattgaccataacccatttgttaaggtaattgttcggccagatgtcaaggagaatccaatgacctgttgtgtcatggactacttggagctaattttagaacaattcgtatgtttgctgatagaacag

SEQ ID NO: 111183 - DNA, 1650 bp, Glycine max
  Peptide Sequence Number=SeqID_227961
atgttgctgcagatatctccgagtttgaggcatgtcaccgtgcttccgggaaaagggttgaaggagtttatcaaagtgaaggttgcatcaaggaagctttcttatcggatgctcttctattcactcttgttcttcacattccttcttaggtttgtgtttgtcttgacagctgtggataacattgatggagaaaacaagtgctcttccttaggttgcctgggaaaaaaattgaggccaaagattttgggaagaagtctagaatcaaatgtaatctccttaactcttataatatctgtctgcgtgagaatccatatggtcccagaagtgatatacggaatattagatcaaccccttggcaaagatgaactagagggaaggtctgatatacctcagacattagaagagttcatgacccaaatgaaggaaggtggatatgatgccaagacatttgcaattaaactaagagaaatggtaacccttatggaacaaagaacaagggaagcaatagttcaagaatatttatatcgtcatgtagcctcaagcggcatacccaaacagcttcactgccttgccttaaggctggccaacgagcacaccaacaatgccgcggcacgccttcagctaccctctgcagaacttgtccctgccctggttgacaacaactactttcactttgtcctggcctcagacaatgttcttgccgcctctgtggttgcaacatcgcttgttcgcaacagtttgcgacctcagagggttgttctgcacataattacagatagaaagacttactaccccatgcaggcttggttctccttgcaccctttatcacctgccataattgaggtcaaggcattgcaccactttgattggtttacaaaagggaaggtgcctgtgcttgaagcaatggaaaaagatcaaaatgttcgatcacattttagaggggggtcatcagctatcgttgcaaatactactgagaagccgaaagtaattgctgcaaagctgcaagcacttagtcctaagtataattcagtaatgaatcacattcggatacatcttccagagttgttctcaagtcttaacaaggtggtcttcctcgatgatgacactgtggtacaaactgatctttcacctctgtgggacattgacttaaatggaaaagttaatggagcagtagaaacatgcagtggagaagataagttggtgatgtcaaagaggttgacaagctatttgaacttctcccaccctttaatatcccaaaattttgatcccaatgaatgtgcttgggcttatggcatgaacatttttgaccttgatgcttggaggaagaccaatataagctctacataccatcattgggttgagcagaatataaaatcagacctcagtttgtggcagctaggaacattaccccctggattaatagcattccatggtcatgtccacactattgatcctttctggcacatgttgggattgggatatcaggaaaatacaagttttgctgatgctgagactgctggtgtcatccatttcaatggcagggcaaagccatggctagatatagcttttccccatctaaagccattgtggaccaagtacattgacttttcagattacttcataaagagttgtcacattagggcattgtaa

SEQ ID NO: 111184 - DNA, 1536 bp, Glycine max
  Peptide Sequence Number=SeqID_227962
atgatggaggaccaccctctctccgtgccccgtgacgaaatggaaaacctcgtactccacgacgacgacgccgccgccgccggcaacaacggtaacgatgataccgccgcaacatcaccgttctcctccaattaccgcagcgccatgtccacgctctccgagtctcaccaccaccaccctctctcgccgccgatcctcgccacccccgccgactccgatcccctcctctccccaaaccccagctcccccgacgcctcctcttaccttgaccctccctcctacgccgaagccgttttcacgcccttcgacggcgacactaacggcatcgagtctccatcttcgccaatttccctctctcgatctccgtcttcgagttcggagtatttgaagataacagtttcgaaccctgtcaaggagcaagaaacctcgaattcgattgttcctggcagcaacaattacgtgacctacttgatcaccacaaagactaacattccggaatttggcgccggaggcgccgactttgcggtccggcggcggttccgcgacgtggtgacgctctccgaccggctggcggaggcgtaccgtgggttcttcattcccccgaggccggacaagagcgtggtggagagccaggtgatgcagaagcaggagttcgtggagcagagaagaatggcgctggagaagtacctgcggcggctcgcagcgcatccggtgatcaggaagagcgacgagttcagggtgtttttgcaggtgcaggggaggctgccgctgccgacgaccaccgacgtggcgtcgagggtgctcgacggtgcggcgaagcttcccaagcagctgatgggggagagtgtgcttgcgccgcatgaggttatgcagccggcgagaggggggatggatttaatgaggctgttcaaggagttgaggcagtctgtggccaatgattggggaggttccaggccttccgttgtggaggaggataaggagtttttggagaagaaggaaaagattcaggagcttgagcagcagatcactggtgcatctcaacaggctgaatcacttgtcaaagcacagcaagatatgggagagacaatgggtgaactagggctggcatttattaaattgacaaaatatgagaatgaagaggctattgtgaactctcagagggtacgggctgctgacatgaaaggtgtagcaacagctgctgtcaaagctagcagattgtttcgagaattaaatgctcagactgtgaagcatttggatacgcttcatgagtatcttggattaatgttggctgttcatggtgcattctcggatcgttcaagtgcattattgacggtgcagactcttctgtcagaattgtcttctttgcagtcaagagctgaaaaacttgaagtggcctcatctaaaatttttggggctgacaaatcaagggttcgtaagttggaggagctacaagaaactataagagtcactgaagatgctaagaatgttgcaattagagaatatgagcggatcaaggtatggtttgtcttcaaatag

SEQ ID NO: 111185 - DNA, 4269 bp, Glycine max
  Peptide Sequence Number=SeqID_227963
atgaacgaaacagtactcaatagcactgagagctatctgtatctccatccaagtgagaacccagctacatctctcgtctcacctgtcctggactcgaccaattaccattcctggagccgatccatgatcacgacattaagtgccaaaaacaagctggagttcgtcgacggaagcgcgccggaaccactcaaaacagacagaatgtatgtagcttggcgacgatgcaataatatggtagtgtcttggttagttcattccgttgcaacctccataaggcagagcatcctttggatggacaaagcggaagagatatggcgagacttgaagtcaagatactcgcaaggagatcttttaaggatttccgatcttcaacaagaggcttcgacactgaaacagggagcactctctgtgacggaatatttcactcgccttcgtgttatttgggacgaaattgaaaatttcagaccggacccggtctgcacctgcaacattagatgtacctgctccaccttcaccgtcattgcacaaaggaaaacagaagatcgagctatgcagtttctacgcggcttgaatgagcaatatgctaacgttcgatcccatgtgctcctcatggaccccatacctgctatatcaagaatcttctcctatgtggcacaacaagaacgacaactaataggtaactcaacccctgatctcaacttagaacctaaagacatttctattaatgctgcaagaattatatgtgactactgtggacgtactggtcacacggaaaatgtgtgctacaagaaacacgacgtgccccttaatcgtgaaggaagaagcaagaatacaggtgggaggaagacgtgcacccactgtggtaaaaccggccacaccgtcgacgtctgctatcaaaagcatggttatccgccgggatacaagccatacaatggaagaaacgtgaataatgtagtagctacagatggcaaacctgaagatgatcacatgcaacatcgtgaatcccaggaactcgtacgattctcaccggagcagtacaaggccctacttgctttaatccaacggccgactgccggaaactcagcaactgatcaacccaaacaggttgcttccatctcgtcgtgcactattgataaaacatcaagtccaggtaaggccctacctcctgtaactacaaaatctacctcctggatattagattcaggagccacagatcacgttacttcatctctcgacaatcttcattcctatgaatgcatcaatccagtcactgtaaagcttcctaacggtcatcatgtccacgctactcattccggaatcgtacacctctcacccactataacactgtttaatgtcttatttatacccacattcacattcaatattatttccatttcaaaactcgtatcatctactgattgtgcattgatattttcttccaattcatgcatgttgcaggatacgaacaaacgtatgaagattggtatagttgaagcgagacatggtctttatcatctaataccagacctgctaaccaccaaaactatatgttcaaccgttgttcaccctaagtgcaatatccttcccatagacctatggcactttcgaatgggccacccctcaactgagagattacaatgtatgaaatcgtactaccctattctaagcaatgataaaagctttacatgtaacacttgtcactatgcaaagcataagaaactaccttttccctctagcatctctcatgcatctcatgttttttatttacttcatatggacatatggggcccgtgttcaaaaccatctatgcatggtcacaaatacttcttaacaattgtcgataatcattcacgatttacatgggtacatctcatgcataataaagctgaaacacggcctattatcatgaatttcattacgtccattgaaacccaatatgatagcaaagttaaaataataagaagtgacaacgagcctgagttcatgatgcatggcttctatgcttcaaaaggaatagcgcatcaaaccacgtgtgtagaaacgcctgaacaaaacggcatagctgaacgaaaacatcaacacttacttaacgtcacacgtgcacttttgtttcaggcaaatctacctcccggtttctggtgctacgcgttaactcatgctgtatatttagtaaacatcattcccactccttttctgcatggcatatcaccatacgaaaaactccatggtcgtcctttagatatagctaaccttcgggttttcggttgcttgtgttatgttagcacgctcaaagcaaatcgaaagaaactcgatcccagagcacacccatgtattttcattggtttcaaagcaaacacaaagggatatcaggtttacaacatgcattcacatgacatcatatcatcacgaaatgtcatcttctatgagaactatttcccacaaatttctgaattacaacaacttgactccaattccagtacaccattaccagcctcgttctccactaaccaatatgattcacctatagagcctatcacacaagaacccataaacgttgaccacctaacgaaatcttcttcctcaccaccaagacgttccacacgagctagacatgcacccacctatttgcaggattatcatcatgatctctccatcaacaataccagtgcttccacgtttgttcgttatcccctaagttccgttttgtcatactcgcgtctttcacccacacacaaacacttcgtcttatccatatcatcaaccgtagaaccttcttcttatgctgaggcttcacggcacgactgttggattaaggcaatgaaggctgaactacaagccctacagtcgaatgagacctggaggctcactcttcttcctccacagaaaaccgccattggttgcaggtggatttacaagatcaagtatcgcgctgatggttcaattgaaagatataaagcacgtttagtggcaaagggttacacacagatggagggtcttgattatcttgatacgttctctcctgtagcaaagttgactaccgttcgtcttcttcttgcccttgctgcagtgaatcaatggcatctgcggcaactggacgttaataacgctttcctccacggagaacttgacgaagaagtttatatgcaggttccaccgggattgactgtttcgaatcctcaactggtatgtcgcttgcagcgttccctttacggcctcaagcaggcgagccgtcaatggttcacaaagctgtcaggtttcctggtatcccatggctttcaaaaatctaattcagatcactctctcttcttgcggtttactggttctataacaacggtgctcttagtttacgtagatgatatcatcctcacagggaatagcatcaacgaaatacaagacataaccatgctccttgatcaggcattcaagataaaggatctcgggactttgaagttcttccttgggttcgaaattgcacgcacttcagcagggatacacttgtgtcaacgaaaatatgttctagatatactatccgattcaggaatgctcggatgtcgaccaaacaccaccccaatggactactctaccaagttgcaggctatggtagacactcccttatccgctgagtcttcttcttcctatcgacgacttatcgggagactcatatacctgactaactctcgacctgacattgcgtatgccgtccaacaactcagtcaatacatgtctagtccgaccaatgttcatcaacaggctgcttatcgagtgcttcggtatctcaagggaacacctgggtctggcctatttttcccggcaacaaacactcttcagcttcgagccttcagcgactccgactgggcaggatgcccagattccaggaaatctaccacgggattcctgatctacttcggttcttccctcatctcttggcaatctaaaaagcaatctactgtttcacgtagttcttcggaagccgaataccgagctctagcttcgactacctgtgaattgcagtggttaacatacctcctccaagacttccgtatcacattcatcaaccgctaccttcacatcgagatcgattgccatattgtccgtcacaaagtcaccatgggtctcataaagcttcttccggtttcatcctctatgcaactcgcagatatcttcaccaaggctttatctccttctatttttcaacacctttgtaccaagctgggaatgatgaatatccattcccagcttgagggggggatcttaacagcatcttgttag

SEQ ID NO: 111186 - DNA, 192 bp, Glycine max
  Peptide Sequence Number=SeqID_227964
atgaattgtaacctgcgaaaaagggaaaggccatggaagggagagacatgcaggtgtggtgttatatatatacagtatgaagaagccatgaagctcaagatagatagcgccaaaagaagaacaaacatgcataaaggcgatgccatgaagactgaagaaggaaattacagtgaggaagagaatagaagctag

SEQ ID NO: 111187 - DNA, 225 bp, Glycine max
  Peptide Sequence Number=SeqID_227965
atgagtgagatacgaagatttggaggtttgggaatggaggaacgtcgtgagagaaaaggggctgcgcagggatttctggaaaatgtgatatttatagagcaggacgcgtggaggaggcagcctactggtaatcgattacatgaatactgtaatcgattacaggctatctgttctagtgtaatcgattacagtattcatgtaatcgattaccagaacaaggaatag

SEQ ID NO: 111188 - DNA, 432 bp, Glycine max
  Peptide Sequence Number=SeqID_227966
atggaggccatgaaagagcaaatggccataatgatggaagccatgatgagtatgaaaaaaatgatggaggtcaatgcggctacagttgttgccacaagtactgccacagaagtggacccgactcactcatctggccccaatcaaaacaagcattcattcccaccatatggcttgcctcccaactatatgccacccaatgttgcacacactcccaataaggatgtcaataacttcactctcatactcactaagagccaacaactccaatccaatcatgcacatgtttctcaacccataggggagacacatgaagcaccccgagaccacaatctagtcgactttgaacctcacctcggatatgccactgaggggcaagcagttggtggtgtacccctgccaaacactttggggggacctcagtatcacccataa

SEQ ID NO: 111189 - DNA, 429 bp, Glycine max
  Peptide Sequence Number=SeqID_227967
atgaataggtggatgactatgaagaacctcatgctagaggactcgggaacacgacgctctgataggatgggtagagggtgtcacagacgaggcaatggtggggaagggggaaccaagaaggcaataaggagtggctggaggggggggggaaggggatcgcgggccgcgtttttaaggcagctggacgcgcctgggaccccagtgcgacccgttgcgcctacaacagcagcgctaacgaacgcgcctgcacgcagagtgccaaccgaagctccagcaccgccgacgcatccaatcctaaagcgccctcgtcagcagcgcgttcagacctgtcccaccgctagtcacatcatgccatgtgtcactattacggggaacgcgcccatcagagaagcactttgtagtaaaaaaacagacccacgaagtaaataa

SEQ ID NO: 111190 - DNA, 862 bp, Glycine max
  Peptide Sequence Number=SeqID_227968
aaaagaacacgctttatggcgcccttaccgaactcgtgctagagctagagtaacgggtaaagcagaggaggtgcaagagaaggtgaaggccgacatggaggccatgaaagggaaaatgtccacaatgatggaggccatgatgagtatgaagaagataatggaagcccatgcgattgtagttgccgctaccggcgctgttgctaagccccatgatgtgcaaattcaaaacgagcacgccttcccgccatatggcttgcctcccaactatacaccacccaatgtggcgtacactcccaatgagaatgtcaataactccactcctatactcattgagagccaacaacctcaatctgatcatgcacatgtctctcgacccatgggggagacacatgaaatgccccaccacaatctagccgacttcgagccttgcctcggatatgccactaaagggcaaacagttggtggtataaccctgcaaaacactttggagggccctcaatttcgcccccaaccacaaccctcacattccacaatggttaaaaacccttatgcatggctgaaatgggagaagttggatcctctagaggaaaggctcaaggccattgaaggaggggactacttgcctcatgaaccatctaaagatgtattgtcggaagatggggtatacgcaagagatgaggaactgctgatacatttcttccaagaaagtcttactggggcagtgtcagtacattctgatatggctccagataggatgcaactgcagaacatgtgcaaaaaggggtatgaatctttcaaagaatacgcccaaaggtggagagacctggcagctcaagtggcacctccaacgatggaggaatag

SEQ ID NO: 111191 - DNA, 279 bp, Glycine max
  Peptide Sequence Number=SeqID_227969
atggatttctacactaatacccgacctactgaggaaggagttcggggtgtgcactcctgggtgaggggccagtgggtccccttcgatgcaaacgcactcagtcagtttctaggccaccccctgatcttggaggagggccaacagtgcgaatacagccagaggaggagacaatatctagctttgatgaggaggccattgcccagctattatgcttatcggggcaggatttcacccagaccactgcagggatacaggtgtggatcatgcacaccagcatga

SEQ ID NO: 111192 - DNA, 210 bp, Glycine max
  Peptide Sequence Number=SeqID_227970
atgaaggcagatatggaggccttgaaggatcaattggcttccatgatggaagccatgttaagcatgaagagaatgatggaaagcaacacggctgcagttgccgtctccaacgctgccgtcaagacagttcctacccatccttctgcaaccccagcctatagagggcgcttgggggccgcctccggtcgtggaagggagagagaaacttga

SEQ ID NO: 111193 - DNA, 975 bp, Glycine max
  Peptide Sequence Number=SeqID_227971
atggcgacggatgcaagggcgaagttccaaaacccggaattccggcccgatttccacgcggacttaacggtgtcaactcacgacggcctccacttctggcagttcatgatcgccggatccatcgcgggctgcgtcgagcacatggccatgttccccgttgacaccgtcaagacccgcatgcaagccataggctcctgccccgtcaaatccgtaacggtccgtcacgccctcaagtccattctccaatcggagggcccgtcggccctctaccgtggcatcggtgctatgggcctcggcgccgggcccgcccacgccgtctacttctccgtctacgagacctgcaagaagaaattctccgagggcagccccagcaacgccgcggcgcacgctgcgtccggcgtctgcgccaccgtggccagtgacgcggtgttcactccgatggacatggtgaagcagaggctgcagctggggaacagtggctacaagggggtttgggactgcgtgaagagggtcatgagtgaggaggggtttggggcgttctatgcgtcttataggaccactgttttgatgaacgcgccgttcactgccgtgcatttcacgacgtatgaggccgcgaaacgcggcctcctggaggtctcgccggagagtgtggatgatgagagactggttgtgcacgccactgctggggctgctgccggggctttggctgctgctgttaccacgccacttgatgttgtcaagactcaattgcagtgtcagggtgtctgtggttgtgataggttcaaaagtggatcaattggggacgttatcaaaaccatagtgaaaaaagatggatacagagggctcatgcgaggatggattccaaggatgctctttcatgctcctgcagctgctatttgctggtctacatatgaagctggaaagtcctttttccaagatttcaatcagcagaaagacattggcactgttacctaa

SEQ ID NO: 111194 - DNA, 636 bp, Glycine max
  Peptide Sequence Number=SeqID_227972
atgtcaattgatttcattaccggcctcccgtcatcacagggccatactgtcattatggttgtagtcgaccggtattcaaaaggggcccacttcggcgctcttcccacccagcacactgctcatcaggtcgccgttcacttcctcaccctcgtctgcaaacttcacggcttcccgcgcagcttagtctccgacagggacgctttgttcctcagccaattctggaaggagctcttccgtctcagcggcacccagcttcgaatgacgactgcgtatcatcctcagtccgacggacaaaccgaggtcgtcaatcggactttggaacaatatctccgcgcctacgtccaccacaaacccagccactggtttcaatacttgccccttgcggagtggtcttacaataccacggtacattccagcacgggttttaccccgtttgaaatcgtttatggccggccccctccttccacggttgactacatccgcggttcctcccccattgatgctgttgattcactgttaacagaccgaactgagcttcacgcactcctccagcgccgcctccaaaaggcccaatcttctatgaaggccaccgccgataagcactgccgcgacactcaattctccatcggggattgg

SEQ ID NO: 111195 - DNA, 106 bp, Glycine max
  Peptide Sequence Number=SeqID_227973
atgggacacaaaacgctgaacatccttcttgatggtgggccagtcaaaactttgtcggaggcggtggagggtttttgcaactccggtgtgtcctccgaggggagag

SEQ ID NO: 111196 - DNA, 1173 bp, Glycine max
  Peptide Sequence Number=SeqID_227974
atggcatcactgtgtctaaactcattaccagtcccaccaacttctctttcttcttcttcttcttcttcttctttgcttcttcataacaacaacaacaacaacaacaatcttagtcccttgaaacccattgttgtcagtggagaccccccaacttttgtttctgctcctggtcgcagaattcttgctgttggagatctacatggagatcttaagcaagctaggtctgcacttgaaatggctggtgtattgagctctgatggtcgagacttatggactggtggagaaactgtgttggttcaacttggagacatactagatcgaggtgaagatgaaattgccatcttgtccatgctgcgatcattggatagacaggcaaaagaaaaaggtggagcagtgtttcaggtaaatggaaatcatgagaccatgaatgtggaaggggattatagatatgttgagtctgggggatttgatgagtgtaatgatttcttagaatatatcaatggttctgaaggtgactgggaagaaacttttacttcttgggttgatgtctctaaaaggtggaaagaagatcgaacaatgtcaaaaagttattggggaccttggaatttattgaagagacaaaagggagtcattgccagatcaatcctctttaggcctggtgggcttcttgcacgtgagcttgcaaggcatgctgttgtactaaaggtcaatgactgggtcttctgtcatggtggacttcttcctcaccatgttgcatatggcttagagaggatgaataaagaagtgtctgagtggatgagaggtcagcatgaggatgacaatactcacaaaatgcctttcattgccactaggggttatgatagtgttgtttggaatcgtttatactcaagagacacaccagatttagtggactatcaggctaaacaggtatgttccattcttgacgagacaatgcaagcagttggtgctaaggcaatggtggttggacatactcctcaaactataggtgtaaattgtaaatacaattgtagcatatggcgcgtagatgttggaatgtccagtggagttctgaattcaaaaccagaggttctagaaattatagacgataaagcaagagttataaggtgcaaaagggacagacacagtgaacttcaagctgctgcatatacttaa

SEQ ID NO: 111197 - DNA, 225 bp, Glycine max
  Peptide Sequence Number=SeqID_227975
atgtataagaaaacaaagctcgattttaaacttaaagaataccaatcagcactagaagttagaaaagataagaatcttaccagaatcaatgtccactccgagaatgctctgaaccaaatcgggattgctaattgtgggaagggaggtgggtttggtccgcggagaggtaatcgcaggaaccgtcagtttcgaggttgtaggcttcagtgtggacagacatggtga

SEQ ID NO: 111198 - DNA, 1407 bp, Glycine max
  Peptide Sequence Number=SeqID_227976
atgcagaacttgcagaggattggtacagttgatatggaggaaggtccttatgggctgaagatgtctcctctcagtctcgacaaggagtgctttgaggtagccagaacacctgtaggtattaatctctgtcaacaaaaatatgctctagatatccttaatgacagtgagatgcttggttccaaatcagttcaatttgttgatcaacctacttctactcagcaacaggctacttcaagaattcttagatacatcaaaggatctccagattgggctggctgccttgacaccagaaaatctatcactggttatgccatttacattggtaattcattggtctcatggaaatctaagaaacaagcaacgatttcaagaagttcgtcagaggctgagtatagagcatgggcaagtgccacttatgagctgcaatgggttaatttcttgctggaagagtttaaggttcattcccagcaacctgctaccttgtattgtgacaacaagtctgctctccacatagctacaaatcccatttttcatgagagaacaaaacacattgaaattgactgccaagtaattcgaaagaaggtgatgactgggatagtgaaattgcttcctatttcctctgcaaatcagcttgcagatatctacactaaagctctgctgtctcgtgattttcagtttttgtatttcaagctaggcagtccaaacaaacagactggaagaatacgtgaagctggtagtttaaacctggagcccgttgacagagtcaacagaaactatagtaacttgccattaccttttggtggaatctccatcacagtgaagggtttctcacgtccaacagggtggctctctgctggtgaatggctgaatgcaaaccttgcttacttgagaaagaatatgatgcaaatgatcaaccgaattctgagatggctgatgcaaccaaaaagtgtggagaatcgtatgttttgcttcgtctgttgtggaaggtactgctttacactgttttcagtttctttatctgggttaccttcttcaagacagccctccacctctctcaggctggagaatcatttggcatttttggttctcatggccacttctatttactcttttttcttcgataaaacttcaaatggcaaaccagatgcatatagcctgatctcatatgcctcttttgttgctatcatgtctcttggcttgtcaagattgactcaatttggattcgagattgatctcctacatttcttctgtggaggtctaatcatacaactcttggagattaaacgttggttagtcatcattggtgggtgtttcatttatttcctcgttgtcattcttggtccctctttggaaactccagagcagcgtgttcagctccaggatgtagtcattcaaattccgaagtag

SEQ ID NO: 111199 - DNA, 1698 bp, Glycine max
  Peptide Sequence Number=SeqID_227977
atggggatgttgtggacagtgttcctcttttgggtctggacttatgtcactcaaagcaattcatcttcacaggaagacagcggcaatgatggtcttatcctgctacggttcataaattgtataatgtcccttgagaaggagaatgagatgcttgtccccatggtttgtagtcatgtgaacaaatacattaaagccatggttgattccgaatccaaagacgagggccacattccagagctgcaattggatcctgatgttaacttcatgatggatgcacagccatcgggaattagcatgcatcttcatgaaaccgtgaagctaatgatggcagctgggtttgagcaggaatgctgtgacgcatacagcaattgccacaaggagtttctagaacagtgtctgtgggcacttgggttgcaattgcaagcgctcaacacatggaacattgagaattggataaaaacttgcaaggcagctgggaagatactgtttcccaatgaaaggagactatgtgattccgtcttctttgggttatctagagctgtggatgtatctttcacgaaggtatgcaagggattgacgattcgtctactgagttttgctgataccatgataacaaccgagagctattttttgctgaatcttttgtccagtgtcatccctaaaatgtcggagtcattgcacgagattaagcaggagttactcttacacaaattttgtaaggacagtatgtatatgttgctcaaagctgatgttaaaaaggttgagaaaagattgaatattttaaaggcgtttgcaaagattatttacggtaatactgctcaggcaactgttgccgcaattttcctgatagagggaaagtcttcattttctgtgctgatagcctggatgacagagttgctagagagcattttggaagccaagtccagagacgactacactgaccctgcattgggctatgtgtttatgatgaataatctaagatacataggacaagaggcatgtaaatggagatccattgtggatgaaagaaatgataattggttccgacaaaccgcgacaaagggaaaggagtcggtggtgccgcctaatgtggtagcggagtcaatgaaagataagctcaatttgttcaacttgatgtttgtggagataatcacacagtgggcagatgttataggaaaagtggttttcctccaaactatacttctagaggaggaagaagtagccaaggaggctctggcagagggagttctaatgggaaaggaaacaaggcctcaaggatcaaatgttaacaatgttaatgttgtggaagaaaaaggtgatagccttgttctagaaagaagtcaagaagtacaaaatgatgaagtaaagctgaactctctacagtataaggccttgatgacactgctgcaacaacaacagaactcggctcacgtaaattcacatgtgaatcaaattggtatagtcactggttttgttggttccagcaatatacatgttggttctactcctttgttcagctaccaaaagaacctgcaagatcaaaagaaaaacagaaaacacagcaaagcaacaagcaagagtctacaccatgagtttaggtggttcgacaatgtgcctacatccacgggaaatgcagctcatcatcatcacattgatcatgaaacattacaagttcaacacaagcagcagctagcttga

SEQ ID NO: 111200 - DNA, 1659 bp, Glycine max
  Peptide Sequence Number=SeqID_227978
atggaaactccagaggagtgtcttctgctcgaggacctaagtcaagtaatgattcaaagtaattcaaatacagaactagtagatgctgaaggtgatagtactctaaataccccaccaccagaaaacggggatgctgatggtgttcctcttctgggtctggacttagtcactcaatgcaattcatcttcacaggaagacaacagtgatgatggtcttatcccacagttcatggattgtataaaagtgcttgagaaggagaacgagattcttgtccccatggtttcaagtcatgtggacaaatatcttaaagccatgcttgactccgaatccaaaccagagctgtcgccaccgccaccagaactttatcctgacgtcaacatggtggtggatgcactgccatcaggaatcgtcacgcgccttagcgacaccgcgaagcaaatgatggaagccgggtttgagcgggaatgctgtgaagcgtacagcaaatggcgaagagagtttcaagaacagtgtctgtctgcacttgggttgaaattgcaagagctcaagatagaggactttgagaattggataaaaacttgcaaggcagcggtaaagataatgtttcccaatgaaaggagactcagcaatattgtcttctcggggtttcatagagctgcggacgtctctttcacggaggtttgcatgaaattgacgatttgtctagtgagttttgccgataccatcataacaacaacaacaacaacaactgatcagagttatttgctgccaagttttttgtccagtgtcattcctgaaatgtcgaaatcattgcatgagctgaatcaggagtcactcttacacggattttgtaaggacggtatcttgctcgaagctgatgtgaagaaggttcatgaaagatttgaaatttttaaggcgtttgcaaatcttatttacattaatactgctcaggaaactgtcgccggtggaggagggcttcatctgattacccagcaagcaacgaactacatcgatcatgtttgtgaatctttcggagaaactgtccgagaatacaaggttattcctggaagagagggaaaatcttcattttctgagctgctagccaggatgatagagttgttagagagcattttggaaaccaagtccagagacgactacactgaccctgcattgggctatgtttttatgatgaataatctctggtacattggacaagaggcatgtaaatggagatcccttgtggacggaagaaccatattagatgatcattggttccaacaaaacacaacaaaggtggaacaaaactgtaaactctatcaaagaagctcatggaataagatgctggacattttgaagctagagggaaacgagtcagtggcgccacctaatgtggtagcagagtcaatgaaagataagctcaatttgttcaacctacagtttgagaagatatacttctttcaatctacatggattctctctgatcataagcaactaagggaacaagttataaattccatagacagcaccttgttgccagcatatggaaaatttattgacaggtttcaggatgttcttggtgagcatgcttgtgagtatattgagtatggaattgtagacattcaaaatcgtctcagctgtttgtttcttctaagtgagtag

SEQ ID NO: 111201 - DNA, 159 bp, Glycine max
  Peptide Sequence Number=SeqID_227979
atggcagcggaaaagctttggggaccgccgacgatgttgaaagggattttgacaatggaggggacagtgtacacagtggtcttcattgttggtgatggagatgaggaagtcacggtcttcattgggagagaaagggtgttaggagaacagagggaataa

SEQ ID NO: 111202 - DNA, 911 bp, Glycine max
  Peptide Sequence Number=SeqID_227980
atggaagcagctccatcatcatcaacttgcgcctgcagccaccttgtgaccatgccctaccctgctcgcggctacatcaaccccatgatgaacttctgcaagatgcttctctccaacgacaacaccagattaatcctcgtaaccttcgtcgtcaccgaggaatggctcggtttcatcggctccgacccaaagcccgacattatgagattcgctacaatccccaacgtcgtagcttccgatcacccggggttcctagaagctgtcatggccaaaatggaagcgtcctttgaggagctactcaaccgccttcagccgccgcctaccgccatcgtgtctgatacttttctgtactgggcggtcgttgttggaagccggaggaatattccggtggcgttgttttcgaccatgtccgcgtctattttctttgtgctccaccaccatcaccttttggtcaatttgtcagaaaacggtggcgaacgtgtggattatattcctgaaatttcctcaatgcgggtcgtggattttcctctaaacgatggtagttgccgcagcaagcaattgctgaaaacatgcctgaaaggtttcgcgtgggtttcaaaagcacagtatcttctattcacttccatttatgagctcgaacctcatgccattgatgtcctaaaagcagagttgtcattgcccatatacactattggccctgccataccttattttagccttcaaaacaatcccactttcagcaccacaaatgggactagtgatagctacatggaatggctacaggttctgttctttacatctcacaaaggaagccatttctcggtttcaagggctcaaatggatgagattgcatttgctttgagggaaagtggcattcagttcttgtgggtaggccgtagtgaggcttcaag

SEQ ID NO: 111203 - DNA, 4722 bp, Glycine max
  Peptide Sequence Number=SeqID_227981
atgacagacccagagatacctcaagggaacactgttgaaacagagaaaatacgaaaacagcagaggagcttacatcttttactgaagccagagatagcaaatctttgtgaaattctgcatctgcctgaaaatgtcaagagtatggttgaaaattgtcttgaatatactatgaacaattatcagatctgtacagaaccagtgtcaatattacaggcttttcaactatctctgtgttggactgctgctgctttgctaaatcacaaacttgactttgaagagtccctcatgcttgctaagcagaacttgaattttgactgcaagaaggaagtggtggatgaaattaattcaagactctgggatctgaaggaattttttttaaaactcacaggaaactctaatgttgccagctatccaaaagcttctgagtcatcaaatggggtttattcatttattgaagagacaccagaggttgaattagtaaaaaatgacaattctaaaaatattaaaaacgttcagaagagtaaaagccagtggaataagctacttctgacacaacaagaagagaagcaaaagttgaaaaaagatattgaaaatgaaaatggtgaattttggagaaggtaccgaatacacagggcagctattcaatcatgttctcccaatgatgtaaccaaagagcaaaagctcaaggttttcaacagtgaatacatgaaaataattagagaattggaaaggcagcatgagatatgtctcaaggatcttgaggacaagcaattaaaaacaaggctgacattccaagagatttcagcacctgatgaattgataaacccagttacttcaaacaaatctgggactaaggttgaccagacttgtgatcaagcccagcattctaatgctccgaaagaccttgtgtctgatcatgttgtcgaaggagagggtttcaatgatatagttgaaatcatgacaaggactggaactgggattggattatctgaagctcctgatgccaatgcctctgtagttgtaccatgcagtagcacagttgaactgcaaactcctctggtcaaacatgcttatgctaatgagatggacatagtggcttcaaaagatggaccagtatctggaaataagtgctataatgttgctgaaaatgaatatgatagtcaaggaaatattttctctaagcattacaattccagagaacaatgttctgatggagctattagctcgccagaggagggggagtttgtaaattatagttgtgaatctcatgatttttggaaggatgctataacacaagttctgccttcatctaatgaagagatatgtgatgggataacattagatattcaatgttctgatggagctattagctcgccagaggatggggagtttgtaaattatagttctgaatctcatgattttgggcaggatgctatgacacgggttctgctttcatctaatgaagagatgtgtgattggaaaacattagatgttcagcgttctgatggagctattagcttgccagaggagggggagtgtataaattatagttgtgaatctcatgattttgggcaggatgctatagcccaagttctgccttcatctaatgaagagatatgtgatgggaaaacattagatgttccctgtggagaggtgtctcctacagggtgtaacaccagcagttcaaatggtgatcatgttgaaattccttcttctaggcaaggggaacttgatgggactatactgagcaatcctgtttgtggttcatcaatagaagttggggctaatggttccaatgatggtgcaaagaatatggcacccttgaattctcaatcatctgaagaacatatcccatgtgtaaataccatatccacaccaaattgtgtgaatgctgcacaaatccatgaggctgatgacaataatggttcaaaaaatgctgaaactctgaactcatctttgtctgatgaaagaatttcctccttgaattcaaaatcacctcaagaccatgtccgtaatgaaaatgccatgtgcatgcaaaattgtgagaattttgcaccgagccttgaggatgatgacggtgatggttcaactattgtcattccaaatccacctttgattgatgagagaaatgctgataggaccatagtattaaatagagatgcacatgtgggaatgcttgagactgtcaatctcactccatccacagagcaaatatctggaggtgcagtagatgaagatggtctccccaaccacattcccaagtcatcagttttagatagtgtattgtccagaccacgcgaagctgatagtcctagtaatagctcggatgctgattgtattattctttcaaatcaaccttctttagagaaacaaaatcatgaagtcttatcaaacatacctgttggacaaattccagttgaagtgtcagacacttgtcatgagaggattactgtaaatgtattagatggggaggaagctgtgggaaggcctgccacagtcaattgtactgattatcctgagaatataattcctctgaattcttcatccatggatcaaatatctaatggaggtccattattagatggagatttatcatcagggccttgtgctactagcccaggcaatggtctgaccctacctgatgaacaaattcctgtcttagtgccagaaaatagcgataaagtggctcgatgtcaattaacagacagtgcagtggtgaagaaaaatgccatatctgaccagcaggaaggagtatgtagaaccatgacagaaaacagtttatcccaggagactccagtatcgagaacagttcatgatctcatggagcctctagaaccactgcaatcattatcatctgtagagtctccacctgacccggatactgctagagaaatgccgaacactttgatatctagtcctgttgatattgtacctgataatcaatccattaatgtttcactggtcatggagcctccagagcaggaggggcaattactttctgcaggtttcctttcttccaaccaggacctatctaatttgcctttggtgactggaaacaaagaccagccatccgatgaagatgatctcccctatcacatttctgagattcaaaatcaagttgtgcaacaagcctcatattcggaccagcaggaaggagcatgtagaaccatgacagaaaacagtttgtccctagagactccagtatctagaccagttgatgatctcatggagcctctagaacaagtgcaaccattatcatctgtagagtctccacctgaccgtgatactgctagagaaatgcagaacattttggtatctagttctgttgattttgtaccagacaatcaatccattaatgattcactggtcatggagcctccagagcaggaggggcaattaccttctgccggtatcctttcttccaaccaggacctagctaacttgcctttggtgactcgaactgaagaccagccatccaatgaagatggtattcccaaccacattcccgagacatcaattgagattcaaaaccaagctgttgggcaatgtgcctcaaatgtggaacttgactcatgttctcgtcaagttgtacatccagcctcaaatatggaccttgattcacttcttcctggtggattcagacggcagtcttcagacacaagaaatttgtcaactctcacagagaataatagccatcctgtacaacctgctagccaatcagcttccaggattattcgacatttgtgccttgatccacttaccaatgaattagaaagactgcgtatactgacagaccaaaatatgaaagaatatgaaaacaagaaattgcagttgaaatgtgattttgagaaggaactcgaggaactttacaggaagtatgacattaaacgtaaggagattgaggttgaatttcagaatataaggaagaacctggatacacgaaataaaatagtttttgtaaataagatattggctgaggctttcagggctaaatccatggatcttaaagtatctggtgcatcaagaatgcagcaagatgcaagtgttccaatgcaattatttcagcttgcaagtcagcaaaatgccactcagccctgtctggttggtgcatcatcttgtgggcctcctgcagccagcgtgcagagttcctacgccacaactaccactcagactatggtatcaccaatacaggccacttacagtacaccaggaactttctccagtgtttctccaagactacctcatatcaactccctctcttcacccttgggaaatgttcaaactgctggggagatacgtgcccctgcaccacatctccagccttatagacccccaacatccatcccagcctccagtccatgtacagttccgcatgggaggccaggtcagcctacacccggtaatattccggtaacttctcccccattttctcaccggacaccccggccaatgccggcaaactttcagtctgttcctcatagggggcattggcccgtaagtacaggtgggttatccacacctaatttatctgctgccatgaattctcgtggtgatgctaatagtcaacctggtataaatctggcaaatgttcggccacatatgccagatttgcctacattgatgaacttgaacctatccaaatttggctgtaatagctcgccggctaactcagcacatcaagctacatcacctgatgtagtctgtttatcagatgatgaatga

SEQ ID NO: 111204 - DNA, 229 bp, Glycine max
  Peptide Sequence Number=SeqID_227982
gcgtatctccttatcagaatcagatgtgaaaaagggtgggaggaaaactgccaataatgttgatcagccttcttcaaaatctaatggtgaaaatttatctactaggaacaaggaagtgagtgaactaagatgtagagtagtcaatctggcctatccgagggaagatacagggagaagccaaaaacaaaaatctttcagttccggagttcagacagtgccaaaggagtaa

SEQ ID NO: 111205 - DNA, 222 bp, Glycine max
  Peptide Sequence Number=SeqID_227983
atgttgaactcggagagtagcgcggagaaaattttactcggcttcaggaaacggcggcgaacggcgacggtgttcttcgagttgggttggtgttgcaatcaaggggattctccgagcactataaaacgctgcatgtgtatcccgaggaaagccgagaaattattgcgaagaatggaatacaattggctacaagaacggggaaaagggcattatagactttga

SEQ ID NO: 111206 - DNA, 183 bp, Glycine max
  Peptide Sequence Number=SeqID_227984
atgcaatttacgtcatcgacttgttcaaagaactttgtttcatcacgtgcgttgcacaaacaacaactcccctccttggtagttagtggcatagtggacaacatggtgtttggggttaagtggtggctggacagaaatatagaaatggcaataactgaagctacatggctccaaatgaggtga

SEQ ID NO: 111207 - DNA, 192 bp, Glycine max
  Peptide Sequence Number=SeqID_227985
atgggatttccaaagtttttaatagaggaatttatagctggacaattaaagaatagagtttcgtttcgtaaagcaatgaaaaaagctattgaattaactgaacaggcgggtacaaaaggagttcaagtacaaattgcaggacgtatcgacggaaaagaaattgcacgtgttgaatggatcagagaaaggtag

SEQ ID NO: 111208 - DNA, 663 bp, Glycine max
  Peptide Sequence Number=SeqID_227986
atgggatgcacttcactgcttagaagccccaagaaagaagaacaagaagtacccgatgccaattctaaccaagcttacacctatgaagggttcagtattttggacgaactcgaaggggtcttgaacaccaaggaagaacaaaactttccccaacaaaactcttctagtggtggtgaacttcattgggatttcatggaatgggaggagtttcaaccccccaatgttggagaggaaggagaagatgaaaatgaagggaaagagcatacaagaaagaacacaaggagcaaatgcctctttgaggaggagcaagcgattataaggagagaaagcaataacaacattgttgggttttgggaagtggatgatgagaagatggtggctttgaatttgaacttgaactatcaagaggttttggatgcatggtctgaccgaggctctctatgggctgatgattgttctctttcattccccaccaataatgcctactatatgggagaagtgccagtgttggaagaagagagagcaaggagggaagcaagtgttcttaggtacaaagagaagcgccagaacaggttgttctcaaagaagataagataccaagttcggaaattaaacgctgataaaagaccaagaatcaagggtcgctttgtgaagagacactga

SEQ ID NO: 111209 - DNA, 456 bp, Glycine max
  Peptide Sequence Number=SeqID_227987
atggcctccatcattgtggccatttgctctttcatggcctccgtgttgggccttcatctgctcttgcacctcctctacttcacccattactctacttctagcacgggttcgattttcaacatggtccatgacatcttcgtcaaggtgaaactggaagtaacaaggacattaacagtcctaaatgtgtttggcagtagacgaagcaatgatgtaacacaatccatcttttgccccaacttttgcaagatggttacttccatacttcaacttgactcgatgaatcttttcgtaaaagcacgagcttggttcaaccccataacccagggaatggcaattttgatcgccaatacttcaacaacatttcatagggatgaaagattcgggaatacgcatgctatgtatggaaaatgtaattatgagattgagatgcccgaagagacatcctttcttaattaa

SEQ ID NO: 111210 - DNA, 297 bp, Glycine max
  Peptide Sequence Number=SeqID_227988
atgcagtgtgcatgctttaaattttcatttactgatgcatataggaatgctattgaatttgagaagaagacacacgctagaaaccttgagcacagacgggctatggacaacaatatgattattatggaccgcgaggttgaaaagttacgtgctgacttggctaatgcagaaaaaagggcaagggctgtgatggctgcagatgcaaaaacaaatcctggatatcctgctaactatgacaatcctgagatgggatatggaggaattacatgtcctcctgattcttatagcatgcatcag

SEQ ID NO: 111211 - DNA, 561 bp, Glycine max
  Peptide Sequence Number=SeqID_227989
atgaaattagaagaggaaagcgcattctctaacctaaaaggtgaaaatgagtcaccatggagacgggagagaatgaatttcatagtggcaattgctaggggcacccagcaacattgctggtgcacccaacaatttttaaaaaacccaaaaaatgcccctaatggtgtaagcgtttcagattcgacccaagaaattttcttccagcgaagacattacaattgcggaagaaaaaaacttcttccgtggagtctcgcggaagacgtcttccgtgagattcaacggaagaaggtttcttccgttgttgaaattacacctgcagaagaatgcttcttccgtggagtctcgcggaagacgtcttctgtgagactccacggaagaagcattcttctgctattgacattacaactgcggaagacagcttcttccgtggagactcacggaagacattttccgcgagcactcatggaagatgtcttccgcagttgtgatatcaacagcggaagaaagcttctttcgtggagtaattcgttttatgattttttagttttaagattattttga

SEQ ID NO: 111212 - DNA, 453 bp, Glycine max
  Peptide Sequence Number=SeqID_227990
atggcgccaccaccattggcgcttccgcgtaggagctgccatgtggagagggacgcgcaagtagcagcagcggcttggccttttgcttacatggagtgggacgtgcaaggtgcactggcgcgttgtgcatgggagactaaagacgccagtcaaactggcgttttagctttgcagaaggtgacagggtgcacagtgctgcagcagactgctgcagctgcaggaagcaggaaggaaacgccattggagcctgcgggttgcgtttgcaagtccaacgcgccatcacgaggagcgctttcttccttttatatgcagttctcgtgctgcattgtgctacccgtttgctcagccttcttcaagcttgcttcctttggttggttccttgcatctttggtttctactgcttgtaacttcttggttaagtttgttttatatgttaatgttatgtatgcttag

SEQ ID NO: 111213 - DNA, 267 bp, Glycine max
  Peptide Sequence Number=SeqID_227991
atggtgtccataagctttagtatagcagacatcccaccaaagagtgtttttggggtcagggcaataggggtggctatggtggagatagacgcagagacaattatagagatggaggcagttctgggcctgataggcgtgataattacggtgggaatcgatcacatccatactgagggcttcaatagtgaacattttatgtactatggtttatggtctgaggaatttgttgtattcagttggctggcagggattaatttgagcatgtga

SEQ ID NO: 111214 - DNA, 273 bp, Glycine max
  Peptide Sequence Number=SeqID_227992
atgtttgtcggcacagttgggcttttgggcctcgagtttgagaaccttgatgatggtgtaattgatgtggttctcaagttgaggaggaggtcaaagttgcggaagccgccgtcggcatcaatggcaaccatagaggagcccaggcatcaaagttgggttttttgggagttagggttttttgtgattcctctggaggagagggcaatggggatgaaagagaagcagaataaggagagacgagaggacgcgagatgcatgcaaccttcatcttga

SEQ ID NO: 111215 - DNA, 219 bp, Glycine max
  Peptide Sequence Number=SeqID_227993
atgggggcaaatgagcccgttgacgcgaagaaactgacatcgtcttttgcaccttttgtcatccaggaacagcgagtcaggtggttttttactctcgtcgtccggaaacattcaagcccagcgatgcgcgagattcttctctgctgggcagagatgattaggtgcaatggtgaagggaagtgtcgtggttgtccaactttgtcgttttcaaaacactga

SEQ ID NO: 111216 - DNA, 429 bp, Glycine max
  Peptide Sequence Number=SeqID_227994
atggacaagttgaaaacaaataaagttgttgatactttcctgatcctcaagcttaagcaactcactgttcttacactggctgagacatacaaggtactaccctataaccaactgatgcaggagttagacatgacaaatgttcgtgaacttgaagattttctaattaatgaatgcctgtactcgttggtgttgcaacctacccttcggcgggagggcgacgcgagactcacgggggcgtcttcagagaaaggaaaatgcgcggagtcgccaccaacgtttattcgaggaaattgtcggaaaaacaggaaaagacatggtctacgaattttaagtgtgaaaggttcgggagttgtatttatgcacggggaagggtgtttccctcgctcctacgtattcctcaattgtgataaggaaatcggacctacgtag

SEQ ID NO: 111217 - DNA, 627 bp, Glycine max
  Peptide Sequence Number=SeqID_227995
atggcctcatcaaactacttgttccccgaaggcaattcaattaataggcctcctatttttattgtaaaggattaccattattggaaaacccgcatgcaaatctttatagatgctatagatttaaacatttgggaagccattgaaatagggccttatgttctcaccatggtggctggaaatattacatctgccttaggaatggatgagtattttaaggtatcaaattgtaaaaatgcaaaagataagtgggacaccctacaagtaacacatgagagcacaacaaatgaacatgaaatggaactgttgagattaaatcaacttgaagaaaatgataagaagaagggaattgcttttaaagcctcatcttcaatccaagaagaaagtgataaggaaggttcaattgacttggatgaagatgaagatcttagtctctatgtcaaaagattcaacatattccttaggatgagaagaattcaaagaagacaaaacttcaagcctaaaagaaggactcaagaatcatcccaaactccaagatgctatgagtgcaatcaactcgaacatctgagcgttgattgtccaatctttaagaaaaaaatggagaagctcgaaaagaagaacattggataa

SEQ ID NO: 111218 - DNA, 522 bp, Glycine max
  Peptide Sequence Number=SeqID_227996
atggaagccaatgcggttacagttgccgctaccagcgctgttgctaaggtgaacccgatgcccccatctggcctcaaccaaatgaatcatccaacctcggctatggtaggcaaagatttgggaagtacgggcggcccccattatgcgcaaattcaaaacaagcacgccttcccgccatgtggatcgcctcccaaggaggatacacatgaaatgccccaccacaatctagcggactttgagccttgcctcggatatgccactgaagggcaagtagttagtgcccctcctgctatggctaaaatgggaaagttggctcatataaaggaaaggctcaaggacattgaaggaggcgaagattatgcctttgctaacctagaagagttgttcctagtgccgaactttgacaagtacaaggggacgacttgccccaagaaccatctaaagatgtattatcggaagatgagggcatacgcaaaagatgaggaactactgatacatttcttccaagaaagtcttactagg

SEQ ID NO: 111219 - DNA, 279 bp, Glycine max
  Peptide Sequence Number=SeqID_227997
atgtctgccgtgtcaagcatgcacccattccaggaaaaaggaagacctccgaaaatacagaaaactgacaacaagttcacaaaggaaccagaaaagcttaataataggatcccaaataccagagcaccgccaaacccaaacgttccagatgcactcaattcttacctaaccactggcaccccgcaattgcaaaatgatgatgcaattgcagaactcatttatcaaaagcagatcaagaatgagaataaccaatacagtaggtggcttctgcaaatgtaa

SEQ ID NO: 111220 - DNA, 483 bp, Glycine max
  Peptide Sequence Number=SeqID_227998
atggagaaccctaaagaaaataacaaggtagagaatcctcatacggtgaatgcagttttgcatcctacttttgtcttttctgctagaaaactagcagaccaattgggagatacaaaagctgatatggatcctgatccggaacaacaaatattggatcctaaattaagaagaatattgtcaaactcatttgttgcccaaagatcaagggagaagaagaaaaatcatttagcccatatggagattcaaaagaaaacttttgaggtgaataatgttattgatttctttggaatcaatgttattgacaagaatgaaatagcccaaaaacaaccaatacaagatttgtaccaaaataagaggcaagctcagatagtagaagaagaaacattgtaccaggaaattgatattcttaagaattattcaatgttcgaagatgctgaaattgagaagaacaaaggtgaagtgaatagggagagagaactctaa

SEQ ID NO: 111221 - DNA, 297 bp, Glycine max
  Peptide Sequence Number=SeqID_227999
atgtggttggacatgtttttaaagttgccttatacaagaggcttcttgccatggtttcaagaccaagggttatctgagccccaagtgaccataaaggaagagatgaaaatcatatctaagcgatttgaggaacttgatgtttgtggtaaagtaactctaaagagtaaacttcaggaaattgcataccatgatcaaaaatctatgtgtcctcctccagaaaaggtcaacactaaaggtgcacaaaagaaacccatgaatagaaaccaaagatcaacaaaacgcgattcgtcttactag

SEQ ID NO: 111222 - DNA, 393 bp, Glycine max
  Peptide Sequence Number=SeqID_228000
atgtcacaaattggaacaatagaagaaggaaagtttgtctattacaaattttccatagacaatgtcatttgggagaaactctcttccgggaattcttgtgttgaagtaaaattagaatcagagtcagattgggggggggacactgatattttcatctccagacatcctctcatatttcctacacgacaccagcataagtgcatcatcttgcatgtcatctatggaactggataccgaacaatgtacagttttgcaggctgtggagtgtttcttaggattgaggagcccaagaaccacattcactgtgacaggtgtggtcaggctttccagcaggaagaattagaaaatcacatgaaagtttttcacgaggcacttcactgccctgtggaataa

SEQ ID NO: 111223 - DNA, 471 bp, Glycine max
  Peptide Sequence Number=SeqID_228001
atggcgggcaaacacatcttcggtgatgttgaattgcagctaatggattttccacaacaaccaagtagttccactaaaacaagatattttgatattctaggtccaattatgcaatgcaaagagtgccaagcaatgatgtggtatgatgagaggatagacaagtatagggatgttgccaatctgaaattcaacctttattgtggcaatgggaaagttcagttaccattcttacaactagtacctcaattgttgcaacatctcttatttgataaatttgcaagtgaaggcaagaactatcaacaaaatattcagatgtataatacgatgttcgcatttatgtctcctgcagcaaaggttgacaaaactataaacaatggaaaagggccaccaactatccatattcagggtcagccatgccataggattggtagccttctgcctccgtctggtggtgtaccaaaatttgcatag

SEQ ID NO: 111224 - DNA, 357 bp, Glycine max
  Peptide Sequence Number=SeqID_228002
atggctggggcggtgatgggtggtgaggtgcacacgattatggcccctattgagagggcgaaactattgttgcagacccaagagagcaacttgacaattgtcgcgagtgggcgtctcagattcaagggcatgttggattgcatagcccgtacggttagggaagaaggcattctctctttgtggagaggcaatggcagcagtgttattcgttactatccttctgtcgctctcaatttctctctcaagcctttggttgccttagtttatcctattattcaagagatttactctggtaatcgattaccagatgatgtaatcgattatcagtggccaaaaacggtttacaacagctactaa

SEQ ID NO: 111225 - DNA, 471 bp, Glycine max
  Peptide Sequence Number=SeqID_228003
atgtccatcaaggtagttgaattattgaaacaaactagcttgatcatatgggaagaggcccctgtggcacacaaatatcattttgaagcattggacaagactttgagagacatcatgagaattacaaatgaagttgatattgtttttggaggaaaagtcatagattttggaggagactttaggcaaattttgtcggttattcctcgaggaacgcattctgacattgttcatcctaccatcaatgcatcctacttatgggatcattgtactattttaacactgacaaagaatatgcgcttacaaactaccgtagaatctgaatacacattggaagtggcagactttgttaaatggatccttgaaattgatgacgataatcttggtcaaccaaattatggatatgctacaatagaaattcctctagaccttctcatcctagattactcaagcaacattatattcccagaatga

SEQ ID NO: 111226 - DNA, 232 bp, Glycine max
  Peptide Sequence Number=SeqID_228004
atggtgaaatcattcaaagttcaagtgcaaatgcagttttcagaggtgacaagacaaaaatcgttactcttgaatccaacaatgacgctgtcagacataatcaccgcaatacagtcatcaattacagacaatgatgttacgcctataattactacactttggtatcgttgtcttgtatatgaattcaatggtgaagttcaatatagggcaattcaaattattgacgaagaag

SEQ ID NO: 111227 - DNA, 926 bp, Glycine max
  Peptide Sequence Number=SeqID_228005
caccagatcctggtgcccacccgccgctacggccagggacgagaactccagatcctgcccaccgtcaccctgctcgccagcgacgtgcacgacgacgacgcgttggaccgcctggcgcgcgactgcgacgtggtcgtcaatctcgtcggcatcctgcacggcaatgcgggccgcccctatggctccgatttcgcgcaggcgcacgtgcacctgccgcaacgcatcgcccgggcctgccgccgccagggcgtgcgccggctgctgcatgtcagcgcgctgggggcggattccaatggcggcagcatgtaccagcgttccaagggcgatggcgaggccgccatccggcaggagctggccgattggcgcgaaggggggtggacgatgttccgcccctcggtggtgttcgggccggacgacaatttcaccaacatgttcgcgcgcctggcgcgctggctgccggtgctgccgctggccggcgcgcacgcgcgcatgcagccggtgtacgtgggcgacgtggtgtcggcgatgctgtcggcgttggccaacacgcatgcctgcggcaagacctacgagctgggcgggccgcaggtctacaccctgggcgagatcgcgcgcctgtgcgcgggctggagcggccatccgcgtccggtgatgagcgtgccgatgggcgtgggccggatgcaggcgttgctgttcgaatgcttgccggggcggccgctgatgtcgcgcgacaacctcgattccctgcgcagcgacaacatctgcggggcgccgatggcgcccgaactgaatgtggtgccgacgggcctggaggcggtggcgcccggctacctggcgccggcgcgctagtgcgcgaagcctgcgtcgacgggggcagccctggggcgtatcgcgcctgttgccgcgaccagccctggtcgcaatga

SEQ ID NO: 111228 - DNA, 432 bp, Glycine max
  Peptide Sequence Number=SeqID_228006
atgttcatgacccctaggttgtgcatttcaggtgttttgggtgaaaaaacgtgtttccgtgaagaaaatccaagccaaggtgctgccgtaaggctttcgagacgtttccatgagcaaatcagtgaagattttccgccgcgcgttcttcaccgttcttcatccattcttcgttcgttcttcggtcttcaaccgaactacgtaggtctgagttcctcatcgcaattgaggatacataggagcaaaagccccacttttgttgaccaccccaagagatcgttaatggtccaacgccttaacgtttctctcctttcaaaaaccaagagatcgttaatggtccaacgccttaacgtttatctcctttcaaaaaccaagagatcgttaatgatccaacaccttaacgtttctctcctgtcaaaaccaagagatcgttaa

SEQ ID NO: 111229 - DNA, 537 bp, Glycine max
  Peptide Sequence Number=SeqID_228007
atgaaggccgacgtggaggccatgatgagtatgaggaaaatgatggaggttaacacgactacagttgttgccacaggtaccgccactaaggtggacccaactcacccatctagcctcaatcaagtccagagcaagcattccttcccaccatatggcttgcctccctattatacaccacccaatgttgcacacgctcctgatgaaaatacacatgaagtaccccaagaccacaatctagccaacttcgagcctcgtctcgaatatgccactaaagggcaggcgattggtggcatacccctgccaaacactttgggggtccctcaatatcgcccacaactacaacccttactgcctcttgccatgttgtgcctagtgcccaacgtggtcattcctttggagttcaaggtggcagattttgataagtacaaggggactacttgtcccaagaatgacttaaagatgaaagtcttactggggcaaccgtcacctggtacaccaatctggagtcttcccgggtctgttcttggaaagacctaa

SEQ ID NO: 111230 - DNA, 594 bp, Glycine max
  Peptide Sequence Number=SeqID_228008
atgggacagccgagtaaaaagttattgccgtttgaatttgctcagagcttcggtattcaatttcgagcgtctcgatatattacgggactgaatcagacgtccgaagcttcggtcttcaatttcgagcgtctcgacatatttcgggactcaatcagacatccgagtaaaaagttattgtcgtttgaatttctcagagcttcacttcaacattcaatttcgagggtttcgatatattacgggattcaatcagacatccgagtaaaaagttattggcgtttgaatttgctcagagcttcggcattcaagtcggagcctctcgatatactacgggactcaatcagaccaccgagtaaaaagttattgtcgtttgaatttgctcagagcttcggcattcaagtccaatcgtctcgatatattacgggactcaatcagacatccgaagcttcggtattccatttcgagcgtctcgatatattacgggactcaatcagacatccgagtaaaaagttattgtcgtttgaatttgctcagagcttcgataatcaattccgagcatctcgatctattaccggactcattcagacaaccgagtga

SEQ ID NO: 111231 - DNA, 438 bp, Glycine max
  Peptide Sequence Number=SeqID_228009
atggaagcttctcagaacctagctcccacatcccacacctcagatttgaatatggacagagctaggttggtctatggcttggtaaccaacatggacatgaacattggagcccttatctcaggtcagatttcttctatttctcagagtaactcctctaggctcagatctctagccttgatcactgccctaagcagagctagaggagttacctctgacaatctgacctatgagagcctgagcccggccattaacttggcctacattaagaaaaattgttggaatatggatgatctaacagttaacttcaaaggggcaaagaaggaaaaggttcgaccagctgaggtttcctttttcttctactctaccagctccttccacttctgctactcttacaccagctccttcagactcatctactcaagactctcagtgctttga

SEQ ID NO: 111232 - DNA, 139 bp, Glycine max
  Peptide Sequence Number=SeqID_228010
atggagacgctcaaaattgaacaacgaaagctcacgagaaattcaaatggctataacgtttcacttggatgtctagttcacctggatcatatatcgagaccctcgaaattgaacacgaagctcctggaaaattcagaag

SEQ ID NO: 111233 - DNA, 174 bp, Glycine max
  Peptide Sequence Number=SeqID_228011
agggtgtcatacacgcaagattggctgaaaggaacatctttttcaatgtttactgatgaggactttaaagagctaaacaagggtaatgagatttacaagcagaaaaagtttaaggaagctagagaccgcaattccaggagcattgtcttatcaccaacaattgttaatcaatag

SEQ ID NO: 111234 - DNA, 114 bp, Glycine max
  Peptide Sequence Number=SeqID_228012
atgactaacttttgtcttcttgctaaaccaatttgccggtttagcgagacatccgctgagtgcaccactcttgtggctgagtgcaccactcctgcggctgagcgcgaggaataa

SEQ ID NO: 111235 - DNA, 448 bp, Glycine max
  Peptide Sequence Number=SeqID_228013
atgaaggttgaacaactctttgcttgccatcatattagcaaagagggaaaagttccattggctacccttagctttcaagggaagaggcacattccctcctactatgaaagggagcttatggacaagctccaaaggcttagacaagggagtatgagtgttgaagaatatagacaacaaatggaactactccttttaagagctcgacttagggaagaggaaagaacgagcatagctaggttccttagtgggcttaatatggaagtgagggacaaggttgaactccttccatatagggacctagatgagctagtccaactttgtataagagtggagcaacaacttaaaagaaatccttcttcaaaatcttatggctctcactcttatccaaggaaggaccaagcccatggaattttaggggctgcaccttcaaaacccaaggaagataagg

SEQ ID NO: 111236 - DNA, 315 bp, Glycine max
  Peptide Sequence Number=SeqID_228014
atgcaacatttatccatcgatggaaacatgggcatcttattgcatcatggtgcacatcagaaaagtaaccattgtaatcaaaagaaagattgctctttacgacacccttattggatgcatgccaagaccaagataaagagtgaaatagaggaggtgcaggaacaaatgaaggccgatatggaggtcatgaagaaacaaatgacgacaatgatggaggcgatgatggatatgaggaagataatggaggttaatgttgttgtagctgctgagagggacccaactcacccgcccgttttaatcaagaaagtcacctag

SEQ ID NO: 111237 - DNA, 483 bp, Glycine max
  Peptide Sequence Number=SeqID_228015
atggcaactcaagtagtgctctcgatgatggagagagagctgataacaatgataatggacatactactggtgttctactatgacaaaatggtaggttacatgccttcgagttttgcatatctagtgtttgccagcgagagaattgaagtaggtttgaggaaagggaaatttaattgtgttgcttctgtgaattttggtaataggggacttgggaggagtggcgagaggaagaaggagggggaacctcatgttgtggctgcagttcccgcgcgaccaaactttccactagccccttataatcccatgtacctgtcgcaacgtgcccttcgcgggcgagcgagggcgaggctcacgggtgcgcttcccaaaggaggaaagatgcgcggagtccccaccaacgtttatttgtggaaaacgtcggaaaaaccgaaggaaaccggtcaaaatgaaaattctaagttcgggagttgtatttacgcttga

SEQ ID NO: 111238 - DNA, 267 bp, Glycine max
  Peptide Sequence Number=SeqID_228016
atgtggaactgggaaatgtgtttcttcaaaggttatccccacaacattatggatattagtctatcccgtacgatatttgtcgcaacctatccttcggcgggagggcgacacgagggctcacgggtgcgtcttccatgggaggaagatgcgcggagttaccaccaacgtttattcgaggaaaacatcagaaaaaccggaaaggtgtggtctacgaactttaatcgtgaaaggttcaggagttgtatttacgcacggggaaagtattag

SEQ ID NO: 111239 - DNA, 240 bp, Glycine max
  Peptide Sequence Number=SeqID_228017
atgagtccagatgttaattcatgcatctatgacagcaatttaaaaaaaaactcagtccaacagaccctagagttcgacctcaactgtaaataccaagcccggacagaccctagtactgtttacttacctcacaaaagttggacaaaacctagcccggacaagttaccggcaccgacgaaacgcagaagcacacgagggagggcaccacagaggttttctatgaaggaggttgctagctag

SEQ ID NO: 111240 - DNA, 258 bp, Glycine max
  Peptide Sequence Number=SeqID_228018
atgaaagaaaactggattcgaggccagcctccagacaaagcaagaaagaaagcaaacttagcttttttcatatcatccctcgtaaaattaccttgtcctcaaggtgataatcctcatataattgatcccaattctcccacgagatgtcatccagggatagcccttcccattgcaccaacacttcccaaggcccttgttctaaagctcgccgataatctaatatggctagctaagggagtaatgactggttggtgttga

SEQ ID NO: 111241 - DNA, 369 bp, Glycine max
  Peptide Sequence Number=SeqID_228019
atgacactgatcaccatagaagcaaatgcttcatgccacttcacgttcaagcatacccctcaaggtgatattaaccatatcatttcctactatgcttactttggatttgcatggtcagacaacccagtacgaatctcgcagcaattcttcgggcatgatgccaatgggaagcctactagatctatcttcaatcaaaatacaatcgttaaagtccatgaggatgtgggagatttcaacgacgatgaggatatcacatcgtctgagatctctttctatcgggatgtctacagtgaagagatatttgagggtgagatggtttcatccgacaaggaatgcgattcgttgggagacgaaagcaacccttcttag

SEQ ID NO: 111242 - DNA, 528 bp, Glycine max
  Peptide Sequence Number=SeqID_228020
atggatttggaaggccgttacagtcttagaattggagattacagtcttgaagatattcaatctgaagagattgctgatcatgcaaaagtgctggctgagcttgaggctgcacaagcgcaagttgaccaagaatgcaaagatgcttcttgtgatcaagatattcagataaggattccaaagctaaaggatcttgagtctaaagcaaaagagttgaggaaatctagcagatgcaagaaagtgagtgtcttaaacaagaaaaatgtgtgcttgatgaaggaaatgagctactacatgttttccaacttgctcggttcacaagtcgtggatatcagcataagagcatccactcaaagccgatctttgctcaagatttcttccatcctcgccaccgccaggtcgggtggccatgacaggcacacggtggcagcgatggacgtagatgaggcgaaaagggattttaggaccatcgggatagagggagacgcgagtgttaacatgatcgtcgttggaggagaaggggaagcatga

SEQ ID NO: 111243 - DNA, 350 bp, Glycine max
  Peptide Sequence Number=SeqID_228021
tctcagccttgaatgcaaggtgtcctgtgctatttctgttgaaagatggaactgttaaaatggctttggcagctgggccagcctgggtgactcaattacctatgagagttagggccataaacttacagacctttgacacggctagcaagtctgtgtggcctctttaccttcaaccactggctgagaggattgagcacctgggtccttctactgatattttccgtgctgtagctgaaattgctgtccagctatctggcagtggaagcacttctaatgatcttctggatgagttgtgcagcaatgagagtcttgccaggggggtgggaggtgttgaattgctcattccttag

SEQ ID NO: 111244 - DNA, 1476 bp, Glycine max
  Peptide Sequence Number=SeqID_228022
atggttaaattcataacattgcaactttgcaagttagacgtgatatatgttcttctctatatcgaagaagggtgtgatccagttaacaagctttattactgtgacttgtctgaacttccaaacgggctggaaggttttcggaatgagagttccctcctcccatttgtcaagctggttgataaatttgatggacaatatcaagccattgcaaatgatgacacattgtttacatttttaactaacaaagatgccccaaaatataaactagtccgagtagatttgaaagaaccaaatgcttggaccgatgttatcccagagtctgaaaaagatgtgcttgagtcagcacgtgctgtaaatggtaatcaactgattgtgagctatttgagtgatgtgaaatatgttctgcaagtaagagacttggaaacaggttccttgcaacataagttaccaattgacattggcacagtcagtgaaatttctgcacggcgtgaagacactgtgcttttcattggttttacaagctttttgactcctggaatcatataccagtgcgacctgggaacacaaactcctgacatgaagatatttcgtgagattgacatccctgggtttgatcgctctgagtttcatgtcaatcaggtttttgtgccttctaaagacggtaccaagattccaatgttcattgttgccagaaaggatattgttttggatggttcacacccttgtctgttatatggatatggcggctttaacgtcagtcttacaccatatttcaacatcagtcgcactgtattggcaagacatttaggtgctgttttctgcatagcaaatatacgtggtggtggagaatatggggaggaatggcataaatctggctcccttgcaaataagcaaaactgctttgatgatttcatttcagcagctgaataccttgtatctgctggttatacccaacccagaaagttatgtatcgagggtggaagcaatggtggacttcttgttggcgcttgcataaatcagagacctgatctttttggttgtgccctggctcatgttggtgttatggacatgttacggttccacaaatttacaataggtcatgcttgggccacagactatggttgttcagaaaaggaggaagaatttcattggctgatcaagtactcaccattgcataacgtccggagaccttgggaacagcatcccgatcagtcaattcagtacccatcaacaatgctattgactgctgatcatgatgatcgtgttgtgccattgcattcgttaaagctgttggcgaccctgcagtatgtcctcgttaccagccttgataaaagtccccaaacaaacccaataattggtcgcattgaatgcaaggctgggcatggagctgggcgtccaacacagaaaatgatagatgaagctgccgaccggtacagtttcatggccaaaatgttagacgcacattggattgaatag

SEQ ID NO: 111245 - DNA, 1392 bp, Glycine max
  Peptide Sequence Number=SeqID_228023
atgtcgatggtggtggcagcaagtggtgataatgatagcgacaatgttagtggtagtggtagtaatgtcggtaacaatgatggtgacaacggtgatagcggtgttggtggtggcataattggtggtattgttggtaatggtgatagcaatgttaatgagggtggtggtagtaatactgatggtggtggttatattagtagcaacaatggtggaagtgatgatagtggcggtggtagtggttacgacgatgttggtggtagttgtagggacaattacagaggtagtggtgttggtggtaacaatgatggtggtagaggtagtggtagcaatgttggtggtgatgatgatggtgatagtgatagtggtattggtgatcatgatggtgacaatgacgatgacagttacattaatggtgatggtagcaatgttggtgctagttatgtcattgacaacaatgatggtagcgacaatgacaaaaatgatattggtggtggtgatgaaggaatggagaaggaagccgaattgggtgaaaaggagtttgaacaaatggtgcgggctttgccttccgatgctgtcaaggagttattgtcgcacggggtgggccccgtctatgcttctcctccctccctctcttccctcttcgatgcaacacaacaagattgcctttgcacactttgcttagggattctgcagttcacatattctaatgttcaaaacgacaatctccctcttctcattgctgacatggttaaacgacaagcctatcagttcgataccttttcccttgaagtttccattccacctatcattatcgatgatctcctatatgaaaaccaaatatggatcccaaccttggttccaagaaaacttgcacagtggatgcatctctacaaaggacgccttaaaattttctcttatctatcctcttcaaaatcttctggtgagccaagcatagttggagaaagatcttttagcagtacacttgaaaatgattcctctgactgctgtaaattcttgctagaaaagtattcacggaatgtgagtcaaacacgctggatcattgatgatgaaagaatgggagaagcatcagttgaggaaataattggtggaaacatcctccaagcctgccaaggtgatagttttaagtttcatgctgcaggcagagaagatattgatgtccggatgttgggtccaggcaggccatttcttgttgaggtgcaaaatggaagacatatcccgtctgaactgtttgtaaaagatatagagaaaacgataaataaaatggagaataaactggttagggtgaaaaatctgaaacttgttggtagtgatggatggaaccttatgcgtgaaggtgaagcagagaagcaggttttgcattttgattcttaa

SEQ ID NO: 111246 - DNA, 1167 bp, Glycine max
  Peptide Sequence Number=SeqID_228024
atgaagacaactaagctatgtttggattaccgttgttttccattggagggtgctgaaatttggagatggatatcctttgtatcttatagtcggaacatgcttttgtttgcactttacaacgggcgcttggaaagagaaggtacttctgctgatctgcacataaggggtcaaatacaatcagaatcagtgcaaataggacttgctatgcagcatttgggtgcacttctacttgaacttggccgaacaatgttgacactgcgtatgggacagtcttctgcagaatctgttgttaacgctggaccagcagtttacatctctccatcagggccaaatccaataatggtgcagccttttccacttcagacaagctccctctttggtggtccagttcccccctcaactcctgcaactttaggcaccattggaattggaaatgctcctaggaacgtaaacattcatatacatgctggtacctctcttgcaccaattgtttcagccattggttctagggaaaataatggcgaggggacaagaagtgaacaccataatgagcctggctctggtgattcaggttcaacacgggtattacctgttagaaatgtcatagcagcaactatcccatcacaccctcctggtgttggagtctctagtagcacacaaactgggtttggtatttctacctcacagccaccttctgattcagcttcattgtcatctgttttagctgaaatcaattctcgccttagaaacgttgttggtaatatgcaaggagataacacagttccatcaggtcaaatggaatcaaacagcagggacttgtcttctggatctgaatcaagacctcctacagtaaacaaacagcaagataccgtggacgtgaatggttttggggctatcagtgcttcctcagttggctgcacttctgaaagtgaagtacagaaggtccaaaccgaggcagtccaaacctcaagtaatgttttggttgacaaatttgtttcaagttcttccaaccaagatttacaaagttgttctagtggagaaacaatagtaaaaccagaaatagaacaagatgttctggctgtaagtgaaagacaaaatgtaactgaacctgccaaagctgctccactaggattgggtgtgggtggtttagagcgcaagcaattttaa

SEQ ID NO: 111247 - DNA, 966 bp, Glycine max
  Peptide Sequence Number=SeqID_228025
atggcgggtcagtcctccaatgaaggctccagtactggaaacatttcagcagaatgttccgattcaactgttcagctcaatatcaagactctagattcccgcatctacagttttcaagtggacaaaaatatgcctgtttcattgttcaaagagaaaattgcaaatgaaattggtgttcctgttaatcagcaacggctgatatttagaggaaaagtcttaaaggatgagcatgttctttctgagtatcgtatccttcaaattgcttctggtatgagttctggtgagtcaactggtacaagtggtaaccgaggctcaggggctcctcgtaatcgtgttgggcaaatttcacatagtgttgttctgggaacatttaatgtgggtgaacaaggtgaaggaattgttcatgacctcactcgggttattgggcatgttttaaattctattggaaacagtggccagagcacaattagtggtcctaatgctacgcaaacttcttcagttcagccaaggaatgaaactgatggaatgcatgctggaaatcaaaacccagcaggaaatcaggcaccatctggacagacatttcatggcccgacatttcaatctgtctctcatgttgttcagattcctgtggcggcagggaccatacccattccttctctcaatgcaccaattcctgattcactgaacacactgtctgagtttatgaatcgcatggaacagatactaacacaaaatggttatcaatcaaatctttcatctgctaaccctagagatcagctagtggaattgccttctaatgtacaagggttgccgacacttgaagcattaagcactgtcttgcatcgtgcagaacagttacttggtggtcaagctgttgctgcactatctgtaattaacacatcccatttactaatattcatgttcaccttaatgataaaaatatctttctattatctgcaactataa

SEQ ID NO: 111248 - DNA, 336 bp, Glycine max
  Peptide Sequence Number=SeqID_228026
atgtctgaagatggcaacatacttagagagaatacaaattttgtgaatgaattcatcctatctgaagatgtggctgttgttgagtcacagatacttaaattatttgaagattctgaagatgaacttgcaattgggttgttgaatttaagatggtgtgcaatagctgggttcccaatctgcaagtcagctgatcaaagtctatgggctaaaagactggaaggaatgcaattggagacctccatgaaagggttgcggggtggggagtggggttcagtagtggagagacgcaggcgctgtatcatatcttgtgtcaactgtagccataattcagaataa

SEQ ID NO: 111249 - DNA, 645 bp, Glycine max
  Peptide Sequence Number=SeqID_228027
atgggagaagatgaaatggaatcaaagacagtcatactccagggaagtctaatccatttctctcaaaatctcacctccacagctggtcgtgaatttacggaatttgcaacagaaccgtctatgcagaggcaagttgtggaggcactccactcgggtgacagaaagaaggcttcagacttactttcggattttggttccagaagccgccactcattaacagctgaccattttgttcacatttttgagtactgtgctcgctctcctgatcctttgtttgttatggagattttgagattcatggagttaaaaggtgttagcatgaacaatatatgctcatctcttatgatgcaggccctttgtaatgggggttacttggaagaggcctttgatatcgttgattatcttggaggaagtcaacgtctctatccagttctcccactgtacaatagtctcttaagatcctgcacaacaatgcagaatataattcaagcaagcagatgtttggacttaatggaaaagaagatggtagggaagaatgaagttacatatattgagcttctcaagactgataatgtaaggcttagagatcatttcaatcccttttccaactgtggcatgagtttgcatatttaccttactgcttaa

SEQ ID NO: 111250 - DNA, 240 bp, Glycine max
  Peptide Sequence Number=SeqID_228028
atgatgagagcccttggagaagaagggatgataaaagagttgatccagtatttacatgtggcagaaaatcttttcatttatagaaacccttcattgggaacacatatgtacaacacagtgttacattatcttgttgaagccaaggaagaaagtctcacattggttagagataaggcaaagatagaatatataagtgggggacaccctcaccccgtaagctatcttttgggagttaattag

SEQ ID NO: 111251 - DNA, 1131 bp, Glycine max
  Peptide Sequence Number=SeqID_228029
atggctctggatagattcatttggtcatttacaaggttaggagatttagaatctgcatataaaatactactagaaatgatttcattagccaccaggggaaacattcctattgctagaacagttcatgggaaggtgtatactaatagactggacatccctgtgccttcaaataaagggccaggctcaaccatgttggacttgaaggagaacaaaaaattggactattgtatgcaccctcctcttatgtatatacctgacagtatttctgcaagtatagagcaacagattatttgcatggggaataaaaaagctaagagtactgaattagctgggctgaatgggcaaaaacatccgctgcttaagaaggcgttgagtcggtcttttgatgatataatacatgggtgtgcaaaacaaaagaatcatatgcttgcaaggaagcttatgttacagatacgtctcctttttgtctcaacgtcgaacatgtttctgacttgggcaccaaaaccttccttacacttgccagacatgtgtgagacattagttgtattgcttgtctatatgacaaatcttggtttgcagccatccagacatacatataatggcattattaaagttgtttctcatagaagctttggggatgccataagagtgttgaaaaagatgcagcagaagaatttgaagccatatgattcaactctagcgtcactttcaatcacttgcagcaaagcactacaactagatttagctgaggcttttctgaatcaaatttctgaatgtctatatccaaatccttataatgctttgctagcatcatgcgatcaactgaatcaacttgaacgtgctattcgagtgtttgccaagatggagcagaaaaaagttttacctaatatcaggacatgcgagcttctgttttcgttatttggagttgtaaatggccattacgaagacagtgatgcgctgtcaaaggtggatgttgctaaaagaataaatgctatacaaaagcatatggccaacaatggcattcagcatagagtagctcaaggtcaaaggaaaactttactgaacagccacatgcttcgtagtgctgaatggtgggcagcaaatactagatatggaagaatggatgagtga

SEQ ID NO: 111252 - DNA, 1809 bp, Glycine max
  Peptide Sequence Number=SeqID_228030
ttcctgaccgtgccgccatttgagtgcgcctggagagaggatttgaaattccgggaggcaggccggggttgcgtcgcctttgaagcattcgcctgcaacgatgtcacactggttttccgggagaatgtgggaagccagggctaccattataaaagagatagcagtcctcactacacaatcatattggggagtcacaggaatcggcgactcagaattgaggtcaatggaaaagctgttgtcgatgtggcaggggttggcctctgctgctcttcctcctttcagagttattggatcagcatctatgatggcttgattagtataggcaatgggaaataccctttccaggatgttgttttccagtggttggattcttatcccaattgtaatgttcagtatattggcctcagcagctgggataaacatgttaagtatagaaatgttaatgtcttgtctctaacacacactcatgtgcccctctcgaagcatgtcgtttttggtgattatcaagttgaggacgaggttgatgcagcagactgttacaattacaaaaacatggattatgacaaatgggggctcaaaaaattcctcgagagttgggacttgtctgatgtgttattcatcgttggtaaagaggaaaaacccgttcccgctcacaaggcaattttagctgcatctggaaagttttctctgtgctcctcctcctttgtcatcaacctacccactgtatcttatctacttttccgtgcactgcttcactacatctatgttggctggacccaggaacaactcggttctttgagggatttaagtctacagtttgaagtgacaccactggtgaagcagtgtgaagagactatggaacggtttaagctagataagaagttgtttgacacgggcaagaatgtggagttaacatatccatctatccgacctcattgttcaactttgccctcacttcctgtcagcactcagcaactgaaacaattgaaattaacaggccagtacagtgatgtaaacatctacattgagggttatgggctcattgcacgagctcataaaattgttcttagcttatggagtatcccctttgctcggatgttcacaaatggaatgagtgaaagcatgtcctcggaggttactttaagggatgtcccaccggaagctttcaaggctatgcttaactttttatatgatgggcaattgaatgacaaagttatagattctggtgctttgttgctccaactccttctattagctgatcaatttggagtgacttttcttcaacaagaatgctgcaaaatgcttttagaatgtctctcagaggactcagtatgtccactcctccaagtggtttcttcaatgccatcatgtagacttattaaagaatcattgcagaggagaatttccatgaactttgactattatatcagtgcgagtactgactttgtgttattagatgagacaactttaatcaatatcattaagcatccagatctgacagtaacgtctgaagagaaagtccttaatgcaattctaatgtttggcatgaatgcaaaacagttgtttgggtgggaagtggtggatcagttaatggaaaattcaaaaccagaactcctttttggtgagaggcttcagttaatctatgacttgttgccatttgtgcgatttccactactacaatattccttacttgagaagttgcagcatagcagcattggccggcatattcctgttttccaaaatcttgttaacgaggctatcaattttgttaaatgtgggctggcagagtcagaaaatgaagagaagtaa

SEQ ID NO: 111253 - DNA, 150 bp, Glycine max
  Peptide Sequence Number=SeqID_228031
cggcatgatgatggaaggggtaatacggggtggaggttaaggaatgatccagaaggcactggcagggctaagaccgagcacttagctgacgaggatggtcctactaatgtccaatcaggcaaagatacgcacgagatgacaatcaatgat

SEQ ID NO: 111254 - DNA, 1113 bp, Glycine max
  Peptide Sequence Number=SeqID_228032
atgcatgcgcgcgcgcttgtttttgtgattctcgatcaaaatcatcatcttagttctacatgtggatgtgggttaattaattttacgatattcgatactgtgtatgataggattgtgttggcaccgttatcacgatcgaggtcttacaacttcatccctcagccgcatgctgctctatattattctcaaagaacaactaagggtggctttttgattggggaagcctccggtgtgtctgatacggcacagggataccctaatacacctggcatctggacaagagaacagctggaagcttggaaacctattgtgagcgctgttcatgaaaagggggaataccaaccagatggtaaagccccaatatcaagcacagacaagcgacttcgcaaggatatagccaacaataaagcaacagctgataaatacccacctcctcgccgggtgagagccgatgaaatccccaagcttgtcaatgactttgtaattgcagccaaaaatgccatggaagcgggttttgatggaatagagatacatggagcaaacggatacctgctggatcagtttctaaaggacaaagtgaacgacagagatgacgagtacggaggaaacttagagaatcgttgtcgattcccactgcaagtggtgaaggcagtagctgatgagataggagctgacaaggttgggatgaggctctcccctttcgctgattacaatgactgtggagactctgaccctcatgcattgggcgttcacatggctcagtcattgaatgaaatgggcattctttatattcacttgattgagccaaggatggtaacacaattccacaagtttgacggtaccaaatcgtccctaacgccaattaggaaggccttcaaagacgggacttttattgtggctggtggctacgataggaatgagggaaatgaagctatatcatgcgctgctgcagatttggtcgcctatgggcgcctttttttggctaatccagatctccccacaagatttcagctcgatgctcacttaaaccaacccgatgccaccaccttttactcacatcatcctgtgcttggatatacagattacccgtttcttcaacccaaccccaagtaa

SEQ ID NO: 111255 - DNA, 420 bp, Glycine max
  Peptide Sequence Number=SeqID_228033
atgaccatcatcgttgccaccaacataactatcaccgctactaccactggtggtgacagcggcgatcacagtggtggtggtgatggcggcgatgacagcggtaacaatcatgttaatcatgttagcggtggcaagggcagtgatgatcatagtggtgttgaggtggcggctatggcaattatggtggaaacagtcatgacagtagtggtggtcatgatgatgataggtgcccattcacattatgcttaccctgaagtcaagatgactgataaagaaagattagcaacatctctaaacacaactgctggatttaagcaccataaacttaaagtgtatgtccagtttctagaagctcttcctggcatagaaccaacgaatggtaattataataatgcagtaataacccaggcagaaacataa

SEQ ID NO: 111256 - DNA, 1335 bp, Glycine max
  Peptide Sequence Number=SeqID_228034
atggcatcctttacctctgagcttggagttcattttgaaactagtctagaagctcctcatgtaattgatgttgactcacaggtgtggcccgctataatctccactggtcctggcaattatcctttaaatgcaagttacaaaacagcagatggatatgcattccaggatgcagttggaaaatctttagaggaaatcttcaagattgttccaggtggatgccttgtgttctttccaagttataaattgatggacaaattatgcaagcgttggtctgaaacagttgattccctacagaattctgagaaaggaggagctgctttacttggtgtttgtcgaggaaaggatcagaatgcatggttcaaaagaaagaaaaatcagaagctgaacaagtctggtaatggagatgggagagaaacatcagtgattgagaataacatgtcttttcccacactaacccctcaagatcttgttgagagtcagccatcagctcaaaagagcagtaacacatacaattgtaaatatctcccacaatgctgtaatcagacagagccaaggttcactggagaatcatctgtggcaatcatacatgaggaaacttccattgtcatggaaaccccttgtatagatgttgaaaatgatcccactagtcctgattactccaaggatgacaactctggttccatcataattgaggcctcagctcaatttgcagatcacttatcaagtctttcaataatgtctttaactaaaggaagtaaaaactcttcaagggcccagtcttcaataacaattactcctaaaaagaatgtaattacaagtgatattccagaaatggaaagtgttaactctcataatcagaaaaggagaaatcccatggtcactccatttataaacctcgttgaagaagataattttgttgcaccttgtgccagtcctcttacatggtacacaaaaagctccgtagatgttagagagataactcatggaagtgaatatggtttcaagagaattttgaagtcaaattctcctccattactgacaagcactatacctggttcttgttcaccaactgcccctccactagacaaaagtaatatcaacaatttgctaggagttcagatcatggctactgactcatcaaatgttcagttacttgacaagatattgttttactttgattcattggaagtgaagagcagtgaggaatcagggaacgttgcctcagggaaagtggatctgtcgccagttaaagactctagggaggatgaaattgctgtcttaaattctattgagaaatattcttattttccccgaccagggaattcagaagtctag

SEQ ID NO: 111257 - DNA, 309 bp, Glycine max
  Peptide Sequence Number=SeqID_228035
atggagaagcttaacgggatcaaaggcattaattttagactcgtcgttatggctcttgtttcagatgattttcaaggaatgaaaaaggatgtcgtgtttgaaagttggtgtgaacctgataccgttgttttgagaggttttggatactatggtttcgaaagcggagaggttttcggatttgttgagcaaatttgcgcagagttccaaggagagaagggatgttttaggtgtgggtcgttgtttgatggtggtggtgcatggagaggttgcaaaaaaggaggaaggagcttgcataaatgtcgtttttaa

SEQ ID NO: 111258 - DNA, 1263 bp, Glycine max
  Peptide Sequence Number=SeqID_228036
atgatctctgcatcaaaccctaaccctaaaaatgtgtaccacatcggcggtctgcaagtggagtttccctatcagccatacgggtctcaatttgcctttatgggtagagtaatttccacccttaatcgagctcagaaagaaggccattgtcacgcgttgcttgagtctccaaccggcactggcaagtccctgtcgcttctctgttcctctctcgcttggcagcaccattataaatctcaacaccaccacctcaagtccgcacatgaggcaaccgccgatcctctggcttatggcggcggttttgttcccgacgaagttccactttcttctgaaagtctggaccgtacgcaatctgagggcaacaacaagaagcagaagaaaaaggaagcacccactatatattatgcctcaaatgctcataaagtcaaaggtcatccatcccttcataaaggaggatgcaatgaggtacatgacatagaagatcttgtaaaagttggacaattggtaaaaggttgttcttattatgctgctcgttctatgtcagatgatgcacagttggtattttgtccatataactacatcattaatccagtcattcgggcagcaatggatgtggatattaaaggagccatagtgattcttgatgaagctcacaacatagaggacattgctcgtgatgctggcagtgtggatattgaagaggatgttgtggatagtatgcttaactatatggtcatacctttgaaagaactacaaatggagcttcaacaactttgttctattaaggctgaaatttaccaaccgctatatgaaatgacacagggccttactagttggatggaacagaagaagaacaagctagaaaaacgtgattttcagcactatgtgtcttgttggactggtgataaggctttaagagagcttgaagaagcaaatatttcaaaacagtgtttccctatcttgctagaatgtgctaccaaggcaatcaaagttgctacagacttggagacagatgcaccgcatataagtgccatgtcagtgataacattggaaggcttattctcatcgctaacttatttcttctcgagaaatggatctcacatgttggattaccagcttgctcttcagcgatgtatcagagaagatactggaagagcttctagaaactggacatacactttaagtttatggtgcttaaatccagcagttgtgtttagagatgttgctaatctttctttatcagtcatcttgacttcagggtaa

SEQ ID NO: 111259 - DNA, 372 bp, Glycine max
  Peptide Sequence Number=SeqID_228037
atgcttcgagatggaggtctcctagcggtggagggattcgagggtttctttggagagggatttgagggtttctttggagagggaatcgagagattgggatttcttggcgacagagtgttgaagggaggagaagtgggtggagagggtgacaaagagatcatgctcacagagttcttctgtgccacgcctccgccgaaccctgatctctccaccaggctcaaatccctatggaggaaggtggacacaacgactctgctgcggtccgtggtgtcgaagctgaatgaatcgacatcattgggggcagagatagcaacggcgatggaagaggcagtggacccggtgaggctagtggagagagaaagagagaaataa

SEQ ID NO: 111260 - DNA, 210 bp, Glycine max
  Peptide Sequence Number=SeqID_228038
atgaaaaagattgaagaccttcttgaaaatctgacagagttctctaacaaaggtatagttgggtggaatgcattaggcaacttagaaaatggaggacacagagatggggtagaggcagatactcccatggaaatgcatggatcttgggctcttacatctcaactagatgaagaaacaaagaaaatggcttgggcaacagaggaaggatga

SEQ ID NO: 111261 - DNA, 390 bp, Glycine max
  Peptide Sequence Number=SeqID_228039
atgttggaatatcttggcaagatcaagatgattgttgatgatattgcttcagttggtgatgtcacaacctatcacgagtacatgaactcccttgaaagtcttcctagggactctgattctgttattgctctcgttgagagtcgtcttccaaatatctccattgaagaagttgaatgtttaatccttgcgcaagaattgcaccttaaaaaatgtgtcaaattcagcttgttgagtaattcctttgttacgttagtgaatcttactcatggaaaaacttcacaatccatgattgatgatgattttgtctctaattcttcctctaataccccgataacatatgtgaacaagtattcctctgattctagggtttttggtggtcataattattga

SEQ ID NO: 111262 - DNA, 381 bp, Glycine max
  Peptide Sequence Number=SeqID_228040
atgtgcatagattaccacaagctcaatgatgccataaggaaggatcactttcctctatcattcatggatcaaatgttgaagcggctagcaggacaattcttctattgtttcttggatggctattcaagatacaatgagattgtaatgaaccccaaggatcaagagaagattgcttttattggccttttggtgtcttttcctacagatgaatgtcattcgggttatgtagaatgcaccagctacttttcaacggaaaaatcgtcaggaaaaccacaaagacaaggaatggtttacgattggagaaaaaggattcaggatatgttttcgcagggtgaaggtgttagcaccctaggtgtccgtcatgaaaatgacagtctttaa

SEQ ID NO: 111263 - DNA, 147 bp, Glycine max
  Peptide Sequence Number=SeqID_228041
atgtccttgttgacaaacggccactccttgatgcaaactaatttgttcaccaacttggaagttcgaggcgggaagttgctccacgtcgtggggttgattggaaggagaagaggctacctaggcctgcagtgtcaaagatgggaataa

SEQ ID NO: 111264 - DNA, 358 bp, Glycine max
  Peptide Sequence Number=SeqID_228042
gtgcagcaggatttgagcttggtgcagaaaatgcttgtgtgtggttggctgtggaaagagtagtacagaatgagttctggatagttttctggctttgccctgttttgcttggctgtgatagcttgtgctgtttgaatgttgttttgcttggatgttgtggaagcttgggaggattgatggggacccggggatggtgggtttatgcgcgcattgtggatgtggaaaacttgttgtgcaccatcgcccgaccgccacctagtaccacatgtgatggggtgaaacttcctgcttttattgttgaccacagagtggtacctggagatatgtcgcgggggtcaggagaccttggggacgtcag

SEQ ID NO: 111265 - DNA, 369 bp, Glycine max
  Peptide Sequence Number=SeqID_228043
atgacggaaaccgtttgtacggataaccgcttgggtatctccgtacgtcacctaacttcatgggtcatgataacaaaaggtggggtggtcgacaaaagcggggcttttgctcttacgtacatcattgtggccatttgctctttcatggcctccatgttagccttcatctactcttgcacctcatctactccatccattactctacctctagcatggattttcaacatggtccatgacatctttgtcaaggtggaactagaagtaacaaggacatcaacaaccctaaatgtgtttggcattagacgaagcagtgatgtaactcaattcatcttttgccctaatttgcaaattggttacttccatacttga

SEQ ID NO: 111266 - DNA, 420 bp, Glycine max
  Peptide Sequence Number=SeqID_228044
atgatgcaaaaacacatcaggggcgatgcggcttttgctcgcccttttcatgccatccgcgacattgagtttgcaccggaaaatatcgtaaccggcgccagctttactgcttcttctgtgccagggctcccgcctcagccgccgctgccgttgttacagcttgaacgtcacaaggacatgcttgatgcggccgaacaggcggcgatagaaaaagagcagtggattgatgacgaggctgaacgcctgctgtcctgcttcccggatcacctctatttattccgtgcctggaatgttcatcctgaagtcaaaaaatgctgtgccggcagtggcgcagaggaagcctacagggattttataatcgggctggcctatctgcaggctgaacaaaactacgatctgcaggtcgtgctgggctgggag

SEQ ID NO: 111267 - DNA, 979 bp, Glycine max
  Peptide Sequence Number=SeqID_228045
ctgaaaacccccggtcagcgcctgaaacctacagtgatcctgctgctgagcgtagcgctggtatggctgccgattcgctacttcgacaagctgcaaaaagccaatgaagagctcaccaatatcgacctgccaagctatggcggcgtagtggcgcactcttatctgccttcgaactggatcgcggcgctgggcctgttcgcctggaccaaggtggatgagaggctggacagccaggagttactcgatccggcgaagaagtttacctatatagcgccgcctggcattgacgatacctatgtggtgtttgtgattggcgagaccacgcgctgggatcacatgggcatgctgggctataaccgcgataccacgccgaagctgtcgaaagagaagaatctggtggcattccgcggtgaatcctgtgataccgccaccaagctgtcgctgcgctgcatgtttgtgcgcgagggcggcaccatggataaccctggccgtacgctgaaagagcagaacatttttgcggtgatgaaagagctgggcttcacctccgagctgttcgccatgcagagcgaagtgtggttctacgacaacgccgatgtgaataacttctcgttccgcgagcagattggttctgagaagcgcaatcagggcaaagcggtggacgatatgctgctggtgccggagctgcaggcttcactgcagcgcttcccgaaaggcaagcatctggtggtgttgcacacgaaaggttcacactatctctattcgcagcgttatccgcgcgagtatgcccgctatcagcctgaatgtattggcgtggacgataagtgcagcaaagcccagctgattaacgcctacgacaactcgattctgtatgttgataccatgctggacagcgtgctggatcagctgcgtgataagaaggcgattgtgttctatgccgcggaccacggtgagtcgatcagcgaaaatatgcacctgcacg

SEQ ID NO: 111268 - DNA, 420 bp, Glycine max
  Peptide Sequence Number=SeqID_228046
atgcatgtgcttttaagtggaggatcagttcatcaaattcatgaggtcaaggaaatgaaccctcaagattccttgaaacttttctgcttaaatgcctttaatgaaagccagcccaaaatgggttatgaaaaactaaccgaagaggttgttaaaatagcgcaggggaatccattagctttagaagttttgggttcagatttccattctcgatgtatagacacatgggagtgtgcattaagcaaaatcaagaagtatcccaatgagaaaattctaagtgtgttgagattcaattatgatggactggatgaattagagaaaaaaacatttctagatattgcattctttttctataatcatgacaaagactatgtcataaggaaattggatgctcagggttttcatggagcaagtggaataaag

SEQ ID NO: 111269 - DNA, 474 bp, Glycine max
  Peptide Sequence Number=SeqID_228047
cgcagcgtggatgtcgcgattcgctatcgtgagacgccggagcgcggactgcactgtaccttgctacatgaagaccgatttatcgtcgtcgccagccccgcgctaggtattacacggctggaggatttgcgtcacgcgaccctgttccacgttgaacatcgtcacgttccggcagattcgccgggctgggagaactggcaacgccgctacggaccaccgcagctgaatatcgacgcagggttaaccttcagcgacgagacgcatgcgctacaggcggcggtggcgggacaaggcgtggtgattgccagcgaactgctggcgcgcgatctgttgcaacgcggggtattaacggcaccatttgaaatgttcttaccgggagcaaactattatctggtggcgacacaagagctagcccagcgcgccgatatcagcgccttgcgggactggctactgcagcagatagcgatgagttga

SEQ ID NO: 111270 - DNA, 105 bp, Glycine max
  Peptide Sequence Number=SeqID_228048
atggtgaagcataggcgtattaaaggatgcaggggtcaaatggtgttgatggaaaaagcaatcaaactgagtatgaaggatatgcattttaatgataatgaataa

SEQ ID NO: 111271 - DNA, 828 bp, Glycine max
  Peptide Sequence Number=SeqID_228049
atgactgcttttcttcagagtgaatttatgaacccttccattgagccgcttttggagctgggactcaatcatgaacaacaacaccaggagttgttgcttacggacatcaaatatattttaggtcacaatcctcttttcccggcgtaccggaaagataaggaagagagcaaggaaatagttctgaccggtgaaatgatcagattaagtgaaggtgtgtatgaaattggttttaatggtaatggcttttgctttgataacgaactgggaagacataaagtatacctcaacaattttgaaataagtgaccgtctggttaccaatggcgaatatctggaatttataaatgacaacggatatagggatttcagacattggcatgcagagggttgggactgggtgaaacaaaatgaggtgaaatcaccgttatattggcattggatcgatgaaaaatggatgtattatactttagatggtttacaggaagtagatcctgacgaagcggtttgccacatcaatttctatgaagcttcagcctttgcagcatggaaaggaatgcgtcttccaaccgaagcggagtgggaggttgcttccgtacattttcagtggggagaaaggtgggaatggacgggaagtgcttatttaccatatcccggatttaaaaaagaagcgggtgccgtaggcgagtataacggaaagtttatggtcaatcaaatggttttaagaggggcttccgaagctacaccgaaaggacacagcagaaatacatacaggaatttctttcatgcaaatcttcagtggcagtttacaggaataagattagcgagataa

SEQ ID NO: 111272 - DNA, 725 bp, Glycine max
  Peptide Sequence Number=SeqID_228050
tggactgcacatcctcagcaccagaggattgcatgtcctcaccttcagaggactacacgcactcccctatagaggactacaagccctcgccatcaaggggctacacgccctcgccttaccttcaagaggctacacgccctcgccttgcctttagaggtctacacaccctcgccttcagagaactacacgtcctcgccttcagagggctacacaccctcgcctttagaggactacgcgtcctcgactttagaggactacacgtctttgccttcagaagactagacaggattacacgtcctcaccttaagaggcctacacgtcctcgccttcagaggactgcatgtcctcgccttcagatggctacacgccctcgccttcagaggactacacgtcctcgctttcagagggcaacaggccctcgccttaagaggactacatggctacacacccttgcctttagaggagtacacgtctacgcctttcgagggctccacgccctctccttaagaggactacacgtcctcgccttgagagggctacatgccctcgcgttcaaagggcttcatgcccgcacctacagaggagtgcatgtcctcgtcttcatagggctacatgctctcgccttcagaggaagggtgtcataccctaatttcgtccggggaccttcgcttgatgacatgcgacctttctttggtccttgtgaggtgcttggcacccgtcattag

SEQ ID NO: 111273 - DNA, 561 bp, Glycine max
  Peptide Sequence Number=SeqID_228051
gcctacaagctccaatggagcttgcatcatgccttcagaaggctacacgcgttcgccttcagaggactacacgtcctcgccttcagagggctacacaacctcgccttcagagaactacacatcctcgccttcagagggctacacgccctaggctttagagggctacatgccctcgcctacacaggactatactacctcacctttacagggctagacattctcgcctttagaggatggcacgtcctcggcttcagaggactacacgtcctagccttcagaggactacacatccttaccttcagaggactacatttcctcaccttcgaagggctacatgccctcgccttcagaggactacatgccatgagagggctacaagccctcaattttagaagactacaagtgctcgctttcagagggctacatatcctcgccttccgatggctacacgccctcgctttcagaggattacacatgctcgccttccgagggctacacaccctcgcattcatagggcttcaaaccctcgccttcagaggactacacgtcctcaccttctga

SEQ ID NO: 111274 - DNA, 432 bp, Glycine max
  Peptide Sequence Number=SeqID_228052
atgcggaacatgcttttagtaaaggagacaaaacttccaactgatcagagcaacatatgctttttggatgaaaaacaatgtgtctattggggaagggagagtatgctgatgaaattttctcataacccgttaaatgagattttggatgttagcatttcgtttctaaatgaccatttagaggaagcactgggttcaacaaaaattgaagaaaatcactcaaagtgtatcaatctcacacattgcggggcgagaaagtcgctagcgcacaggattttggttggcaatcaaagggagaggaccactttaggtcgtgggcaaggattgacattctcaccctgggtcaaggtttatgataagttgggattttggccaaggcctgttgaacggctggtcatgatatatgtcagggtttggccagcggttcggggataa

SEQ ID NO: 111275 - DNA, 195 bp, Glycine max
  Peptide Sequence Number=SeqID_228053
atgacgtacgaagacctctttgcccgtcccctcatcgccaaccatttgggccgtggtaaactccccgaaaaagatgctggatggctgactttccaagaggatcggcccaatgtgaaaaccaacctgctcgccaatcatggagggggagcggttaacgccgttgagtccgataggccgcgcaggtctaaaccttaa

SEQ ID NO: 111276 - DNA, 138 bp, Glycine max
  Peptide Sequence Number=SeqID_228054
atgtcagtaaaaaacctcgtcaagtgctcaggagtacatgacaagacaaaccacacattgggagaccaatcagggtcacgctattttactagaatgcttcaaccatgtgggattgacacagacttaaaggagtactga

SEQ ID NO: 111277 - DNA, 520 bp, Glycine max
  Peptide Sequence Number=SeqID_228055
atgacggaagggtgtggtgaagggttttgccttgcaaaccttcccggtgatgcttttagtctatgggggaacttctttgaggcaaagaaacaaatgatggctgatgccaagtttgcggggctgcttggtcttggcaagccgttggttgaaattttgccccccggtcaacttcgtggtttttgcccgttgttggcttggctagggtcggcggtgctgggttatggccccgtgctaagtttcggattggttggccccctcctcccccccgtgatcagttttgttgccaggattttgccaactttggcttgcgccccgttggctaagtctgcacaagggggaggaggggcttggtcgtccgtccgcccgggcacacacctagttagcaccagcaggcaaaacgagagagagccgacgaacgggtttgttggtgatttggagggagggacgaatcaaagcgacagggctgaatctcagtggatcgtggcagcaaggcactctgccacttacaataccccgtcgc

SEQ ID NO: 111278 - DNA, 855 bp, Glycine max
  Peptide Sequence Number=SeqID_228056
atgggaattattacgctttgggggccgggcggcccccaggggagaggatcaggagaacagggcgatcagcaccggcgccagcaggctcagcaggaagccgtgcacgatggcggggggcaccatgtccagcccgccgctgcgctgcagcaccggcagggtgaagtccatcgaggtggcgccgcacaggccgagggcggtggagcggctgcggcgcaccagcgtcgggatcagcatgattgccaccagctcgcgcgccagatcgttgaagaacgcggcgctgcccatcaccgggccgtaggcgtcggtgatcagaatgcccgacagcgaataccagccgaagccggaggccatcgccagcccggccttgaccggcagccccagcagctgcgccgccagcgcgccgccggccagcgacgcgacggtcaccaccaacgccaccagcgtgccgcggcggttgagcacgatctggcgcagcgtcatgccgctgttgcgcagctgaatgccgaccaacagcagcaggaagatcagcgcatattcgctgcctttatgggcgaactgcagccattgccactgcgtcaggccgagcaggaagccgccgagcaccacgccgcacagcttgagcgactccagcgccatgtgcacgcgcgaaggcagcttttcctgtttatggctgctgcgccacggcatgcgccgctccagcagcgccagcaacagcagattggcgcagagaatgcagaagaagaacaccgcgctgtattggaagatcagcaccaggttgctgctgagatcttccatgaacgccaggctgatacccatgaaaaacaggatcacgtacaccatccagctcagcagccg

SEQ ID NO: 111279 - DNA, 678 bp, Glycine max
  Peptide Sequence Number=SeqID_228057
aaggaaggaagaatcaggattctatcttcatgcgaaggatgtccaaatgttccaatgatgagaacaaggggttgtattaattataatcccgtcctcgccataagacagcttggctaccccatgagaggagtgccatcagacgaaagcatcacgcctttcatcacacggggtttcagtgaccccaatgcgagggacagagagcttaggggaagcagtaatgggatcatcggcggctatcataagtggctgagagtccggacacaaggattggattggctcccaaatctaaagactgtgagagacaatggggttaaagcttcggaagaaagtgatgaggtacaagccctaaaggcaaagcttgaaagagcccgggtagtcaaagagaagttcaagtccatagccatcaaaggcagcaatagtgagctcaaactccgaagaggtgaaaggaatcatcacggtgagactgaagggaatatgtgggccatcatcgatgagtgcaaagagaagctaaatcaagcggcgactcacgagcaaaggctagaggatgagtacgccaagatatcagtagaaagggaagcaagggaaagggtaattgattcattgcaccaagaggcaaccatgaggatggaccgatttgctcttaccttgaacgggagtcaagaaatccccgattgttag

SEQ ID NO: 111280 - DNA, 492 bp, Glycine max
  Peptide Sequence Number=SeqID_228058
atggtttgtagggatcgcacccacaagacacccagtggacccgaagtagtccaacagggccctggggtttccatctctggttacgggcctctgttagtcctacagggtgccgttcccccagcaaggtcatgccatcgtgacataggaatcgcacccacaaagacaccagtggactcggagaagtccaacagggccctagggtttctagctctgggatcacgcccgcaagacacccagtggactcgaagaagtccaatagggtcttggagttgccaagctctaattacgggcctctgtcagttctacggagtgcctgtcgctcccagcaaggtcatcagaccccctactaatagagctttcatcaagaagtattgcgtccccaggcaggcgcagggcgaaacaccacaacagcctggggatggccggcagcgggcaacagacgcaccgccatcccctctagagttcacctcagctcatccacaaaaaggttag

SEQ ID NO: 111281 - DNA, 423 bp, Glycine max
  Peptide Sequence Number=SeqID_228059
atggagcaccggtcacaccagccaaacacttccgacctcccattaatagatcattcattgacaaatattgcatgccaaggcaagtacaacaattggagcagtttcagcagccttagccagcaacagattctcgaccaccaccatagcattcgccatccttggagtcaatctcaacacacctacagaggatggagctccagatgcacacttacatgcgtcatttggctgatcaaccctaatacctacccttggcctactcctgagcaatttagagctactattacatggcctggagaagcgcctattattcaggtggaggtaggtcctgcagatgcccaagaagctgcccaaggagatagaggaagagcagaggaagatgaagacatggaagatcttgtagattatttcattggaggaaactga

SEQ ID NO: 111282 - DNA, 249 bp, Glycine max
  Peptide Sequence Number=SeqID_228060
atgtatttggccactggtaatcgattacatcctctgaaaccctcagaggaagaaacaaaaacttcatcctccgtgctctccgatgaaaacctaaacctaatccaacaagatgaccaactatcatcaacagatgacgatgggcaaatcaatactctaacaagagacaagatctcttgtttgaagcaatcaattctatacctgacccccaggaaaagaaggtttttctggaaaaactcaagaaaacattag

SEQ ID NO: 111283 - DNA, 371 bp, Glycine max
  Peptide Sequence Number=SeqID_228061
gcggtgttgtccttgctgaggtgttgttggctgattcacgattcactcgaccggatatgggttttcacccaacaaaactcattttcgtgcctagcgatgcggatgaggcgccactcgatgtttccatttgcctgcatgcctttggtattgtggggtgtggttcgtttagtggtgtcaagtcttgcgaacgtgacgacccattccatccaggcctctttgttggggacgctggaggatttcaaagtcccacacgtgaaccactgaacgtgggtggtctagtgcccccacattgttccttaaaatcggttgtctcggatgacgcttgccctggcgcttgctttgttcaacgcgatgcttctactcttagttag

SEQ ID NO: 111284 - DNA, 510 bp, Glycine max
  Peptide Sequence Number=SeqID_228062
atggaggggcaagagcagatgaaggccgacatggaggccatgaaagagcaaatggccacaacgatggaggccatgatgagcatgaagaagataatggaagctaatgtggttgaagttgccgcttccagcgctattactaaggtgaacccgacgcccccatctggccttaacaaaatgaatcatccaacctcagatatggtaggcaaagatttgggaagtatgggcggcccccattatatgcaaattcaaaacaagcatgccttcccgccctatggcttgcctcccaactatacaccacccaatgtggcgtacaatcccactgagaatgtcaataaatcccctcccatgctcattgagagccaacaacctcaatctgatcatgcacatgtctctcaacccatgggggagacacatgaaattccccaccataatctagccaacttcgagccttgcctcggatatgccactgaagggaaagcagttggtggtatacccctgcaaaacacttag

SEQ ID NO: 111285 - DNA, 153 bp, Glycine max
  Peptide Sequence Number=SeqID_228063
atggaggttgaggaaccctggcagggcttatggctaccattgcattatcaagtggtgtttgggcattgggcgtgtgctgagcaggcaggcattatggctgatttggggatggcttttatggatgattgggtgaaaggaactgttattggctga

SEQ ID NO: 111286 - DNA, 582 bp, Glycine max
  Peptide Sequence Number=SeqID_228064
cgaccctctcggcgagtagaactcttcttcatcgtcctccaccgttgccgtcgattcctcccgaagcctcgaagtctgccgcgccagcggcggcagcggctggagctctggcgagtccattttccgagggttcaacgcggcagcgcgtgggtcagagagctcatcaacgccgccgcgggagttcacaatggtgccaaggtagagaaactcagagcttgtagaagacgtgtttctggctttccgggaagcggcgccggatgtggtggaggcttcgcgagggaagagacggatgctgctgtcggatctgagggttttatcgtcggcggagtagtttttgcggcggcggcggcagtagacgaaggcggaaagggcgacgaccgcggcggcgcaggcgacggcggcgatggcgacggcgaggagttttttggaggaagatttgaacttttgggtttgggggaggatgagagaggagatgttagcagggaaggaagcaaaggcagaaggagaaggaggaggaggaggagaagggtatgttgggaaaaagggtgtggaagaagaagcattggtattgggtgtggttga

SEQ ID NO: 111287 - DNA, 822 bp, Glycine max
  Peptide Sequence Number=SeqID_228065
atgcttcgggcttccggaatacaatgggatctccgtaaagtggataattatgaatgttacgaagaatttgattgggaagttcaatggcaaaaagaaggagattccttagctcgttatttagttcgaattggtgaaatgatggaatccataaaaattattcaacaggctttggaaggaattcccggcggaccatatgaaaatttagaaattcgctgctttgatagagaaaaagagccagaatggaatgagtttgagtatcgatttattagtaaaaaaccgtctccgacttttgaattgccaaaacaagaactttatgtaagaattgaagcccccaagggagaattgggaatttttctaataggggatcaaaatggttttccctggagatggaaaattcgtccgccagaaagggaaatatccgcagggatacaacaacgtattggacctgaatacacaggtccttttggagttcttcaagctctagcagacggaacaaaattacttttcaaagagaatcttattccatctagaggagatattcgtttattcagtataggaccatctatatcagtcatatcgattataataagctattcagtaattccttttggctataactttgttttatctgatctgaatattggtgtttttttatggattgctatttcgagtattgctcccattggacttcttatgtcaggatatgggtcaaataataaatattcctttttgggtggtctacgagcagctgctcaatcgattagttatgaaataccattaactctatgtgtgttatcaatatctctacgtgcgattcgttga

SEQ ID NO: 111288 - DNA, 264 bp, Glycine max
  Peptide Sequence Number=SeqID_228066
atgaatgctaaaacccgaatttccaatcaaaaatcgaaagaaaaagaagaaaagaaagaaaaggaagaaatgaaaagaaagaaaagaaaaggaaaagaaggattcccgatcaaagatcggaagaaagcaaaaaagggaaagattggaggaaaacataataattctcgatcaataaaggaaaccaggaaagagaacataagatcttcagaccagataaatgttcggcgaggttgctcccgactagcgatgtcccgccccgcataa

SEQ ID NO: 111289 - DNA, 297 bp, Glycine max
  Peptide Sequence Number=SeqID_228067
atgtatggcagtaggaaacgatgtgattttgagggggagttgtatgtatatgacgttgagggggagactgctgctgctgatgatgactgttgtaagctgatagaagatgctgcagtaagagcatggagacagggggagcagaagcagaaagctgatgtcacgagagatgtcttgacatcctggagaagacttgtagatgtgcaacttgaagaatttccgctgtgcttgattactctgataatggaagttgctgatcccacttgcataactgctcgtacctgctcaggaagtgtctaa

SEQ ID NO: 111290 - DNA, 285 bp, Glycine max
  Peptide Sequence Number=SeqID_228068
atggcttcctatggtgaagcaaaggactccattggtgaagaagttccaaggcctacaagctctacatggagctacattatctgtgctcttgtgcggctgacatggagggtggacacgtgtctaggagttccacaaaggatgccacgtgtgcgaaatctaccggcaagtgcaccggattgtcaaatgttcttgtgttctatgccgaggacaaaaataccaaacaccgattcctccagcatttggactaatttaaatcaaacttcgttcgtagatccctcttgttga

SEQ ID NO: 111291 - DNA, 237 bp, Glycine max
  Peptide Sequence Number=SeqID_228069
atgaggctaaatcgtgaagtggtaaaagtggtagttgcgctcagctcaccatttaggcttagcgtgcatccatcgttaagcacagcttcagtgcgcttagcacgacagaagaatctggcagagcatcaatatcaaggtcgcgctaagcgcgagatcagtgtgctaagcacagcggttgtcttcagccagactcagcgcatgactggcgctaagctcaaatccacttactcgcgctaa

SEQ ID NO: 111292 - DNA, 330 bp, Glycine max
  Peptide Sequence Number=SeqID_228070
atggaagtgagggacaaggttgaactccttccatatagggacctagatgagctagtccaactttgtataagagtggagcaacaacttaaaagaaagacttcttcaaaatcttatggctctcactcttatccaaggaaggaccaagcccatggaattttaggggctgcaccttcaaaacccaaggaagataaggggaaacatcccttagcactgccatattgcggcagtaaggactaccttctcctatcaagggaaacatcccttttcacacacgatgagttgaaaagggccctatactcgggtgcatgggaacataaggagtggaggtga

SEQ ID NO: 111293 - DNA, 939 bp, Glycine max
  Peptide Sequence Number=SeqID_228071
atgggacagttattgacaagtgcgagtattttggcaacagcagaaaaactcagtaatgccgaattgcttgccgcattaacctaccgtgcagcgaaggcgcttaatctgtctgatcgcggcacattgaaggaaggcatgcgcgcagattttactttatttaaaaccgataattaccagaatattacttatcaccaaggtagcatgcaaccccaagctgtgtggaaagatggtgtggaagagcttcgcgactatggccgaatctatatgtatcgctttagaccggaatatgctatgcatgcacgatcaatagcggattatccggcagtaagcaagcaggcggcagcgattatgttgatgattcagaacaatcttgatcctgccgtggcgcagcatcctcatgaactgataacttatggcggcaatggtgcggttttccaaaactgggctcaatatcggctcaccatgcagtatctttcacagatgacggatgagcagacgctgcatctttatagcggtcacccgatgggactttttccttcgtcccaacatgccccgcgtgtggtggtaacaaatggtatgatgattccaaactattcgaaaccggatgactgggagcgttttaatgccttaggagttacgcaatatggacagatgacagccggatcctatatgtatatcggtccgcagggtattgtccatggaacgacaattactgtaatgaacgccttccgaaaacatttagccgcaggagataccatcgaaggcaaggtctttttgacttcaggtctaggaggcatgagtggggcacaacccaaagcaggcaatattgcgggctgtataacggtatgtgccgagataaatccagctgcagcgagaacgcggtatgaccagggctgggtagatcgattgatagaacatatcggccagcttactgaacag

SEQ ID NO: 111294 - DNA, 210 bp, Glycine max
  Peptide Sequence Number=SeqID_228072
atggatatctttgaagatactgacatccctgtaatattgggaagaccattcatgttgaccgcaagctgcatagttgatatggggaagaggaagttggagctaggttttgaagatcagaaaattgattttgatttttttgttgaaaacaaagcctactccagaacacaatgtgtgcttacaggtaagggaaggaagtcaagaggttcttaa

SEQ ID NO: 111295 - DNA, 222 bp, Glycine max
  Peptide Sequence Number=SeqID_228073
atggatgaatgcatgaagaaatgcttatggcacaaattcattttatggacacgagaggccgaaaggttatctctttttaaatacagcatttgggcagcacagcgccccatgcatgcacttaagaaggagacacgggccttccaacttctcgtgacaaatgaggggatcaacatacaacacgtgcgtgacgacatgatgcagatgcgcaaaagtgcaacatga

SEQ ID NO: 111296 - DNA, 483 bp, Glycine max
  Peptide Sequence Number=SeqID_228074
gaagctgctcagtctggaagcactaataccgtgattgatcctccatctcctatcagacgacaggtgaagtggaagatgacccgcactaaggaaactgggcaaatgacgtctgaggcagcaaaggaaattgctgagaagattgtctcacaagccggtgtcacgatcaagaaatactttggatcggctccaaggacctcccacacatcttcctctatggctcctgaagacctagagcagttgacacaacaaatcagggaccagctggagggagtcatactgcctcttgagcctgaggttggtccttcagctgcttgtgtcagcacaaaggagagttgtgttgatccctcaaggaatgattcagacacgggaatactttatgagggatccacaaccgttcacaatattcatttgttgcatgaggtcaaggttggtgttgaggaggttagagatgcagatgctctcattcttgtacccactgaagag

SEQ ID NO: 111297 - DNA, 279 bp, Glycine max
  Peptide Sequence Number=SeqID_228075
atgtctcctccacctctaggacctctctatcactcacaaactcagctcacgctctcaggacgacttcattttccagctctgcggatggaccgaagcggtgcgcttagcgggatgacccttcgcttagcggacatgcacaactcatccttcttacagccaaggagtgttgtgctcagcggatggctcactaagccagcagattgtcttagcgagaaggtgaaaatcagcccttcacaaacttgcctaattaacctgaaattgagagaaaatgattattaa

SEQ ID NO: 111298 - DNA, 620 bp, Glycine max
  misc_feature (490)..(490): n is a, c, g, or t
  Peptide Sequence Number=SeqID_228076
atgggtgaaatagaggaggaacaagagcggatgaaggcctacatagaggccatgaaagagcaaatggccacaatgatggaggccatgatgagcatgaagaagataatggaagtcaatgcaactatagttgccgctaccagcgctgttgctgagggaggcaaagagttgggaattacaggcggcccccattgtgtgcaaattcaaaacaagcatgccttcttgccatatgacttgcctcccaactatacaccacccaatgtggtgcccactcccgatgagaatgtcaataactccactcccatacttattaagtgccaacaacctcaatttgatcatgcacatatctctcaacccatgggggagacacatgaaataccccaccacaatctagctgacttcgagcctcacctcgaatacgccactatggggcaagtagttggtggtgtacccctgccaaacactttggagggccctcagtttcgcccacaancactacccttgcattttgcggtgggaagagtccctcctactatggtggaaagggagaaattggatcatataccggaaaggctcagggtcattgaaggaggtggagatcatgcttttgctgacattgcaaa

SEQ ID NO: 111299 - DNA, 339 bp, Glycine max
  Peptide Sequence Number=SeqID_228077
atggaggactcttcctggcttgaagttcacttgaatcaaagagtggcagttcgtgaagagcagggctttgtccatgggaagacgcaggtaatcaatgagttctttgtgaccaacagctgctacattgttgacttggctgcaaacggggttgcacccaacactgaagctagtgtgggccctttgtcatggattggcatttgtgaaactaattcagcatttcctcagaacttttccctcatgtgcttccattgggcttgtgcttggtcttctgctatatccaatagctttgaaatatattctccaaatatgagagtggtttataaatacaacttctgctga

SEQ ID NO: 111300 - DNA, 135 bp, Glycine max
  Peptide Sequence Number=SeqID_228078
atggaggagacacgagaagatgcagggccagcagagcaagggccatctaatgatgagaccttaagtaataaggagtctcctcaacattttgacaaagatgttttgtcttctcaaaaagcatcacaaaaactctag

SEQ ID NO: 111301 - DNA, 729 bp, Glycine max
  Peptide Sequence Number=SeqID_228079
atgaatgcaagttgcatgagccctgcgtatgaggaaggcgttgaacagttcttggaatttgcctccgaaagaagtcgactggatgaggatgaaaagtatttttgtccttgtataaactgtttgaatgggagacgacaagcgcataaatgtcaggtgaagaagatattatgtccaatgggtatgaagtaccagaaaatatatgcatgtcctaatggttgcatactgtacagatatgagtttgaagaaatgcataaatgtcccaggtgtggggtatcatggcacaaagtaaaggatgataatgagtgcaacagtgttaaaagcacaaagaaaggccccccagcaaaggtgttatggtatcttctaatcattccaaggtttaagcatttatttgctaatggagatgacacaaaagaccttacatggcatgcagatgagagaaattgtgatggaatgcgaaaatacatgatgttgtctatgatgatatcgggcccaagacagtcaggaaatgacatcgatgtttatcacagtcacttgattgaagacttgacaaagttgtgggaaaaaggggttgtcgtgtttgatgggtatcaaaatgagacattcaggttgtgtgtaatgttattttgtaccattaatgactttccagcatatgagaatttgaatggatacagtgttaagggccatcatgcacaccctatttgtgagaagacacaagctatgtacaactga

SEQ ID NO: 111302 - DNA, 216 bp, Glycine max
  Peptide Sequence Number=SeqID_228080
atgattcttccggatgaccctttgtttcatccgaaagaaccctacttcaggaaattttctggaagaacttcttctggaagtttcgaaagaagtcttcacgattcttccggaaacagccaccgtaacaaggaggccaacctcaaaggcaaaacacgtctgatcgaagcagaagaagcagccgggctcgcgggactcgcggagaagaagaagcactag

SEQ ID NO: 111303 - DNA, 213 bp, Glycine max
  Peptide Sequence Number=SeqID_228081
atggatagactagtggttcatgttgatcctgctactgggaaagctgatggtccccacagaaggaaagctgaatttgatattccagaagcgtccaaccaaaggacaaagaagaaaatccttaagatgggactcgtattgcctcctgagcccgaggttggtccttctgttgcccgtgtcaacacaaagggaagttctgtctatccctcggggtag

SEQ ID NO: 111304 - DNA, 384 bp, Glycine max
  Peptide Sequence Number=SeqID_228082
atgacgtattattttaaattattttttcgcgcttctggtgcttcaactttactcttactcttacccgttcgacctcgcgatggtcttctccctcatgtttctaactcactgccatccctcacgttttgctgtgacgctgtcaccacctcacccgtgttatgttgtgacgtcatcaccacctcaactcgtgttttgttgcgacaccatcgtcgtttcatcctctctacctcacgacaaagatattgtatttggtttcgtggcctgttccctcgcaacttccttcccagatttattggtgttttggttgtttgcatgaatctggttttggttgtttttgacagtgtaggcctcactattgtttgtttgcatgattttggttcctag

SEQ ID NO: 111305 - DNA, 372 bp, Glycine max
  Peptide Sequence Number=SeqID_228083
atgttaatgtgtaatgatcaattttcgtgtgttggtccgattgagttattatgcaccattggaagaacaccagatggagtaataaacttacttcaacgcactatgccccgtactcatgatgtcatcatgtattacaacgggaaatggaacatgccaccccagaacaaatttgttggatgcgcgttcacaggaaaaaatcctaagaaatttcaaattccttcaacatgtaccatcgatgaactgaaggatttaataaagcaagttgcacctaaagggattccccctcttggaattcacgaattcaaacggtgttatttgatggaaccagggaacgacattaatttttttaggttctttgacgtccaaacatga

SEQ ID NO: 111306 - DNA, 312 bp, Glycine max
  Peptide Sequence Number=SeqID_228084
atggcttcagcgactaagcagcaacaagagggagagaaaccggcgaagcgaaaaccggttttcacgaaagtggatcagctgaaaccgggaaccaacggtcacactctggtggcaaaggtgttgtcctccaacactgtgttgcagaagggacgaccctcttcttcgcacaacattcgtcccactctcatcgccgagtgcctcatcggcgacgacaccggcaccatcatcttcaccgcgcgcaatgaacaagtgggtattctgggaatggggattagaattttgattatgaagtggctgactctgttggattag

SEQ ID NO: 111307 - DNA, 486 bp, Glycine max
  Peptide Sequence Number=SeqID_228085
ggtgtgttagataagacaccagtttatgttctattatttgacatgatgaaacccgataacacagttattcttcgtaatgcaaagattgacatgtttaagggatcaatgaggcttgctgttgaaacgagtggtgtgttagataagacaccagtttatgttctattatttgacatgatgaaacccgataacacagttattcttcgtaatgcaaagattgacatgtttaagggatcaatgaggcttgctgttgaaacgagtggtgtgttagataagacaccagtttatgttctattatttgacatgatgaaacccgataacacagttattcttcgtaatgcaaagattgacatgtttaagggatcaatgaggcttgctgttgacaaatggggccgcattgaggttactgatcctgcaaaattcgtagttaaagaggacaacaacctatctctggtcgaatatgaattggtgaacgtggctgaggaatga

SEQ ID NO: 111308 - DNA, 129 bp, Glycine max
  Peptide Sequence Number=SeqID_228086
atggttgaatcatttgtatgctctagtcagaagaggaggaagatccctcagaggttgcaggttcttagagtaggcgatagggatggtgagcggggtgtagatgaggtgcttttttccaaaaatgtttag

SEQ ID NO: 111309 - DNA, 411 bp, Glycine max
  Peptide Sequence Number=SeqID_228087
atggagaagatcttgctaagactaacccctcaatttgatcacatagttgttgcaattgatgagtccaaagatcttgaggaattgaaagtagaagagccacaaaattctctcgaggcgcatgagcaaaggctcaatgagaagtctagtacaagtctgaatcatcaaataaaagaagaggaagaactttcaacaatcaaagaagaaggaaagggcaagacaaaaagaaaattcagtgcttcaactgtgaaaaatgaggtcgctatgcctctgaatgttggcatggcaaagggaagcagaccaagaacagtgaagagaaggctaatgtggctcaagatgaagtttctgatgaggatcttgttctgttggttgcaaccagtgatggaactccccattcagaagcttgatatttag

SEQ ID NO: 111310 - DNA, 210 bp, Glycine max
  Peptide Sequence Number=SeqID_228088
atgacaaatctaagtagcttggcatatttccttgggttagaacttgtgactacttcaaagggaattatacttcatcaacaaaggtatgttatcaaagtgcttaaaaggtttcacatggcagattgcaatcttgctaatactccagcaaaggtatgtgaagggaacattggattatggtatattgttcctagaaagatagatcagaaacca

SEQ ID NO: 111311 - DNA, 273 bp, Glycine max
  Peptide Sequence Number=SeqID_228089
atgtgtaaggagttttatctacaacaaggtgcgggttgtaagaatggaagccattcttggcttccaagagatgctcaaggttgtgaaggaaggagtctctgcgagagaaagatgaagctgcaattaagaagaaggactacaaagcgaagtttcttttccatcaatgtgtggaccttgtggtttttgaaaagatctcaaaagccaaaatggctaaggcgacttaggacatcttgcagaaagcatacaggaatgctgagaagaccaagaaagtga

SEQ ID NO: 111312 - DNA, 258 bp, Glycine max
  Peptide Sequence Number=SeqID_228090
atgaaggagatgtgtaaggatttcaagatccaacaccacaattccacgccttacaagctcaagatcgatggggcagttaaggctgctaataagaatatcaagaaaatagttcataagatgatcgtgtcatacaaggattggcatgagatgctccccttcgcactaaatggttatcgaactttggtgcgcacatcaactggggaaacccctttctctttggtgtacgggatggaggatgtgctcccgtttgaggtatag

SEQ ID NO: 111313 - DNA, 263 bp, Glycine max
  Peptide Sequence Number=SeqID_228091
atgtcctcacctttacagggctacacgccctcaccatcagaggactacatgtcctcgccttacagagggctacatgtcctcaccttcatagggttacactccctcacctttagagggctacacgccctcgcacttagaggactactcgtccttgccttaagagggctatatgacctcacctttagagggctacacgcccttaccttcagagaactgcaagtcctcgcctacagagggctacatgtcctcaccttcataaggct

SEQ ID NO: 111314 - DNA, 357 bp, Glycine max
  Peptide Sequence Number=SeqID_228092
atgatgcaaggcatgactcagatccttcgtgccggcgagcaccttcactgcgtgattggtagcgacgtctgctcccctgactggcagaagagaatcatcggcgtgatgaaagagtcgcgcgcgagttcgagaacgagatttcgggaactttcaggtgaaagagaggatggagtgagtcagggaattcagattacctcagtatcaaggtttgaggatgagaacgaggaaaaactggtggatggaacgtgcattgagtgtggctctaccggggcagctgggagtgattctgcatctctaagtctcatattcaagaagccaagaccgaatggccatccaataggcatctcatcattctaa

SEQ ID NO: 111315 - DNA, 252 bp, Glycine max
  Peptide Sequence Number=SeqID_228093
atgattccccaacctcgttctcttcgtcaccaacgccgacaaggatttctcgaacttcttccttctccggatacactacacctcagtaacgcggatctgcgaggaggtcgacgaacgagatgtacttgtttacctttcgaccttgccctctatgagcgaattagcaatttgcgtgtccaccacgttgttcaacttgatgttgaactgaaagcacaacgcctccttgtcgcgtttgcaatcgtgaatcaatga

SEQ ID NO: 111316 - DNA, 419 bp, Glycine max
  Peptide Sequence Number=SeqID_228094
atgacggaagggtgtggtgaagggttttgccttgcaaaccttcccggtgatgcttttagtctatgggggaacttctttgaggcaaagaaacaaatgatggctgatgccaagtttgcggggctgcttggtcttggcaagccgttggttgaaattttgccccccggtcaacttcgtggtttttgcccgttgttggcttggctagggtcggcggtgctgggttatggccccgtgctaagtttcggattggttggccccctcctcccccccgtgatcagttttgttgccaggattttgccaactttggcttgcgccccgttggctaagtctgtgcctcgggagggacgaatcaaagcgacaagggctgaatctcagtggatcgtggcagcaaggtcactctgccacttacaataccccgtcgc

SEQ ID NO: 111317 - DNA, 606 bp, Glycine max
  Peptide Sequence Number=SeqID_228095
atgttttgcttgagatcttgtcttaacacactggagggtacatccctttgtggtacaagtagagggtacatctatttgggtttgactgagaacaatagaggatacatctcttgtggatcagttctagtggagggtacatccactaggttcaaagagaacaagggagggtacatcccttgtggatctttgcttgtaaaaggatttttacaaggccactcgatccaacatcttgaagagctcgttaggattcttaaagtccatgagcaagagtttgcacaagatgaaggaacaaagaaagggaagttgctagcccttacaactcaaagaccaaaacgtagcactacgtccaaagagtcattgtccaagtcccttgtcgtaagtgacaccttagaagaagaatctgatgatgactctgatgaagaagattatgagctgagtctgatcacaagaaaagttagaaaaatatggaaaaataagaactcgtctagattcaatggattgtctaagagatcattccacaagaaagagaaaagtccaatcatctgctatgagtgcaaaaatccaggacacttcaagttagaatgtcctgatcttgaaaagccatag

SEQ ID NO: 111318 - DNA, 1035 bp, Glycine max
  Peptide Sequence Number=SeqID_228096
atggaggaaagagagatttttagttctgggcatgctgttaaggttgttgaggccccccagagcttccacgtagcactaaactccgtgcagttttccgggcccacagtggagtcaccggtgccttctccagttccggcatcggcaccggcaccggcgccggtgagtgcttcggtgatgaattcaggtagtacggaagggaagaagaagaggggcaggcctaggaagtatggaccggacggcaaggtggcgctgtcgccgatgccgatatcggcgtcgattccgttgaccggagacttctcagcctggaaaaggggaagagggaagccacttgaatcaatcaagaagtcttttaagttttatgaagctggaggtgcaggaccaggtgatggaattgcatactcagttggtgccaatttcacacctcacatccttacagtaaatgaaggcgaggatgttactatgaagattatgtccttctctcaacaaggatgtcaagcaatttgcattctgtctgcaaatggcacaatttcaaatgttacactacgccaaccaacttcttctggtggtactttaacatatgaggggcggtttgaaattctctccttgtctggttcatatataacaactgagaatggattaacaaagagcagatctggtgggatgagcatctctttggccgctccagatggtcgagtaatggggggtggattggctggtttgctggtagctgcaggtcctgtgcaggttgttgtggctagttttgttcctggtcatcagctggagcaacagaaaccaaagaagccgagagtggagcatatatcaatggctgctccgacgtatgtcaaccctacttctgctgaagaaataagaattggtcttggtggagtaaagccaatcatgacaccggctgcttttcaagtgcaccacatttttggcaatggtcaaagctctgggaactcagcttctgatgattcagctcctttccctgaaaacgagtccaaccctagccatgcagatgctggagttgcatgctaa

SEQ ID NO: 111319 - DNA, 2232 bp, Glycine max
  Peptide Sequence Number=SeqID_228097
atgtctaaaccaaatcatcttttacaaaccaaaacaacatgtggatcacttcttgatgaacttcagataatatggaatgaagttggagagtctgagactgaaaaagatagaatggtgtttgagattgaagaagagtgtctagaagtatacagaagaaaggtagataaagcaaataggtctagagctcaactaaggcaggaaattgctgattctgaggcagagcttgcaagtatctgcttagcaatgggagagcgaccagtgcatgttaggcaggcctgggtaaaggaggagggttgtgttaggcccttagtagcctacgtaaaactggtccatatgcctaacatgtttgaccaaaaagctgtaagcttgaaacaagagctagcaagagttcgccaagagctggaggaaatgcaaaaaaggaagtctgggcgtagaaatcaatttatagaagttcaagaacaaattcaaagtatctcaaatgaaattagtccaagtattacagctattgtagatgaaactgatttatcattaagaaagcttgaagaattgcacagacaacttcttgcacttcaaaaggaaaagagtgagcgcctcaagaaggttcaagaccacctgtataccttaaattctctttgttctgtgcttggcttggacttcaagcagacagtcagtggagtccatcctagcttaggaaattcagagggacctaagagtgtaaataacgataccatcaatcaattggctattggtatacaaggcctgcgaaaagttaaattaaagagaatgcagaggctccaagatctagcttcaacaatgttggagctctggaatttgatggatacacctattgaagagcaacaagtttttcagaatgttacttgtaatatagctgcttcagaacatgaagtgactgagccaaacagcttgtctgagaacttcatctataatgttgaggcagaagtatctaggttagaagagttaaaatcaagcaaaataaaagagcttgttttgaagaaaagagtagagctagaggagatttgtcaaaagactcatttgattccagaaattggcagtgcaatgaaatatcctgttgaagccatagaatccggatctgtagaccctgcttgtgtgcttgaacaaattgaacttcgaattgcccgagtaaaagaggaagcttttttcagaaaagaaatacttgaaaaagttgagaaatggttgtcagcatgtgatgaagagtcttggcttgaggagtacaacagggtagggaccaacttacaccagattttaagtcttgggcacttattatactgttttagcaggttggatgaaaatcgatacaatgctgggagaggttctcatattactctcaagagagctgagaaagcccgtgccttggttaacaaacttccagcaatggtagatgctttaacttcaaaaactgtagcatgggaaaaggacaaaggcattgagttcacatatgatggtacctgtctgctctccatgcttgagaactactccctatcacggcaagagaaggagcaagaacgtcgtaggcagcgggaactaaagaaacttcagggacaaataatagtggaaaaggaggtactgtatggatctaaaccaagcccttcaaaggcccagagtgtaaaaaaagcacctaggttgtcaactagaagtacatcaagtaaaagaatctcccttggatgtcaaaccccaaaatctgattcaaaagctactcagtcattctccacagggaagacagacaaaaagaagattctccaccggattctcccaactactcttcttgatggctttttgataaggctgtatgtggcaccaaggaatgccagaagaggacttgatattgctggtgttcctttgagaaaatactctaccggtgctggaagtgttcttgacatggtatctcctttgacacgacaacctttttctcccatctctttaacattatcatcgaaagccaatgtcgcaaatgctgcaaatgatacacagaatgagaagttgcagaaaacattagtaacaaccacagtggccaatgaagagaacaaaactccaaaggcagtacctattcctgaccccactacacctttgaaattgttgaatcctatgaatatgtccatgactccaggtcctgcatcagttccttatggagtctcggctcaagagattgaatattcctttgaggaaagaaggctcggttttgtgttagcataa

SEQ ID NO: 111320 - DNA, 216 bp, Glycine max
  Peptide Sequence Number=SeqID_228098
atggtaaaaactttttccggaagaactttgaactaccggaggaagttgttccggaagaaattgttctggaagcagaactatgaacttccggaagtacttcttccggaagttgatttgtcaactttcggaagaagtagttctggaagagacttccgaaacaacttcttctggaatttcagtgttgtttttccggaagaacatcttccggaatgttag

SEQ ID NO: 111321 - DNA, 162 bp, Glycine max
  Peptide Sequence Number=SeqID_228099
atggttggatatgtcacttacattgatttcatgaataacatgggtcattgtaactttgaggtggttccaaagtggctctttgacatctttcctcctctcaaatatttcatggagtatttagctataggagtgcatgaaaaattaaagaagttaatatattaa

SEQ ID NO: 111322 - DNA, 453 bp, Glycine max
  Peptide Sequence Number=SeqID_228100
atgaatgcaaagagaagagaaaatatggttggtgtgcttccaaagagaagaatattgatgcggcatggggagtcacaggggaatcatgatacgacgatgtacaccaccatacccgaccacaacattcagtcaacggcacaaggcatgacccaagcccttcgtgccgaaaaacaccttcgccgcgtgataagcagttacggatgctctcctgactggcgggtgcagttctacgtgtccccctatgcccgcacccgatcgacgctctgcaagctcagacattgtttcttgaagaagagaatcatcgacgtgagggaagagtcacgagttcgagaacatgatttcgagaactatcaggtggaagagaggatgaagacttggttagtaggagatggattgacagaaaaggaacgactgaaggcacccaaaggaacattatttattccatacacataa

SEQ ID NO: 111323 - DNA, 204 bp, Glycine max
  Peptide Sequence Number=SeqID_228101
atggcgacggagatacctaagtggttattcgtacaaagacaacatctgttaatcccaattcatgaagtccggtggcaagcggagatatccgagtggttatccgtacacaactttctgttaatcccgacccgagagtccggtggcaggcggagatacccgagtggttatccacacaagacaacatctgttaatcccgacccatga

SEQ ID NO: 111324 - DNA, 246 bp, Glycine max
  Peptide Sequence Number=SeqID_228102
atgcgattccgatcttatggctccgcctcctccaaggaaatccagaaattcatcatccttcagctgcccctgtctctgtctaaggaattaccatccctcggtggcctcaaaatgctactgatgttccactctatggaatcggtgtttgtcgaagcctgtgtcggcttgcaaggccgcactagaactctcttcaatggtgcccttcctggacctcttcgcggggagcttcttcacggccaattctag

SEQ ID NO: 111325 - DNA, 495 bp, Glycine max
  Peptide Sequence Number=SeqID_228103
atggctcaggttcaaccaatcaacaaaaagaggaatgaagtggatagaaaggtggaggcaaaccttaaagaaattgaggaaataaaagttgcaactgatatggctttgaggaatgtagaaatggtagattctgcaaaggttgtagttaagggtgaactgaggcttgttgaagaacaatgtcaagggagggacctattatcccattactgtcaaaagggtacagcagatttcagctcagtgcaaattgccctacatataacttgttcattatgtgctacagttttttctgccattctacttaaggacaatgtttcaattgaaatcatagaagcaagaaatgaaagacatatttattgtgatgctgattgggcaagctatcctacaggccgacgctctactagtatgggaaaaaatagctgtaatgatcaaccagagagtgatctgaatcaaccaattttagtccaggatgaggaactaaaacctaggtggctataa

SEQ ID NO: 111326 - DNA, 498 bp, Glycine max
  Peptide Sequence Number=SeqID_228104
atgagggaagcgacaatgagggaagcaggcatgaggatgctcaccagactagttgcagcaccattagcagctttccgaatcagccaacagaaacttgtccagatgcttggtaatattcaagcgatgactcttgttggatggcagatcagaatggaacatgtcctaaataatcaaagaaatttcttaccacaaggaggaaattttgatgctggagatgcttgtggaaatgctgtagaaacgtctagtggtgaggatcaaaatagaactggtttaaaacagagacgatctttggtcatggtggattgtgagaggttgaagatgcaagctatttttcttgattctctcagtgttaggaaaactgagaaaatcaagacatcaaaattccgcgcatgcacaaccgtgatgatgccgatgtcccttagctctaccgtgctcgacaagtgcagccccactaggtgcttgcaccgtgcaccaagactcagcaattcagccctatga

SEQ ID NO: 111327 - DNA, 210 bp, Glycine max
  Peptide Sequence Number=SeqID_228105
atgttgtttggtgctggtcgaagtttggtcacgatgggtgaagggtggaggagatggtttttgtcggagatgatgcaacacgatgatggtggtgcgactgtgctatttggtggtggagtgagtaaagatttggtagaagacaaaaatgccctcccattggatagatgccacaaattggttgaggctaaaatggcattttctataggctaa

SEQ ID NO: 111328 - DNA, 330 bp, Glycine max
  Peptide Sequence Number=SeqID_228106
atgttgaaacgtgccaacactccaccaagggataatcccttaaagtttgaaatgcctggcataacattcacaagtgcagacttcaagggtatgggtcctgaacaagatgaccccatggtcattaccaatgaaacgcttataaaccagggtagcatgaccaacatcttgttttggaacacctttaagcaattggatatacctgaatcaacactacaaccctatggtgatctgctttttggatttgccaatgagagggtaggaatgaaaggatctatagagttgttaacaagattcgacaccaagattgggtatagggatattgtagtctag

SEQ ID NO: 111329 - DNA, 174 bp, Glycine max
  Peptide Sequence Number=SeqID_228107
atgacgatgaagaccaatgtgatgctcatcaaagatgtgtcacaaaaagcaaaaagatccattagggatgccttgaggcaaagggagcaagatgagggcaacgttgaccgaagatgcatcacgcgtcgtgtgcgtaaacttcacgccccaaagcatacatggggttgcgtgtga

SEQ ID NO: 111330 - DNA, 759 bp, Glycine max
  Peptide Sequence Number=SeqID_228108
atggatgattttggtgagcatggggatcaaaatttgtttcatcacaacaatgaccaaagtgatgtagagggtgttgccataccaatttcacccatgttgcaatatcaccaacctaggcgtccaatggagttgaacctcgaccacctaccacaatacattgatcaccaccatttcgttcagcaacaagaccctgtgcaactaccatttggtgcactcaagatgcagcttgaggatggacgtacccttgctgattacaacatccaaaaggagtccactctccacttggttctccgtctccgtggtgggatgcaaatctttgtcaagacattgactggaaagacaatcacccttgaggtggaaagcttaacgtcaaagctaaagttcaggacaaagaggatttttgtgaagacccttatcggaaagacaattactctggaggtagagagctcagacacaattgacaatgtaaaggcaaagatccaagacaaggagagtattcctccagaccagcaaaggttgatttttgctgggaagcagcttgaagatgagtctacccttcaccttgtccttcgtctgagaggaggaatgcagatctttgtgaagactttgataggtaaatctgtcaccttggaggttgaaagttcagacacaattgataatgtcaaagcaaaattccaggacaaggagggaatcctaccagaccagcggagggttgatctttgctgggaagcaattggaggatggaaggacacttgctga

SEQ ID NO: 111331 - DNA, 426 bp, Glycine max
  Peptide Sequence Number=SeqID_228109
atgaattcagagtcaatttgtgcgtacatttatatcaatggtgaggtcatctccgattcaagtgcaagtgcaattttcaaaggtgacaagacaaaatcaatactgttgaatccaacaatgaagttgcgagacataatcaccgcaatacaatcatcaattagagatgatgatgttacatctattattactgcactttggtatcgttgtcctgtatacatattcaatggttgtgttcagtatagggcagttccaatcattgatgaagaaggtgtttggtgcatgtttcatacatttacaaatatgacaagtgtaatatgtatggaacttaaagttgatgttcataattcatcatcatcttctcaagttaatgacctaaactggccagagatggagcaaaagctggagaattccttgaaattagaatga

SEQ ID NO: 111332 - DNA, 609 bp, Glycine max
  Peptide Sequence Number=SeqID_228110
gattcttcctccacttcatataagtatcctactgctcgtgttttcacgcattgtgttacagctaaattctcaaaggcaccaatttcattgctcagagttcccaaattctccccaagagataaaatgtctctaatcccaaacttcttcggtggccggagaaacaatgtgttcgatcctttctcactggacgtgtgggatcccttcaaggattttcctttcccaaatacgctttcttcagcttccttccctgaattttctcgggaaaattcagcatttgtgagcacccgtgtggactggaaggagaccccagaggcgcacgtgttcaaggcagatattccaggactgaagaaggaggaagtgaaggtgcagattgaagacgataaggttcttcagataagcggagagaggaacgttgagaaggaagataagaacgacacgtggcatcgagtggagcgtagcagtggcaagttcatgagaaggttcagattgccggagaacgctaaagtggagcaagtgaaggcttctatggaaaatggggttcttactgtcactgtccccaaggaagaggttaagaagcctgatgttaaggccatagaaatctctggttaa

SEQ ID NO: 111333 - DNA, 813 bp, Glycine max
  Peptide Sequence Number=SeqID_228111
atgaaggaatctattatctcattctcatctcagatggaggatattacagttacaacaacacaattaagtgagagtttcaatgatcgtttaaggctttacatgaaaccgacatataatgtgttgaaatttttcagaaactttgataggttactagatgatatgcgatacaaggagatagagtctaactatgagatgagccagaaaatgccatcgagtatgaatatcatgatttgtgtcgtgctagtgaaaatatcaagtaaggctgctgaatgtgaagaggctacaacatttcttgcaagaaaactggtggaacttgacattgaagttaacaatatcttaaataagagatcttccacgtcaacttcagctcttggtgacgcaaattgtcaaaataatgaagtcagtgcatatgacacaaccattggtgtttcccgagtcaagggtataaaaaagaaggaaggtgtgtcttgggtaaaaggtagaccaaaaagttgtgtgaagaaaacatgtaaaaaaggcaaagacactcacaagtatagtcccatgaggcaaaaaatttctacgaccatgtcaattccaattacacagaaaatgccacttctacatggatttcaagatccagagacaattggtattaatatgacacatttaatgagtaaaactcaggaaaatggagagcacatggaagaactttgtctttctatgtatactcatcaaggacaagtgcatttgaaggaaaatattgaaaagtgtccaagtcctgttcttcaaacaacaaatgttcctgggaggaacacagttgggttcaagtag

SEQ ID NO: 111334 - DNA, 417 bp, Glycine max
  Peptide Sequence Number=SeqID_228112
atgtcgatcatcccaaacgccaaccccttggaggactctcccttcacgacccagtccatgtcaaccctaccccaaagcgcagcaacgttgatgagcagtagcagcatcagccagttcgactggcacgagacaacggactcgcacgtgctgaaggccgaggtgccggggctgaagaaggaggagatgaagatcgaggtggacagcgagagaactcttcaggtgagcggggagaggaacgtggagaagaaagatgagagtggtgtggagcgtagcagctgcatgttcaagaagtgcttcacgcttccgcccaacgcaaaacttgatctcgtcaaggcctcctacgaaaacggtgttcttactatcactattcctaagatgaatgaggccactgctaaggccattgagaattcgtattga

SEQ ID NO: 111335 - DNA, 615 bp, Glycine max
  Peptide Sequence Number=SeqID_228113
atggattctgacttctggacctcgcgtcttgctgccgctaaacgccaatacacgcttcagcatcaccatccaaattctcacttagatcggttgggaatcgatgattttgatgtggaagaagaggtgagacctgattttccttgcccgtattgttatgaagactttgacatcgcgtctttgtcttctcatcttgaagatgaacattcttgtgaatcaagagtcacggtgcttcttggtggtggtggtggatatcggtcaaacagtgcagcagtgtctaatgctgctgctactgatccattcctatcctcatttattttgaatttccctgcttgtgaagcagaagaaatttcaaaatctgtggtaacaagtgctgacgattcttcttccaaaaatgcaacacctgtgcatatttggaaatcaagttttgatccctccttgagtactgaagagcgcgagaaaaggatgagacaagctgctgggagatctgctgcacctttgacatatagtgctgaatctgatcatagttatccttttatcccacccttaacactaggaccttatgctccctttcaagtggaatctgatgaagaagttgggaatttctcttttagatag

SEQ ID NO: 111336 - DNA, 552 bp, Glycine max
  Peptide Sequence Number=SeqID_228114
atggctacaccacccagctccccccatcctcctcctaagtcagcaacaccttcgtcgtctacgttgaagaagacaagaaaagcaacacggctcagatcattggctactagatcagttggggtggagagattagtggttcatgtggatcctaccactgggaaagtcgatggtccccacggaaagaaattaataatgtatttggggatcggcgcttgcgataaggttgatgttacatatgataattggaaacaagtccatgtagatcaaaaggatttgatctgggagttagatttgacctccaaatgtgctctagcagacgtcaaggagagcgacgatgataaagtatgtggaaattacaacataagcaaggagaagtggaaccagctttgtcagagccatagagacccttcatgggaggcctcacggggaagctttgtcgctcatggacatcaggatgtactgactactgtcattgggcgaccaaaacaccctggtcatgttcgtgctactggagccaacgtcacgattaaacaatactttggattggcttga

SEQ ID NO: 111337 - DNA, 99 bp, Glycine max
  Peptide Sequence Number=SeqID_228115
atggaggtgcataatggtgttgctgagagaagaagcagaatcattctgagcatggccaagatcatgatgaaagggaagggaatgcctcattacttctag

SEQ ID NO: 111338 - DNA, 291 bp, Glycine max
  Peptide Sequence Number=SeqID_228116
atgacacaagtggcatacaatgcttcaaccaacaacttttcacaagatatgcagtttttcaaagatatgatcataataattagcttttacttgctgcttattgattttactgtgtgtgttgtcatcttaccacaattgctttcacccaataaactcctccaaatttgggacaaatttgccttgaactatgatgctctcctacaacctaaggtagatggagattgcattttacaagctcagggttcaagtcaatcaatcaaattttcagctcaacatgggtgcaagggataa

SEQ ID NO: 111339 - DNA, 390 bp, Glycine max
  Peptide Sequence Number=SeqID_228117
atgtcaggatttacacgcaattctcctcaaatttcagccagcccgcatcaattagaccttgcaccttacgcttcagggccctacaatgctcaatggaacgccccggggcttctccgtgacaagcacacgttgcgttcgagtcgtattctcggagaaatggaggttgatgaaccttggctagggttatggctaccattgaattatcaagtagatatgggatcaagtttagcatatgacaacggaatttggggtgaaccctacaggctttttgctgcaaaattcctttttgttgggattgcctttgtggataactgggcggtgggtaaggagaaggaatggcagtcacagcatgggcttctccctcattctcaccctcttcatttgccctag

SEQ ID NO: 111340 - DNA, 413 bp, Glycine max
  Peptide Sequence Number=SeqID_228118
gttaaagaatttgagaatagctagacatgggaaatttggagaaaattctgctaggtcatcagtacttgcatgggtatacagaccaactaaaccaaggccaaatgattttgaattggtacaacctagccggccaaattcaattcaggcaagattgattccactagtgcagccgaattcagctgaaggcagttcagctaatacagccgaattcagtgcatgcaggaccttcttggatggttcagccaatatgattcaagtaagaccaacaccaattcagttgtgttatgctcaggcaagccaggctttgcaagtccaaccaaatttcactcaacatgtaccgtatagccattcttggcccaatcaggttcatccgccacttccaatcaattgcttgcttgaatcgctgtttggag

SEQ ID NO: 111341 - DNA, 315 bp, Glycine max
  Peptide Sequence Number=SeqID_228119
atgccgagaagctttcaactaaaagaagtatctccaaggatgtggatacaagttattaacaactatttcgaaagacacaagaaatacctccattattatcagttaatggtacaagagtcttcaagtgcacttgcagtgcatacaataatcaaaatcaagccaagcacaaaacatgcaaaaagtgcacaaacatatacaatgaaaaacaaaaacattaaaaaacccaaaaacagcctgtaccgtgaacaggtgttctcgctctccaaacctccaaacagcgattcaagcaagcaattgattggaagtggcggatga

SEQ ID NO: 111342 - DNA, 465 bp, Glycine max
  Peptide Sequence Number=SeqID_228120
atgggtgaagtagagaaggtgcaagagcagatgaaggccgacacggaggccttgaaagagcaaatggccacaatgatggaggccatgatgagcataaaggagataatggaggtcaatgcggctgcaatagccactaccagcaccattgttgaggtggacctgacccccccatatggcctcaaccaaatcatccaacctcagatatgtgcgaaaaacaagcatgccttcccaccatatggtttgcctcccaactatacaccacccaatgtggcatacactcccagtgaggatgtcaataactccgctcccatactcattgaaagccaacaacctcaaactgatcatgcacatgtctctcaaaccatgggggagacacatgaaattccccaccacaatctagccgacttcgagccttgcctcggatacgccactgaagggcaagcaattggtggtatacccttgtaa

SEQ ID NO: 111343 - DNA, 255 bp, Glycine max
  Peptide Sequence Number=SeqID_228121
atgggatccgttgggaaaactctcaacatcagtaacaccttcttcaacaggaaccacaaagaagatgaggaagcaacgaagaagatgaaccacgaagaagaagaagatccaggaagaagaagcgtgagcgaatggaggaagaagaagcatgaaaaaattgaaaaaatgttgggtgcccaaaacaacaacctttggtttttggtcaacaattcatgttcttacgactccatcctcttttattttggaactggataa

SEQ ID NO: 111344 - DNA, 267 bp, Glycine max
  Peptide Sequence Number=SeqID_228122
atgaagccactccacttaacagctatggtagaagaccaaatcattaataggcatgggaatggggcccgaactcgtgaggcctgccctggacatgccccgattttgatggggaaaatccgagttgatcagggtcggggtcgggtttgggtttttcctgacaaccaaagttgggttcgggatcgggattttctaagcatgtcgggggcagggcgaggcggggtggggcggggaaaacctgatcccgtcgagggcagggataggggataa

SEQ ID NO: 111345 - DNA, 150 bp, Glycine max
  Peptide Sequence Number=SeqID_228123
atggagatccaagatccagacttccacatggaccatgaaccatatggtttttttactaatgaatacagttctagatcatcttgttgggaagattcaacggattcagcaatctatggatttcaggccagtttggattgcaagttaaagtaa

SEQ ID NO: 111346 - DNA, 636 bp, Glycine max
  Peptide Sequence Number=SeqID_228124
atgttccagccgtatactgttttagatgctgatggttttccagtctatcgtagaagaaacaatggtaatgcaattgagaaaaatggtgttataattgataacaggtatattgtaccttacaatccaagatttatcagaaaataccaagcgcatatcaatattgaatggtgtaaccaaagcacttctatcaaatatttatttaagtacatcaacaagggatatgatagagtgattgctattttgattgatgaagataatgatcaaactgagaatggtgacactcataatgatgagatcaaagaatatctagattacagaaaacctgctgttgaaagattacacttccatcttccaggccaacatagtgatctctatgaagaccatgatgatattgatgatgaattgtctaagccaagtatctctgattcaaagtttatttcatggatgaacaccaaccaaaattctgttgaagggagaaatcttacttatgcagaacttgtttctaagtttgtataccatcagaagaaaatatgttggccccttaggaagaaaggctataccattggcagattactatggggttccaccaattataggggaattatcttatttgagaatgatgcttactgtttgtaa

SEQ ID NO: 111347 - DNA, 2586 bp, Glycine max
  Peptide Sequence Number=SeqID_228125
atggaatcgggggtgggatcgggtggttctggggttgtggtgaagagcagaaactcctcgggttgtttaattgtgcgaaagaaaggggatgggttgggtgctactgcttccacctctcggaagctctatgaatccaagaaaaggccaaacatcaacgtgcctgtgtcctcgagtgattctggttcaagcgacgagttgctgatgcctcctggtagaaggcttggtcccgagactattcgagtttgcaatggtttggttgcctctgagcgggttgggagtgaaattagtcggaagagggatagagtgggacgaattagcggtagtggggagggcattggtgcggagaaaggtttggagcagtgggaaaggaagcgtagtaagttggatgtatacgatttcgatgaatacgatggcatggatgtggagaacatgaggaggaggcatttggatggtcctgggggaggaaggtttatgggatcagtgcatgctgctacaagtggcattgatagggatttcagaacagggtcaagtggacgtgttcttgataagagaaagaactcctatgctgacaggcctagttgcttctatccggaagattatgtgtgtaacagtaggttcaagatgaacaatgatggagctcaggtacctccaccctcgcagagggagaagtttaattcagacgagtccattagggttcaggggaagaatggtgttttgaaggtaatggttaataagaagaaggtgggtggtacatcagaacagtattatgatcatcacaaacccttggaaagcaggcaaaggttgaagaccgaagaaactgccaagaggttgaagaccgaagagactgccaagaggttgaagactgaggggactgccaagaggaatattccaattcttaaaaaaaatgaaaagaaacctgttgataaaccagcattacttaagaggccagagaagaaaaggacagcatcaagaaaatcgttgtcaagcaaggacagtaagggtgatgagggggattcagataacagtgacacatcattgaatccaagaataagaaatactgaagctcgtaagtctgtgaaaaaaataatctctgaggatgagcagactcctgtgcgcgaaaaaaccccaaccacaagaacgaaagaaggaaaaatcaagcgtggtagtggtacagaaaaacagaaactgcgggaacaaataagagagatgctgctgaattcaggttggacgatagactatcgacctcgaaggaacagagactacctggatgcagtttacattaatccagcaggtacagcctattggtctatcatcaaggcctatgatgctcttcaaaagcaatcaaatgatgatgctgatgaggtcaagcccaaaggggatagttcttcttttgctcctattgctgatgaggttctcagtcagctaacaaggaaaactaggaagaaaatggagaaagaattgaaaaagaagaagaaaaggcatgatagtgaaagtgataatgagaaagagcctcaaataagaagatctgccagccacaagcgtgatatgaatagcatggatagtgatagcaacgaggagaaattaagctcctttataaaacagggaaataggtcaatgaaaaacaaaatgtttgaaaatacctctatcagtgctcgctctaaaatccagaatgctacccatcaatcaagtgatggaatagaaaaaccattatttggatgtgatcctcatatacacggacggaagagtaaaaaacatggaagatgtaccttgttagttcgcagttctaacaaaggatcaaattcagaatctgatggctttgttccatatatgggcaagcggacagttcttgcctggttaattgactctggaacagtagagttaagccaaaaggttcagtaccgcagacggaagaaagtcatgctggaggggtggatcacaagagacggcattcactgtggctgctgtagtaagatcctcacagtttcaaagtttgagcttcatgccggtagcaaattgcctcagccatatcaaaatatatatttggaatctggagtttctcttctacagtgccagatagatgcatggaatagacaagagcatgctgaaaaaattggtttccattcagtggatattgatggaaatgatcctaatgatgatacttgtggtatatgtggagatggaggggatttaatctgttgtgatggctgtccatcaacatttcatcagagctgcttggatatccagatgcttcctcctggtgaatggcattgtccaaattgcacctgtaaattttgtggcatagccagtgaaacttctgataaagatgatgcatctgtgaatgtcctacgcacttgcatcttatgcgagaaaaaatatcatgactcttgcactaaggagatggatacccttcctaataatatcaattcatcaagcctttctttctgtgggaaagagtgcaaagagctttctgaatacttgaagaaataccttggtaccaagcatgaactagaagcggggttttcatggtgtctcattcatagatcagatgaagactcagaggcagcttgcaggggacttacccagagg

SEQ ID NO: 111348 - DNA, 228 bp, Glycine max
  Peptide Sequence Number=SeqID_228126
atgagatttttgaacatgttgaagagatgcttcaaagtcgtaccagagttggctttaagggttttcaattggctaaagctcaaggatgggtacagtcacacaatgcagacttacaataccgtgttgcacattgccggaaaagctaaagaatttgggttggtgaagaagttggtggaagaaatgagtatggagtccaaaatgatgttaactcatggaccatttttataa

SEQ ID NO: 111349 - DNA, 222 bp, Glycine max
  Peptide Sequence Number=SeqID_228127
atgacaattctcagaagattcgaacctccactgcaatggaatgtagttgtgctcaacaaaggcatcaatgataagtatgccactctcccttggtacaaattccttcaagaaggtgattttagccatggagacgagctctcattctactataggcgtgctgagaagatctgggaggttgtcatcaggcgtgcaattgattgggatgatagtgatatagattag

SEQ ID NO: 111350 - DNA, 225 bp, Glycine max
  Peptide Sequence Number=SeqID_228128
gatggaaggactttatgtacatcaacaccaaaatatggaataggaaaagaggctggaaatgagaaaggttatctcattggaatgtctgtttgttatccacaaccgggttcaatcaagattcatgatggtgaaattttgactctagaatctagatataaaaatgagtttcgtactggagctatggaacatttctacatctatttggcagaggaactaccacaatga

SEQ ID NO: 111351 - DNA, 261 bp, Glycine max
  Peptide Sequence Number=SeqID_228129
atgagtgttgcgcttagcggacgctcgctaagccagcagattggcttagcgagaagtaaacaagctgaggatgaggaagatgaggattgggggcttcccctagagctaaaaagaatggtcgaacaagaagacaaggaagtaaagccacaccaagaagaaacaaagattgtgaacttgggtgttggcgaggaaagaaaagaggtgaaggttggcacaggcatgtccatgaatattcgggatgaattggtagctctgctgtga

SEQ ID NO: 111352 - DNA, 207 bp, Glycine max
  Peptide Sequence Number=SeqID_228130
atggatacactaagattcttggaagggaagattcaggcaaagtccatcatgcttttgggcttttgcattgagagtagccatcgaattcttgtgtatgagttgatgccaaaaggaacattatccagttttttgtttggagagggtgaaaagcctcaatggggtcacagggttgagattagctgttggagtcgcaagaggaaaaagtag

SEQ ID NO: 111353 - DNA, 982 bp, Glycine max
  Peptide Sequence Number=SeqID_228131
aaacattgaggaagcactagatgatcccaattggaaattagcagtcttagaggagttggatgcacttaggaagaatgtgtttatgagtcttccccccggatttgaggaagaacttggaagaaataaggtgtgtagattaaagaagtcactatataggctgaagcaatctccaaaagcatggtttggaactgtggtaatagagcttggtgatgatagcttggagctcaaaggtttgaaggagaaacttgccaaagcttttgaaatcaaggaacttggcccattaaaatacttccttagaattgaatttgcaagatctaaggaaggtatttttatgaaccagcggaagtatattctggatcttttaaaagaaacaggattacttggatgcaaagctgctgaaacaccaatggagcccaacataaaactgcaaccagctaaaactgaggatatggtggacaaaggaagtcagtttatgcacacaccaagacccgaacatttgaaggcagctttcaggatcctaagatacttgaaggggtcacctgggaaggggctactctataaacatcgtgggcaccttcaggtagaagcctacactgatgcagattgcaagaaacaaagtgttgtagcaagaagcaatgaagaagatgagtttagagcagtggctcatggcatttgtgaggtgttgtgggtggaaaaaattctacaagaatttaaggttttcaattccccaccaataaagttgtactgtgacaacaagtctgcaatatctattgcacacaacctagtcctgcatgataggaccaagcaagtagaagttgacaaacactttatcaaagagaagatcgaaaggggacagatctgtattactcatgttcccactgcagaccaatcagcagacatcttaaagaaaggattacccaagaaactgttcaacaacataaccagcaagttgtccaagaaagatatctccaagctagcttga

SEQ ID NO: 111354 - DNA, 237 bp, Glycine max
  Peptide Sequence Number=SeqID_228132
atggagctccgcgagaagcaccattgggagctagaaaatctgactctgaccacacaacctctcaaaacgttgaaattcttcacattagctgttattcaatacatcaagaaaacagcaatatatctattggcaaaaggtggatgggttatgcttttcagtgttgcagttgggactcttggcatagtgctgatgacccttggttgcctccatgagaaggtatttgtattcagtcagtaa

SEQ ID NO: 111355 - DNA, 168 bp, Glycine max
  Peptide Sequence Number=SeqID_228133
atggtggctcgaggggcagtcgtgatcacgcaagagagcgacattggtggctcaacggatgaacatactaatctcacatcttcacaacttcccattgtcttggacaaggaatttcaactagtcaattttgaggactccaactcagataatgcttcttcacaaacatag

SEQ ID NO: 111356 - DNA, 552 bp, Glycine max
  Peptide Sequence Number=SeqID_228134
atggcattcatagagaaagctgtggttttcttgatgatgacagctttccaagtttcaaattcagctgttcacaaggttggggactctgctggttggaccatcattggtaacatagattacaagaagtgggctgctactaagaacttccaagttggtgacactatcatttttgaatacaatgcaaagttccacaacgtgatgcgagtgacgcatggtatgtacaagtcatgcaatgcatcatccccgttgacgaggatgagcacaggcaatgacaccataaagataacaaactatggtcaccacttgttcttgtgtggcgtccctggtcactgccaagcaggacagaaggtagatattaacgtggtgaagaaggtatctgcagaagcaccaacaccatcaccaatatcagcaatggcctctccagttccacctgcaccttctcctaacaatggagccccattcattgttgtaaagggagctttaataatgccactgcttgcacttgctctttctagctatgcatcattgggaatatctctacttgttaattag

SEQ ID NO: 111357 - DNA, 1638 bp, Glycine max
  Peptide Sequence Number=SeqID_228135
atggccgtcggaggtttcaccaacgccgccggtggcgccgatttcgaggccaaaatcactcccatcgtcatcatttcatgtatcatggctgccaccggaggtctcatgtttggctacgacgtcggcgtttcagaggctcaatcgattctgattttccttgacgaggatcacgattcatgtggcgctaatatgggaatcccacgtggtgtgacgtctatgcccccgttcttgaagaagttttttccgacggtatacagaaagacagtggaagagaaaggactggatagtaattactgcaaatacgacaaccaaggattacagcttttcacgtcgtctctgtatctggctggtttgacttcaacgttcttcgcttcgtacacgactcgtaggttgggaagaaggctgaccatgttgattgctgggttcttcttcatcggtggagttgtcctaaatgctgctgctcaagacctcgccatgctcatcgttggaagaatcttgcttggttgtggtgttggctttgctaatcaggccgtgccagtgttcctctctgagatcgcaccttcaagaatacgaggagcattgaatatattgttccagcttaatgtcaccattggcattctatttgctaaccttgtcaactacggcaccaacaaaatcaaaggtgggtggggttggaggctatctcttgggttggctggtatcccagcagttcttctgacattgggagccttgttcgtggtggacacccccaacagtctgatcgaacgtgggcgcttggaagaaggaaaaactgttcttaaaaagattcgcggcactgacaacatcgaacttgaattccaggaattggttgaggccagtcgtgtggctaaagaggtgaagcatccattcaggaatcttctcaagcgcaggaaccgaccccaactcgtcatttccattgcccttcagatattccagcaattcacaggcatcaacgcaatcatgttctatgccccggttctcttcaacaccttaggattcaagaacgatgcatccctctattctgctgtcataactggtgctgtgaatgttctctccaccgttgtatccatctactcggtggacaaactgggacgtcgcatgctcctgctggaggctggtgtgcagatgttcttgtctcaagtggtgattgcaatcattctgggaataaaggtgacggaccattctgatgacctttccaaaggcattgcaattctggtggttgtgatggtgtgcactttcgtgtcttcctttgcatggtcttggggtccccttgggtggcttatcccgagtgagactttcccattggagactcgttccgctggtcagagtgtcaccgtttgtgtcaacttgctcttcaccttcgtcattgcacaggcattcctttctatgctctgccacttcaagtttggcatcttcttgttcttctctggctgggtcctcgtcatgtctgtcttcgtgcttttcctgttgccagaaacaaagaatgtccccattgaagagatgaccgagagagtgtggaagcagcattggttctggaagaggtttatcgatgatgccgcagatgagaaagtagccaatgtctctaatggtaatggatttgatccaacctccaggttgtaa

SEQ ID NO: 111358 - DNA, 2091 bp, Glycine max
  Peptide Sequence Number=SeqID_228136
atgtctgatgcaagaggtacaggacttgctgctgttgtcatcaatattgctgttgaaaattttgctggctggaagttctcagtgacatttaatataattcagaaatcatatattgctggatttgtcgtatatgtcctgatcaacttggctttggtgttttcctctgtatatattatcacacaatttgcaccagcagctgctggatctggtattcctgaaatcaagggttacttaaatggagttgatattcatggcatccttcttttcagaactttaattggaaagatatttggaagcattggttcagtgggtggaggccttgctctgggtaaagaaggtcctcttgtccatactggtgcttgtattgcttctttgcttggacaaccagaaattagtgattggactagcccgacaaggctagcccaattccagcttgaaagtagtgaacaggtaacctgtggatgtgcagctggagttgctgcagcatttagagctccagttggtggtgtattgtttgctttggaagaggttacatcttggtggaggagtcaactcatgtggcgtgtcttcttcacctcggctgttgtggctgttgtggtccgagctgcaatggggtggtgtaagagtggaaaatgtggacactttgggtccggtggattcataatatgggatatatcagagttaagatctaagctattacctttttcacttggtcaagaggattattcctttgcagagttatttccaatggctattattggggttattggaggcctactaggctctttattcaaccagcttacactttatattaccacttggcgtcgaaatcatcttcacaagaaagggagcagggtcaagattattgaagcatgccttgtatccattttaacatcagccatttcatttggcttgccacttctaagaaaatgtagtccttgccctgattctgatcttgcatctggtattgaatgcccacgacctcctggaatgtatgggaattatgtaaattttttttgtagcaaagacaaggaatacaatgatctcgcaactattttcttcaacacacaggatgatgccataaggaatttattcagtgcaaaaacaataaatgagtacagttcccaaagtttattaacctttttggttatgttttatgcattagcagtgatcacgtttggtactgctgtgccagctggtcaatttgttcctggtataatgataggatcaacatatgggcgtcttgttggcatgtttgtcgtaaagtattacagaaggctcaacattgaagagggaacgtatgctttgctgggagctgcatcttttcttggaggctcaatgcggatgacagtatctctctgtgtcattatggttgaaatctcaaataacttaaaatttttacctcttattatgcttgttcttcttatatcgaaggctgttggtgatgcttttaacgaaggtatctatgaggagcaagctcaattgaggggcattccattactggaatcaaggcctaaatatgagatgcggaatatgacagcaaaggaagcctgtgggagtggaagggtggtctctttccctcgtgttgttaaggtttctgacgtagtttccattctgcggagcaacaaacacaatggttttccatcaaaggttgatttccagcatagccctttaccctctgatccaagaggtgggggcagatcaattaggcatgattctggtgaatttgcaaagcctgtttctagtaaaggaatatgtattgatgatatacatctaagttcagatgacttagaaatgtacattgatcttgctccatttttgaatccctcaccatatattgtaccagaagatatgtctttgacaaaggtatacaatcttttccgtcaacttggtcttaggcatttatttgttgttcctcgcccatcatgtgtggttggtttgataacaagaaaagatttgttgattgaggacaaagaaaatgtgaatacgttagagcttcagtcaactagtaaagtgtatgcatttatggacatctttgtcagattatctcttcaaaagaaacatgatttttcaattattgacaacttctaa

SEQ ID NO: 111359 - DNA, 246 bp, Glycine max
  Peptide Sequence Number=SeqID_228137
atgctggccaatcatttccaaaacggcatcgaaacggcgaggctcgtttggtcgcggattcctaattcggaagaatcgcagctcctcgacgacgccgttggcatccttaagaagaacgacggaggctgtgtcgagagccttgactatgaagtcattgagaattttgcttatcgtgaggaacagttacgaaatgatattgtgctgtgctttgagatttgtaggcgcagagagggaagctgtatgtga

SEQ ID NO: 111360 - DNA, 951 bp, Glycine max
  Peptide Sequence Number=SeqID_228138
atgtcttttggatggaatttgcaagcacccggacatgatttacatggtgtttattggtccacctgtgatggaaacaacttcaacaatggcaaccggaaacgaagcaggatcagctattatcatgggaattctaacattcataataattactgggcagaacacggtgtctattctaatgtttaccactttgattatggtaatcattttcagtgtgatgcagacccgttatctttgaaaaggagaaaacattcatctcctatttgtgaaaacaaccagaaatactatcttccatctactgtccaaggcaatatcccttcatctgttaacttccaagcatctcccacaagatccaatgttgatacctctgtatcacctatctgtaagcttgattgttctatatttgaagataaagagctggtgtttatgtcaagggatgagattgatagatgttctccatcaagaaaagatggtattgatgtacttcgtgagagacacttgcgctactcttactgtgccttccttcaaaatcttgggatgtggctcaacttgcctcaaactaccattgggacagccatgggttggtttgaaaagtatcatgatcgagtgcttgaggcagagctgttgttgcttactactctaaattttgaactcaatgtggagcatccttatacatctcttacatctgtccttaacaaattagacccatcaaagactgttttggtgaatctggcattaaacttgatcagcaaagggcttcagagctctctatggcttcagtataaaccacatcatattgctgctggagctgcatatcttgcttcaatgtttctcaagattgatcttactgcttatcacaatatctggcaagagtttgaggcaacaccatccattcttcgaggtactcttcacccactcctcccttccttccctttctcccctttcccttgttaa

SEQ ID NO: 111361 - DNA, 743 bp, Glycine max
  Peptide Sequence Number=SeqID_228139
agggctacacgccctcaccttcagaggattgcacatcctcaccttcagaggactacacgtcctcaccattaaaggactgtacgtcctcaccttcagaggattgcacgtcctcacctttagagggctacacgtcctcaccttcagaggactacacgtcctcaccttcagagagctgcacgttctcaccttcagaggactacgcgccctcacctttagagggttgcacgccctcgccttcaaaaggcgacacgtcctcgacttcagtgggctgcacgccttcgcctatagacggctatgcgtcctcactttcaatgggctccacatctgcactttaagagaatttaagagggagtctatcacgcatctactatgcatactggggcaagatttcacccatgctgctgcaaagagacgagtgcggatcatgtgcaccaacatgaccactcttacacagatatggatgacgttgctacttagcaacattttgtccagcgaccacaatgccgatctccccctgcagaagtatcagttgggatcacacccacaaagacacccagtggaccaagagaagtccaacaaggtcttgggatttccagctctgattacgggcctttgtcagttctacagagtgcccgtcgcccccagcaagggtgagacaccacagcagcctaggcatggccggcagcaggcaacaggcgcaccgccaccacctctagagttcacctcagctcatccacaaaaag

SEQ ID NO: 111362 - DNA, 207 bp, Glycine max
  Peptide Sequence Number=SeqID_228140
atgaggcttcattgtcatcaaacgagtcggagacctagcatgaccacaaatcgacctccactccttatggctcacatagacccgggtataaggcctaatatctcaatgtgtgtgcgaggtgtagggcctaactctctaacagtccccagcggagtcgccaactgtctcaacttacccttcggcgggggcgtgaaaaggccaagatag

SEQ ID NO: 111363 - DNA, 1168 bp, Glycine max
  Peptide Sequence Number=SeqID_228141
cgaggccggcatgaacgacggttcagcgctgccgctgctgatgctggcgctgctgctgatgcatccgggcgccttcagtctggagttgctgggcggctgggcggcgcgcgatgtggtgtgggcgattggcggcggcctggcgattggttatctgctcggccggctgatcggccagctggcgacccatctgcgcagcgcgcatcacgacgtagcccctaatgatttcctcgcgctggcactgatcgccctgagctacgcggcggcgcagtcggtggatgcgtctggcttccttgccacctttgcggcaggcgtcggcttacgccgcgccgagctgcgcgtgactaaacgctttccactggaagatttaccggaagagaagcgctacctgccggcagaggtgctggtcaatcctaaccagcgcctgaaacaggggggcggcagcccggtaaaatcggtcggcctggtggtcggcgatgcgctcgatgatggtggtgctgggcattacgctggcgcatcactggaatctcaccggcatcggcctggcgctgctgctgtttgtggtggtgcggccgctggcggtatggctgaccacctggcgctgcgaaatgccgtttatgcggcggatgctgattggctggctggggattcgcggcatcggcagtatcaattatattgcttatgcctgggtgcatggcctgcagggcccgcaggcggaacagatgatggacatggcgctgacgctggtggtgtgcagcattgtgctgcacggcatcacggtgacgccgctactgaactggccgcgctggcggatgatacggatgccgacgcgcaggagaatatctacgccagccagctgtgccacattgttagcggggaacagaaaaccggtgacatgcagagctacactgagaaaatgaagtcacagctggcggccagccagtcaccgtcggccatgaacaagccctccttcaatgaggaaaccgcgcaggaagtggtcaacggctggctggagctgggcgaagaagagcgggcgaagctgcgtcacgatcagcagcagtgtgagcagacggacctgcatcacataatgagacgccgcctccgggctggcgcattttccataccggctactgggcaagatgattacacggcgtcgttttctgttggctag

SEQ ID NO: 111364 - DNA, 1926 bp, Glycine max
  Peptide Sequence Number=SeqID_228142
atgggtaataaagattttttccagcttgccgggcttaagcgccgatcgcataaactgatgctgcgtcgcttcgccacagtcgaacagccaggtctcgccgcgcttcgacagcgtcagcgcaatggcggtgacgttgcgctgcaggctgggcgcgcccgcgccggtaccaagaaatgtcagcggcgttacactctatgccagttttcctccaacagatggacacaacggatgaccagacattttgattacctcgccattggcggcggcagcggcggtatcgcctccattaaccgtgcggcgatgtatggccagaagtgcgcgctgatcgaagcgaaagagctgggcggcacctgcgtcaacgtcggctgtgtaccgaagaaagtgatgtggcatgcggcgcaaatcgctgaagcaattcacctgtacggtccggattacggctttgataccaccgttaatcgctttgactggtcaacgctggtgaaaaatcgcagcgcctacatcgaccgtatccacacctcatacgacaacgtgctgggtaaaaaccaggtggaagtgatcaaagggttcgcgcgctttgtcgatgcccacacggtggaagtgaacggcgagaccattactgccgaccatatcctgatcgccaccggcgggcgtcccatccatccaaaggtgccgggcgcagagtacggcatcgattccgacggcttctttgagctggaggcgctgccaaaacgcgttgcggtggtaggcgcaggctatattgcggtagagctggccggcgtggtgaatgcgctgggcgcagaaactcacctgtttgtgcgtcagcatgcgccgctgcgcagcttcgacccgctgattgttgagacgctggttgaagtgatgcaggcggaaggtccgacgctgcacaccgaatcgatcccgaaagcggtgatcaggaatgctgacggcagcctgacgctgcagctggaaaacggccagcagcagacggtggattgcctggtatgggcaattggccgcgagcccgctaccgataacctcaacctggcggtgaccggtgtggcgctgaatgacaaaggctacattcaggtcgacaagttccagaacactaacgtcaaaggcatctatgcggtaggtgataacaccggtgcggtcgagctgacgccggtggccgtggcggcaggccgtcgcctgtccgaacgcctgtttaataacaagccggacgagcatctcgactacagcaacgttcccaccgtggtgttcagccacccgccgattggcaccgtcggtctgaccgaaccgcaggcgcgtgagcagtatggcgacgaccaggtaaaagtgtacaaatcgtcgttcaccgccatgtataccgcggtgacccagcaccgtcagccgtgccgcatgaagctggtatgcgtggggccggaagagaagattgtgggtattcacggtatcggcaacggcatggatgagatgctgcagggctttgcggtggcgctgaagatgggcgccaccaaaaaagacttcgacaacaccgtggcgattcacccgacggcggcggaagacgcgcatacccgctatgatttttgctttgctggcccggcggccagcgttttgcgctgcggtcgacgtcgcgctttacaccctgattcccatcatggtggtgatgctattcatcatgaaatacctcgaagtgaaaggcgtgctggattttgtcgtgcgccacgccacgccgttactgaagccgctggggattaccggcctggcgctgttcgcactcatccagttaaattttgtcagttttgccgcaccgctcgccgcgctggcgatcatggagaagcgcggcacgtcagaccgccacatggcagccacgctggcgatgctgtttgcgatgggccaggccaacgccttttatccgctgattcctga

SEQ ID NO: 111365 - DNA, 903 bp, Glycine max
  Peptide Sequence Number=SeqID_228143
atgaaacgcccttcctggcacgaactgcaggcgatcaaaacgctgggcgagcagcgcagctttcggcgcgccgccgagctgcttggcctgaagcgctcttcgctcagccacctggtgaaaacgctggagcacaacctcggcgtgcagctgtttcagcgcaccacacgcagcgtgtcgctgaccgacgccggtgagcagctattacagcgcctcgcgccgctgctcaatcagatggatgaggtgctgcacgacgtcagcctgagccgccagcagcagtacggtacgctgcgcatcagcgccagcgatgtggtgattggcctgctgctggatcaggtggtgcccgagttcagcgcgcgctatcccggtattcagcttgatttctccgcccagggcgcgctggtagatatcaccgccgccgggtttgatgccggcatccggctgattgaagatgtgccgcaggatatggtggctattgcgcttggcggcccgctgaccttcgttaccgtagcctcgcccgactatctggcggtgcacgcgccggtgcgtcagccgcaggatttactgcagcagcagtgtattcgtcatcgcctgcccgggggcaaacgctatcgctgggagtatcagagtgcggaagaaagtctggagattgacgtgccgggtacgctgacgttagacaataacgcgctgatggcgcgcgcggccatcaacggttcagggattgcgttcgtgccctcactgtacgttagcgaggcactgcagcagggaaaattagtggagctgctggccgactggcgcattcagtcggcgggaatcgcgctgtggttcccgccgaaccggcatcagtcaatggcgctgcggctgtttatcgacgcattgaaaacccgcctgccgcactaccgctga

SEQ ID NO: 111366 - DNA, 696 bp, Glycine max
  Peptide Sequence Number=SeqID_228144
atgaacgctttctccggaccaggcaatattctctttaagcattctcactgggttcccgccccagcagctattggagtgtatcgttttccccgccaccagactcatggcaccaattacgctgccggagactacgccctcctcacatatcagaatattgttcttaccatgaaaattaatctggctattgatgagtgtcgtcgggatggccgttttcaaagcggcctgaatcacgtcgatattaagcgttgggcatcagaacagcaggctgtgcgccgtggcgcgcagcgcaatgcccagcaaaatgccgggcacggcgaagcggaacagacgcggaaaacggctggagagcccgaggaaaatgccgatgccgggcagatcgaaggtctgaatcagcaggcctgccgaggcgttgatgttgtgcgcactgtactgcccctgttcgaccagaccggcaaccacgcccggtgccagcagctgcgtcagcagctcaatggcgccggcactcttcaggatgcccactaccgacaaggaaaggatcagcatcggcagcgaaccgagcgcgaggcgaatggcgtcggcacccgaggtgttgatgatggcgatcagtcccggcttcgtgtcgctgttctccacgccctggtcttcatcgcgcagcgcgacgtcggaaagtttgcgggcaaaaaaatgataggttga

SEQ ID NO: 111367 - DNA, 822 bp, Glycine max
  Peptide Sequence Number=SeqID_228145
atgaaaacctggttaattaccggtgccagcagcggtctgggccgactgatgagtgaacgtttacttgagcgcggcgatcgcgtggtggcaacggtgcgccgcgagcaggcgctcgaagatttgcagcagcaatatggcgatcggctgttggtgatgcggctggatctggccgaaacggccagtatcgcaccggccatcgccagcgcctttgcccgcgtcgggcgtattgatgtggtggtaagcaacgccgcttacggtctgtttggcgcggcggaagagctcagcgatgcgcagattgcacgccagatcgccaccaatctcaccggatcgatccagctgattcgcgccgtcatcccgcatttgcgccagcagggtgggggccgcattgcgcagatctcgtccgagggcggccaggtggcgtatcccaatttcagcctgtatcacgccagcaaatggggcattgaaggttttttcgaagcggtgcgccaggaagtcgccagctttggcatcgagctgctgctggtggagccgggcccgaccgttaccaacttcgccagcgggctggatatcgccgcgccgctcgacgcctatcgtgacaacgcatccggtcagttgcgtcgggcgattgaagcgggtgactttgctatattgggtgatgccggaaaatgcgtggcggccacgctggcgacgctggatcaggaaacgatgccgctgcggctggcgctgggcagcacggcctatcagcacatcgaagccgcgctggaagcccggctggcagaactgcgcgcgcagagagcgctggcgtttggcgcggatgcgtaa

SEQ ID NO: 111368 - DNA, 642 bp, Glycine max
  Peptide Sequence Number=SeqID_228146
atgtctaaactcgacctgcttgacccacagaactcaaccctgatcttcatcgaccaccagccacagatggcgtttggtgtcgccaatattgaccgccagcagctcaaaaataacaccgtcgccctggcgaaagcggggaaaattttcgacgtgccggtgatttacacctcggtagaaacggagagcttcagcggctacatctggccagaactgctggcggtgcacccggaatcgaagccgattgagcgtacctccatgaactcctgggaagacgcgaaatttgtcgaggcggtagagaaaaccggtcgtaaaaaactgatcatctcggcgctgtggaccgaagtgtgcctgactttcccggccctgatggcgctgaaagccggttatgaagtgtatgtggtgaccgatacctccggcggcaccagtgtagatgcgcacgaacgttccgtgcagcgcatggtgcaggcgggtgcggtaccggtgacctggcagcaggtgctgctggagtaccagcgcgactggtcacgcaaagagacctacgatgcggtgatggatctggtgcgtgagcacagcggtgcctacggcatgggcgtcgactacgcctacaccatggtgcacaaagcgccgcagcgtcagggctga

SEQ ID NO: 111369 - DNA, 489 bp, Glycine max
  Peptide Sequence Number=SeqID_228147
atggactcgaaatctatcttaaggctcatgagaaccctagggccttctcttacatctctggtccaatcttcttggagtcttctatccaatgcccttgaggggatttcgctccaattaaagcattcctctctgagcggtggttcggcgacaagcaacagtggctcatggtggccaccaatggtcatgggtggtggagaagaagcacaacatttccagctgagtgcaattcctcttccgctgagcgcaacatttcgcgctgagcacaattcctcctcagcaatgccttccaaggttattttgatgatgccaaagaatcaagagttaagcaaattccaaagattcaagaatcaaatttcaagaatcaagattcaagaatcaagtttcaagaataaggattcaagaatcaagtttcaagaatcaagattcaaggataatcaagatcaagattcaagacttaagattcaagaatcaagagaagacttaatctag

SEQ ID NO: 111370 - DNA, 231 bp, Glycine max
  Peptide Sequence Number=SeqID_228148
atgaagagacctatgtacaagaaaccatatccagaatgggtggaccatatgatgcctttgcggaaagggtataaaacactagacttctccatgttttctgtacaactgtccgaaggagaatatgcagctttggcaactaagaatatgcatcctcggttgaaaaagaatctggtggctcaagaatatggtgaccttagccaattaccttccaaagcaaatcgaatagaatag

SEQ ID NO: 111371 - DNA, 402 bp, Glycine max
  Peptide Sequence Number=SeqID_228149
atggaagacacacccgtgagccccgcgttgccctcctgccgaagggtaggttgtgacagcagcagaaagacactcaacgagcttagagccatagtctccacgcctcacttgacaatgaaattacatacactgacaagggagattgtaaccgtcaaggctgaccaaaggcaatcatgccagtgctatacagagagcctgaaggtagcaccttatcctcccatccaggagcttgccatatctcaccccacagcggttgaaggcactcaagtcatgatagtggatgaaaggtctcaaagtcgagccctaaccatctaccaatccatcctaggcaatgaatttgacatagatccgctagatgacacccccgaccgaggaccgaaaccaattgaaaagcttgtctag

SEQ ID NO: 111372 - DNA, 276 bp, Glycine max
  Peptide Sequence Number=SeqID_228150
tttttccgacgttttcctcaaataaacgttggtggcgactccgtgcgtattcctttcttggaagacgcacccttgagcttagctcatcagtgggctaagcgtgcatccaccgttaagcgcagcttcaacgcactttgcgtgacaatagaatctggcaaggcatcaatatcaaggtcgtgcactaagcacgagatcagtgcgctaagcacagcagttgtcttcagtcaggctcagtgcacgactggcgctaagctcaaatccacttactcgcgctaa

SEQ ID NO: 111373 - DNA, 195 bp, Glycine max
  Peptide Sequence Number=SeqID_228151
atgacgttacagctagacgggactagcacagcatcagaaatgaacgtacatgacctgatgagatttacttcgcaggctcaacaaaaagaacatcaaccacattatgtacatcgcaactggttagatgtcaataatataacagcgcattacggcaggatgttggaattggcctttgtaagggctttaacaaagtaa

SEQ ID NO: 111374 - DNA, 408 bp, Glycine max
  Peptide Sequence Number=SeqID_228152
atggagaaggaggcacgagacatagagattccaaacattagatgggaggtttttgagccgatgatgaggtcaaataaattctgcattcgtgtgctttatgaaagttgtgctgtgaaagcttttgatatcactcttgatattgcccaagatctcctccgagcagctgatcaatatcttttagaaggacttaagagactctgtgagtacacaattgcacaggatatatcactggagaatgtgtcaagtatgtatgaactttcagaggcctttaacgctatatcattgaggcacacatgcatcctttttatcttggagcactatgataaattgagtggaaagccagggtatctatctgaatccctcaatcccgtgtttgctttttctttgcaatacataaaagatgtctga

SEQ ID NO: 111375 - DNA, 1632 bp, Glycine max
  Peptide Sequence Number=SeqID_228153
ggtgtgactggtcctcacttgattgtggctccaaaggctgttctgccaaattggatcaatgaattctcaacatgggctcctagcatcacaaccattctttatgatggacggctggatgagagaaaagcaatgaaggaagagttgtcaggggaggggaaatttaatgttctgataacacactatgatcttataatgagagataaagcatttctcaagaaaatccattggctctacttgattgtggatgaagggcatcgattgaagaatcatgagtgtgctctagcaagaaccctggactctgggtatgattttttacttgttcagtattggtgttatgatgatgaccaatctgtaggttctggaaaatcaaaaagtctacagaacttgacaatgcaactcagaaaatgttgtaaccatccctacctctttgtgggtgactatgatatccataaacacaaggaggagattttcagagcatcaggaaagtttgaacttcttgaccgtttgcttccaaaacttcgtagagctggtcacagagtcctccttttttctcagatgactcggctcatggacattcttgaaatttatctgcgacttaatgattttaaatttcttagacttgatggctcaacaaaaactgaggaaagaggttccctactacggaaattcaatgcacctgattctgcatactttatgtttctcttgagcacccgtgccggaggtcttggtttgaacttacaaacagcagatactgttataatctttgacagcgattggaacccacaaatggatcaacaagccgaggatcgagcacatcgcattggacaaaaaaaggaagttagagtttttgtgttagttagtgtgggatctattgaagaggtgattttagagcgtgctaaacaaaagatgggcattgatgccaaagtcattcaggcagggctctttaacacaacttctacagcacaagacagaagagaaatgttgcaggagattatgcgtagaggtactagctcacttggtacggatgtcccgagtgagagagaaattaaccgccttgcggcccgatctgatgaggaattttggctgtttgagaaaatggatgaagagcgaaggcaaaaggagaattacagatctcgtctcatggaagagcatgaactgccggattgggtatactctccactaaataaggatgataaggtcaaaatatttgacagtggtagtgttactggaaagcgtaaaagaaatgaagtggtatatgcagatacattaagtgacctacaatggatgaaggctgtggagaacggacaggacatatctaagctttcagtcaaagggaaaagaagagaccacctccctgttgacaaccatgcacaagctagtgatgacatggggacagaagaacggttatttagaagtgaagacactttcgacgtgacacctgcctctaagagactcaagcccgaagaaataaattcccagaaacatgaaaacgaagatgtcagtgttggtggtttgaacgagcatatattttcctggaatactcgtagaaagaagagatcaggctaccttggccagggttcattctctgatagtagagggcagaattcaaatggaagagcaaactggaactga

SEQ ID NO: 111376 - DNA, 858 bp, Glycine max
  Peptide Sequence Number=SeqID_228154
atggaagagatagagcggcgaagagagggttgcatgaagggagagtttgattcctttgggacagagagaaaggtgaaggctcctgcgatggagcaagcagtgtcactgattggtgccctgaacctggtttctcgcaacctccctcttcccccagacctctttgacaccgtttcttctatctatcaccgatctaatcctctctcttccgaggccgatgcaccggaacaagatttgttggccgaccttcaaaatgcgctgttggagcaacgtcctaactacgcctctgcttccaaattgaacaaaacaagggaaagccgttatcacactcagattcgacaccgcttaacccaactccaaggattgccttcaagcagaggagaggacctacagactatgtgcttgcttgagctttatggactaaagctagctgagttgcagaggaaggtgcagactgacgtgaattctgaatactggctcaatgttaaatgtgcatatccagacaggcaattatttgattggagcatgatgcggttgcgtcgtccgctgtatggtgttggagatccattttccatggatgccgatgatcaaataaggaagaaacgggatgctgagagactatcaagattggaagaacaggcaaaaaatcatatggaaaccagaaaaagaagattttttgcagaaatactgaatgcggtccgagagttccaattacaaattcaagcttttttgaagcgaagaaaacagaggaatgatggtgtacaggcatggcatggaaggcaaaggcaacgtgcaacacgggcagagaaattgagattccaagccttaaaggccgatgatcaggaagcttacatgagaatg

SEQ ID NO: 111377 - DNA, 1620 bp, Glycine max
  Peptide Sequence Number=SeqID_228155
atgggtccgatgctacaaaccattctcactgtgcttcttctccttatgcttcttctcatcgtcatcttcctcttctttctcttcaaaccatggcgcttctttttctctccgcgtttcctctcctccatcaagggcgagctagagcggcccctttttgtgggggacgaaggtgatgcgtcgtcgtttaatcagtgcaatgaattgcctcgagattatgatctcgagggtgcgtgttatcccagtgaagttcattttcgctctcctcgaacccatggccaaggccttgttcataagcaaaggcttcaaacccttaacatgccacagccacatgctggtgatactttggttgtcgatgtcatctctgatcattcctctgaggatcttgatgttggtcaaacgcttaagcttccttcatctcatttagctcaaattcaaaagcatgccccgcccaattttcaaaatgatagacttgaggactttgtgcaaagggatatctctgatcaaagtaatttccttagtccttttttttattgtcttgccattgctctatgtatttgcattgtcaacataatgacatatccttttgttagaagtgcaggaagttgcctcactctggaggttatcagtggcccttctcggggacttcgttattctgttgagtccaccaacccctctcgtctcccgctaaccttgggaagggtttctccgagtgatttgttgatgaaggattcggaagtgtcaggaaagcatgccatgataaactggaatttggataaaatgaaatgggagttggtggatatgggtagcctcaatggaacactgttgaattctaagccaatcaaccatcaagacactggaagtaggaattgggggaatccgatgaatcttactaatggagatatcataacacttggaacaacatcaaaagtaatggttcatattacctcacaaactcagcatcacattccctttggagttggtatggcatcagatccgatggctatgcgtcgaggaggaaaaaagtttactatggaagacgtttgctattatcaatggcctctacctgggctggatcagtttggaatttttggcatttgtgatgggcatggtggagatggggctgccaaatctgctagcaaactttttcctgaggtaattgctagtatattatcggattcattaaaaagggagagggttttatcactctgtgatgcttcagatgttcttcgagaagcattttctcaaacagaagcacacatgaataactattatgagggatgtacagcaacagtgcttctggtgtggactgatggtgatgaaaatttctttgcacaatgtgctaatgttggagactccacctgtattatgagtgtgaatgggaaacaaatcaagatgtcagaagatcacaagttaacgaattattctgaaagactcagaatcgaagagacaggtgaaccactaaaagatgaggaaacacgtctatatggtataaatctggcaagaatgcttggggacaaattcctgaaacagcaggattcccggttcagttcagaaccttacattagtcaagttgtgcatattgatcaagcgagcaacgcttttgctattctagctaggtga

SEQ ID NO: 111378 - DNA, 837 bp, Glycine max
  Peptide Sequence Number=SeqID_228156
atggctgcaattgtgtgccagtcaagattacacagacttatgttggcatccccaaaacctcctcctcaacaacccttcaagtcttgttgcttctgggaagaatccaattatgctaaaccacattatgacgatgaagacaattacaaagccgacgacaccccaacagattggagctccattcaagctctttcaagtactgtgactgtgagcaactctatatatgaggtgaaacaatcatcatcgctgctgagactcagccccaagagtttggagctctgcacggagaaactagggaatgagacaggaagtgatgacatcacagctgagactggcaatgatgacttgctctcttcttcttcttcttcttcagaaattacaagggagcagaaaagtaagaaagtgcgtgaagcagctcggacttttccaccacctttgagaacgataagaggatcagagtcgatacgagtgaggccccacagagaagatgggaggttagtgcttcaactcactaaggtggtcccatcttgtttccaagctctgagaagccctggccgccttcgtctctgcttttggactaatgatgatattcaagaaacacaagatcatgtggaggataaccaaaaagagatagaaaaaatggaacaacaagaacaagatcaaagtgttgatgatgttgttgagaataatgggcgtggatgggaacacgaacaaaccaaaggttgcaacagttggactgttgttgagaggccaagcagcagctgcaaggaagaaggtgaccatgaaaacaatgatttcttaataaattggggggaacctcgtttggtcaccacttcataa

SEQ ID NO: 111379 - DNA, 216 bp, Glycine max
  Peptide Sequence Number=SeqID_228157
atgatgcagtttgggtatattgtcttgacaacctctgctggtatcatggatcatgaagaggctaggagaaagaatgttggtggaagcaatatgagaagtgcaggaagcaattccggatgtgcagaaagaacaccccagcgatgttcgatgacaaatcaagatgagatcattgactgcacaaacgttctaaaagcagatcctgaaatcctgcgttga

SEQ ID NO: 111380 - DNA, 402 bp, Glycine max
  Peptide Sequence Number=SeqID_228158
atggtgtcaagttggctatggcctcgcctgctggtgtcatactcgactattggtgccgggttggttctgggcttaactattagttttgggtcgatttcaggatttggctgttggtgccgggtcaatttcaggatttggctgttggtgtcgggtcaatttcgggatttgactgctggtgtcgggtcagttccaagactggttattggtgtcgggtcgattccgggctttgaagatggaatgttgatgttagaccgcttggtcattgaaaaaagtaagggatccttaatccttataatgttaggcaccctaagattcatggatgatggaggaattgtgactcgtctcgcctttggtcaaacaacattagagtacttccttaggctgttctcaagctactgctaa

SEQ ID NO: 111381 - DNA, 570 bp, Glycine max
  Peptide Sequence Number=SeqID_228159
atgaagccaaacactatggtagtacgcgcttttgatgggtctcatagagaagagattggggaaataagtctacctatcaagatttgtccaatttcctttgagaaattgaaattcattgttgatgacaaactggtcattattgaggaggatctactagtcagtaagccatcatccactccttatattgaagtttccgaggaagccttgaagaccttattccaagggattgaaattgcaaatgatatttatgcaaaggaagggaaggcgattacccaaccatcaggtgcttccttgatggtagcaaaagttatgctagagaatgggcatcaatatggccatggactaggaagacatgggcaagatgaagaaagcggagatgaaaaagggtatttcttcaaagttataaggttggtagagcaagaagctaaagagattctcaccaatgaagaaccaattgatataattaatttggggactaaagatgataaaaaaggagatatgtcaggacttgatgtcaacatagtggagtataacttgcaattgaatctagaatgccctccagttaaatag

SEQ ID NO: 111382 - DNA, 228 bp, Glycine max
  Peptide Sequence Number=SeqID_228160
atgtcatctattggagttttcacatcttctaccctcattcttctaagtagctctccaccttcttcaataatactaactgatggctctctatgtcctggcaaaggattattccctatgttagggttatcctccttaaaattcaaccatcccgctctaattaaactctacattttgaacttcaaagctgtacaattttttgaggaatggccaataacacctgcaagatag

SEQ ID NO: 111383 - DNA, 705 bp, Glycine max
  Peptide Sequence Number=SeqID_228161
atggctaaagaggataaggagaaaaccacattcagcatgccttggggaaccttctgttataaagtcatgttgttttggttgaagaacatttgggcaacatatcagagggtgatggtgactttattccatgacatgatgcataaggaggttgaagtttacatggatgacatgatcgctaagtcagaaaaggtggaagatcatgtagtccatatgcagaaattgcttgaggggctaaggaagttcaaactgaggctaaatccagccaaatgcatttttggcatcaaatctggaaaattgttaggtttcatcttcaaccaaagaggaattaaagtggattttaacaaagataaggacatgccacttataaggatccagtgtcatgatcagcttgcatattatcacatggtagaagaggaatctgatgggaaaccaatgtactttgacatcaaagagtatatcaagagtcgagagtatcctccaaatgcctcagagaatggcaaaagaacattgagaagactagcaatgagctttttcccaaacagggatatgtcattgaagtgcaaacgatcattagagaagttcatgaagggacattatgtggttaagaaagcattctctgaaggagctttgatcctcaaaaacatggatggcaaggacttaccataccctgtgaactctgatgtaatgaagaaatactatgcttga

SEQ ID NO: 111384 - DNA, 204 bp, Glycine max
  Peptide Sequence Number=SeqID_228162
atggaagaaatggttagaacaacttgggataatgtcagaaagaaaggggataaagagttaggaaaacctcatgtgatagcctccttagagtataaagaatggagaaagcttagaggagttcctgcttcaatccttgcagaaaccccatgcggggatagttcatcccatgaatttgtcctaacaatcgcctccttgacttcttag

SEQ ID NO: 111385 - DNA, 369 bp, Glycine max
  Peptide Sequence Number=SeqID_228163
atgttagaagctcaaaaggaagtagatcataaagaaagagtattgcctattaaaaggaaatctcccagttttgaagcacaagattcatcggaagaggttaatttagggaccaatgacaatccaataaaaactaaaagatttacacagcaggaggtctgtaacatgttgaagaattggagtagcgcgctaagtacaccagtgcctactcaacccgaggagccaaagtggaggccaattgtaccgtgcagcttctctcatccaggatttagcattcttggattaggctttaccgagcttcactctttaagctttaaggcagggctaaggcattggttgaatttctctaagagttgggagcgaaggaactga

SEQ ID NO: 111386 - DNA, 312 bp, Glycine max
  Peptide Sequence Number=SeqID_228164
atggtgccattgatccttgacaaggtagtgaatgccatccaaattgtgtcaaggttttgggctaatatggctgatgagggctcgaataaagaggttcccaatacgcatgagggtgtatctcctaacgaccctgactttgaggggctccaatgggtcgaaagcatcatgaaaatccttttctggaatatgaggggattagctaactcggagactaggtttgtccttaaacacctttatctttctaacaagcttgatttgctctttttggaagagccatggactactttggacaaaatccctgttggatactag

SEQ ID NO: 111387 - DNA, 141 bp, Glycine max
  Peptide Sequence Number=SeqID_228165
atggtggagggcttgggcaaaggttttccttggattagaagaggggggaggtgtgggattgtcggggccagggccaaggaacccctaaggaatgaaaggggtgacttcgaccatggattttttttcacgggaatgagttaa

SEQ ID NO: 111388 - DNA, 552 bp, Glycine max
  Peptide Sequence Number=SeqID_228166
atggacatgaccaatgtactcaaacctggtcaagatgcaacatcactagttggtccttggtacacaactatgtgtgcaccatcctctgaggaaaatccactagaagcgagagaggagatgaagaaaataggatcaaggaagagcacttccatcaacattctacttggtacttttgatagaagccacatggatccttcaatggaagcgaaaactccaaaggttcagtgggacaagaagattaacatatggatgcccccatcaaagttgattcttgtaaatgtagccaatctgcatctcagacttgctgaattctcaaggatagatgagcagcaactaccaaacgacactgtcaagattaaagaggttctcattgacctcactatctctagcattgtgcatgaaaatgaagtacctgaagtgtcccttgctatgtccaatgctacaaaggctgataaggttattccaactagttcttctgaacctacatccaagcagactaaaacgttacttgaagccactgttagtcgtcttatacaactaacttttgtatag

SEQ ID NO: 111389 - DNA, 258 bp, Glycine max
  Peptide Sequence Number=SeqID_228167
atggtgggagaagggtgtacaaagagtcacaacgaggagggtgcagacagaacaaggtggagcaggagaaggaggagagttgtcgcaggaagaataacaaccttcacaggaaggagaggcgttgtcgcaggagctgtcattgcgagtgggagttgcatggcggggaaggtggtgtttgggatgcttggggttgaaggatacaaatatgggagtataggattcaaaacccttgcttcgactgtgggcaaccaaaattag

SEQ ID NO: 111390 - DNA, 510 bp, Glycine max
  Peptide Sequence Number=SeqID_228168
atgtttgaacataagcgacatgtagaagctcaagtggtggaccctttaaaacaacctgcgcaagtggagccttcaaagcatgttaagaaagtggaggatgtcgagcatgttgaccaagtccaggaacgcggtgagataaaattagtatcacatgggagaaagttgcaattaaagattatcctatatgaccagatacaggatgtggtcaaggggtctagtttcttcccgttaactacatgcagttatcaaataatagacaatggactcttgtctgcttttgtagaaaaatggcacagagagacaaacaccttccatttgcccgtgggagagatgacgataacacttgatgatgtggcattgttacttgacactctcattactggtgccttttacaattgtgaacatatggataaggaagcggcaattctcgtacttgttgagttacttgaagttgaatataaggatgcctttaatgaacaaagaaaactagaggttgacaaatccgtttaa

SEQ ID NO: 111391 - DNA, 1148 bp, Glycine max
  Peptide Sequence Number=SeqID_228169
atgccttcatcaactgcttttcaatggctaagccttgttggcatcatttggctccaatccataaatggaacaaacaccaatttccctgcttactcctcccagctgaagcagctcctctccatttcccaatttcagctcaacaaccttgcttttgcctccgatgcaggcaaaatctttggctttttttctggcatggctgctttttacctccccctttggcttgtcctcatgattggttcaactcttggactaattggctatggtgttcaatatctcttgataacaaaccaaatctcctctctctcctattggcatgtgttcttgctaactgttctagcagggaacagcatttgctggatcaacactgtgtgctatgtgatcacaataaggaacttctcatctgatcatcgccaagttgctgtggggttaacaactagttaccaagggttgagtgctaagatttacaccagcattgttggaactgtttctggacaaaacaaggctaagacatttctctttctgaactcattcttgccactgatagtttccctaatagcagctcctgtggtcagagaaattgaagctgtcacaaggcctaaacacatgagtgttggatttgttgttatgtttgttattacaattgccactggaatatatgctgtgatgagcagcttgcaatttgtctcaaacaagatatctccacttagtaaccttgttggtgttctagtgttccttttattccctctattagttccactttccatgaagatcaatgcactagtagggtcatggcacaaaaatagagaaaaacaaagagtctatcattttactgcagaggagagtcatgatatagaagagaggatagagaatgaggttaaagagggtgaagatagtagagaagttaatcaagaagttggtattggtataagagaagaagtaggagtgaaattgatgctgagaagaatagatttctggttatatttctttgtctatttattcggtgcaacacttggtttagtatttctgaacaacttaggacaaatagctgaatcacgaggttactctggaacttcatcattggtgtctttgtcctcttcttttgggttctttggccgtctcatgccatctataggggactacttctaccg

SEQ ID NO: 111392 - DNA, 315 bp, Glycine max
  Peptide Sequence Number=SeqID_228170
atggagagattgtcctatgatttgagtacacatactgatatgattattgataatgagcaacacaaggaattgtgtcaagtaccatgtgaattatggagctacataggtatgggactgtgccagcagttgaggttgagggatacttactccccatcactttccaaaggttgtattgcgattgatgatcgatcaatagtggagtatggatccatactgtgtcaagaagagactggcaaggagacactgcactcaaaggtcagttttatttattcttgcatttgggttaaggtagactttgctcactgctgtgactag

SEQ ID NO: 111393 - DNA, 285 bp, Glycine max
  Peptide Sequence Number=SeqID_228171
atggcagggtactgtgctttattactatgtctgtattttttggtgcttctggtaccaagtcgtcatgaactcttgcaaaacattggtattaattgcgatgctgtggctcgcagtggtgatgcattggcattgtctgaactatcgctcaaattccttgcacctctaagacctattttggaagccaaggccatagcggtgtggcttgacaaaaactatcgtcctatacgaattccagcagagatgaagtctaaatttgtaaagtttattcgaattgaggactcttaa

SEQ ID NO: 111394 - DNA, 326 bp, Glycine max
  Peptide Sequence Number=SeqID_228172
atggcctgtcgctttcattatcccgagactatcaaagtccccattcccatccagagaaaaacgatttcgatggtgtacgaggacgatgatggtcgtccatttctaattgtttttgagaatgttgcagttccctttgctatccagagacaagcgagtctgatagcatgcaccaaggcttttgctgatgcacctgatgtcttttatgctctttcttttgacagggaggttgcttcatgtggaagctacctagctcgcctgggcgagctggacggcaacgacctccctcatttttgctataaaatggcatttggggctgaggggaaagg

SEQ ID NO: 111395 - DNA, 513 bp, Glycine max
  Peptide Sequence Number=SeqID_228173
atggtgacaacaccaatgttgcctatcatggaaatcaacaactgggacaagcattcaccatgcttgaaaatgcctgtcgtgggagtcgctaaagaagggaacccaatgaatggggagaatatcctgcatcaggagctcgatgatcatgctatgatagtggccatgcaaaaagagatgaacatgctcaagactgaggaggctaacacgacatggagagaaagaactccctctatcacacaaccaaccccaagagcaacaaatgccaaaaatcgactttatccctttattgatgtgtttcctaaaacgttgaaagatgctacacttcactggtatactcgattgccgagaaactccattgactcatttgtgatgcttatcgcatattttggagctcaatacatgataagcagaccacaccatttgatagttgtggcattcgccaacatcaagcaagaagaagatgaattacttgatttcatgaagagattctcattagtcttagttcgaatttga

SEQ ID NO: 111396 - DNA, 393 bp, Glycine max
  Peptide Sequence Number=SeqID_228174
atggacgaagatcaatggatgtatgacaatacaatgtctgaagaagttaatatggattatgaaaatgaacaagaatgtggtgtgaatgaatcacatgttgattgttcggatgcttttaatacttctcaagctcgatcggttgcccatgaaaacagatttgttgcagtcattatgaggaagaaagaatttgttagaagagacactgggagtaggaaatgtggttgtctcttcaaactttgtgggaaactagttattagaggggaaggttggatggtgaagttgatctgtgggattcacaatcatgaattggccaagtccttagttggacatccatatgttgggcgattgactaagagtgagaagaatattattgctgatatgacaaagtcgatg

SEQ ID NO: 111397 - DNA, 228 bp, Glycine max
  Peptide Sequence Number=SeqID_228175
atgtcgaccatcgatgaactcctcgacgagctaggcgacgtatgtgaaaaagggaggtacaacaagcaaaaagggacagaaataaagaaaaaaagaagaaaatcagaagaagctcaagtccaacaaggcgctaagcgcaggacgcgcgctaggcgcgacatggcgctgagcgcgaggcttcgcgctcaacgagactatgaaggcccaagcccaagtttacacctataa

SEQ ID NO: 111398 - DNA, 903 bp, Glycine max
  Peptide Sequence Number=SeqID_228176
atgggttctgcttcagtcaccaaagcaccaccctcttcctcctcatcacccaactcttcttctactgagtcccttgatggcttgaagtttggccagaaaatctactttgaggaagtgagtgttgctgcagcagcagcaacaacaactcaagggggcaacaaaacaagaggtggggtttctgcttcaaagaagggaaggggtggctcagtgcaagctcctaggtgtcaggttgcgggctgcaaagtagatctgagtggtgctaaggcttactattctaggcacaaagtttgtgccatgcactccaagtcccctactgtcactgttgctgataacaatggtcgagacgatggctttctgatggaatttgcttcataccccaagcttactttgagaaatacattgccaactcaaagatcaactgagccggctccagggaaccatgctgcaacactcacctggcaaggaggttcagacactccatctgaatttttcctgcaaggatcagggagtagtggtggaacaagcttccttagttcaaaacatcccttagtggaaagttacactggagtcactgactcaaactgtgctctctctcttctgtcaagtcaaacctggggttccagaaacacagccccagcaacaagttttgaactgaacaacaacttgttcaatttcaatgggacatccatgacacaatttgctgtggcgtctttgcaagctgcagccatccatcaacttccaaatgctacctcatggttgtacctaaagggagttgattctggtaattgttcgcctgagcgtgtccccaatcacggtcttgctcaaatttctccccctcttcatagccatgttcatagtgagcttgatgtgtcacagcagggcaggaggcattacatgatctag

SEQ ID NO: 111399 - DNA, 252 bp, Glycine max
  Peptide Sequence Number=SeqID_228177
atgacccctactcatgatgagcttctgtattacaacgggaggtggaacatgtcacaccaaaacaactttgtaggctacgcgttcacaggaaaaaatcctaaaaaatttgaaattcctttaggatttaccatcgatgaactgaaggatttgataaagcaagttgtacctgaagggattccccctcatggaattcaagcatcacaaatggttatggaaatcgaagacgacatgcctacgtctctacaagattga

SEQ ID NO: 111400 - DNA, 1761 bp, Glycine max
  Peptide Sequence Number=SeqID_228178
atgaaccttgctcaacgaaacccaaacatcaaaagaatttccccagctgaaatgcaactgagcagagaaaaaggtctatgttattggggtgatgaccaattttctctaacccataaatgtcccaaccgtcaaatcatgatgctacaatttgatgaccctgaagaggatacccaacctgaactagaaaaaacccaactagatatgacctaccctgaacctgacctagccacaaatgaccactatctttctctgaatgcaatgaaagggaccgatagcatgggtattttgcgattcacaggccaaattgggcaaatccatgtacaagtcttagttgatggaggaaattttttacaaccccgaattgctgaatttcttaaactcccaatggaaccatatccttgtttcaaatttttggtgggaaatggccaatctatgacttctgagggagtgatccctaatttgtccatcacattacaaggacatgagttgacattccacactgaggatgatgttttgaaagatttaccacaacatatagccccaaagattgccctgttgttgcacacttacagttcaatgttccaaactccaacatcattaccacctcctagaagtcagaatcatgctattccatttttggagggtatgcagccagtcaaagtcaaatcgtacagatatcctcatagccagaaagaacaaattgagaagatggtgcatgaaatgctagaccaagttttctttgatgatatccttatatacaactctacttggccagaacatttgacacatttgaaaaatgtgctacgagtccttcaacaacatgtactatttgtgaagttgtccaagtgttcatttggagtattagaaattgaatacttaggacacatagtttccggacaaggagtatctatggatagtagtaaggttcatgcaatccatgagtggccaccacccacaaatgtgacacaattaagaggatttctaggtctcacaggctattataggcatttcatcaaagcatatgccaaaattgttgcccctttgactgaattactcaagaaagatggttatttatggattgaggaaactgaaacagcattccttagactcaaagaagctatgatgacaacacctgttctggggttacctaatttccaacaaccctttatcttagaaacaaatgcatcagggattggtatagagtgtaagccaagaaaagataatttggcagctgatgccctctctagagtaatgtcattatcatggtctgagcctgagcattccattgtcagaaaattgaaagaagcactgcagagagatcccaaaattgttgttcctaaggatgtggacctgatacaacaactcttacaggaatttcatagctcaccaattggggggcatttcgggttaacaagaactttggcaagggtgacacaacagtttcactggccagatctgaagcatgatgtgcaacaatttgttcaatcttgtgcaatttgtcaacaggcaaaaactttacataccaaacctactggattgctgcaaccactgcctataccatctcaagtatgggaggatataacaatggattttatcactggcctaccaaattcatatggcttccatactattctggtagtagtagactgtttatcaaaatatggtcatttcatagcactcaaaggggattacacgagcagggtaccacattggccatgtcctcagcctaccatccttaattcgatggccaaccagaagtag

SEQ ID NO: 111401 - DNA, 2121 bp, Glycine max
  Peptide Sequence Number=SeqID_228179
atggctggaagtctgtcaaaaatcactccagatatgtcaaaaatagaacctctagacggctcaaattataggagatggtctcaaaaactgttgattttgtttgaagccttagaggttgattatgtgctatttgaagatcctcccgctgatgtcaacgcttctgaatcatctactcctgaaactcctgctacccctgtcgtcacaccgcttcctgcagaaaccaagaaagctggcaaagaagcaaagaagaaatatgaaaaggacaacaaaactgctagaggtcatctgctaactcatatggcagataatctgtttgatcttttcattaatcaaaagtctgcgaaaacaatatggaacactctgctgaaacgttacggcgatgacgatgctggaagaaagaaatatgtggcaggaaattggctgcgtttccaaatgatggatgacaaaccaatcatggagcagattcatgagtatgagaatctagttggtgatatactaaatgaaggaatgaagatgtgtcataaagcttatgagtgcaaactgaggaagggacaacaatctaacaactcgaaacctgctgcaccacatgctcctcaagcacatctagcagaaaatgaagaagtgatagttgttgtggtagtggaggcaaacatggtcgacaacaaggtggactggattctagataccggtgcttctaaacacttatgcgccaacaaagagctttttcaccagattgaggatgctgatgacggagaatgtgttttcatgggaaattcagctacatctggagtgcttggtaaaggaaagattctccttaaacttacttctggaaaaacattatctttgagtgatattttagttccccataaacgactagataaaactccctatgaattatggaaaggatttgcgccaaatttaaattttttaaaagtatggggatgtcttgctaaggtagctctaccagatttcaagaggactaatgtagtgcctttacatttgcatacttcttcctctgtaacaaatgaacaagttaatgaacctagaagaagtaaaaggaagagaatagaaagtagttttggaccagattttgttactgccttcgtggttgaaaacaatgatgtcgataaaataaatgatgtttttgtatctacttttctcattgaggaagatcctaaaacttataatgaggttgtaacttccattgatgccaatttttggaaagaggaaattaatagtgaattagattctatcatgtataatcatacttgggatttagttgacttacctaagggaagtaaaccaattagatgcaaatggatttttagaaagaaattaagaactgatggaaccattgataaatttaaagctagattagtagttgttggttacacacaaaagaaagaaattgactattttgatacatattctcctgttactaaaatttccgcaattcgttctcttgttgctttagctgctattcatggacttatagtatatcaaatggatgtaaagacagcttttcttaatggtgacttgagagaggaaatttatgtggaacaacctgagggctatgtgattcaaggtcaagagaacaaagtgtgtaagttgagaaaatcattatatggccttaaacaggctcccaaacaatggtatgaaaaatttgaccaaactttgtcacattatattgaaaagatacttaaaaaaaaaattaactgttatgatgaattacctgtgagaactccctatgatcctagcatacatcttaagaaaaacaatggttctagtgtttcacgaactgaatatgctaaaatcatagggagtgttatgtttctcatgaattgtactagacctgacatagcatatgctgtgagtagactaagcagatatactcacaatccaggtaatgaacattggactgcacttcgtcgcttactcgggtatcttaaaggtactatggattggtgtttgcatttttataaatttcctgctgtgttagaaggattttgtgatgcaaattgggttactgataatgatgaatggaggtgccatatcatggaagtcttccaagaaaacttgtatagcacgttcaactatggaatcagaatttattgctcttga

SEQ ID NO: 111402 - DNA, 993 bp, Glycine max
  Peptide Sequence Number=SeqID_228180
atgaccgataggaggaaggaagccataccttttttctgggtactatccttcgatggcgagaatagcaggggtgatcaagatcttggaatgagaattagactgagtgaagcaaagctggtggatctagcagcaattgacacctttcttgcttatcaccacagcaaggaaagcccggttattgctgttttggcagatgcgtatgatacatttgacttaagatgcgagaagagtagtgcgaggattgtctattgtacgcctgctttttatgtatggttggtatcccacgtcttcaatcatgagagtagatctgtctgccccctacaaggtcatcgcatctgcgtcgaaaaggacaaagcaaattgggaagaactcttggcaggcatgacaagagcgtccattagttggttcccatggtggaaagaaggaggggagggagtgttatgctcatgtgaaggatttccaaatgtcccttggatggggacgaggggttgcattaattataatcccatgttggccataagacagttaggttaccctatgagaggtgcaccatcagaggagaccatcgcgcctttcatcacgcgaggtttcaatgaagctaatgtaaagacactccagaggatctataaggaatggaataaagcagaaagaaaagataaagaacttagtggaagtagccaaggtgtcataggcagctatcacaaatggttgaagtcgagaacgcaagggataacttggctcccaaagttaaagagtctgagcggggaagaggctgaaatgcttgaggagagtgaagacgtgcaagctttgaaagctgagctcgaaaatacaagagtagagaagaagaagctaaaggtggcaatcactagggtcaggaaagaatgtgatgagctgaaagatatcaacatgaccatagttgaagcgctagagcgggaaacaaaaaaagcccaaaaggaagagtggagcaggaacaagtttcgaggggctttgtag

SEQ ID NO: 111403 - DNA, 246 bp, Glycine max
  Peptide Sequence Number=SeqID_228181
atggaagagcttggtgactttgaggagtttgaattcgataccatcgaagatgaggtgcttgtagaattgaaccaagtggaggatttacgattacttatcattgtaacgttactattgctaaatattgatgagaatcctaaaactaaccaaatacaaggaccaccaggagtaggaccaggtaatccttatggcatctaccttgacttatcttccctctctggaagtggcattatccaaacttcatga

SEQ ID NO: 111404 - DNA, 306 bp, Glycine max
  Peptide Sequence Number=SeqID_228182
atggataacttctcttcacgtctagatacggatatccatgaagcctccaaagacacaggaccacctcttattcatctgctccctacatacatcagatacgggatcaacatgggtgcgaaccacacgtgcaacaacgtaatggtttatcagaggaaggtggtggcgaacactactaaaaaaaccatttttaatgacgttcaatctattacggttctattgacccgatgtagattggttagcggtggcagtcctgtaattattgcgaagatgacgacgacgtttatggaagaccgtctttataggtaa

SEQ ID NO: 111405 - DNA, 375 bp, Glycine max
  Peptide Sequence Number=SeqID_228183
atgcaaattaaccccgtcaaatttggaagagtggaagctcaaaattatatgggggaaaagaagcaattaccgtacgtcaaagaatcaaaatggcgcgtcaatgcgcacgagaggcgacagtggcgatgtcagggcaacacggcggcaaggcaggggagtgtgacttatggaggcggtgatagcttgcaaggtagggttaatgcacagaagagactagcaacgactgaatatgaactgcgattccgtgcacaccccatgcacgtgactatcaagtgcctgaacaatgacgatcctttggagaaaccacctttgaagttgaccaaccaatttatgagattgccattatgtgcacgactcgtgcacgtgactgtatga

SEQ ID NO: 111406 - DNA, 306 bp, Glycine max
  Peptide Sequence Number=SeqID_228184
atggaaacagtactgctagaagatgacaatgctgcagaagcacttcttagctttatttcggagtccgggtcccaaatattagtgctgggttctgactcctcaaatttcataacaaggaagctaaaaggacctgggataccaactaccattctaagatgtgctcctgacagttgtgatgtatatattgtagctagagataaaattatatccaagttggctgatttttcatcttctcattcttatggtatgattgaagatcttgcatttcaggattttgatgtctgcacctatgccctgattgtgtga

SEQ ID NO: 111407 - DNA, 1008 bp, Glycine max
  Peptide Sequence Number=SeqID_228185
atgaagaagaaaatccagaaaactgcagagatgatattgaaactatcagcctccattcatttgatttcattgcttctgcacaacgtcagcaggtctgtggagagctggttcaagctcaaaattgttgttgagaaatccactgtcccagttagaacagctgaggcaattgagaaaattctatgccataatactaatagcaagggcatcaagtatcaaattttgtcaaatcctgagtttctctctgagggaactgctattcaagattttctaaaccctgatagggttctcattggagggagccaatgccctgaaggtttagaagcaatccaaaagctgaaggctatatatgctcattgggtgcctgaagacagaatgataacaaccaatttgtggtcagcagaactttccaagttagctgataatgcctttttggcacaaaggatttcatctattaatgctatgtcagccttttgtgaggccactgggccgaaatttcacaacaatggcctcactgaagtggctaattactggaaacaagtgatcaaggtgaatgactaccaaaagagtcgttttgtgaagcgtgttgtgacatcgatgttcaacacggtttcgggtaagaagattgcaattctggggtttgccttcaagaaacacactagtgacactaggaagactcctgcaattgatgtttgcaaaggactattgggggataacacgtgcttgagcatatacgatccatgcgttactgaggagcagattcaaaaggatttgtcaatggatggtgtagaatgggaccagcagccaatgagttctactacacagaaaaagtgggatgagttcaagaacattgattatcaaagcgtgtatgacaacatgcacaaaccagcatttgtgtttgatggtagaaacatattgaatgttgacaagctgagagaaattggattcattgtgtactcaattgggaggccattagagcaatggctaaagaacatgccccaacaggcttga

SEQ ID NO: 111408 - DNA, 645 bp, Glycine max
  Peptide Sequence Number=SeqID_228186
atgaaagcgtttatctcttctgtagtagccagtgccgttctgcttgcgctgcccgccgcgcaggccgccgataacgatgttgccgcgctggaaaaagccgcgcgcgccgaaggccaggttaacagcgtcggtatgcctgacacctgggccaactggaaagatacctggaacgatctcagcaccaaatacggtctcaagcacagcgataccgatatgtcttcggcgcaggagctggcgaagtttgccgccgagcaggataacgccagcgccgatatcggcgacgtgggcgccgccttcggtccgattgccgtcgccaaaggcgtggcgcaaccctataaaccgacccactgggatcagattccggcatgggcgaaagacgccgatggcaactggatgctggcctacaccggcaccatcgctttcctgatcgacaagcagcaggtgaaagacgcaccgcacagctgggccgatctgaaaaaaggtaagtatgtggtcactatcggcgacgtcggcacggctgctcaggcggcaaacggcgttctcgccgccagctatgcgctgggcggtgacgagaagaacatcaaaccggcgctggcgttctttggcgagctggcgaaaccgggccgccttggcgtgaccgatccg

SEQ ID NO: 111409 - DNA, 471 bp, Glycine max
  Peptide Sequence Number=SeqID_228187
atggttataacctgttttgagtcagtgaggagggaaaaagtcctacttgatgaaaatgccaagctcactgaaaatggcaggctctctgagaagatagaagcagtggcaaattatcaaggggacagttacatgggcaaaccagtgaggataaattgtcaaaaggcgattctggtgatgaaatgctcagctctgttctcaagacctttgtctactagccctaatcagttagacggtgacaaaataacaggagctaccaatcataaatccgtgaatttggagggaagcctgttggttccgcacctattcaaggaccacagaagatgtagttacatgatagccaatgcactggataaggatggtaaattcactactgtccaagtctctcgaaaacttaagcagcttggtttgtatcttcctctgcccaaggatggtaaattcactactgcccaaggggtgcttctccttaactaa

SEQ ID NO: 111410 - DNA, 429 bp, Glycine max
  Peptide Sequence Number=SeqID_228188
atggggattgatcattctctcactagtagcaagcaaaacatatggggggagagaaaatgtgttgtatcaccatctttcgggattttgtcacaatcttctgggactcaagcagagcagaaatgggcaggctctaactggatacaatgggaagtgaatcggattccacagatcgagaaagtggaagtggatttcggctttttaattggcagtgacttgagaatgaattacaatgtactaaaaagcgaaaatagtgagttagggaacaatgaggctgagattccaattgaggcattggtaggactcaaggaatttgatggacatgaagggcttcattcagaatttaatggtgatgatgttttcatgttggaggaatctctcttaataactcatagaagtaaatgtgtagtttccaaaaaggatgaatattga

SEQ ID NO: 111411 - DNA, 531 bp, Glycine max
  Peptide Sequence Number=SeqID_228189
atgaaacatggagctagtcaagctgctctttcaagcaacaaaccattttggaaacaacaaaaacatagcatgcagaataaccaatcaaggcagaacgaagaaggcagaataagcaagcaaaaacacaccaaaaacactctgaaactaaaatttaggggaacagaaaatgttcaaaatgggaatggaaagttccaatttggatcacctcacccactggtaacatttggagacatgttaaggaaaactgcatgtcccagagttcttattacagaagtgtatgcggccactaaccatctgaatgaaatgaatatcattgggaaaggaactttaggtaaggtctataagggtacaatgacaaataatctgaatgttgcaataaagcacataatcaatgatgatggaaatgtggacacttttgttagagaaattacaagcttatctcatgtcagacaccctaatatcagcagttgcaaacaatcacagtttacttggtgccaacttaaagtggaattaaacaaggaatatgcttaa

SEQ ID NO: 111412 - DNA, 596 bp, Glycine max
  Peptide Sequence Number=SeqID_228190
atggtgtcaccacaagggcgaaacacatgcacaattgatgatctcgtgccttatgtggaaaagttagcgattttatcccaagagcaagagaggatcactgagcctgtggcacatggtccagcatcagaacgtcgatttcccccacaacagtttcacatgattcagtcaagtgttgaaactcgaggttttgacagacgaagggagattgttcaagcggaagatttttcccaacaaatggagcagcgtggccatggaatgtattacatgccaccaacattttctcagtatccttcgcaaatgtatcagtatcctttcgaaggtcatgacactgatatgtctgcaagcgaatattcatttggtggtgttgcggaaacacatcctcatttttcatggccgaccatgaccccttcgcagcaacatgatgccctaatggcaacacctaatgccccattagcttcgcaatgggatgtacccggagcaatacctgatatgggtgacttattaggtgttgatttgcgtcacgagttttctacagaggctgagcaacaagggcagagacagcgcgcaagaagaaatcaagatcgtctagcccgaag

SEQ ID NO: 111413 - DNA, 698 bp, Glycine max
  Peptide Sequence Number=SeqID_228191
atgagtcatcttcaggttttagaccttgcacaaaacaatctgtctggcaatataccgagctgtttcagtaacttgagtgccatgacactaatgaaccaaagtacagatcctcgtatctattctcaaggaaaacatggtacgtcgatggaaagtatagttagtgtgctactatggctgaaaggaagaggagatgagtacagaaacattctgggtttggtaacaagcattgatctgtcaagtaacaagttatttggggaaataccaagagaaatcacatatctaaatggattgaattttttaaacatgtcccacaaccaattgattggtcatattccacaaggtataggtaatatgagatcattacagtccattgatttttcgaggaatcaactttttggtgaaatccctccaagcattgcaaatttgagctttctgagcatgctagacttgtcatacaatcatttgaagggaaatattccaacaggaactcaattgcaaacctttgatgcctccagcttcatcggcaacaatctatgtggtccaccactgcccataaactgcagctccaatgggaaaacccatagttatgaaggaagtgatgggcatggagtgaattggttttttgtcagtatgacaattggatttattgtgggattctggatagtgattgctcctttgctgatttgtagatcatggcg

SEQ ID NO: 111414 - DNA, 1388 bp, Glycine max
  Peptide Sequence Number=SeqID_228192
ggccggagtttgggcgacatcaatgccccgccagcaactgatggtcgagggcgaaatgcaccagctcgatggtgctgttgcactgcaacttgcccaggacgttggcgcgatgcacgtgcaccgttttatggctgagcgcgagcttgaaagcgatctcctttacgctgtcgcctttgaccagcagatcgaagatttcacgctcgcgcggggtcagcgcttccagcgccgtggccggctgctcgccgccgcgcagcgcccgcagcgcgtcggcgcacaggtaatggccgcccatatcgacggaacgcaccgcctgcaccagctcttccggcccgcagcgtttggtcagatagccgctggcgccggcgtccagcgcgctttgcacgaaggtgggggagtcatagatgctgaggatgatcgcgcggaactgcggcttctgcgcccgcaggcgcttcaacaggctgaggccgttttcatccggcatggcgatgtccatcaacgcgacgctgacgtcgtcgcgcagcaatgccggccaggccgccgccgcgctgctgtattgccccaccacgtcgagatcgtcctcgaggctgagcaattgcgcaaagccggagcgcaccaccacatggtcatccaccagtatcacacggatcatttttcgcactctgttgccgaatcatggccctatgatgcctgccgccgcggtgctggcaatcagccaagcgcgcgcggcacgccgctcctcttccgaatgcagcgtcgtttcgtggcgctgatgatcttcggtcacgatcagcttcatgtcgctgagggtcacccggccgtggcgctgggtgaagtgcgactgcggcgaggtgctgtggaagcggcacatctcgtcgaactcatgcagctcgcgtggttgaacggtaaagcgatacagggttttggcatgcgaacgttggtcgccgttgcggcgttccagcaggtaatactcgccttcccgctccaggtggaaggtgccgctggcctgcggttgcggctcggcggcgacgatcttcagcggcgtcaggaaggaatcgccgaaaccgacgtccaccagccaggcctggcccgccagatccacccgcagcgccagatggtcgtagggcgggccgaaatggccgtcgcgcgcgcggatctcgccggagatgaagctcaccttgaaaccgatctcccgcagcagcagagcgaacagcgcgttcagctcataacagaaaccgccgcggttgcgctcgaccaccttgctgaacagcgcctccggcgccagctgaataccctgatgataaataatgctcaggttctcgaacgggacgctcagcatgtggcgatggtgcagctgttgcaacgtggggaggtcagggcgggcggcgccg

SEQ ID NO: 111415 - DNA, 330 bp, Glycine max
  Peptide Sequence Number=SeqID_228193
atggactcgcatggccaaaaatattttatctctttcatagacgattactcacgatacatgtatctttacttgcttaacaataaatatgaagcattggatgcctttaaggttttcaaggcaggcgtagagaaacaatgtggaaaacaaataaagattgtgagatcagatagaggaggcaaattttacggcaaatacactgaaaatggacaagcacctggtccttttgcaaagtttcttcaagagcatgacattgtggcccaatacaccatgcctggctcgccaaatcaaaacagtgtggctggaagaagaaatcgaacattaagggacatg

SEQ ID NO: 111416 - DNA, 211 bp, Glycine max
  Peptide Sequence Number=SeqID_228194
gagcagtcgcgctcagcggaccatttgggctcagtgtgcatccgacgctaagcgcaactttagcgcgcttagcgtgacaagggaatttggcagagcacaagaatcaaggccactcgctaagggcaagattagctcgctaagcgagatgttcatctcttgccaagctcagcgcgtggctggtgctaagcccatatccatttactcacgctaa

SEQ ID NO: 111417 - DNA, 525 bp, Glycine max
  Peptide Sequence Number=SeqID_228195
atgcaccatgaatgctcacctcgaattgttcatcgtgatatatcaagcaagaatgttcttttggattccgaatatgtagctcatgtctcagattttggaacagccaagtttcttaatccagattcatccaattggacctcattcgtaggaaccttggatatgctgctccagcacttttattttgttacagaacttgcatacacaatggaggtgaatgagaaatgtgacgtgtatagttttggggtcctagcatgggaaatacttattgggaagcaccctggtgatgttatatcttctttattgggatcatctccatctactcttgtggcctcaacactcgatctcatggcattgatggataagttggaccaacgtctccctcatccaacaaagccaattggtaaggaagtggcatcaattgcaaagatagcaatggcctgcttgactgaaagtccacgatctcgccctaccatggagcaggttgccaatgagctggtaatgtcaagctcatcttcaatggattag

SEQ ID NO: 111418 - DNA, 624 bp, Glycine max
  Peptide Sequence Number=SeqID_228196
atggacccagagagtttattttcatcaaggaacaagaagtccaaatggaccaagttgcctatggaagctgggattggtccagtgaattcattcaaggataaagataatacactaagctttgacaaatttccaatggtgaaaggaatggacccagagaatttatttccatcaaggagcatgtgcatggagtccaaattgaccaagttgcctatggaagctgggattggtccagtgagttcattaaaggatatagataatacactaagctttgacaaatttccaatggtgaaaggaatgataccagagagatcattatcagaaagattaagaaacaagagtttggagagattaccaatggtattgggaatgctaccaaagagcaatctcagaagaagcagcaaatgcacagaagtacatcacaagaagcagcaaaagtggttggagcttcatggacagaagcgttggaattatgaacaccatgaggaaattttgaggaaggattcaatcacagattgtctgatacaatcaaatgctggagaagtacttacaagcaattcatgcgatatgcacacttatatgcaaaacatcgtgaaccacgaaccagagtcaagagatattatataa

SEQ ID NO: 111419 - DNA, 390 bp, Glycine max
  Peptide Sequence Number=SeqID_228197
atgacattgatagaccacattgacaaaattatgagaagtatatctaggaattggagaccacaagtaatagtgctaagagacttgaagaatcttgattctatgtctctttggaaacttgttgctaccctcaagaagacacaaacaaagatgagctcgctttcatctctcgcaaaatccatattatgtggagaaacaaaagtggttccaagtggagaagctcctcaagaagaataccccgagacaagaaggaaaaaaacaaaaagcttcatagtttgcaatgagtgcaaaaaacctgaacatttcaagtctgaatgtccagatttagagaaaaatcaagatatgaagaaattctttagcactaaagaaaagaaggggcttatgagtacatga

SEQ ID NO: 111420 - DNA, 210 bp, Glycine max
  Peptide Sequence Number=SeqID_228198
atgaagcctaagagaatgaaaataatatctgacttactgatatctgtttcaaaggctgagagacaagaagcaaggttgaaagtacggcaagactcattgagacttgggaatgttggtgtaatcagttcaattatgaattgtagagctggaactgtcatatccgagacctgggaagatggtcaagctttaaaggatctgaatgcccagctt

SEQ ID NO: 111421 - DNA, 207 bp, Glycine max
  Peptide Sequence Number=SeqID_228199
atggactccttgaagcaaagttggtacattgatagcggttgctccaaacacatggcgggagatgcatcaaagtttattcatatttcttccaaaaatagtgaatatgtgacctatggagacaacaacaaagaacattctacatcggttctaaaaccgatgttgaaagtgccgatgttgaatgtatcactgttaacatcggttttgtaa

SEQ ID NO: 111422 - DNA, 372 bp, Glycine max
  Peptide Sequence Number=SeqID_228200
atgacttacaccaagaaaactgatcaaatgatgtttgaggcggcaaaggaaattgctaacaagattgattccatggaggaggaggcttcacaggattccattgtcgcccatgaacaccctggtcgtgtgcgtgctgctggagccgatgtcacgatcgaacaatactttggaccggctccaaggacctcccacacgtcttcgtccatgtctccgaaagacatggagcagttgaggcaaaaaatcagggaccagctggaggagtggatcacagaaaaagtgactcgacaagtactcgcactacctcctgagcctgaggatggtcgttcaactactcatgtcagcacaaaggaaaatgttgtcatctggttttga

SEQ ID NO: 111423 - DNA, 537 bp, Glycine max
  Peptide Sequence Number=SeqID_228201
atgggaacaaatcaaaccggcaagaggttctaccaagtcaaggtcaaaagcccagataccaccagcatcaaggaattagggcggttgatggaacccctccaaatgcaagccttccgcaagacttacggaaagatcttagagttgactatagcagaagtgtccatagaagccattgcatcacttacccaatactacgaccagcctttgagaattgcaactgtggtcaaggattcagcaagaggtttggaccgcataaaacagactcggaacggcatagcgggcctaccacagaagtacctagaagacaaggcgaggggtatggccaatcaaggagactgggttcccgtttatggatgtgttagctttgctaatttttggggtcgtcctctttccaaacgtggatggtttggtgcgagaagagtagcgcacggatcatctgttgcttacccgccctttgtgtttggttggtttcacaccttgttccaccaagacacaagacatcccatgtccgctcctaagccatcgctcgtgtactga

SEQ ID NO: 111424 - DNA, 324 bp, Glycine max
  Peptide Sequence Number=SeqID_228202
atggtggtcatcgtgcccaaggaacacctagttgtttggttttgttcattgcataacaggccagacaactaccttaaggggatcattaacagtgctttaaaaggtcttgatgatgctctacaatctaaatcaaaggcttctgctaggtggattgtcgtcaagtgtaatagacaaaaaggaagtactgagtgcggctattatgtcatgcactggatgtccaccatcattttaggaagtttcaagaataactgggaagcgaccgttagagccagagagattaaaggcgctgcaaatccagtgggcacaatattatctccgagttag

SEQ ID NO: 111425 - DNA, 147 bp, Glycine max
  Peptide Sequence Number=SeqID_228203
atgaggcaccttgcaaggttcattttctactatgtgatgccaatgatccttctcagtatgagactgatatatgaattgctacaaattctaaatatgaatgactacatggctgttatgcattttaaattgtacttgcaccttaattaa

SEQ ID NO: 111426 - DNA, 558 bp, Glycine max
  Peptide Sequence Number=SeqID_228204
atggtaacaagaagtacatcaagattagtcaatgttattaatgaggatagtgatcaaaattctgataatacaactgaagcagaaaactcaaatacagttccagaagcaattataaacccaattaattctaaacaagggaaaaccccatcgaaattatactaccaacatccaactgcccctgtccttctactagaagaaagaggagaaaataatttcaagagtttttctgcaaataacatctatgagtggaatatagatgctcaaacagaatacaatatcatgaatacactccaacatatgacaatggtagccacaacttaccaaacctcccatgaatgttcggaagaaaccattatagacattttagtggcaagatttttcggacaactaaaaggctgcacagtcaagactgatctcaatggtcaagtcattactaatgatgatgatcaagagattcctaacgctgttaacaccttaatctttacaatagcacaacattttattggagacccatctttatggaaagataggtcttgtagaattattatcaaatcttaa

SEQ ID NO: 111427 - DNA, 567 bp, Glycine max
  Peptide Sequence Number=SeqID_228205
atggctgattatgcttggtcaatccagaccctccaagcccttgaagatatgggccttaccaaaatcccaaaactagcaaagaaaacctgggcagagatggcctcggaatcagacgatgattctaaaacaaatctttttaaacaaatccaaaaaaccaagcaaaccaaaacatacagatatggaagaatagaaaataataaacaatatccatctttgcaaagacatgcatttgtcaaatggtggactcagtttgatacttcaaaggtggctcctgaccaagtcaacaactggtttcagagtcaccctgaacttctcaaaccagctgacctagaaacatcgttgttttttaaccaaaaatctcaacttgtagtctttctagcaagctccaaatccaaggagagtcttgcaaagaatctcaatgaagttctccaaatgcttcaacaagaagaagaggaagaatcttcaaagaaagaagctgaatcttctgaagattttgatgaccaagatgatgatcccttctaccagaatgaggatgattgtttcggcatctcacttgaagaagattaa

SEQ ID NO: 111428 - DNA, 213 bp, Glycine max
  Peptide Sequence Number=SeqID_228206
atggtgggttacacacctttaagctttgcggatatggtcttcgccgatgaaaagatcgaagtgggtctgaaaagaggcaaatctgatcatccttctttgatgaatgcaacaaccggggcaaataaagaggatgagaatgagggagaaacccttgctatgactatcattttgatgcaatcctactcccaaagggtattggatagaagactctaa

SEQ ID NO: 111429 - DNA, 225 bp, Glycine max
  Peptide Sequence Number=SeqID_228207
atgggtaaagaagatactgtgttcgatgggtgtgggatatcatggtacaaactgaaggatgataacaagtgtagtagtgacgaaagcacaaataaaggccccctaatgaaggtgttatggaaagaggcaagaaatcttaggcttggacttgccattgatggaatgaatccctttggtagtttaagcactaaccacagttcgtggcctatttttctagtaatttag

SEQ ID NO: 111430 - DNA, 722 bp, Glycine max
  Peptide Sequence Number=SeqID_228208
ccaaaggaaagaccggaggtgaggaaaccacaggcgatgccgacgcggcggaagggcacgtgttcggcaacgaaggtccaggcgccgggcacttcaccgccgatggcggcaccctgcagcatgcgcaggatgatgagcaggatgggagcggccacgccaatggtggcgtaggtcggcatcagtgccatgcccagcgtggaaagagccatcaagaggatcgagaaagcgaagacacgcttgcggccgtaacggtcgccataatgcgccagtacgataccgcccagcggccgcaccagataaccggcggcaaagatgccgaaggtctggatcatcaccagccaatccggcatctcaggcgggaagaacagatggccgatcacggtcgcgaaaaatacgaaaatgatgaagtcgtaaaattcgagcgcaccgcccagggccgaaaggccgagcgttttgtaatcctggctattgaggggccgggctgccgccggtgtggtggtgggagacatgaggctgcttcttttctaaatttcgtattacttatgggaatgcggcaagcgcagcgcgatttcaagccttatgctgttcaatcactcagaaggacgggcgaatgggtggcgatgatcaattgcccgcctcgatcggccgcatggcggatgagcgcggcgagttcgagctgtttctgcattgaaagcgggctttccggttcatccagaaaataa

SEQ ID NO: 111431 - DNA, 396 bp, Glycine max
  Peptide Sequence Number=SeqID_228209
atgcggagatacccgagtggttatccgtttaaactttcttttgctatctctaagactcaaagcatgatagcacgcagagacaaacatcgtcttctgcaccctttgtcaatcgcggccaacaagcccgttgacacgcggagatttacgtcatcttccacgcagacaatttctgtcatattgaccctggagtcacgtgacatgcggagatacccaagtggcggcgggcccgatgacatgcggttatccgcatgctcgatgggtgataaatgcacagagacagattcggcgccctttatcattcaggagcaacgagtcgagtggaacaacaagttgggtggtaaacgcgcagagacagattctgcggcctttgccattcagatttcacaaattgggtga

SEQ ID NO: 111432 - DNA, 857 bp, Glycine max
  Peptide Sequence Number=SeqID_228210
atggaggacaacaaggaatcaaaagctggtccgctatttagaaaattatggactaaagttaaccaattggaacacaataggataatggacttgataactcatccttcgccagtgctgtttgatgcaataaaatcaggaaatgttgaggctgtgaagatgcttattgacaagaatcctgaattagtgacaataaaggaccccaaaaatggacggaacctactgcacttggttgtgctatttcgacaaaaaagaatatttataagtatgctatggggattggaagagcatatagtacgagcagtggaagtggacaatgaaggtaacaacattctacacttggctgcgcatcttccagttgaattccaagaattgtccagtttaagagcaagcattcaaatgcaaagagagctcgaatggttcaagacgtgtgttcctcgtgaactaagaagaatgagaaacaacatgggcaagagaccaattgatgtattttatgaagaacacaagaagttatccgaagaaataaaagatgcagccaaaggaatagccgaatatggcatgcttgtgtcaacacttgttgctaccgtagcatttgcggctgctctgacagttccaggtgataagaccaatgcgtggtttactgtcttcatattgacaaatgcagttgcattattcacttcttctgcgtctttgctctcattcttgtcaaatttcacttcatcaagattcgcacaaagcgaatttgtgaaatcactgcatcccagcttgacttttgggcgtgccttacttttcatctcggtttttgctatggttgtggctttcactgcagcctcctttttgatgtttgatcacaaatccaa

SEQ ID NO: 111433 - DNA, 229 bp, Glycine max
  Peptide Sequence Number=SeqID_228211
gacctcattgaagctcaaagatccagcctccatagaagctccacaagcaagcttccatcaagtggtaatcagagcacaagagcttcaagggaattggaaaagaggattggtgtcatcccttgaagaatttgagtcaagaagcaaggggccaaccaccttaagagctattggactaagaagcactccaaattgcgtgaatcaccaaagagagaacaaccaccaaaattaa

SEQ ID NO: 111434 - DNA, 909 bp, Glycine max
  Peptide Sequence Number=SeqID_228212
gaaactttcaaattggaaaagacgactggaagtggttttgtttacttggaagggatatgggttggtgatggtgaaaaagttgaagatgtgccttgtgtggggcgaatatttacttggtacaaaccaaatgggatagtcgaaagcaaattagacaggatccttgtctctgcaaaatggttttccaagtggcaaggaagcactcaatttatcatgtaccgcaatttcttagatcgctatccaattatgttgagatccattattgttgattggggtccaaagctgttttgggttcttgattgctggtttgaggataaatcttttagaaagctggaaaaagaaggtgatgacaaacagctgaacgacaaagagagcttagagtggcagcactctcaaatgaatccattacgaggcaaaaggcaagaactagatggatcaaggaaaggggttgtaactcttgagccaagcagggtcaaagaggaaactagacaattcttcaagaggagatttgaggaggtggagtgggagaggcctaggttggatggggttagatttaagtctatcggtcagcaagataatgatcttttggtggcatgttttgaagaggaagaagtgagggctgcagtgttgtcaaatggtggttatggcggcgccatggcagtatggcgtggcggatttttgataaaatgccaccaaatagcggtggcgttgcgggcttcaaatggtggtgccatgacggtcgccataggtttaacagtggtggcagaatgcacgcagcacgcaacacgcaccagcgcgagttctctcatggtatcacccgaagtcgacgacggcacaatgcaccatgcgtgcgagaaacggacgacgacagtgactgcgacggctgcagctatagatggtgacatgatataa

SEQ ID NO: 111435 - DNA, 348 bp, Glycine max
  Peptide Sequence Number=SeqID_228213
atggcatatgtaaaagcaatcgaggtgatgttgaggagctttgggctgttgtttgtacccttttcttttttgggtatccctattggggcatacctaaggcgtaaagattgcctgggtgaattgggagacaatttgtctctcaaaggagaaaaaggtggcttgggcgtctgggacttggtgaaattcaactatgctctacttgaaaaatggcattggaacttgtttcatcatcatggagaattgtgggtgcaagttttggactctaaatatggaagttggaggaatttggatgagacaagaaggaataatagagtctctttggtgacaggatttaagcattatttgtaa

SEQ ID NO: 111436 - DNA, 210 bp, Glycine max
  Peptide Sequence Number=SeqID_228214
atgatgcgtcaagagcatgtcgacatgatccttgaagttctctccttgaagtatcactcagtcatagtgattatagagagcaagtttgaaactcaacctcttgagcaggttgaagctttgcttcttgctcatgagccgctggctttggtggtggttttaaccatggtggtggctagcgtggcggtgtggttgagacaccctctaccctaa

SEQ ID NO: 111437 - DNA, 255 bp, Glycine max
  Peptide Sequence Number=SeqID_228215
atgtcgataactctgcttccatacccatcgagacccaacaacctcagtttgatcatgcacatgtctctcaacccatgggggagatacatgaagtacctcacctcagatatgccactgaggggtaggcatttggcggcatacccctgccaaacactttatggggccctcagtatcacccacaaccacaacccttgcatcttgtgttggaacgactgcctcttgccatggtggaaagggagaaatttgatcatataa

SEQ ID NO: 111438 - DNA, 234 bp, Glycine max
  Peptide Sequence Number=SeqID_228216
atggtgctggctttgttcctactaataatcataggaaccagctggcccctaaaatttgtaacttcagtaccactgaaacatttatcaggctggaggggtagagaagtgaatgtgcaacgggatgggttgaggttgagtacaacatgttggattctatatccagatgatgcaaaggcccaagctgttcactcaacagaggcaatggagcctgataggggggcacatcaggattga

SEQ ID NO: 111439 - DNA, 1239 bp, Glycine max
  Peptide Sequence Number=SeqID_228217
atgtctgaatgtattccggtaaaaaatatcgataccagccataccgccgaaacgctggcggcactggtgcaaagcgaccgggtccatacctgtctctatacttccgaggaaattttcgacctcgaaatcgacaacatttttaaccgtacctgggtatgggtcgcccacgagagcgaaatccctgacgccggcagctataaatcctcgatggtgggtacccagccggtgatcgtcgtgcgcgatcgcaaaggcaatatcaacgtgctgctcaaccgctgccgccaccgcgccgccaccgtctgcgaacatcgcagcgggaaaacgaacggttttacctgcccgtatcacggctggggctatggcctcgacggcgcgctgcgcggggtgccgcatccggagagctacggcgatacgctgaacaaatctgagctcggcatggtgcgcctgcgcgttgaaagctacgccggaatgattttcgccagcttcaaccacgacattgagccactgaccgacttcctcggcccggcgatgaaatggatggatctgttcatgaaacagggggctggctacgcgctgcaggccaccaccgcgcaccgttttcgctttcccggcaactggaaaatccagctggaaaataccaccgacggctatcacttcccgatcgttcataagtcgtttttaagctcggtcgataaacagaccgaagagatgctcaacttcgtcgacggcaaaggtttcgtggaagatctcggcaatggccacagcgtgatggtgatgatccccgagcttatcgatctggaagccaatctcgatgcgccaatcccggagcgctttagcgagctggcccaggccctgcgcgaggaaggccacgacgagcagcaggtgcggcgcatcgtacgcgcggtcggcggcagcggttttaaccttaacctgttccccaatgtcgcctgttcaatggccttcttccgcgtgctgcagccgatatcgatggcccggcgatcgccaaccaggcgcgcctgcggctgcacgaacacttccaggggccgatgggcttcggcacccccgatgattcagaggcctgggagcgggtgcagcgcggcggcggcgcgggcgacgatctgtggatcatgctcaaccgcggcctgcccggcgaagtccgcaccgccgacggcctgcgcagcgacgtcagcgccgaaaccggcatgcgcgccgcctatcaacaatggaaaaagtacatga

SEQ ID NO: 111440 - DNA, 720 bp, Glycine max
  Peptide Sequence Number=SeqID_228218
atggataaccattcatggtgttatccagcctgtgctcaatgtcataggaaaactaacatccaaacaggaccattcacatgtggatgtggcaaggataatgatcagcctattctaaggtatagagttgaggtcatggttacacaaaacaatgagagtgaaaattttttgctttgggaccgtgaatgtgctgaattgattggccaaacagctgatggtgtgaatagggtcaagattgaagatgatgatcttgatttgaatgcttcccctcaagcacttgacaaattgttgggtcatgtgcttgcttttaaggtcaggattcaatcaagattcaaaaatctagttgtacttaaatactcaaaagacctggatttgatcaatgctgttctggagatgctgcctgatagtgaggtgttcttttctgatatctattttagtcgttgttgtcatgatgatatgattcatgagtttgactatcatcaacttatatatggtgcagacatgttccaaatagatccttccaatgttgattgcaatgatgctacgcatgttgaatgtcaatttctatctgccacagctgaccatgatccggttgcggggttgcctttaacgcccaaaaagcggatgtcatctgatgaagccgatgatgagttagggagctctcatatttcgtcagcccagctatcgtctaacaaattaacaagacattctcataggagctaa

SEQ ID NO: 111441 - DNA, 171 bp, Glycine max
  Peptide Sequence Number=SeqID_228219
atggcctttgtggatgatttagtgttctttgttgatagggtggtggttaatgagaaaggtcgatattggctgagtaatgacattgttgggctggtgggaaatttggccatacccacattgatcctttcgccagcgaaaactaaatcagcaaagcttgaaggagaattataa

SEQ ID NO: 111442 - DNA, 381 bp, Glycine max
  Peptide Sequence Number=SeqID_228220
atggagtgcaaatccttaagcattaaggcggtgagacatagttcagtgatgcgctcaggagtctgtgcattacaacagaccctcacagttggggctgcttcagtgttgaagcagtctttggggttggctcagaggaggggccatacacagctcactcctctacatgtggttgccactttgctaagccttagaggcagttccttgagaagggcttgcctcaagtctcagcctcaccaaacttctcatcatcctcttcaatgcagggcccttgagttatgcttcaatgttgccctcaacaggctccaaacaacaccttctcctttgatccacactcagccttctctctccaatgctctcattgctgcattgaagagggcttag

SEQ ID NO: 111443 - DNA, 369 bp, Glycine max
  Peptide Sequence Number=SeqID_228221
atggagaatctgtttgatcgaaggttcagagggggccacgtggcgtgtgatgagggggagcggagaagggacacgtggcagggtttgaggggaggggagagtagaaaacgtggcgcggtggtgcctcgctgtatgtgtgtcgcgcgaatctcgaggcgcaggagaagagagagaggacgaggtgccgcttcgcgagggagggacacgtggcggggatttgaggggtttgagaagacgaaacgtggagggtgggtttttaaggtgatggtgacgttacgagcgttgggggagggtgagtggtgtgtatttgcggtgggactcgttgcggaaagggacacgtcgggaatttctcacgtactacgctggtga

SEQ ID NO: 111444 - DNA, 624 bp, Glycine max
  Peptide Sequence Number=SeqID_228222
atgggtgccaagtacctcgaagtggtcaaacgagggtcgcatcccaacaaacgggtgtatctacccaatggaacattgtcccaacttcttcatgaatctacaatgctacttggatatcagcctgactggcctgctagactatctattgcaattggagtggcaaaagattttaagccattgattggggacatcgaaatatcagaatttctagattcaatcaaaggctcgactatgattatcccatatgttggctcctctgtttacgttccaccagaatatgcatatacaatgagagtcacagaacctggaaatgcttatagctttggtgtgattctgctagagatcctgacaactcgaacatcggttgatgaggcttttggtgaaggtttggatttggtgaagtgggttcatggagctgcagcaagaggtgaaactccagagcagatactggatgcaaggcttagctcagtttctattgattggaggagacaaatgcttgctgctctaaaagtggcattgctatgcactgactgtaggccagcaaaacgaccaaagatgatgaatatagtgggaatgcttcgagaaataagaaatcacaagccacatgagttctctgtgccatga

SEQ ID NO: 111445 - DNA, 340 bp, Glycine max
  Peptide Sequence Number=SeqID_228223
atgtcgacacgacttgatgttgctaattccaaaattgccactatcaaaactgttctgaaatctcacaatcaagcgctacaagaacataccacccaactcggatctctacttaccagtgtcggagagctcatcaaatcagtttcctccctatgctcagaggtgtgtgatgggtttcattggtttcccaatggagcttcattgttctcaggttctactcctgtgggattgtccatctccaacaatcatagacttcacacaaagcacaataaacttgttaccttcattggcaatgacccagtagggtggattgccaaagctaagacgtacttcactatccaag

SEQ ID NO: 111446 - DNA, 369 bp, Glycine max
  Peptide Sequence Number=SeqID_228224
atgcgtctaccggggaaggagagtctgctgatgaaatctcccataaccataaatgagattttggatgttagcatttcgtttctaaatgaccatttagaggaaacactgggttcgacaaaaatagaagaaatccactcaaagtgtatcaatctcgcacaggtttacggtgagtcaagattttggctcaaagcttgtagaatggctagacatgatacatgtcagggtttggtttggttcaaggataaaagggatgccccacattatttccatgacacaaatgcaaaaatgatgatttggaaactttatgcaaaactggtcatgcatgcacctatgtggacactcaagtgtcaaatttttatggtcatgtga

SEQ ID NO: 111447 - DNA, 339 bp, Glycine max
  Peptide Sequence Number=SeqID_228225
atgaacacacaaaatgaatccgaaggactttctaggcttgtaatggggctaggctgccaaaaattcatggtttttctaggattcaaaagcttagataatgacaaaaagctcaaaagtcaagatcacttcatgataacaaggatgatgacattcaagaatgagttcaagattgagtcaagaacacttcaaggatcaagaggaaatttgatttcaagaatcaagaatcaagaatcaagattcaagaataatcaagatcaagattcaagactcaaagattcaagaatcaagagaagacttaatcaagataagtatttaaaagtttttcaaaacattgagtag

SEQ ID NO: 111448 - DNA, 126 bp, Glycine max
  Peptide Sequence Number=SeqID_228226
atggcatatcccggaaatccagtgagaaaattgactttaatttttcaggtcttaactcttaagaagaggaagcacttggaggaacttggacagtgtcatatgaggggtcccaaatgccggttatga

SEQ ID NO: 111449 - DNA, 648 bp, Glycine max
  Peptide Sequence Number=SeqID_228227
atggaatccaacttagtttataaggtgaccaaaattaatccattaaaaaagcttttcaatttcaacaaggataaggatggttactggaaatggttttttggcaacttggcctcaggaggtgctgctggtgcctcatcccttttgtttatctactgcctcgactatgcccgaactggtttggctaatgatgtaaagaagggtggagaaaggcaattcaatggtcttgttgatgtttacgggaagacatatgcatctgatggtattgctggactttatcgtggcttcaacattacttgtgttggagtctttgtgtaccgtggtctcttctttggattgtatgattccctgaggccagctctcttggttgggaattttcagcttggctctttcgctgactttagcatagcatttctcgcctgctgtagtgcaagaaggaggagggagggggagctatggaagttgcctatcttgagcggtttgattgaagggagaaataaggaggattttgaaaatttcggtgggccacatgaaagtcaattttcccctctaaagtctaaactgtgtgaggaaaatgtgattgttgatgatgtgtttaccattttgttagtaaatgcgacgatagcaccacaacaaagatggaggaaatga

SEQ ID NO: 111450 - DNA, 297 bp, Glycine max
  Peptide Sequence Number=SeqID_228228
atgtatgcacatgcaattgaagatctatctgcttcatgcagcaaacactctaggcagaacaatgatggtgctagagttggggaagaaggggctctcggttggtccacatggttggacaaagaggaggaaactaggccacaacttatgaatgaggaactctcacgtgaaaatgaaggtggtggttggactggttggtcagaaccatggtctaaagataatgagggtattgccaatgttgaacatgaaaccatgaatgacgtggttatggagaatattcaagatgaagaggaatactaa

SEQ ID NO: 111451 - DNA, 306 bp, Glycine max
  Peptide Sequence Number=SeqID_228229
atggattgtgggggtaacaagattggtggaagtgataggggtgggccttgtggtgcctgcaagtttctgagaagaaagtgtgtgaagggttgcatatttgcaccatactttgactcagaccaaggaacggctcattttgctgcggtgcacaaggtgtttggtgctagcaatgcctctaagttactcatgcggattccagcacacaaaagacttgatgctgttgttactctttgctatgaggctttggctagggctagagaccccgtttatggttgtgttggtcacctctttgctcttcaacaacag

SEQ ID NO: 111452 - DNA, 426 bp, Glycine max
  Peptide Sequence Number=SeqID_228230
atgagtgaaatcgaagaagtacaggaacaaatgaaggtcaatatggaggccatgaaggaacaaatgacaacgatgatggaagcaatgatgagcatgaggaagataaaggaggataacactgctacagtttttgctgtgagtactgctactgagatggatccgattcaccaggagaatcctcgaggttttgcacttccatatttgagaagaaaactcattcgaccaggagctcgtggaaaatgcccaaagatagatagtaggcccgtgtcatcaagtttcagcgggatcgacagatccttggcaccaatctatgaccttagatcaggaaagtttcacttggtcatataccaaagcgtaacaatccattgccatccttcaatggtgcatgcgataggtcccaaagccttatattttcttgttgtgtag

SEQ ID NO: 111453 - DNA, 321 bp, Glycine max
  Peptide Sequence Number=SeqID_228231
atggtccttgcgagttgcgtggttcagtctcttatagtcaatgtaaactcaccaactgttagccactctagttgggatcaactcattatcgtggttcctcataacagtgattcccgacttcctagggaccacttggacaggtctagaatcatcctcaaagagtatccgatgcacgcatatggaaggatttattccaagaagctccaaggaatgtggctgaatggtggaaggcaagggaaggttgatagctggtgggagagaaatgaaaggataagtgatggaagcttgcttgtggggcttctatggaggctggatctttga

SEQ ID NO: 111454 - DNA, 402 bp, Glycine max
  Peptide Sequence Number=SeqID_228232
atgaggacattgagtcctatgaaagataaagcagaagacattgaagtctttgaaagcgcgagaactttgagtcctgtggaagataaaggcgaggactttgagtcctatggaaacataaaggcaaggactttgagtcctatggaaacggcgaggactttgagtcctatggaagataaaggagaggactttgagtcctatggaaacataaaggtgaggacgttgagtcctatgaaagataaagggtctctattcccaaactcaaaagataggacaatggattttggaaattggcatataaagagaaatctgtgcacttatagcctgatatggagcatgagttttggaatgcagaggcatgcaaacttcgtcttcaaatgcaataaatgtaggctttgtatctag

SEQ ID NO: 111455 - DNA, 228 bp, Glycine max
  Peptide Sequence Number=SeqID_228233
atggttgatgtctgtcagacccaaaaacaaaagccacaaggaaaggggcaaaatggtcattttctagaaatttctagacctaaactcgcccaggccaacatctggctcgcctgggccatggaaaagcttcagcctgaagcaaataacatgcctaggctagctgataccttcaagttgaagcaaccaactcgcctaggcgagctaatgacttctagcttaagcaactag

SEQ ID NO: 111456 - DNA, 168 bp, Glycine max
  Peptide Sequence Number=SeqID_228234
atgtactttccattttatgctggtggtcagggtgaagatttggatattacatgcaaaataaaagagaagggggaaactgggtgtaccttgaggcatgctttatggcatcaaaaaccttcattcttcaattcagtacaaaagaggttgccaagacatgtgccaagatga

SEQ ID NO: 111457 - DNA, 342 bp, Glycine max
  Peptide Sequence Number=SeqID_228235
atggtcatgaacttgcaggctgagttaacctatgtccaggctcgtctcgcgacgatgcagcgactgccaatgcaagtggctcctcttccacaccctcaaagctcttcaccaccaccaacctttcattcctcagatcacttggcatcaaatgctgacttgcaaagtgcccctatgatgcactttgatcctcttcagccacattcagcatcattagagttaagcagcgtcgttttcaatcaatcagatcaacaactcgaggatagggaactccaagttttggcacgggaatttgtgagcaaatacttgcccggagtaaggttccagcaatacaactctccctga

SEQ ID NO: 111458 - DNA, 1878 bp, Glycine max
  Peptide Sequence Number=SeqID_228236
atgaataattccaagaaacaagaagaggaagacgaggttttcctcccgcacccccccgatctgtcccctccccacccccccgatgcgtccttctctctcctcttcccctcctccccttcctcctcacactcctccccttctccttcttcaccccccaaacccctcttcatctcccccgacccccacatctcgtcccagttctacaccttcaccccctcctcccacgccctcatgctccgctccctcctcctccgccgcctcccctccccctccgacatccgctccgccaccccccgctccgtgctctcctcctggcgcaccgtctggaaggaccgcaacgaggacaccgcctacctcaccgcctggaaacgcatccaggacaagcttaccacccaccacgaccctgattccaacacccacttcctctgcttcaaaaacaacccccaccaattcgtccctcacgtcaaccagtggcagcacatcgtcatgtcccaccactccgactccgacctctgccacctcaacctcaaggacaccctcgaccgcatcaagcaccactggactgtgggcgccaaattctacggcatcccggagagcttcatccgcgtctgcgtcgccgcctgccccgtctgctcctctgccaccactgagggcggttcctcggatccctccgtggcagcgcgtggcaagcggcggcggttcgagtacaccgagagcttcgacgtgccggccagggaggtccccagccggctccagcagcttgctgcaaagcacaaggttgtgctttgcataaggcagaagtatattaggtataagccttttatggctgaggttaaggactatgcttgccatagggctggggagcctgctgctaagaaatctaaggttttgaagagggagccctatgcttccaagaggtgtggatgtgggtttaggattagggcaattgtgccgattgcaaattataatgagaaggataagagttttgtgtatcaggaggaaggggtggcggttttcaagctgtatgctgtgcactccgggcacgagccggggccgttggacgggaatgcaaggattatgcatagggttgttgggcataaggggggtgggtttttgatggatcaggagaataatgtttatggggtgagtgaggagatggagggggagggagggtttggggggttgttggggaaggaggatggtggtggggatttgcagttttcggtgatgcagcaggtgcaggagttgaggaatgaggtggggatgttagaagggaaggttgggaagatgccaagggagatgttgggggctatttcgagggagttgttcgaggttttgaataaggttaggagtattggggaggtggggttgaagccggggattgagttgattgcagataaggctgtggcacacggggtggtggaggatgatgtgttggttggggacaatgatttggctaactggagcaatcatcacgagaggatttatggggatggcaaggacaccgagctgattgaggatgacgaggatagttttggccggacgctgggagaggttgtttcgtggggtgatcagatgacgacagagtgcaggagtcagaaggatgatctgatgagtgacacttgtaagccggagaagtggttgaaatgcagcgactttgatgagaaaagcattcttgattgtgaggacagtaaactaaccaagcccgttagattgatcagacacgacgagggtatagtgtcggatgtagtaggtcttggctgtatgcaggttgacagtttctacccggacaaccctaaatggtatgattctccttgtgctttggatactggtgctgattgtggagatagtgcattccgtcatggagagattttatag

SEQ ID NO: 111459 - DNA, 315 bp, Glycine max
  Peptide Sequence Number=SeqID_228237
ggaattaatgcaaatttcacttcattttctggcaaaaaggagaaaaattggaaggtgcagcagctgcatgcactcagtgcgttatcagctcgtccaacgagtcaattgtctattctggtgcttaggatgcctggctcgctaagccaaagttcacttactcgtgctaagcgtgaaaatggcactaagcgcaccttcgaggacagaaagccctttttaaagcctaaagtgaaaaatcaaaaagaggaagaagagagtgcggagaacagagaacagaggcacaaaacagagcaaggaagcaaaaaccttagcttctaa

SEQ ID NO: 111460 - DNA, 288 bp, Glycine max
  Peptide Sequence Number=SeqID_228238
atggctgggggagaagacatcatgagggtacaaatatgttggttcaaagtgagaatgcaaggtatacaaggggagacacttggtgttgcgagaattgaaaataaaggtagcctttgctatttggatggacaagtcttgaaaagaaaccataagtgttgggagatacttgcgttcgatggggagtttgttcactttcaaattgatcgaaggatatttctcttttggcttgagggggagaattatagagttccaagccaaaagataaggtacatgcatattgggaattga

SEQ ID NO: 111461 - DNA, 390 bp, Glycine max
  Peptide Sequence Number=SeqID_228239
atggaagctgtcacaatgactcttgcctctgacgaagccattcaatccttgaaaacaatcaaaggttcactcttcttgaaactgaagaatgtagctttcctaaggaagagtttcatgccgaaaaagatctataccaatgtcgaagtgagagtggtcgtgctctacgacagcaccatcgtcaccttttgttctcaccgctgccacttctcctcgcttctaggtccctttgtcgtcgtatcccttggcatcatcagggctctagtttgtcaggaagtcctcgccaaggagccctcaccgccaaaggttctcccgaacaacatcgttctctaccagttcgaggcttgctatttctgcaacaaagtcaaagatttaaaaaccgtcttagaatga

SEQ ID NO: 111462 - DNA, 333 bp, Glycine max
  Peptide Sequence Number=SeqID_228240
atggttatgtatgctatgacaattgggagagggaatctttttttaaggaatcctgccagcaccaataacgggttaacgtatcccaccagtacgaacaacgacttcttcatgcatggggttccgccactcccattggcgataccccatgcccaccatcaacacatcatcatccatcctgtgcaccatcatccatcataccatagcaatttccgccagtcaaagtggcggaattgctgttgccctatccacgtggacccgccattcaaagtggcgagattgtcttacatggacccgccattcagagtgacgagattgtcttgtcttgatccgtag

SEQ ID NO: 111463 - DNA, 792 bp, Glycine max
  Peptide Sequence Number=SeqID_228241
atgaacccaatgatgatcgaacctgcaaacattagttcttcgtcatccttcaatatcaaccccaaaattgttgaagaaagaatgggtccctacaacattcgtgtgataaatgaacaagtggtgaagcccaatcccagagatacattgagattcaatgtgactgttacccttcgacaattttcaatttatgactggcgtctgcgtctcataagaacctcaaccttgttggaaacttcaacatccataagcttccaaagcttgtttgaagataatcaagattttttacgatcagtattatccaacccagaatgttttctctacttcatcccaagaagttttgatcaaatatcacggaatattgtttccgttgttcaacgagccttggaggttcagggctccccttcttcggctgagtctgcagatttcgaatgcgaagtgttccctttgactttagatattttcgtggacatgctggaagaagtagatgaagaaacgcttgcactaatagaagaggagtccatacagcaagaggtcgcaatgattccagcctccaatgaagccatacactccctgcaagcgttcacagatccactcttcctcaagactgaaaagtgtaatatttgcatggatgagttttatgctgaagagggtaatgaagatgatgtcaagttattgtcgtcttcgtcaatgccatgcggtcatgtgtttcatcatcaatgcatcgtgaagtggctgcaaaccagtcacacgtgtcccttgtgtcgctaccctatgccctctgtccacgactag

SEQ ID NO: 111464 - DNA, 384 bp, Glycine max
  Peptide Sequence Number=SeqID_228242
atgtcgaatcaaaagattgagcttattcttccagatgagctaaactacctacaggagatctatgcatacaaaatattgacaaaaacaacagttatccaattcaaaaagaaaacaaatatagacaaaacaaaagttccctggtgtcgccatgtgcccttcgcgggcgagcgagggcgaggctcacgagtgcgcttcccaaaggaggaaagatgcgcggagttgccacctacgtttatttgtgaaaaacgtcgggaaaaccgaaggaaaccggtcaaaatgaaaattctaagttcgggagttgtatttacgtttgaggaaggtcgacaaaagcggggctcttgctcctacgtaccctccatcaaagaggaaataagacctacgtag

SEQ ID NO: 111465 - DNA, 240 bp, Glycine max
  Peptide Sequence Number=SeqID_228243
atggaatggaggaagtgctacttggatgttatattggtgcccttggtgtttctaacaagcattgggtaccatttctggctatggcataaggttcgaactcagccacacacaaccatcattggcatcaatgctagtggccgtagaaattgggttaatgccatgatgaagtgctcacgaaacatatctttgtccacaatttttgcggcaaatgaacttggtcggtataaggttcatttataa

SEQ ID NO: 111466 - DNA, 138 bp, Glycine max
  Peptide Sequence Number=SeqID_228244
atggagaattggcgaacagcgctactcataacttcgcggggctccagactcgaagagaatggagaattggcgaacagcgctacgcataacttcgcggggctccagactcgaaggtggagggtgcatgaactgcgctag

SEQ ID NO: 111467 - DNA, 312 bp, Glycine max
  Peptide Sequence Number=SeqID_228245
atgagtaaaaagtgtgaggattcccaagtttttggacttggaatggttctctcatcaagggttcaactttcctattatgttggaagattgtcaaagctggtacaaatgaaaggaactttttatccaaagctagtcaaggttttctacacccctttcattgagtacttcaatattgatgtctctaataagattgtggactttactaaagcatctagtgagatcaccgaaaggcatctcaagaagcttgggatgagatttattgatgatgaatggataatggttggagagccggcagctggaaactttgactag

SEQ ID NO: 111468 - DNA, 204 bp, Glycine max
  Peptide Sequence Number=SeqID_228246
atgcatagttctaactctaaaaaatggattgacaccatgaaagatgagatgaagtctatgaaagaaaatgaagtttgggatctagtcaaattgcctgaaggtatgaaacctattggttgtaaatggatatttaaaaccaagaaggattcaaagggtaatatcgagagatataaggctcgtctagttgctaaaggctttacttag

SEQ ID NO: 111469 - DNA, 201 bp, Glycine max
  Peptide Sequence Number=SeqID_228247
atggaaagtgtatctgttgttgtgtattgcgatggtgatatgatttcatcatttgaagagatattgcttgaatgtcctagtggccctacaatcgtcacattgagtgaggaggacatattgtttgatgccttaaggaaaacaattatggatgtcatcgaagctaacaacgttaattttaatcttaatttcaagccaacataa

SEQ ID NO: 111470 - DNA, 630 bp, Glycine max
  Peptide Sequence Number=SeqID_228248
atggctaataattatagtgtgttagagctcaaccttggtttaggcaacaacaacgttggtggtcatgcagggcaatcaccaaggcaaaggtgccccgcaccgtttctgttgaaaacgtacgatttgttggaagaattaggtgagaacattgaagatagcaccaaaattgtgtcgtggaatgcagaaggaactggctttgttgtgtggtctccatctgagttctctgagctcaccttgcccagatatttcaagcacaacaacttctctagcttcattcgccaattgaatacctatggatttaagaaaatatcatcaaaaagatgggaattcaagcacgagaaatttcagaggggttgcaggcacatgttaggtgaaatcacaaggaaaaagtgcgagccaagtgtgtttcctgcatacctcaagtcttcttctgaggaaaataatgcaacgagttccacggaagaaaacaatgatcatcaactacttatggaggagaacaagaacctaaagaaggagagattagagctgcaagtgcaaatagatgaatgcaaagcacttgaaatgaagttgttggaatgtctctctcagtttatggacacccaccaaaataaagttaggagactatgttaa

SEQ ID NO: 111471 - DNA, 324 bp, Glycine max
  Peptide Sequence Number=SeqID_228249
atgttgagtttgcgatgcgaactagccatggttcctttctccgaaccatgcgtcacggacaccgccatggttacgggagaagatggttatggttacgaacacgatgattcgccgaatcgaatgcggttccatgaaactaacaagatggctcgtcgtttggaagttggaggttggaactatctaactagtcacgacatggaagagagattggagagggtgctgtggggtgaagacatcggagagggtgctgtgggggtggacggcgaaggagcggcggcgagggaagggagcgaggttggaggtggcggggctgagaaaatttga

SEQ ID NO: 111472 - DNA, 258 bp, Glycine max
  Peptide Sequence Number=SeqID_228250
atgttgagaggaacacgagagaggtcgagaagtgcaagagctgagacttgcgagagtggtggctcattgtggctcaagttcagatttgcgagagaggttgagacttgtgagagtggtggctcacggtggccattcacggtgcaaaaactacaaattgagagagaaagagatagagacggagatagcagagaggtcgagagtcgagattggtgtggacatgtggtagcaacacaaagagaagagactataacttattaa

SEQ ID NO: 111473 - DNA, 660 bp, Glycine max
  Peptide Sequence Number=SeqID_228251
atgacgacgacgaggacaacgatgattcatcctcatcttggtataaatgctgattctgataagggttgccatatggaagttgttgaccactttgagatgatgttcactactaagaaaactgcattttatcgggtttcaacctcaaactacaccaatcccctcgacgacgacgattggggcgacttcatgaaccattccaaacagatcaacgaaaaacccttcgactcgttcggggttcccacggatcccaagggagctattttgctttcgatcttcggcgaggaagagggaaaagaagaggagaaacccgcttctggcaatgttttctccaacggcgatggtggtgcagtgaaaaggggatccagttcgaacgggtctgttggaatcagtgatttgatttccagtttgtataatcagcagcaccctcaggtggattctcataacaacaaatcggtttcggtatccaatgttgctgctcccaatctgacgtactcgaacgaaagcaaattgaattcagatgaggatgaagatggaagggaattcaagtctacggagtgggaaactggaaccaagagccaggatgttaaggctgaaacaccaaagcatgataatggtgctcttgatgttggtattgtgttggattcatccaatgagatttag

SEQ ID NO: 111474 - DNA, 428 bp, Glycine max
  Peptide Sequence Number=SeqID_228252
atggatgacggtggctactactcaacaacaacctatttgagcagttcaatcgagcaagtgatgaggcccaaatcaccattgcctggccttgttgattttcatgggaagtggaagcaaatggttaagattcaggttttggagagagagattggtttgcttcagaaaaactgcccctacgtgatcaccatagaaaccacatgcacatggggagctgaaacctcgaacattgtgagcttaaggatgatgatgcctttccatcacggtcactatgagctatgcccttgccagggccatagaggaaccatagtggtgtggcatatgtcatccttgcaaacagggcactgggggtgctcactggtgcaagagaagcactttggacatggaatcacttgtagatgcagggccagcagtataggtggccacaaagg

SEQ ID NO: 111475 - DNA, 546 bp, Glycine max
  Peptide Sequence Number=SeqID_228253
atggagaacgacatgggtctggatgtggacgccctcaacggcatcaacaaggaagagggtagtggggaaccttcacgggatcaatcaaagttgtatatctttcttgagattgtaacaaaaggttcccttagaagcctctatcagaagtatactcttcgagattcccaagtatctttctatacgagacaaattctacatggtttgaaatatcttcatgaccgaaatgcggttcatagggatatcatatgtgcaaatatattggtggatgcaagtggatttgtcaagcttgcagattttggattggcaaagtttgaaattgattatgttggtcaaagtgaattggcattaaatgaggatctatataacacaaagtacaaggacaagttggagttgtcttataaggactgcttgggaaaatggaaaagagcatcttgcatatttaaacatcatgacgcagtagctgatgtgtttcattctcaattcaataaccagggacttattcatgaagtgttcaccacaatattatgtggcttgtctagtgactaa

SEQ ID NO: 111476 - DNA, 189 bp, Glycine max
  Peptide Sequence Number=SeqID_228254
atggctttatatcaaatatgttctggactcactacgaagaagttttttgactacattcagcttccaaattttgacatagctgtagatgccacagcaacttttaaggagctaatgacaaggcataaatctactgtagctgatttccttagcaattattatgaatgggtagttttgacacttgtctattga

SEQ ID NO: 111477 - DNA, 291 bp, Glycine max
  Peptide Sequence Number=SeqID_228255
atgcatgcttggaatggttttcttggcatgtcatcgagaacctctggttccaatggatcaactttccttaggagtggttttcatattttgtttctaatcactgctgatgatgatgattctaatcactgcctagccttcatgttcatgaatttggtagttccttttcttctactaggagtggagtatggccacctaattgctggaaacttcatatctgagggcttcaaatcatggttgttggacacatggagtgcttgcactcacaagaagaaagtaatggcacactactaa

SEQ ID NO: 111478 - DNA, 126 bp, Glycine max
  Peptide Sequence Number=SeqID_228256
atgggggaaagttctacagttctagacctaaagccacatgagggaggagaagttgcctttggaggcataggtaaaggaaaaatctctgatataggtgtgacaccctctaccccaacatatatataa

SEQ ID NO: 111479 - DNA, 866 bp, Glycine max
  Peptide Sequence Number=SeqID_228257
gaattacaaatgattctaaagatccatctattgataccttcaagtcaactactttacctatattgaagcgctttggagttccatttgaagacttggagcttaaagtagagagtcgtggattacctcccaatggtggtggtgaagttgttttgtctgttccagttgttcagaatctaacggcggttagttggattgatgagggttttgtgaggaaaattagaggaactactttttcaacaagagtgtctgttcagtttgaatatagcatgattaaatctgcccgtggaatcatcaatccgctggtttctgatgtgcacattttctctgatcacagatcaggtccagaggcgggaaactctcctggatatgggatttcgctggttgcagaaactacgtctggttgcttcatctctgcagatactgctgtttctcaagcaagggatgaagatacttctggccttgcagatgatgcaaaaagagacttgatgcctccagacgatatcggtgtggggattgctaatgctttagtaggggagatagctcaaaatggagtggtagattcaacacatcagggtttgttatttcttctttgtgctctatgccctcaagatgtttccaaggttcgtgtaggaaaactttcccagcatggagttgaaactctcagaaatctaagggattttcttgatttgaagtttattatcaaaccagatccgaactcacagtcggtttttctaaagtgtattggttatggcatgaagaacctttctcaaaaggcaactgtgtacatgttcttgcacatttgcttcagagatctggaacttaagctgtacttggttccaatctctctttatgattggtccctataa

SEQ ID NO: 111480 - DNA, 330 bp, Glycine max
  Peptide Sequence Number=SeqID_228258
gggaaatccaacaggcacatagatgtggccctagtcaaggaattctatgccaacttgtacaatccagaagacaagtcccccaggcaggtccgagtgcgggggaaactgataaagtttgatgccacttccctcaacaccttcttggagacaccacccatcctagagccagaggagcagtatattgcctattcgctcttctgccggacccacattgaccctcaggagttggctgccaggctctgcatcctagggagggaatttgttttgaatgtagagggggcgccatggaagttgcttaggaaggacctcaccactcttgctcagacatga

SEQ ID NO: 111481 - DNA, 297 bp, Glycine max
  Peptide Sequence Number=SeqID_228259
atggctgtccaaccgaaaacaacaaaagagacagaagcattttgggacataactgaagtctcggtttgggtttcctctggactccagcaacaccaactagcagcagctgtctccaagattccagcaataacttgccaacttagaagatcacgcaaaagaggagttgagttgagagggaagagagaaaacaaatatgaaggagagtgttttgagagtcatcaagtttctgggaagagaagcagcttcggtggagctgttgtagtatttgtgctatgtttgttgttcttgcctgtgtag

SEQ ID NO: 111482 - DNA, 660 bp, Glycine max
  Peptide Sequence Number=SeqID_228260
atggaagccagagaaggtattagttctggggttacagtgataggtgcagaagctccatcagcttaccatgtggcgccaaggagtgaagctccaaaccaggttcatgtccctgatggtggtggtgctgctgctacagctgcacctgttggtgtctcacctgtgagtgcggggttggatggaacagcagttaagaagaaacggggtaggccgaggaaatatgggcctgatgggtcagtcactatggcattgtcaccaatgccaatttcgtcgtcggctccgccttctaatgacttttcctccgggaagcgggggaaaatgcgggggatggactataagccatcaaaaaaagttggtttggattatctagcttacaagccatccttttgtaccaagaaaatttgcaaagaaaggaaatttgtgttagcaagggagtctgcctctcttgactttcatttgttacatttttacttttttggggggatgatgaaatatgcaatatcattgagattgaatgcttctgttgaaatgacatggtatttcttgaaaggtgacttgaatgcatgctctgatggtacaaattttatgccgcatatcatcactgtcaatgctggcgagatagtaggagtgggggaagatgatgagatagtgtggggaaaatga

SEQ ID NO: 111483 - DNA, 201 bp, Glycine max
  Peptide Sequence Number=SeqID_228261
atggaaatagttaagaaaggggtggtgttgctagagagaatgagaacatgctatatggacatcacgatgaaggtgatatccttttctcaacaaggaccacgagctatatgtatcttatctgctaatggtgtgatttcaaatgttacacttcgtcagcctgattcttctgggggtactttaacttatgaggtgcggcagtaa

SEQ ID NO: 111484 - DNA, 312 bp, Glycine max
  Peptide Sequence Number=SeqID_228262
atgacacccccaccgaccaaatcaaccgaagaactcatattgagaagcagtgaaatagcgaccattggtgccatcttcaacttcggtgggaaaaaacctgattatcttggagtgcagaaaaacccaccagcattagctctgtgtccggcaactaagaactgcgtgtcaacctctgagaatatcagtgatcgcacacattatgctcctccatggaactataatcctgaaggtaggaaaaaacctgtgagcagggaagaagcaatggaggaacttatagacgtggtaataaatgcaactgaactgaaatcttga

SEQ ID NO: 111485 - DNA, 219 bp, Glycine max
  Peptide Sequence Number=SeqID_228263
atgtcacgtggaggtgaaaagacaccagacaagaactttgcaaggagatccgtccatgctggtagattggctcagcatgagcctttctgtggtaattcttggctggagaggtcactggaaaactttcagccaaggcagaggaccactggcaatggccagagaagcatttcaggtcgctggaaggaggaattgacagcagaaattgaaaactgtggctga

SEQ ID NO: 111486 - DNA, 252 bp, Glycine max
  Peptide Sequence Number=SeqID_228264
atgggaagaggcacagtagtgctgggcatggtgactcgtgcctgtaacccaagtgggagtaataaaatgtgtggaaggtgtcaccgtgggagggtgttgatgttctggagggacacgggtggaggtgggaactgggaagctttttaccttgcagccagcaagaacaaaaaattaaagaagccaaagtctagtgattattgcagtgtcttctgcaccatcacctccaaaccaatgctgaaaaagaggatgtga

SEQ ID NO: 111487 - DNA, 501 bp, Glycine max
  Peptide Sequence Number=SeqID_228265
atggcattggcagcaatgcatcactgcaatccaatcttgtgctgtattcttactgtcatagctcttgctcatggcgtattcgatttgctttatccctcaaaggtttttttttacttctttattgtaatttttgttcccaagtcccaacttcccatattaacaattacactcggtttatatctgtgtttgacttattttgagaaaatagctttgtcgccaataacggtcttacatgactctgagcagtattggctccggcaaaagatacctgttaaagatatcaatgggatcccatatgagtacaaagcagtggatctttcaaaaggagagcagtacagtccagaattcgagagattgaatcctctgcactatgttccagtattggttgatgataatgtggtggtttcagactcttatgcaatatttctgcatttggaggaaaaatatactcagaagccactgttgccagttgatcctcagcttagagctctcaatcttcag

SEQ ID NO: 111488 - DNA, 234 bp, Glycine max
  Peptide Sequence Number=SeqID_228266
atgcattctgttcttcctgaaattgagaaagtctgctccatgctagtacaggaaaagctgatctatagcaaatatgatgaagtgggaatagtcttatttgaaactgaagatactaataatgaacttactacggaagtgggtgggtatcaacatgtggtggttttgaaagatactaaagttgtggatggagatattttggaggctttagtaacaactgcctcgaggaacaactga

SEQ ID NO: 111489 - DNA, 297 bp, Glycine max
  Peptide Sequence Number=SeqID_228267
atggagaaaatgttttgtgcagaatcaaaaccatgggcccaatttaccattgacaaaggtttctcagctcttgaaaaattactgaaggattttgctggtacatatgccacaggagaacatatctatatggctgatgtgtttttggccccacagattacactggcagttcagagatttgatattgatatgtccaaattccctacccttagtagattgtatgaaacatacaaagctttgccagagttccaagcctcatcaccacaaagacaacctgatgccttgattcataacccttga

SEQ ID NO: 111490 - DNA, 345 bp, Glycine max
  Peptide Sequence Number=SeqID_228268
atggacactgatctgatcttatttgtcaatagcggccgtagcggccgctatagcggcggggcggagcggaacccatccgcgacggacacgtctgtagcggtgcgatttcaggtcgcggctggagtggccgctatcgcggcggagcgtagcggcgcggtgcgggttgcggagcggttttttgcgccgctacttcgaagcactgatggtatgagtgggttcggtggttctgttgcttcttctgctttgttcttcccagagagagggaagagagagaaggagggagggagagagaggaagagagagagggctttcttgcggcgcggttttaatataccaggggattaa

SEQ ID NO: 111491 - DNA, 3909 bp, Glycine max
  Peptide Sequence Number=SeqID_228269
atggaaacttgggaatgttctggagaccaaattgagttcaattctcaaagtttgggcaatagtgatagcaatgcactaattttgccagctaagagggtgaggaaaaggaaagggaaggaacaggaaaatggaaaagtcaaatcaaataagaaacaaaaattgagcaaacctcagaaaaggaagatgaagaagttagaggatgacaaggagaagcaacttctgctggaaaaagccattaagacattgaatgaaaacacacttccagagtatgcatatcctcttttgctgtcttcatgcaatataaatcgggatgagactatgaaggaaaagcgtaggagggctgttcatttattaaaagaaggattggaggtttcatatgatgggctgtctaagaaacctgagacggatgagattcatttagagcacgctgatgaagtcgaagaaaatgaaattcaaattcaacccattagatcagaggaagtcttaaatacaacatcagtttctttggagtcctctcaagaaccagttcatggcaatgaagttgaaaattataaatatgtctctgaacatcctgctgacatttccattgacaagcatcttgatgaaatcagaagttctaccatgtcttgttctactgatgaaataaaaagcaccaagtcaaaggataggacagatgagaaccataactccaatgaattgagcaacctttcagattattctgcaccaaggtggtcaaatgttcctactgttgtgcatgtgtatagaccaactgaggttgaagacaaaagaaaggatctacctatagttatgatggagcaagagataatggaagctataaatgaccgttctagtgttatcatatgtggagaaactgggtgtggtaaaacaactcaagttcctcagtttctttatgaagctggttatggttcaagtaagggtattattggtgttactcaaccacgtcgggtggcagttcttgccacagctaagcgtgtggcttatgagcttggtcttcgtctagggaaggagaatgatattttgttgaggcgctattctgtcttaattcttgatgaggctcatgagaggagcttgaacacagacattctgattgggatgctctcacgtgtaattaaaacccgccaaatgatttattatgaacagaagaagatgatactttctggggaaagtgtaagtcctgaaaaaatgatttttccattaaaacttgtgcttatgagtgccaccttgcgagtacaagacttcacttctggaaagttattccatactactccaccagtgatagaagttcctacaaggcaatttccagtaacagcgtattttgcaaagaaaacagagaaaacagattacattggagaagcatataagaaggtcttggctattcacaagaggttgccacctgggggcatacttgtctttgttactgggcaaagggaagtagaggacttgtgcaggaagttacgcaaagcatcaagggagtttatcaagaaaaaagttgaagggtctgtggaaactgatagcactgtggtccatgaaacaaattctgttgagggagtaaatattaatgagatcaatgaagcatttgaggttcatggaagttcgtctatccagcaaaccgataggtttagtggctatgatgaagatgaggacgatgtaaattggaatgaatctgaattttcttatgattcagaaacagatagtgaactggaatttgatgaggatgatgataatcttgagctttcagagaacagaagtaatattgttgatgtcttaggacaggcaggaagtcttgcttcattgaaggctgcttttgaaaaattgtctgggcaagccacattaagctcctcaaatggagaggagacatctgtgaatatagaaggtaatttagatcaatcaaaagttttcagggagaaaagagccaaagaaaattgcagtactccaggtgcactctgtgttctacctctgtatgccatgcttcctgcagcagctcaacttcgtgtatttgaagaagtcggggatggagagcgccttgttgttgttgccacaaatgttgctgaaacatctttaacaatcccagggataaagtatgtggttgatactgggagagaaaaggtgaagaattatgatccctctaatggcatggagacatatgaagtacaatggataagtaaggcatctgccgcacagcgtgcaggcagatctggaagaactggacctggacactgttaccgtctctattcttctgcagcctttagtaatgaatttcctgagcactctcctgccgaagttgagaaagtacctgttcatggtgttgtccttctcttgaaatccatgcatattaaaaaggttgcaaacttcccatttcctacttctcttaaagattcttctctgcttgaggctgagaattgcttgaaagctcttgaagcacttgataacaaggatgaacttacacttttaggaaaagccatggcacattatcccttgagtcctcgtcattctagaatgcttctcactgtcattaaaaatacaaggcatgagcataaatgtaatccaaatatgcttctggcatatgctgttgcagccgctgcagctttgagcttgtcaaacccttttgtaatgcaatatgaagatgatagcagcagagatttagagatggttgagaaatctagcttgggagacggtgagaaaggcattggtaaaaaagaaaagtcaaggaaaaagaaactaaaagaaacagctaaagttgcacgtgaaaaatttagagttgtcaccagtgatgccctaaccatagcttatgctttgcagtgttttgaacattcagagaaatcagctgaattctgtgatgacaatgcattgcatttcaaaaccatggatgaaatgtccaaacttcgacaacaactacttaaactggtcttttatcagagtgataaaggtggttttgaagaagagtattcatggattcatggaagtttagaggatgtagaacgtgcttggcaggcttcttcagaaaaatatcctctttctctggttgaggaaaggctcatctgtcaagcaatatgtgctggctgggcagatagggttgctaaacgtattacagcttcttctagggcctctgatggagagaaaacttctcatgctttaaagtatcaatcaagcatggttgatgaaagtgttttccttcatcgctggtcatcagcttccatagtaggccccgagtttttggtttacaatgaactgttagagaccaaaagaccaaacaaagaagggataacaagtgccaagagagcatatatgcacggagtaacaagtgtagagccagcttggttagtcgagaatgcaaagtcttcatgcatcttctctcctcccctgacggatcctagaccttattatgatgcccggactgaccaagtaaaatgttgggtaatcccaacctttgggcgtttctgttgggagcttccgaagcattcattgcccattagcaatgacgaacatcaggtgcaagtgtttgcctatgctttgcttgaaggccaggtgtgtccatgtttaaaatctgttagaaaatacatgtcagccccccctgaaagtattatgaagagagaagcatttggtcaaaaaagggtgggaaatcttttgagcaagttaaagagcaggctgattgatagctctgctatgctcagaatggtgtggaaggagaatccaagggaattattttcagaaattttggattggtttcagcagagttttcacaagcactttgaagagttatggttacaaatgcttaatgaagtgcttatggagaaacaagaaagccctcttcataaaagaaaagaatgcatccaagctttaaccaagtcagtggtgactaggggaatatccatcatgtattcatcctga

SEQ ID NO: 111492 - DNA, 996 bp, Glycine max
  Peptide Sequence Number=SeqID_228270
atggttcaagctttgccccaatacactgaacaagtggaaaagatctcacttcatgtagagatagctggaaagattaacaaaattatcagagaaacggaccttcgagagcttggacagttggaacaagatcttgtttttggggatgctggagccaaggaagttattaactttttaagaacaaagcagaacacgtctcctgaatataagttgcgtttgttgatgatttatgcatctgtctatcctgaaaagtttgagggtgataaagcttcaaagctaatgcagttggcaaaactatcacctgatgacatgaaagttatcagtaatatgcaacttctggcgggatcatcaaacaagaaatcatctgctgctggtggtttctcactcaagttcagtaaccagaagacaaaacaagcagcgcgcaaagatcgtactgaagaggaagaaacatggcaattatttcgattttatcccatgttagaggagctcattgaaaatctcatcaagggtgaattgccaaagaatgaatattcctgtataaatgagccaagtcctagtaatgcccgaggttctgttagaatcagacaacagacccagacagctccaaccactgctcctcattcaatgagatctaggaggactgcaaactggggacgagctcgtacttcagatgatggatattcaagtgactccacattgaagaatgtgactactgatttcaaaaggatgggcaagcgaatctttgtgtttatcattggtggggctactcgatcagagctgcgagtttgtcacaagttgacacaaaaattaaaaagggaagtaatcctaggtactacttccatggacgatcctccacaatatcttacgcaatgtcctgattatatttgtagatcatcatataggtgctttatgatgttgaaggttgaattaaatccatctcaaacgatttcagtttatattgccaaaaagatttctgatccaactaacatgattaagtga

SEQ ID NO: 111493 - DNA, 378 bp, Glycine max
  Peptide Sequence Number=SeqID_228271
atggagttgccatgtgtgtggcatcgtgctgcaaaggatagtgacgagtctacagcagcagcggttcgtgaattagttcctaccaagcttgctaatgctgtttgggacatggtttctaaatataaatctaccattcccggttttccacaaaatgaaacttgtgatatgctcattgttgacagatccatagatcagattgcacctgtcattcatgaatggacctatgatgctatgtgccatgatttgttgaatatggatggagataaatatatgcatgaggttcccagcaaagtcgggggccaacctgagataaaggaggttattctacaagaccatgattctgtttggcttgaactacgccacactcatatagcggat

SEQ ID NO: 111494 - DNA, 237 bp, Glycine max
  Peptide Sequence Number=SeqID_228272
atggcggtgtttcgtgagtacacgagtgatgactcattcacaaaggttgatatccctaaggatgtgagtgaattccaagtggctctaacctttgctagagaccacgatggggaagattcaaccaatggaaaccacaaaattgctcacacacataatccaaagtacaacctggatggtgttgatgtttattacgaggacattgtggtcacgaactccactagttgtctttgtttttag

SEQ ID NO: 111495 - DNA, 210 bp, Glycine max
  Peptide Sequence Number=SeqID_228273
atggcgatctctcccacacgcgtggtgaggagcttgagccccgctaggatgcgcgcgagcatagggaatgcgatgatagaaagggcgactcccatgaagacgaggatgccgcaaatgaaaggaagagaggttctgacggcggtgatgcagaattcttatcggccgctccggcgaatggagtggagatcaagctccagacccaaaagctag

SEQ ID NO: 111496 - DNA, 270 bp, Glycine max
  Peptide Sequence Number=SeqID_228274
atggggactaagggagacaggggcgtggaggggttggcggagagggtgggtttgaaggaggttttggaagcaaatgggagaagtggtggtggagatagaaaaaggtgtgtaaaggatgaggcttcttgggttgggacgaaggggaaaattgtggggagtgagagggagagtgaggccactacaaattatggatttggggatttaagggcaagtgaattcatatttgggggttggaggtggtggctattttggttcgaggtgcgatggtga

SEQ ID NO: 111497 - DNA, 192 bp, Glycine max
  Peptide Sequence Number=SeqID_228275
atggtcttactctgcgacggaggtggctttgtcggcggcagcgatggtgcaatgaggccggcgggcttgaccggggaagagtggtcggagaagcgaagacgcaacagaggttttggatttaggatactgtggaacaccgtaaaatcattccttgatcctaagaccaccgtaaaaatcaacgtgagcatataa

SEQ ID NO: 111498 - DNA, 339 bp, Glycine max
  Peptide Sequence Number=SeqID_228276
atgttgaaagccttggtaacaattattgtattcttgatgattgtctctgttcaagatggtttgagtgatgatggcttttttggcgggaagaatactgtgcgtgtttataatgggatgaatgatagcattcttgtgcatctccattgtcaatcgaaggacgatgatcttggccaacatgttcttgccgttggagagcaccaagaatggtcctttgaagatagggtttttggcaacactcttttttggtgcacgatggatgcaggctatttttttaacgagttctctagctcctgggagaagagattgtcatggcatattccaaaaacaccatctttttaa

SEQ ID NO: 111499 - DNA, 243 bp, Glycine max
  Peptide Sequence Number=SeqID_228277
atgaaggcaacaccaaatttggacagtggtagtgttggaagggaggcgacgaccagcggaggcacgagggagtcaaagtgggggaggcacacaatagttgcatctatcatctcacacgatggttgttgccaccgagggtggttcaaaatcttccacgccgtcgcgcctcaccacctgccccatgctttattctcaggagaacaattaacacatgcagagttgttgcggctatgtgatgaataa

SEQ ID NO: 111500 - DNA, 228 bp, Glycine max
  Peptide Sequence Number=SeqID_228278
atgggtttgactgagaacaagagagggtacatctcttatggatcaattctagtggagggtacatccactagggtttcaaagagaacaagggagggtacatcccttgtggatctttgcttgaaactcacttctttcattagagtaggtctgcaacaacagagtgcgtcttttgatgaggatcaatgtcttccagactatggactttatttattcttcatagaactttga

SEQ ID NO: 111501 - DNA, 432 bp, Glycine max
  Peptide Sequence Number=SeqID_228279
ttaggaatggagaggaacgtcctaagttgaagttgtccttccatggaaggaaggtagaaaaatttggcaggcctgctcctgagattgaaggcttagaaactagtagtttccatctaccggtaggaaaggtgactatcaccctagatgatgtgtcatcgttgctacatttgcccattacaagggccttccatagctttgagactcttcatgtggacgatgttgtcttcctcttagttgaattgcttgaagtgagttatgaagagacaagagttgagacggtacaatgccacgaggcatatgttcgttatcctgttgcttctgctattactgctaaagattatgatgagaggaaactgtgtgcttgtcgttggaagtctaggcaggctttgccaatttcgacgaatcgtaagcatctggatagattgacgtctg

SEQ ID NO: 111502 - DNA, 375 bp, Glycine max
  Peptide Sequence Number=SeqID_228280
atggttagaacacgaggtttaggtcgtgcgttaggagctggtagaggtagaggcattagtgaggatgcgcatgaggctgatgtttctctgcgtcgtagacctactgcttcaggatgtaggcaacgggttcgtctacgtgaggacgtcacagagagacctgaggatgtgcctcagtcgcatgaggatgttcctcatgtgtatgatgccaccccagagatgacaggcgccgtcgatgctattcagacagagggagtggctactgatgggagcttggggtcacctgccgcagatgagggtttccccggtggaccacgcgacccatcgattttgaccgattttgctgtgcatgtcgcacacagcatctggagtggacag

SEQ ID NO: 111503 - DNA, 333 bp, Glycine max
  Peptide Sequence Number=SeqID_228281
atgccccgtactcatgacgcgatcctgtattacaacgggaaatggaacatgccaccgcagaacaaatttgttggatgcgcgttcacaggaaaaaatcctaagaaatttcaaattccttcaacatgtaccatcgatgaactgaagaatttaataaagcaagttgcacctaaagggattccccctcttggaattcacgaatcacaaacggtaaaacgattgtttttctgccaaccagctcgctttgagtattcagatacgcttataaaatatgaaataaatgagcagaggaccaatgaagaactgctgaaggtgttagtacaatctaactactag

SEQ ID NO: 111504 - DNA, 165 bp, Glycine max
  Peptide Sequence Number=SeqID_228282
atggcaagcaaggttcctgtatcacagcaagctaactattgtgctgatgccttagcaaatttggcttgtggtttggaggaggactatgtgatttttgatcacccaaagcttttgttgcttgctgatgtttcgggagtttctactcctaggctgatttctatgtag

SEQ ID NO: 111505 - DNA, 180 bp, Glycine max
  Peptide Sequence Number=SeqID_228283
atggaagtggcgacgacgatgaaggtggtggcactcgttagaggcggcaaagacagttgctatgccatgatgaaggctattcactatggccatgagaggtctgacaatggtgtttggtttgctagcaatgcgggaaatgtgaaggagaagaagaaggttcatttcgtgcgtgacagctga

SEQ ID NO: 111506 - DNA, 480 bp, Glycine max
  Peptide Sequence Number=SeqID_228284
atggctgttttgagcattggaggtggtgatgtttctaggaagagagattctatcatcttaactttcgcagatgcaaagatttcagttcttgagtatgatgattctattcacggacttcgtactagttctttgcattgttttgagggtccagaatggcttcatctgaaaagaggaagagaacaatttgcaagaggaccagtggtaaagattgatcctcaaggcaggtgtggtggagttcttatctatgatttgcaaatgataatactaaaggctactcagaagcacagacgtggccgtgcaggggtgtatcccgtgtcggaattgtgctggttgcggattcggacacaactcacgtgcgacgcggtgtctgagttcactggacacggttgggctgccggacacgcgcaattggatgcggcccaccatagaaaaacatttacaaaagtgaacaaactgcctcagctgtcacgcacgaaatga

SEQ ID NO: 111507 - DNA, 2244 bp, Glycine max
  Peptide Sequence Number=SeqID_228285
atgtggaacttgggtttttcccaatacaccgcctcacgcctagcacttcttgggcttgatgtgtggataacaatggttggttctggtttagttggggatgatgatgcctttggatcttcaggagcagttgctgctcgtattgagtcatcttatatgataaacctacgtgacttggatatgaggcataatcttccccatgatgcatacaagcttcttgcggtgccatcgccaataggtggcgttcttgtaattggtgctaacactattcattatcacagtcagtctgcttcttgtgcattggccttgaacaactatgctgttacacttgacagtagtcaagagataccaagatcaagtttcaatgttgagcttgatgctgccaatgcaacttggttgttgagtgatgtggccttgctgtcaacaaaaactggcgaactgctattgcttatgcttgtttatgatggaagtcggttaggggacagtatgctggtgcaattttcttgtggatcaggtgtttccatgatgtcatccaatctaaaagaagaggttggtgatattgaagtagatgctccatcaaagagattgcggaggtcaccttctgatgctttgcaagatatggttagtggtgaggagctctccttgtatgggtctgctacaaatagaacagaatcagcacagaaatccttctcgtttgcagtgagggattcattgattaacgttggtcctttgaaagatttctcatatggtttaagaataaatgctgatgcaaatgctacagggatagccaaacagagtaactatgaattggtgtgctgttctggtcatggaaagaatggttctctgtgtgttctgcggcaatcaattcgcccagaagtgattactgaggttgaacttcctggttgcaaaggaatttggactgtgtatcataagagcacacgttctcataatgctgattcttctaagatggctgatgacgacgatgagtatcatgcttaccttattattagcttggaggctcgaactatggtactagaaactgctgatcttcttagtgaggttactgaaagtgtggactattatgttcaaggaaaaacacttgctgcagggaatttatttggaaggcgtcgagttatccaagtctatgaacgtggtgctcgaattctagatggttcttttatgacccaagacgtaagctttggagcttctaactcagaatctggttctgcatctgagagtgctatagcactttctgtttctatagctgatccatttgtcttactcagaatgagtgatggaagtattcgacttctgattggagatcctagtacctgcactatttctgtcacttctccagcttcatttgagagctccaagggatcagtttcttcatgtacactgtaccatgataaaggacccgagccttggctgaggaaaacaagtactgatgcatggctttctactggtgttggtgaggctattgatggcactgatggtgctgctcaggaccatggggatatttattgtgttgtttgttttgataatggtaaccttgaaatatttgatatccccaatttcaattgtgtcttttctgtggaaaattttatgtctggaaagagccatcttgttgatgctctgatgaaagaggtactaaaagattctaaacaaggggatcgggatggagtggtcaaccaagggaggaaggataatataccgaatatgaaggttgtagagttggccatgcagagatggtctgggcagcatagccgtccatttctttttgggattttgagtgatggaactattctttgttaccatgcttacctttatgaaagtccagatggtacttctaaagttgaggattccgcatcagctggaggatccattggccttagtagtaccaatgtttccaggcttagaaatttgagatttgttcgtgtgcccttggatgcatatcccagggaggatacctcaaatggatcaccttgtcaacaaattactattttcaagaatattggtagttatcagggattcttcctatcagggtcaagaccagcatgggttatggtgttgagggaacgacttcgtgttcatccacagctatgtgatggatctattgttgcttttaccgtccttcacaacgtgaactgcaatcatggacttatatatgttacatcacagggtgttttgaagatatgtcagttgccttctggctcaaactatgacagctactggcctgtacaaaaa

SEQ ID NO: 111508 - DNA, 1202 bp, Glycine max
  Peptide Sequence Number=SeqID_228286
gacttgtggaggagagccagaaggtatttcaatgggctgtggatagagacttgtattcttggaacaccatgatttccacctacgttggatccggtaacatgagtcaagctaaggaattgtttgatggaatgcaagagcgaaatgttgtgtcgtggagtactataatagctggttatgttcaggctttgggtttcttccacgagatgttgcaaataggtcccaagccaaatgaatatacccttgtaagcactcttgcagcctgttcaaatctagtagcattggataaaggaaagtggttccatgcttacattgggaggggcgacattaagatgaatgagaggcttcttgctagcatcattggcatgtatgccaagtgtggagagatagaatcagcatcaagagttttcttagaacacagggtagaaaaagtatctcctaataaagttgcattcattgccttattgaatgcttgtagtcatggctatatggtcgaggaggggaacttatgtttcagattgatggttagtgattatgctattaccccagaaatagtgcattatggatgcatggtacttagtcgttctggtctcttgaaagaggctgaagacatgatttcaagtatgcccatggctccaaatgttgcaatatggggagcactgttgaatgcttgtagaatctataaagatgtggagcggggatatagaataggcaggatcattgaagatatggatcctaaccatatagggtgtcatgttctattgagtaatatatattctacatctaggagatggaatgaagcaagaatgctgagagagaagaataaaatcagtagggatagaaaaaagatttctggttgcagctcaattgaattgaagggaacattccatcaattcctggagatgacaattaagttgaagagtgctgggtatgttcctgagttaggggaacttttgcatgatattgatgatgaggaagatagagtctgctttgtctgtacacagaaattggctattgcttttggattgatgaacacagcaaatggaacaccaattcgcattgtgaagaatttaagagtttgtggggattgtcatcaagcaacaaaattcatctccaaggtttacaatagagtaattatagctagagacagaacaaggtatcaccgcttcaaagatggaatctgttcttgcgaagactactggtag

SEQ ID NO: 111509 - DNA, 180 bp, Glycine max
  Peptide Sequence Number=SeqID_228287
atgtgggatcgacacaagcttaaaggagcactcaaactgggtgacccccaaggcctacactccgaagagtctggtcttagcattaacccgtcacccttaaagggtcttagcattaactcgtcgcccttaaagggacttagcattaactcgtcgcccttaaagggtcttatagtcgtgtga

SEQ ID NO: 111510 - DNA, 303 bp, Glycine max
  Peptide Sequence Number=SeqID_228288
tggaatggcactgagttgaatggtattgcattttttgacgcaccgccattacatgttgtgagcttaaacattgtaaagaacttcatccttattggcgatatccataaaagcatatactttcttagttggaaagagcagggtgctcaattgagcttattagccaaggattttggttctctcgattgttttgcgacggaatttttgattgatggaagtactcttagtctcatggtttcagatgataatagaaacatccagattgatggggattatgtgtataccgtgacttattatctatcttga

SEQ ID NO: 111511 - DNA, 1865 bp, Glycine max
  Peptide Sequence Number=SeqID_228289
atggtcgagtcttcccgcttcgaaatcggttacaataataataacaacaataattctctacacaaccagcaccaccagcagcagcatttaatgttgtctggtgggaaagatgacttgtgtgccttggcaatgtttgaggacagtgtcaagaagttgaagagtccaaagacttcgcctggtcctgctttgagcaaggaccaggtgaattctgctttggacttgctcttcgactggttctatgaaacttgtggctctgtgtctttgtccatgctggagcaccggaagtttcaggcttttttgagccaggttggtttgcccaacaatctgaggagggagatttctggggagaggcttgatgctaggttcggggaggccaaggctgagtccgaggctaggattagggatgccatgttttttcagttggccagtgatggctggaagagtggggattggcttaactttgacttgtgttgcagtggtggcggggaaagcttggtcaagtttgtggtgaatctccccaatgggagtagtgtgtttcagaaggcggtgtttactgggggagtggagaattctaagtatgctgaggaggttttgtgggagacggttacggcggtcacgggaagtgtgcagaggtgtgtggggattgtggcggataagtttaaggccaaggcgttgaggaacttggaggtgcagtaccattggatggtgaacacttcgtgccagcttcaggggtttgctagcttgatcaaggattttaaccgcgagctgccacttttcagagttgtgatcgagagttgtttgaaggttgccaattttatagacaatgaatctcagatgaggagtgttttcctcaagtgcaggatgcaggagatggactgtggtgggctgattcgcgtgccttcgccaaaatgtgatccgttgaagaactttggagtggtgtttcctatgttggaggatattttgagctgtgctagagtgatacaaatggtggtgatggaggatgggtttaaggtgatgtgtatggaggatcctttggcgagggaggttgcggggattgtccagaatgaggggttttggaatgagttggaggcagtttattcgcttgagaagcttgttagagggatggtacaggatgttgaggtggagaggccgttgattggtaggtgcttgcctctttgggaggagctgaggagcaaggtgaaagagtggtgtgggaagtacaacatcgtgggaggacctgtggagaagatagttgagaagcggtttaggaagaattatcaccctgcttgggcagcagcatttatacttgatccactttacttgattaaggatgcaagtgggaagtatcttcctccgtataagtgtttgacgcgcgaacaggagaaggacgtagataagttactgaccaggctggcttcgcgagaagaggctcatgttgtgttgatggagctgatgaagtggagatcagaggggcttgatccgctatatgcacaggctgttcagatgaaacaaagggatccagtaaccgggaagatgaaagttgcaaatccgttaagtagtagacttgtctgggaaacttgtttgactgagtttaaatcacttgggaagattgcagtgagactcatttttttgcatgcaacttcgtgtgggtttaagagtaattggtcttttatgaggaaaatttcagctaataagcactcaagagttgccttggagagggctcagaaaatgatatatattgcagctcatgccaaacttgagaggagagacttttctagtgaggaagaaaaggatgcagagctgtttgccctgtctggcagtgaggatggcatgctcgctgatgtctatgctgatgctcccttagt

SEQ ID NO: 111512 - DNA, 294 bp, Glycine max
  Peptide Sequence Number=SeqID_228290
atggaggaaatggggagaggagaagggagtgaaccgggccttagaccggagctgaagttggagcaggttccgcgtttcaagtgttcagaagcggttcgagaaggggacgagaatgggctcgaggtgggcccagtaccaggcgcctttgcccttgatggcctttgtgcggacagtgaggaggccctcgaagcgcttgttgacggcacggacggcggcggcggcgtcgtcggaggaggggagggggtcggtggaggtggaggtggtggaggtcattgcttggagctggagggttag

SEQ ID NO: 111513 - DNA, 780 bp, Glycine max
  Peptide Sequence Number=SeqID_228291
atggagaacatgacattccaaaacacattgggtagaaaccaagcatgtgaggatacatgctctttgtcacctataaggtctaccaatgtcaaaaaatccccaagagttgatttagagcaagacatacatgaaggtactggggttcagtacgaatttcaaattactcatgaaaatagtaagggggtggagtgggcgtgtgaaagcaaccttgttgaaccctctttggctaactcagatgaccgtgattgggtgaacacaaggcttaaggagtcttttgcaaatggaggttggggccaaaaggaattaatagagaataaggccgacactagtgattgcaaggagcacgtgaggtcaaaaagcaacaagactcttgcaaagaaaggtatgccttttggaggttcaaagcaaggagttactagagggcctattttgaatgttgtctccaatggctcctctagaacttcatctttgaagggtcacaataagaaaagcaaagaaaatttaggacttggggcagaccttgggtgtttcattgaatggcaaagaggagaatttggtgcaaagattggtattaatggagtagagggattctcaacaaaaaaaatgatattgacttacaatattagaggtcttggggggaggttgaaggtgaagtttgttaaggaattggagagaaaaaaggaagggcaatttttattcttacaagaaacaaagagggaagtcattgataaggaattatgcttttctttgtgggaggacatgtggtgtcatggaagatga

SEQ ID NO: 111514 - DNA, 1095 bp, Glycine max
  Peptide Sequence Number=SeqID_228292
atgtcacatacgagaattggaaacaagtccctggctgaatttgatatccctaaagcatcagatctaaggacaaaaaagaaaatacttcagactgtgggggagcggtggagacaatttatgtttgacttgacctccaaatgggcacttgcaaccggcaaggaaagtgtcgatgacactgtatgcaaaaagtacgacattggcaaagagaagatgtgtgaaaaaagacacaggtcatccagaaacaaaacattgtccctcacgtgttgtctcgataagaaaaagaaaaaactagaggaagctgctcaacccggaagcactgacaccgtgattgatcctccatctcccatcagacgacacgtgaagtggaagatgacccgcaccaagaaaactggccaaatgacatctgaggcaacaaaggaaattgctgacaaaattgattcgttggagaagcagacctcacagggttcctttgtcgcccatggacaacaccctggtcgtgtgcgtgctgctggagtcagtgtcacaatcaagcaatactttggaccaactccaaggacctcccgcacgtcttcctccatggttcccgaagacctggagcaactgacgcaacaaatcaaggaccagttggaggagtcgatcataaaaaaccagatacagtcccaatttcagtcgcaaatgcaatcacagggactcgcactgcctgttgagcctgaggtcaaggttggtgttgaggagggtagagatgcagatgctctcattcctgtacccactgaagaggttaagttagtggggcagacacttaacaccttccttgcttggctaacacatcttatcaaacttttatcagaacagggagctgtagaattggcgaaacctatagataggtcggatcatgatgtcgatgatcccctatatctaatgacattgaccatcccacaactttttcttaagccgttgcaagttatgtgggatgctaccgtgtttggggtgtttaatgagaactttcccttgtacataaagcatgaaggtctgtctgaaatagcacacggtggtcaatgtctcagcatctctgttatacaattgtggattttgtaa

SEQ ID NO: 111515 - DNA, 726 bp, Glycine max
  Peptide Sequence Number=SeqID_228293
atgcctcaacaatggccaacattcctcggtcccatccactacctcctcaaagtggcctgtgcttctattgagcttctccaccacgatgcagttgacctacccctcgggtaccaccgcaacagtagagactcattcgatgaagcctccgcctccgcttccgcctcaacctccaccatcgtcactgcgacaggattgttctacaacagaaaaagcatgcacgaaggttcaaccactctaacacatggtagagggtggtggtggtgctgttacgctctaggtgggatcggaggttgttttgggctcacgcgaaacgctactacgattcatcgacgtttttatggttgtttcgagcctttgcgggagggaggacgaaacgacgccgttgctggcgacctttacacggacacctggaccctaatcgcaaagcatcgaagaaggctcttgagcacaagaaagagattgcaaagcatctcggtccccctcattcagactaacccttacaaggatgtaatagcctgtgacgttataaatcttgatgacattgatgtggagttcaactctattgggggactagaaacaatcaagcaagctttgtttaagcttgggcaatttaaacaacattttgcagaagaggaggtggaaggtgttggagttgagcaaagagcaagaagtctcattcctcatgatgctatgaagtacttggacacctttccaagatgttcatga

SEQ ID NO: 111516 - DNA, 822 bp, Glycine max
  Peptide Sequence Number=SeqID_228294
atggaagcaataacaaacaagaaaagggacaataggccttacctcgatgaagaacggaagagcagcacctcgcggaagaatggaagaagaagaggcactcaaaggagggagaagcagcagctcgcacggaagaagaacaaccacctcgcgagggagaaacagcaactcgcacggaagaagaatcaccaagaagaagaaatggctcgcgaaagaaggaggaagaagaaaagcctcgcggaaaggaagaagaaatggcttgctggcactggtgctggaggagagaaaagagctcattcatcccattgtttgcgcgctccatatttcgagctcctagtatgtcttcaccgcccatttctccaactagaggtcgttgaacgtcttgtcatcactggtagtggcggtttcgttagggcttttggtggtgctctacgtcgtaattggggttttaggggggtgggggtgggggtggttgatattgtatttgaaacgctaaaagtggattggtattgcgagagagttctcctccgcgaggtttgtcattccgtcgttggaaccatccttcctgttgttagacaccttccaaatgcgcaactcctcgtcgtcgtcgagatccaccgcggtcatgatgttgtgactttgattgtcgtcgacttcaaattgtgcaactcctcctcctcgtcaagatatgttgtggcgacaaatgtcatgatggaatctgcactttgtgtgcatggccccgatctatttgttggtagaaacaaacttcggtgtacttactcctatttgttcatgctccacgcactcacccaactactagaatga

SEQ ID NO: 111517 - DNA, 2100 bp, Glycine max
  Peptide Sequence Number=SeqID_228295
atggttaaaactagagggttagatcgtgccttaggtagggtacctgtcactgttgccgatgatgtgcctacggtacctgcggacttgcctgcggtacctacgaatttgcatgtggtactagaggctgagcctgttgtagctggtgatgagcccatggataccggtgcagaggatgctgcagatgagactgagggatttcctggtggacccagggacccatctgtgcttacggagtatgctgagcatgttgcagccatcgtatggtccggagaggaacgacctaagttgaagttatcctcccatgggaggaaggtgcataaattaggcagacctgctcctgcaattgaggatatgattgttgggataggattaagtcctctgatcgcattttcagtatccatcacgctggatgacgtcgcatctcttcttcatctgtcgatcattggcgacttccatgcttttcagcctctgcacatcgacaaggtggtgctgatgctggttgagttactgatggtctcaccagaggtagccatggccgagacaggacattgtactggaccatacgtacgcctgtcttggctacgagacatttatcagcgcagatgtcagacccagcactggacagctacaactcgtgcttatcttctgcatcttctgggttgcactctttttgctaataagagtgcaacccatgttcatgttgtgttcttagacgccatgcgtgacctcactcagactaggaggtatgcatggggagctgttgacctcgtccatatgtacgatcagcttaatgatcactttccgtcagttgcggagtgcaatgctgatccagaggatgacgaggattccagatgtctgctagatgccatatgcgaagcaccgaccggtctaggactttcatctgatttcatatacagaccggagagggttatgcgccagtttggatacgtccagtgcattcctgcacacccttctgattcatgggggtcatttgatgatgtagacgataggtggacgcactactcagaccatttggcaccagtagacatcagatcctcctcgatatgcatatgcgacgtagccagacatatccctcaggtgccagagtcacgtatccctcaggagccaacaccagcatcgacacatgcggattctgatgcggacgagcccagacatggagtggagacttgccatgccatcgtagagacgttggagcatcatctcagcctaaataaagtcacgccagacacatcacacatgaggtcatccaaaaatgcctcaggattgccaggggagagtaatgtgtgggaagtagaagtagaagtagaaggagagaagcaccactacatggaaagcgcatcagagcttgtggaattcccgttgttgctgacaccaatcgattccaactacagagcttgcaccattccttacagattcccctccgataaccctcgcaagcccactcccaccgaaatctcttggattgatctcttcctcaactcaatcccctctttcaagaagcgtgcagagagtgatacttctgttcctgatgctgcagctaaagctgaaaaatttgctcaaagatatgctgatatacttgaagatttgaagaaagatcctgaaagtcatggtgggcctcctgattgcattcttctctgcagacttcgtgaacttgtgcttagagaattgggattcagagatatcttcaaaaaagtcaaggatgaagaaaatgcaaaagccatctcactgtttgagaatgttgttcatcttaatgatgccattgaagatgaaggcaagcgacttgagaatctagttagaggaatttttgctggaaacatatttgatcttggttctgcacaggttatcatatttgttgataactctggtgcagatatcattttgggtattatgccatttgcaagagaactacttcggcgtgggagtcaggttgtattggctgctaatgacttaccatccatcaatgatgtgacttgttctgagctagttgaaattatatcaaagttaaaggatgaagatggacagcttgtgggtgtcagtacttcaaatctcttaattgcgaactctggcaatgatttacct

SEQ ID NO: 111518 - DNA, 243 bp, Glycine max
  Peptide Sequence Number=SeqID_228296
atgcatagggacctgccgtgcttgcttttttatatagagagatgtgcagcgccaccgattacaaaattaaatcaatcggaggaacgatgcacgactttggttccaaagaggactcctcctgtaatagaaaataaaccactcggacacaggtggctgcgacgtggaaatcagcatattagtaatgatgatctgatagtttttcatcgaaaattggatatcatgaaacgacatgagtttctgtga

SEQ ID NO: 111519 - DNA, 186 bp, Glycine max
  Peptide Sequence Number=SeqID_228297
tgggctaagcgtgcatccattgctaagcgtaacttcagcatgcttagcgcaacagaagaatctggcagagcatcaatatcaaggccgcatgctaagcgcgagattagtgcgctaagcacagcaattgtcttcagccaggctcagagcacgactggcgctaagctcgaagccacttacatgcactaa

SEQ ID NO: 111520 - DNA, 408 bp, Glycine max
  Peptide Sequence Number=SeqID_228298
atggccgagaatcaattaccatttgtggaagcatgtacaatagtgaaggagatgtgggatgtcatacaagtgactcatgaaggtacttcagaagttagaaaagtcatcacagtctccgagtccaaagatcttacctccatcacacctgttgagctatttggaaaattaagagaatatgaaatgggcatgactagaatggccaaagaggaggctaaggagaagaaaagtaaaggcttagcactaaattctccataccatctaggaatgtgggtggtgaagaaagtgcagaaggtttttgatgaaatcctccctaggaagggaccagttaccagagccatgagcaagaagctccaagaggattgggctagagctgctgaagaaggccctagggttcttatgagcctcggg

SEQ ID NO: 111521 - DNA, 667 bp, Glycine max
  Peptide Sequence Number=SeqID_228299
ctccaagtgggccatttttggtaagcagaactggcgatgcgggatgaaccggaagctgggttacggtgcccaactgcgcgctaacctagaccccacaaagggtgttggtcgattaagacagcaggacggtggtcatggaagtcgaaatccgctaaggaggcgcggcggtcgctgcaaaacccagggcgcgagcccgggcggagcggtcgtcggtgcagatcttggtgggacgggggaagcccgtctgatagcgctctgtgcgcgtactccgaaagggaatcggcctgcccaccctggaaacggctcagccggaggtagggtccagcggctggaagagcaccgcacgtcgcgtgcctctggtcgatggaacaatgtaggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactgtgctctgaatgtcaaagtgaagaaattcaaccaagcgcgggtaaacggcgggagtaactatgactctcttaag

SEQ ID NO: 111522 - DNA, 510 bp, Glycine max
  Peptide Sequence Number=SeqID_228300
atgccaatctccccctgcagatgtatcggttgggatcgcgcccacaagacgcccagtgggcctgaagaagtccaacagggccctggggtttccagctctggttacgggcctctgtcagtcctacagggtgtccgttcccccaacgaggaatcgcacccacaaagacacccagtggacccggagaagtccaacagggccctggggtttccagctctggttacgggcctctgtagtcctacaggatgcccgttccccctggcaaggtcacatcatcatagggatcgcgcctgcaaaacacccagtggacccgaagaagtccaacaggagtacctgtcacctccagcaagggcatcaggccccctactaatcgagctttcatcaaggagtactgcgtctccaggcagggcgcagggcgaaacaccacagcagcctggggatggccggcagcgggcaacagacgcaccgccatcacctctagagttcacctcagctcatccacaaaaaggttag

SEQ ID NO: 111523 - DNA, 327 bp, Glycine max
  Peptide Sequence Number=SeqID_228301
atgtctgtgaagatgcggactacctgcacctggacagaaagaccctatgaagcttcactgtttcctgggattggctttgggcttttcctgcgcagcttaggtggagggcaaagaaggcctccttctgggggggccagagccatcagacctacgggccgagggacagtctcaggtagacagtttctatggggcgtaggcctcccaaaaggtaacggaggcgtgcaaaggtttcctcgggccagacggagattggccctcgagtgcaaaggcagaagggagcttgactgcaagacccacccgtcgagcagggacgaaagtcggccttag

SEQ ID NO: 111524 - DNA, 309 bp, Glycine max
  Peptide Sequence Number=SeqID_228302
atggaagaaccaaaaactagaacgctccaacaagcagaaagaacttccaaagcttacagaattttccaaccacaaaatggaaaaattcttttgagtagagatgtcaaattcatggaagattggcaatggagttgggaggaaccaataaggaagcagctgctaaaagccctacaattctttgatgatgatgtaaatgacattcttaacataggtgcaagatctttatctgaggtctaccaaaggagtaatgttgttgtcttagaacctacaaaatttgagaagaagctgagaaggatgacaagtggataa

SEQ ID NO: 111525 - DNA, 225 bp, Glycine max
  Peptide Sequence Number=SeqID_228303
atgcggatgaggcgccactcgatgtttccatttgcctgcatgcctttggtattgtggggtgtggttcgtttagtggtgtcaagtcttgcgaacgtgagggtgctgacgattggttcctgtgttgcctacctaccaaacggtattcgtgtggctagtcagacccattccatccaggcctctttgttggggacgctggaggatttcaaagtccgtgggatcctctag

SEQ ID NO: 111526 - DNA, 675 bp, Glycine max
  Peptide Sequence Number=SeqID_228304
atgaccttaattcctgcggcggtaattggtggcagcggcgttggcgcgctgacggcaccgacaccggcggtcgcggcctcgaacacctcaacgcagaacgattaccaaccgacctttttcaccccggaagagtgggccttcatcaaggccgccgtggcgcgcctgatcccggccgacgagcgcggccccggcgcactggaagccggcgtgccggagtttatcgatcgccagatgaataccccgtacgccaccggcgccatctggtacatgcaggggccgttcaaccccgatgtgccgaaggagatgggctatcagctgccgctggtgcccaagcaaatctacaacctcggcatcagtgacgccgacgcctacagcaagaaaaccgccggcaagcccttcgccgaactggatggcgcgcagcaagacgccatgctgcaaaagttcgagtcaggcgaggcggagttcccgcagctgccgtcgaaactgttcttctcctatctgctgcaaaacacccgcgaaggtttcttcagcgatcccatccatggcggcaacaaagacatggtgggctggaagctgattaattttccgggcgcgcgcgccgattttatggactgggttgagcgaggggagcgttatcccttcccgccggtctcgattcgtggggagaggggctaa

SEQ ID NO: 111527 - DNA, 366 bp, Glycine max
  Peptide Sequence Number=SeqID_228305
atggctgattcaaaggatgactcctcaaccattgaaaaaactgagcaaactaccttttccaagaaaaccaagtttgcatcctccaaaaaggtgaacctaaacaacgtctccaaaaggaaaaatatagtgcatcctaagcctaaaaccaagacttgtcattattgcatgaaaagaaagcacacatcttataaatgctatgtcaagagatttgatgttccaagaggtaaaagtgtttggattcctaaagatttaattgtgaaaattaaccccattggacctaacctcaattgggtaccacctatctcaaattggttgtgtcttctaagtgtgcctaaaagcaagagactcactatggtacttggatag

SEQ ID NO: 111528 - DNA, 273 bp, Glycine max
  Peptide Sequence Number=SeqID_228306
atggaaggcctttttgttacaaattttgaaagcaaagacgtaagtaaattgccaattacaaagttacaaaaatgtcctcaattttggtggatgttctctctttcaagtttcactaaatttggagtgcttcttagtccaatagctcctaaggtggttggcccctggcttcttgactcaaattcttcaagggatggcacctatccttctttccaattccctatatggaaactcacaaacaaggaaacaaagagacaagcaataaccaaagactaa

SEQ ID NO: 111529 - DNA, 141 bp, Glycine max
  Peptide Sequence Number=SeqID_228307
atgagtaagataggaaggtttggaggtttgggaatggaggaacgtcgcaaggggaagaggctgcgcaggggtggaggcagcctactggtaatcgattacatgaatactgtaattgattacaggccatctgttctagtgtaa

SEQ ID NO: 111530 - DNA, 440 bp, Glycine max
  Peptide Sequence Number=SeqID_228308
atgtggatggatcggtttgctcttaccttgaacgggagtcaagaacttccgcgcttgttagccaaggccaaggcgatggcggacacctactccgcccccgaagagattcatgggcttctcagctatttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 111531 - DNA, 1158 bp, Glycine max
  Peptide Sequence Number=SeqID_228309
atggcctctgcagcttccatttcctcatcacaaccagaagcaccaaaggttcatgcatctgatatttctagcatcaaagcctttgcagaatcaaagggagcctctctgatcccttacacctaccactccatcacagagcaccatgatgatgatgtagcagatgagcttgctgcttccatcccagtcatcgacttgtctctcctcacttcgcatgaccctcaaatccacgccaaagccgtgcaccaactcggcaaggcctgtgcagagtggagtttcttcatggtaattcaaaatcttttcttttccctaatgaatttcactttcaactatcactcacttgcttatcatcagctcacaaatcatggaattcccgagagcctggtggaggagttgatgaaaaagtctcgcgagtttcatgatttgccgatggaagaaaagaaggagtttggtaataaaggaccctttgaaccgatcaggcatggcaccagcttctgtccagaagcagagaatgttcattattggagagattatctcaaggccatcacgtttcctgaattcaacttcccctacaagccaccaggttacagggaagttgcttatgattacagcaaaaaaatcagaggtgtgacaaggaagttgcttgaaggaatatcagagagtttgggattagaatccaattccataatcgagtccactgattttgactctggccatcagctgtttgttgtgaacctgtatccaccatgtccacaaccgcaccttgctctggggctgccttctcattctgacgtaggtttattgaccttgctcacgcagaatggaattggagggcttcaggttaagcacaatggcaaatgggtcaatgtcaatccccttcccaactgcctaattgttttgctttcagatcaactcgaggttgtgagtaatgggaagtacgctagggtgatgcaccgagcaatactcaacaatgcagacactaggatcagtgttgtgctggcgaatggacctgcgctagataaggaaattggacctttgccggagctactgcagaattataagccattgttcagaagcattaaataccgagattacttccaaattcagcagaagtcacgattacaagataaaagtagcttggatgagattcgccttaactaa

SEQ ID NO: 111532 - DNA, 874 bp, Glycine max
  Peptide Sequence Number=SeqID_228310
gaattgcgcatctttcagaagagctgtgatagcaagcctagtccagggagtgtacatcttagaacacgaccgccagaagaaccggctcggaaccaaatccctttctcctccctggtgggaattcttccattttcatcttcacaatgtgcttgtagatagtgctgacttctccatgtttggtgccatcctagaactgagattgccacccaattaccccaaaacttttgctctcaacactccaaaatatgttattgcattccgagtcagagcagaaacaaggtcaagggacatcctcttagaccttaaatgcatagttaacaaaatacacaagagtttcagatttgaactcgccatgcattcatttcagaacacggtggatgtagctggagctgacaatgtgtggctagcaggacactctttggggattaatcatcagaaaatcactcaaggaatccacattgctagtagtgttatgaaagttggtatttctgctgctcttaagggtcatcatcatcatcatgatcacactagtcatgatgagcatgatgatccgtttgctgagttgtctacatgggtgcctcacctgtttgtgaaccctggtgatcatatatgttcagggtacattaactattttgcagagggagaagtggagaaaattggagctcggaaaattgaaaagattgccactaagtgtactttggagagtttactatcagatgctttggacagaaattcagaaccgttgcatctgcttccctcattagagctaaatataaatatgggtcacacgtcaggtttcagagcagcacatggaattgaacaatggtgggatcctcatttacgatttaagtccttgatgtacctttacaaatag

SEQ ID NO: 111533 - DNA, 294 bp, Glycine max
  Peptide Sequence Number=SeqID_228311
atgaatttcaagcgtctcgatatactatgggacacattcagacatccgagtaaaaagttattgtcgtttgatttttctcagagcttctgttatcaattacgagcgtgtcgatatattacgagactcaatcgcacatccgaagcttttattctgaatttcgagcgtctcgatatattacgggacacaatcggacatccgagtaaaaagttattgtcattagaatttgctacgagcatcggttttcaattacgagcgtctagatatactacaggacacattcggacatccgagtaa

SEQ ID NO: 111534 - DNA, 204 bp, Glycine max
  Peptide Sequence Number=SeqID_228312
atggcactcttgggagagacaagcagtcggatagttgtgaactccacattaggttttatttttccaaatggatccattgttcacaatgacaatggtgtttcctttcaagcttccactccagttcccattcgagtacctaacgggtgtgattttcaaacgttaaaaactagaatacacaatacccttaagctaaccgacaagtaa

SEQ ID NO: 111535 - DNA, 370 bp, Glycine max
  Peptide Sequence Number=SeqID_228313
atggacagagatcagcggaaagggaccaaatggacaaatagaaagtatgaatgcagtgataaatggaattcaaaatgtaaacttttaaaaacaagtatcaagggcacaccggagaccggcttacaaatcccaggttttcataaacaaagaaaaccgaagcggcggcagagccgcacaggatcgatacaagagggagaggggagacgtatgagaaatagaaatttattaaaacttgaaagaagcgcttacaaaattttttctttcagagcacctcgtctcagaaacctgaaaaatggccaaatgaaagggtgccccacaacatggttgatgactccttatatagccaaaattctaagaccggtagttgccg

SEQ ID NO: 111536 - DNA, 150 bp, Glycine max
  Peptide Sequence Number=SeqID_228314
atggcggaagaagaatctggactacctatagtgatccacccccaacagaagacaagtcaaggaaatgagaaaaagaaagaagatgagaatattactcaaggcgatccacctcaagaggagagaagtctaagaatcgagatagaggaataa

SEQ ID NO: 111537 - DNA, 615 bp, Glycine max
  Peptide Sequence Number=SeqID_228315
atggaggccatgaaagaccaaatggctgccatgttgagcatgaagaaaataatggaaagcaatgcggctgcagttgccactactagtgccccgattgaggaagacccaactcacccatcgggccttaataaagtaaatcctccagtctcggatatggtaggtcaggggagagaagcattgggaagtacaggtggtccccatgttgtgcagagcaagaattctttcccaccatacggcttgcctcccaactatacaccacccaatgttgcacacgctcccgatgagaatgttaataactccactcccatactcattgagagccgacaaccccaatttgatcatgcacatgtctctcaacccatggggaggcacatgaggcacccgaatctagtaaactttgagcctcacctcagatatgcctttgaggggcaagcattttacggcatacccctaccaaacactttggggggccctcagtatcacccacaaccacaacccttgcattttgtggtgggaagagtccctcctgctatggtggaaagggagaaattcaatcatatagaggaaacactgaaggccattgaagggggcgaaaattatgcctttgctgacatg

SEQ ID NO: 111538 - DNA, 423 bp, Glycine max
  Peptide Sequence Number=SeqID_228316
atgttgtttatcaacttcactgctgaaggtgctggatttttcaaatcaagatacagagaagctgctgagcaatatagacaacagggtttacgctttctggttggagatgctaagtctactaaaggttctttccagtattttggagtgaaggaaggccaagtacctctaattatcgtacaacgtaatgatgggaagaaatttcttaaacccaatttggagcctgatcacatttcaacttggttgaaggcatgcaaggaagaaaatattgtcccatattttaagtctgaacctatttctgaagataacaatgaacctgttaaagttgtagttggggacagtatccaggacatagttttcaattctgggaagaatgttatagtattactttttctatttggatttattccacgaattataagatag

SEQ ID NO: 111539 - DNA, 276 bp, Glycine max
  Peptide Sequence Number=SeqID_228317
atgtcttccgtgagtctccacggaagaagccgtcttccgcaattgcaatgtcaacagcggaagactgcttcttccgtggagtctcgcggaagacgtcttccgccagactccatggaagaagcattcttccgcagacaaaaggaaggacaaaatgatatcataaagatttctgatcctaaattcgcccaggctggcatccagcttgcctacgctaaagatgtaacttcaaccctaagcaagcgactcgcctgtgcgagtggatgccttcaccattaa

SEQ ID NO: 111540 - DNA, 192 bp, Glycine max
  Peptide Sequence Number=SeqID_228318
atggcggggtctcattgtcccaaatctcttcctcttccaaaaggaaaagctataggcatagagggggactccatgatcatcacacatagcaaagggagacaaaaaaacacaaagggaaagagagggagggaacaagctagggctaccagataccacttcaaaaccaatgggaaagtttttgctaagctttaa

SEQ ID NO: 111541 - DNA, 279 bp, Glycine max
  Peptide Sequence Number=SeqID_228319
atgatctgggccttccagactatttttcgaagctggattgcttctgctggaggaagcaacccagctcgcctaggcgagctgggcggcaacctcctccccctttttcctataaaaaggcaaaagggggttgttctaggcgagctgggcggcaacctcctccccctttttcctataaaaaggcaaaaaggggctgttctaaaggtccctgatccccttggctatgcatttcaactgttttgggtggaaaaaatcgtttccgtgaagaaaatccaagtttag

SEQ ID NO: 111542 - DNA, 486 bp, Glycine max
  Peptide Sequence Number=SeqID_228320
atgcctcaccgctggcactgctggtggtgcgttttagcatcgcgctggtcgcgctgttgctggtgggactgtttcgccgccgctggctgccgcagcccggcgatggcggagggcgtgacgccagggctgatcgccaccatcatgggcatccagccaattctgacgctgtgcctggtggagcggcgtctgccaggcaggcgattgctggggcttaacggtcgcgctggcggggctgatactgctggtgtggcgcagtctggcggcgtcgcagctgccgatcagcggcgtgctgtttgcgctggccgcgctgctgtgcatgaccttcggtgccatcatgcagcagcgggtgacgcagcatccggcgcaggtgctgccgctgcagtacggcgtgagtttactggctgtgcctgctggtgctgcccgttaaatcttttcatgtcagcttcacgctacatttctggctggctgcgctgttcctcggcgtga

SEQ ID NO: 111543 - DNA, 180 bp, Glycine max
  Peptide Sequence Number=SeqID_228321
atggcggctctgcggatagaccacgtggaacggatagtcggacggacgccagtcggcgaggatctccaccagccgtccggcctgcaaatccgcggccgcagcgtaacggaacgtctgaatgatgcccagacccgccaccgacgcggcaaggtgcgcgttgctctcattgacgccaacgcg

SEQ ID NO: 111544 - DNA, 684 bp, Glycine max
  Peptide Sequence Number=SeqID_228322
atgacacgcggagataccttacggttatccgcacccttttgtcatccagagtcgtcgggcccgatgacacgcggagacaccttacggttatccgcacccttgtgtcatccagaggcggcgggcccgatgacacgcggagataccttacggttatccgcacccttttgtcatctagaggcggcgggcccgatgacacgcagagacaaaatttggtcattctgcacccttgtgtcatccagaggcggcgggcccgatgacatgcggagataccttacggttatccgcacccttttgtcatccagaggcggcgggcccgatgacaagcagcggccaatgtggtcattctgcacccttgtttcatccagaggcggcgagcccgatgacaagcagcgcccaatgtggtcatctacacccatgtgtcatccagaggcggcgggcccgatgacacgcagagacaaaatttggtcattctgcacccttgtgtcatccagaggtggcgggcccgatgacacgcggagataccttacgattatccgcacccttttgtcatccagaggcggcgggcccgatgacaagcaggggccgatgtggtcattctgcacccttcgtcaatcgcggccgacaagcccgttgacatgcggagatttacatcatcttccgcacttgcaagatctgtcacactga

SEQ ID NO: 111545 - DNA, 574 bp, Glycine max
  Peptide Sequence Number=SeqID_228323
atggatagaagtatgattgatgcagctagtggatgcgctttcatggacaaaactcctattgctgctagacaattgatttccaacatggaagcaaattaccagcaatttgatgccagagttgctgcaccatccagtactgctacaaatgaacttttttattctatggttgttgataatcagaggctggaggataaacttacagagtttacatcccttgtgaggaaacaaaacaagctgctgatgtttctcccatgcaacatggacaaccatttagacctcaacaacaataacaatataatccttacccccaacacctataaccctggttggagagatcatccaaacttgagcaaatatcaagctcctccattcatacaacaacaattccagcagtctacacctacacctgcacaacctatacaaaatagcagttttggaccttccttggaggagctgatgaagcaaatgtacatcaacaacattcgatttcagcagaatgtgagtgccaccatccaagacctaaagactcagattggacagtcaacaacaaatatcaaccagttgcagcaacaag

SEQ ID NO: 111546 - DNA, 165 bp, Glycine max
  Peptide Sequence Number=SeqID_228324
atggaggttgaggaaacctaccaggggttatggctaccattgcattatcaagtagataagggagctctttgctgcaaaattccttccttggttggtgttttggttcgtgctaaaggtggtgttcgtgattggaagtgcggtagacaggctctgtggttgatttag

SEQ ID NO: 111547 - DNA, 229 bp, Glycine max
  Peptide Sequence Number=SeqID_228325
atggccccaaggaagcttgcctcaaagagatccaggaaagacaaggcggagagacgtgtccagctcagggacgacgagtatactgacttccaggaagagatagttcgccagcagtgggcatcggtggttacccccatggccaagttcgacccagacgtagtccccgagtcttatgccaatgcttggcctacagaggagggtgtgcgagatatgcgatcttgggtgacgg

SEQ ID NO: 111548 - DNA, 255 bp, Glycine max
  Peptide Sequence Number=SeqID_228326
atgtgtgaatccacatcaagccggagccgttacaaactccatgttgtggtggtgacccccacatacatatttcctaacgatgccccaattgctctaagatcatatctagtgtcaccccaatggtttttctttgacatgtttcattttgaggattcgccctgttgttgctgctgcaccatgcttaagagacacgtcaaacggattcgtccacatgttggagatctccatggagttgagtctacttatatggcataa

SEQ ID NO: 111549 - DNA, 1124 bp, Glycine max
  Peptide Sequence Number=SeqID_228327
tgtccaaactggaagatgagcttcaggtcaaactgctcaaccgcagtacccgcagcattgggctgacggaagcgggtaaaatttactatcagggctgtcgccgcatgctgcatgaagtgcaggatgttcacgagcaactctacgcctttaacaacacgcctattggcaccctgcgcattggttgttcttcaactatggcacaaaatgttctcgccgccatgaccgcggatatgctgaaagaatacccggggctgaccgtcaatctggtgacgggtattccggcgccggatctgattgccgacgggctggatgtggtgatccgcgtcggtgcattacaggattccagcctgttctcacgtcggctgggcagcatgccgatggtggtctgcgcctcaaaaagctatctcgcgcagtacggtgtccccgagaaacccgccgatctcagcaaccactcgtggctggagtacagcgtacggcccgacaatgaatttgagctgattgccccggaagggatctccacccgactgctgccggaaggccggtttgtgaccaacgacccgatgaccatttcgcgctggctggtggccggggccgggatcgcctacgtgccgctgatgtgggtgatcaacgagatcaacagcggcgtgctggagatcctgttcccgcgctatcaatccgatccgcgcccggtgtacgccctgtataccgaaaaagacaagctgccgctcaaggtacagaccttcatccaggaatattcttttgccactatcaggaatagcgaattgacactgccgccgcctgccctttaccttaataacagtctggatgacgttaaacaaggaaaagaaatgaatatatttgaacaaacaccgccgtcacgcaggcgctatggactcgccgcgttcatcggtttgattgcagggatggtctccgcgtttgtcaaatggggtgccgaggtccccctcccgccacgaagccccaccgatttattcaccgccgcctgtgggccggagcaattaataagagccgcggggtttactggcgggtgcgttagcccagctttttgttcatatgatctccttcccgctgatggggctgacaccaccgctgtttgcacttccctg

SEQ ID NO: 111550 - DNA, 1332 bp, Glycine max
  Peptide Sequence Number=SeqID_228328
atgtcgaggccgatcccgtatcggtggtgtgatagccgcactttgaccctggtgcggagagtggccgtgaacaatcatcaacatctgaatatgcgttacgtgtggagcatctgtctggtggcagcctgcggcggtttgctgtttggctatgactgggtggtgattggcggggccaaacccttctatgaggcctggttcaacgtcaccgatccggcggcatccggctgggcgatgagttcggcgctggtgggctgcgtgtttggcgcgctggtgtccggctggtcagcggacaagctggggcggcggctgccgttgatcgtcgccgcactgctgtttgtggtgtcggcgatcggcaccgcgctggccagcagctttacgctgtttgtctggtggcgcattctcggcggcgtcggcattggtatcgcctcggcgctaagcccgatgtacatcgcggagatcagcccggcagacaagcgcggcaagtttgtcgcggttaaccagctgacaatcgttattggcgtgctggcggcgcagctggtcaacctgatgattgccgatccggtcgtcggcgcatcaacccatgcggcgctgcgtgaaacctggaacggtcaggttggctggcgctggatgttcgcctcggccgccgtgccgtcgctggcatttctgctgctgatgatgtgggtgccggaatcaccgcgctggctgatgctggcgggtcagccacagcgcgcgctggcgatgctgaataaaattggttcgcctgcttatgcgcagcagacgcagcgcgagattgcccgcgcgctggagcaggatcgccagcaaacgcgtgcccgcgccagctcgctgctggcaccgcgcacgctgccgattgtcatcaccggcatcgtgctggcgattttccagcagtggtgcggagatttttgcttcggccggtttcgatatcaacggtacgctgaagtcgatcgtggccaccggcctgatcaatttgctggcaacagtgctggcactgccgctggtggaccggctcggtcgccgcaaactgatgctgatcggcgccggaggactgacgctgtgttatgcactgattgccggtgcctacacgctgggcatcaccggctggccggtgctgattctggtactggcggcgattgcggtttatgcgctgacgctggcaccggtcacctgggtgctgctggcggaaattttccccaaccggattcgcggtctggcgatgtcggtcgccacgctggcactgtggattgcctgttttgtgctgacttatacctttcccatcctcaatgccggacttggtgcagcgggcagctttatgct

SEQ ID NO: 111551 - DNA, 247 bp, Glycine max
  Peptide Sequence Number=SeqID_228329
atggcattcttgggagagacaagcagtcagacagttgtgaactccacattaggttttatttttccaaatggatccattgttcacaacgacagtggtgtttccttccaagcttccactccagttcccattcgagtacctaacgggtgtgattttcaaacgttaaaaaccagaatacacaatacccttaagctaaccgacaagcaatttttggatgaaatttactaccgacagtctttcacgtatgcag

SEQ ID NO: 111552 - DNA, 417 bp, Glycine max
  Peptide Sequence Number=SeqID_228330
atgacaccacgaaaccaaattaaaaactgcgccttctctgtctctgtttgttcttctcactttatattctctctctgtgtatatctcttcactcttattattccttctcttctcaacgacgatggaggacccatcagcagcaacaacgttgttgctgaacagcgaatattcgaggctgttcgtcgaggacacggacttgtacaatcgcattgtgttgggaaccctcttgccgcacttcgtgtggggcccactcccgcacttcctccagacgtggcttcgcaattacctcggcggcgtcctcctctacctcctctccggcctcctgtggtgcttctacatttattattggaagcgcaacgtttatgttcccaaagagatggcatattttggctcggatgtgaaatgggttttgattag

SEQ ID NO: 111553 - DNA, 177 bp, Glycine max
  Peptide Sequence Number=SeqID_228331
atgaaggaagcacttgcacaggcttttgaagatcgtcactatgttgagaaacaagcaatcaagtggcaactaattggagacttctcttacaagaagactttgactcgtctgatgttgaggtcatcgagagtgaatgcttattttgttgatgtcaagcaaaaggaggagaaaaagtga

SEQ ID NO: 111554 - DNA, 162 bp, Glycine max
  Peptide Sequence Number=SeqID_228332
atggacaaagccctgctcttcatgaactaccactccttgattcaaatgaacttcgagccgagaagagttgtccacgtcgtcgggttgaatggaataacaacgaagtggggctacgaggagaaagaaaccttggaagagattttggtgaaagatttggaataa

SEQ ID NO: 111555 - DNA, 375 bp, Glycine max
  Peptide Sequence Number=SeqID_228333
atgaacaaatatggaaaaatacaaaggggaaaaggaatattggacaaatatggaaaaatcccctgtcatcgtcatcgacgatggtggctcaatcatccacggtggttctgcaagcgagcggcgatggcggctcgaggggcggcgatgattgcgctaaggagtggggttgtcgtgattgcgaagaagcgacactggtggcttgaggggcagtcatggtcacacaagggagcgacgttgaaaaatgaagttggaacggtgggaaaaagaaggaaaattctggagttggatggggaagtggaaaaggaaaatgtgaggaagggggaaggtttgggcggggaaaagaagaggggtggggaagtgggaaaggaaatatga

SEQ ID NO: 111556 - DNA, 342 bp, Glycine max
  Peptide Sequence Number=SeqID_228334
atgaatgtgtctcattttgtttgctggaagcaaccgttattctctttatgtttggcatttcaccctcttgatgggatacttcaggcattacctcatagcctttgtttgttttttatgccaatccattttactacacatttagtcctcatattcattgagggcatttggactgctaatattcatgattgcattcatggaaaattgtggcctgttatgggtgctggttaccacaccattcaccacactacatatcggcacaactatggccactacaccatatggatggattggctatttggaactcttcacaaccccgaggaggacgagggcaaggctatgtga

SEQ ID NO: 111557 - DNA, 396 bp, Glycine max
  Peptide Sequence Number=SeqID_228335
atgtatggtaatggtcgttgcagggaagacgcagggttgcacccatcactgaagctagtgtgggccctttgtcatggattggcatctgtgaaactaagtcaacatttcctcagaactttttcctcatgtgcttccattggcgaaacatttttggtgacttctagtattgttctctattttggtgacatgttgttgcttactattaaaaagctacatggactattgatgtcatcagagttagttactgcagaatatgaaataagtagaagtgagataagcattataattcaggggcttgtgcttggtcttctgctatatccaatagctttgaaatatattctccaaatatgggagtggtttataaatacagcttccgctgaagcaaaaagatactaa

SEQ ID NO: 111558 - DNA, 580 bp, Glycine max
  Peptide Sequence Number=SeqID_228336
gacagagagcttaggggaagcagtaatgggatcatcggcggctatcataagtggctgagagtccgaacacaaggattggattggctcccaaatctaaagactgtgagagacgatgaggttaaagcttcggaagaaagtgatgaggtacaagccctaaaggcagagcttgaaagagcccgggtagtcgaagagaagttcaagtccatagccatcaaagaatcatcacgggtcaaaggcatgatctccgaagaggtgaaaggaatcatcacgggtcaaaggcatgatcttgaaggacgagctaaagggaatatgtgggccatcatcgataagtgcaaagagaagctaaatctagcggcgactcacgagcaaaggctagaggatgagtacgccaagatatcagcagaaagggaagcaagggaaagggtaattgattcattgcaccaagaggcaacaatgtggacggaccgatttgctcttactttgaacaggagtcaagaacttccccgattgctagccaaggccaaagcaatggcggacacctactccgcccccaaggagatccacggacttctcagctatt

SEQ ID NO: 111559 - DNA, 113 bp, Glycine max
  Peptide Sequence Number=SeqID_228337
taactagtcctttcctagggaggattgcatcaactggtcccttcctagggaggattgcatcaattattatggttttagtacagtatttcctttatgtctacatacactactag

SEQ ID NO: 111560 - DNA, 158 bp, Glycine max
  Peptide Sequence Number=SeqID_228338
atggcaatggcacagctttatgaacaagctatcaagtatgagaaaggatcgttcatcacttccactggggcattggctacgctttctggcgccaagacaggtcggtgtcccagagacaagcgtgtggtgaaggatgatgttactaagaatgaactttg

SEQ ID NO: 111561 - DNA, 528 bp, Glycine max
  Peptide Sequence Number=SeqID_228339
atggttggttgtgaccctaaagggaccttctcagttggggctaagctttcccgctctaggatcttttttggcttcctctcagactcgccatacgaggtcgccagtctctttgtcgatgattccccaccttctatggggatcatggtgtctgtgccatatgcctttagacttgtcaagtctagtacgcagggccctgagaatgactcgattagttgcctctgcatgtccgttattctaaggatgttcaacagaggtgacaaggtgcttgatccctatccttgtcaagaagtcttcgtaagtctgagctttgaattgagtgtcgttgtcgatgacgatagcatatgggaggtcgtacttggagataaggtatctctaggcgaacttttccacctcgctggccataatttcctgaagtggtcttgcttctatccacttggtgaagtatttaataatgacaatcccagtatgtccattccccacatggcgaaagggcaagcgccacatggcgaaggaccaaagggagcttag

SEQ ID NO: 111562 - DNA, 696 bp, Glycine max
  Peptide Sequence Number=SeqID_228340
atgggtcatatgcgcagttgcaagtttgtattcattctttcatctctatcatcaaattccttctcaaacgagctctttcatgtccaaagcacgaactgcgttccattccgcagccgcgaaagcgaagcatgttctcatggacttcaaaatcgatctaggtggtttcttgatgaactgaagcatataaagtggagacctccacatataggaacaaagcagggttggcaagatagaacaaacaacatgcgaagagggagaaaggaagtcgaagtaatagataaagttggcgatctgagaaaacattggtccgaagaaaaacatttgcctagaatccccccagatgacattcaagatctaaagtcatgtcttctgtatcaacaatttcaagtgtatttagagagaattctcagaaaaccaaaaattgatgcttttgcaaaagaattgaaaccacatcaggaggagagtttttatatgttctcagagtggggaaaacattattgtaaggtttttagtagacatggcaatggggcgaggcagggacagattgaggctgtgatacattttgacgatgacactgaagagttgcagcgatgggaccagcagactaattccgaagcgacggtcgtgctcctccttggtcgcatacttcttcccaaactccgccttaaagcttacgaagtggtgctccacgtttag

SEQ ID NO: 111563 - DNA, 776 bp, Glycine max
  Peptide Sequence Number=SeqID_228341
atgaattgcgttttcgttcatgtgtcctccactttcgagttgagagctatgcgtagtgattgcttagtgcaattctccattctcaacttttttcggagccccatgaattgcgttttcgttcatgtgtcctccaccttcgagtttggagctatgcgtagtgattgcttagtgcaattctccattctcaacctttttcggagccccatgaattgcgtttttgttcacgtgtcctccaccttcgagtttggagctatgcgtagtgattgcttagtgcaattctccattctcaaccttttttgggagcccatgaattgcgttttcgttcatgcgtcctccaccttcgagtttggagccatgcgtagtgattgcttagtgcaattctccattcttaacctttttcgaagccccatgaattgcgttttcgttcatgtgtcctccaccttcgagtttggagctatgcgtagtgattgcttagggcaattctccattctcaacctttttcggagccccatgaattgtgtttttgttcatgtgtcctccaccttcgagtttggagctatgcgtagtgattgcttagtgcaattcttcattctcaaccattttcggagccctatggattgcgttttcgttcatgtgtcctccaccttcgagtttggagccatgcgtagtgattgcttagtgcaattctccattgtcaacctttttcggagccccatgaattgcgttttcgttcacgttacctccaccttcgattttggagctatgcgttgtgattg

SEQ ID NO: 111564 - DNA, 195 bp, Glycine max
  Peptide Sequence Number=SeqID_228342
atggcttcccatcccaatggtagtgtcaagatgaatgttgatggaagttgcttgtttccctcccttcatattggtgttggagttgtccttagagatcatcattacgcatggatctttggttactcttcatttgatgcacgcaagccatatgctaagggagtaagtgtgacagcctctatcccgacatacatataa

SEQ ID NO: 111565 - DNA, 1908 bp, Glycine max
  Peptide Sequence Number=SeqID_228343
atgtcaggggtggtggaagaagggggtgttgaattggtggagaattcggaagaggagagaagaaggtcgagaattggaagcttgaaaaagaaggccataagcgcgtcttctagatttacgcactcgctcaagaagagagggaagaggaaaatagactttagggttcccattgaggatgtgagagacgctgaggaggaattcgcggtgcaggaattgcgtcagaggctgcttctgagggatttggttcctaccaggcatgatgattatcatgcattcttaaggtttcttaaagcgagggactttaacatcgagaagacgattcagatgtgggaagagatgctaacttggagaaaagaatatggaactgacgctatccttcagattatcatctggtcacatcatactttagcacattatccgaagagtttgacttctcaggattttgaatttgaagagctggaagaagtgttgcagcattaccctcaagggtatcatggagttgacaaggaaggtaggccagtttacattgaaaggcttgggaaagctcatccaagccgcttgatgcgtataaccacaatagataggtatttgaaataccatgtccaagagttcgagagggctctgcaggagaagtttccagcatgtaccattgcagccaagagacgaatttcttcaaccacaacagtattggatgtacagggcttgggaatgaaaaatttctctcctactgctgcaagtctattggctgccatctcaaaaatagataacagttactatcctgagactttacatcgaatgtatatcatcaatgctggtcctggatttaagaggatgctttggcctgcagcacagaagtttcttgatgccaaaactattgcaaagatacaggttcttgaacctaaatctttatgtaaattactggatatcattgactctagtcagttgccagactttttgggtggaacatgtacatgtcctggagaaggtggatgtctaaggtctagcaaaggtccatggaatgatcctgatatcatgaaaatggttcatagtgtggaggcaacgtttgagagacaaatcgcccgaatgtccaatgaacaacagaatttagactctttttggatatgcccacagaaggcaagtctcaatctacaattatatccttttctcatctcccaggggcaatgcagtgatacgtcaacagccgaatctgggtcagatcttgatgattctttttcgtccatcggacaaagtagattcacttttcctcgtttagctgcagttcatgaagaagtcagagtatcagacaactactatagttgtgatgatagtgctcctgcagccgagaaagtgcttgaaagtgatgaatttcacataacccaggaacaatcattgcaaaatgatgatacagggaatattgcttgtatggaaaattccacaggcacttcagtcaacaattggttcagctttgttaaggaaaaagtggagaaaacaaatttattatatgtgtcgagagtggtgatatattttatggaaagattagtaatgttctttcgcagtttaagattagaattttggagaacacagaacaatatttacccatctgttgccatggaacacaacaataaccctgcagcagctagtgaaatactttctgaaagggatcatattcttcgatgtatgcaacgtcttgagagactagaaaaaacgtttggggaacttagccacaaacctgcaggcatacctttggagaaggagcacatgcttacaaattccttggataggattaaatctgttgagtttgaccttgaaaagactaagagggtgctacatgctacagtgatgaagcagcttgagattgctgagctgctggagaatttgcaggcatcgaagagtcaagttcttatttga

SEQ ID NO: 111566 - DNA, 147 bp, Glycine max
  Peptide Sequence Number=SeqID_228344
atggacaaagccctgctcttcacgaactgccactccttgattcaaatgaacttcgacccaggaagagtcatccacgtcgtcgggttgaatggaataacaacgaagtggggctacgaggtagaggcatggagtgcctctttccactaa

SEQ ID NO: 111567 - DNA, 649 bp, Glycine max
  Peptide Sequence Number=SeqID_228345
cactgaaacaatccttgatcctgcatctcccattagacaacacgtgaagtggaggatgactcacacaaaaaactctggtcaaatgacatttgaggaagagcagtctgcacagggaaactttattgcctatgaatgtcaggatgtattgattgcttccattgggcgattagagcagtctaggcgtgtccgtgctgatagagacggtgtaacgatcaagcaatactttggaccagcttcaacaagctcttgcacttctacatcgattagccagaagatgacgagacaactaatattgtctttcagccagatgcaatcccagggactcgtaccttctcctgagcctgaggttgctcattttactgtacctgtcagcacaaagggaagttgtgtcgatccctcagggcaggacctagacacaggtccacaatcgtgcacaaccgtccctttgggcaatgatcaggtgaaggtaggtgttgagggagttcgagatggtgatgctcgcgtccctatatccactgaagtggttcagttagtggggcaaacccttaacaccttccttgcttggacaacacatcttgtacaacatttttcagaaaaggataaactgggatcagagggaccgtcaaaacctatagaacatggtgcataa

SEQ ID NO: 111568 - DNA, 828 bp, Glycine max
  Peptide Sequence Number=SeqID_228346
atggctcttattatgaattgcattacaacttattacttgtctttaaagtggaatggtgaaaaacttgatagctttgctcctaatagaggtcttagacaaggtgatcccatgtcaccttatctttttgttctttgtatggaaaagctggctttacttattcaggagaaagttattgaaggcaaatggcttcctatcaaggtatccaaagatggttctatggtgtctcgcttgttttttgctgatggcggtcttctctttgctcatgccaagtctagtgaagttcatatcatcaaggaaagctcaaaggtttccattattgaagggaagggtcaccaatgccaacttttctcatttttggatagggtgaattacaagcttgttggttggaagagagtttgtgataataatgacaaattgatgagaggctttgtttggaacaaaccttcaactcattgggtgaattgggagagtactattactcaacataagtcttgtgttggccttagcattcgtagagctagggaaactaacattgctcttcttaggaaacatattcttccagctatgtatttgaagggagtctctattcttaatgtggaacccaaggatgaggcatcctatacttggcaatctatcatgaaggttgtgcatgacttgaaagctggtttcaaattcagaattggtagaggtcacatctctctttggtgttgtttggctgaggaatcttctttgcatgttgtttgtgattgtagcatggtgaaaactgtttggcttgtgttatttcatgaacttcctagaaatttcttcaagatggatgtcaatgattag

SEQ ID NO: 111569 - DNA, 153 bp, Glycine max
  Peptide Sequence Number=SeqID_228347
atgctgatatcagcacgttttagaaggtcagcattcaaagacggaagatcgttgaaaattgcgacttctaagacggtcattgttgcaccgtcgttgaaggtttcgacattccacgatgttggaatctacaacggtcatccaccatcgttgtag

SEQ ID NO: 111570 - DNA, 807 bp, Glycine max
  Peptide Sequence Number=SeqID_228348
atggctcagccgcttgtgaagaaagatgatgaccgcgacgacgaaggtgcacttcccctttcggtaatacctattggtgatattcttgaggtcaaagccttgacgaattgctctaatgatgttataaacctggacactggagaacacaagggttattcctttgtggcttttaaaacaaaagaggtagcacaaaaggctattgaggagatacatagcaaggaatttaagggttgtcaacgacatgggtcttctactaagaagaacaaagactaccaagagaagctacccgttgttgtgcttagggtagaggaaattatttactctaaagccaattccgaggtgtgtaagaagcctggtgaagagggagcaagggatatttcagggatagaggagcctggatggaaacctaaactcaatgtgcactatgagaaggcggggtgcaaaaacgtggatgattttccttgtattctctttttaccaagttttggtgtttgccctttccattatgagaagcttgttcttgttttttcttcagcttgcaataaggctaagcttcttaaagtgaaagtgttaattgctgataaagaatatcagagtgctattgctgagtctgggtttcttctcaaggaagatgaaaataatttagaggcattttcttggtgcttgcctttgatcatctcaaaagtgggaaacttgttccactatttgatttgttatgtgcttgtaatcactgataattttcttgttgctggaaagttcttcagggaatgtactgtcggactcgaaagtttgatgaaacaagcttga

SEQ ID NO: 111571 - DNA, 414 bp, Glycine max
  Peptide Sequence Number=SeqID_228349
atgagatctttgttcaagtatgtaaatgaatccgtgctgaagaagaagaatccaattttcgaggttggcgaagaaggaggaggagatggaagatgcagaaaacctagcacaaaaatgcgagaggttggcatagagagtgaaagggagagtgagaataaagagaggcgcgagagaacgctccttcactcttcacacaatttcaaaatccctaatccatcatttacgctgcattcttctcagatgtgtgtgtttggcgttccgcatttggctgtgttgaggcatttggtttcctcagatgcctcatgtgagatgaggaagaaaatcatagatccctcctctgagaagaagttccacggtgttcggcagcgactgtgggggaaatgggtggcggaggttcagaatctggcaagatga

SEQ ID NO: 111572 - DNA, 348 bp, Glycine max
  Peptide Sequence Number=SeqID_228350
atggctgaaatcctggtacatagggcaggttctccagatgaattcactaggctaacaactatcacatggataaatgagtttgtcaagcttggtggagaccagcttgttccatattatgctgacattcttggagccattttgccttgtatagcagataaagaagagaaaattagagttgttgctcgtgaaaccaatgaagagctacgtgccctcaaggcagatccagctgaagcgtttgatgtaggagcaatcttgtccattgccaggagtctgaatgtacacctcacgaatcaagggaaccttctggacgtgatcaagagactaacgacaaagctgatactgaggtga

SEQ ID NO: 111573 - DNA, 423 bp, Glycine max
  Peptide Sequence Number=SeqID_228351
atggctaagtatgatccagaaatagtcatggagttctatgccaatgcatggtccacgaaggagggattcaggggcaagcactcctgggtgtggggccaatggatcccctttgatgaggatgacttcgcacagagagtgccagggagacgggtgaggatcatgtgcaccagcatgaccaccttgacacagatctggatgacattgctgctcagcaacatcctccccagcgatcataattctgaccttcccctgccgaagtgccagttggtctatgccatcttgactcaggatcacgcctcccagacacccagtggacccagagaagtccaacagagcactggggtttctagccttgatcatgggcctctgccagttttatggggtgtcggtgaatcccacaaagcttatccggcctcccattaa

SEQ ID NO: 111574 - DNA, 201 bp, Glycine max
  Peptide Sequence Number=SeqID_228352
atgtctactgcaagctacgtagtggatatgggaaagaagatgttgcaaatgggcatagaagatcaaaaaatcagctttgatttatttcatgtagatcaggagccacctgaccgaaatgtctgttttaaagttcatgtgatggaggaaagaagacctgagaagaaggtccttgaagtgggaacattattggatcctggataa

SEQ ID NO: 111575 - DNA, 240 bp, Glycine max
  Peptide Sequence Number=SeqID_228353
ggtcctacaatgctcaatggaatgccctggggctcctccatgataagcacacgttgcgttcgagtcgtatcctcagaaaaatggaggttgaggaaacctagcggggttatggctaccattgaattatcgagtatatatgggatcaaggtggtgtcataccctaatttcgtccggggacctttgcttgatgacatgcaacttttgtttggtccttgtgaggtgcttgggacccatcattag

SEQ ID NO: 111576 - DNA, 189 bp, Glycine max
  Peptide Sequence Number=SeqID_228354
atgggtgccaagcacctcacgaggaccaaagaatggtcgcatgtcatcaagcaaaggtccccggacgaaattaggtccaaggtgaagccagaaaagatccctaagcgagaatgcttggccctaactgggaaggcccattcagggtcacaaccagtcttgacaatggagcatacagactacaagaactag

SEQ ID NO: 111577 - DNA, 636 bp, Glycine max
  Peptide Sequence Number=SeqID_228355
atggtgcctcctccttcctcttcgactccaatggtccttccttccattgcattggcttccacttccacctcatttcaccctcgtgtttccctagatcacatatatacttccaatgatgttgattccttgtggggcatggggtacaaacccaaacaaaagaccccagctagctttgtattggcctttgataaaaatcttatcaggtcagctgggtttcagcatgaaaatgggcggcgacatcaagagaggttgagcatagtggcttttttggaagttgaattttccaaatggagggcgactgttcgcactgtctggagagtggagtgccctaaggtagctagtgccattgttgctcttattgaggccgtgaggtcgaaccaccaactgtcttctaaagttggtagtgtgttggccaagttgttgcgcaccaggttggatagtgatgaattgttcaaatgctgcaaggatttgcaggaagagaaaaggaacttggctggcagggtggaggacgttgcagtggagaaggacgagcttgccaagaaggtggtggatctcgaggcttggctgaaggagttagagtccgcgccagaggagtccaagttgtgggctattagggaaagggaggccagcaaatag

SEQ ID NO: 111578 - DNA, 105 bp, Glycine max
  Peptide Sequence Number=SeqID_228356
atgcagttggatttagatgcatttgactaccttccacttgaaagacttggatttagattgggaaggatgtgcatgaatggcatagacgtattgctgatcagctga

SEQ ID NO: 111579 - DNA, 261 bp, Glycine max
  Peptide Sequence Number=SeqID_228357
atggggatagatcattgcattgttggtcttcaacgaggaatcctagtaagcgcgagtcatcagctcgcgttgactacgtccctgccctttgtacacaccgcccgtcgctcctaccgattgaatggtccggtgaagtgttcggattgcggcgacaatcccgtgaaccatcgagtctttgaacgcaagttgcgcccgaagccattaggccgagggcacgcctgcctgggtgtcacacatcgtttccccaacgcaaacatgtaa

SEQ ID NO: 111580 - DNA, 543 bp, Glycine max
  Peptide Sequence Number=SeqID_228358
atggctgatgacattgtctataattataaaaaatcatcaagaagtccagcattacagcttgatgataggactcttcaaaatctagtcttgcttgaaattgaaaaactgttgcaagcaaatcaaagatcacttacagactatccttccatgccatatccagaagatgcaaattgcctaacctatctagacaatagccttatattagctaaactcaattacaacaatcaagaactcagatcagagtttgaacatctattttctcatatgacagacgaacaagcatcaatttataaccatattgttgaagttgttgataaagatgaaggtggtatgttttttctctatggatatggaggtacaggaaaaacatacatttggaaaacactcacaagttcactaagagatgataataaaattgtaattatggttgtttctagcgtcatagcttctctattattgcctggaggtaaaactgcacattcaaaattccaattccagtttttgaagactcaacttgcaatatccattaaggaactcaattaa

SEQ ID NO: 111581 - DNA, 708 bp, Glycine max
  Peptide Sequence Number=SeqID_228359
atggaagtgagatctatgggagagaactggtggacctgcggcaaaagagtcgatgggagtttctcaacacattcttctctgtgtccgaagctgtggcttacatgcagatggttgacaaacttgatggtgggattataccatccaatcttggctcctttgattataaagggctttataaggcttgaccttcaggttgttggaaaagctctcatcgcggcacacgtagaaggccgcctcaagagtgagattatgtctaaccctgaacagtttgtggagcctgatccggaattactcttcacacttttggatcagaaagaggcaggcaaaaaacttgtacttattaccaactcagattatcattatacacacaaaatgatgcatcattcattcaatagattccttcccaatgacatgggttggagagatttatttgacattgtaattgtctcggcaaacaaaccagaattcttccaaatgtcacaccccatgtatgaggtggtgacagaagagggcctgatgcgtccatgctttaaggctcaaactggtggtttgtactcaggggggagtgcgcagatggttgaaagttccctaaatatacatggagatgagatactgtatattggagaccatatttacactgatgttagtcaacccaaagtccatttgcgatggcgagcagcattgatttgtcgggaactggaagaagaa

SEQ ID NO: 111582 - DNA, 603 bp, Glycine max
  Peptide Sequence Number=SeqID_228360
atggtttcccttgtaggaattgatgtacatgctgcatttgaaggtccagttgaggaggccagaacagaggctagaaaagctgaagatttactgaaaaaattggatattccgagtccttcgttgagaaattcacctcgtggaatattctgcacccgaacgctgaatctaaggtcaattagtgctattggatatgacatggactataccttggtgcattataatgtgaaggcttgggaagggcgtgcttatgactactgtatggaaaacctcaagaatatgggtttccctattgatggacttgcgtttgatccagacctggttatcagaggtcttgtgatagataaagagggaggcaatttggttaaagctgatcgatttggttatataaaaagagccatgcatggaaccaaaatgctatctacgcgtgctgtgagtatattctgtcaggctcttagtgctgaggggcaattctgtggcgcattgttcatccagcatcgagaagcttctcttcatgcaaacaagccagccccaccgcctgagccaaagtcaagggttgcaaggcctgaacctcccgacgtatcttcagagtcaaaccggagatga

SEQ ID NO: 111583 - DNA, 288 bp, Glycine max
  Peptide Sequence Number=SeqID_228361
atgttgtgtcgtgacgactcccgcgggacaccgtctccgggcccccgggagtcgcacttaacagatttgagttccttggcgcacgaagcgccggggtttgtgtttgtcgcgaggacgaggaggccgggcgcacggggcgccgtggtcatcccctccctcccgacgcgaaccgctcacgtcgccacaatccgaacacttcaccggaccattcaatcggtaggagcgactggcggtgtgtacaaagggcagggacgtagtcaacgcgagctgatgactcgtgcttactag

SEQ ID NO: 111584 - DNA, 255 bp, Glycine max
  Peptide Sequence Number=SeqID_228362
atggagggttgtgctgctcttggcaagctgttggagccgcaagattgtgttgcatatatactcccagttattgttaacttctcccaggcatcagtaaaaaaagatagcttgccaattggaaaagaagcaatgcttggagcattttcgttactcaaggttattgagtctgagctacaagcatacttgtctacaactgagggtcgagtgtggggagtgagatggaatatggatgagttagttatggagagaacatag

SEQ ID NO: 111585 - DNA, 396 bp, Glycine max
  Peptide Sequence Number=SeqID_228363
atgaccactgactgggggttgaattccctagctctaacagggagggaatatgtgccgttagtaggtagctcaaaaaaaggttggcctaatactccctgcaacttggaaacacttaaggatggacctggaaagaataaaagatctaattcgagttgcaaatatcgagaaaatgtattcgggaaaaggggggcccccaagatggaagcacatccaagaagagaagtaattaggtggttagagtgtgaaggacacatagaaaagaacttcaggcataaatttctgacttggcacagcttaagagccacatctcaagaagtaaggattgcgaaaatatacattgatacatttcttgaagatccaacatctcttgcagagcaacttgtggacaccttttag

SEQ ID NO: 111586 - DNA, 370 bp, Glycine max
  Peptide Sequence Number=SeqID_228364
atgctagcatcactaaaggaagaagaccctcactttagcaaccctgtactaattggaggagtgattctcacagttttggattttatttttctcttcatgacatctggtagagatccaggaattatccccagaaatgctcacccacctgaattagatgaaccattagacataaacacaccatccatggaatgggtaaataatagggcccctaatcttaagctgcccagagtgaaagatgttctagtcaatggccacacagtgaaggtgaaattttgtgatacttgcttgttgtatcgtccaccacgtgcttcccattgttccatctgtaataattgtgttcagaagtttgatcatcattgtccttgggtcg

SEQ ID NO: 111587 - DNA, 204 bp, Glycine max
  Peptide Sequence Number=SeqID_228365
atgaggtttggagatagcggtgtgcctatggaggaactcgcggtagagtgcattggagatggcgaagacgaagaaagggctggtagtgaaggtgaagaggctatggaggaacttggcggagagcgtgagcatgtaggggaagtgtgtgaggatccacgagaagagaaggagggcgaggcaaagttcaagaatgtgaagggctaa

SEQ ID NO: 111588 - DNA, 312 bp, Glycine max
  Peptide Sequence Number=SeqID_228366
atgtatggaaatgtcacgtatgttccaagaactttttatgccaacagggaagagatgctaaagagctatgccgagtccgtggctggtaacgatggttttgccctatggttcggtgatatcgttcaagctttttcaacaattgaattgtctacttctccaaattctatgcaaatggatgtaagtagaagtaagggaagccatctaaagattttagtttccaatgaaggtgctggtgattctgttgctctactaggtgttattcgcttagtgcaatacttatcacataatcatttacttggaaaacaaagatga

SEQ ID NO: 111589 - DNA, 891 bp, Glycine max
  Peptide Sequence Number=SeqID_228367
atgatggaccgggaggtcatttccattggcagttcctccttagaggatactcgtcatggtgcctccaacaatgagtcctcctcttcaagagggagaagtagtagcggtggagatgtcagggcgactccccgtgtgcgacatagccatagcactgggtcggctttgtctcgacctatcgtcgttggctatgagtgggtgaagctggcaagccctgaagactcctgcaagatagtcgttcaggcttgcaggagtgatgacttccctttcttgagggcggcatcaagtagttcaccctttttctttatgtataggtgtttgtttgaggtcttgggtctcattctccccttgaccgctttccaatatgctatgcttgagcatttgaatgtggctccttctcagctccacccacacagttgggcaatggtgaaagcttttgaaattttatgccttttcttcaacatccggcctagtgtgctagtcttcttatttttctttcaaatgaagctgactggggtggggagcctcgcttcgcattctactagcagtctgaccctattaggttcaagtcgtttaatgaggatttgctggcccttgtcgagtttgactcaaatgtctttcgccattttaaggaccatttctttaaggttcaagttgtttaatgaggatctgctgacccttgtggaaagggtcgacaaagctattttggagcaactgtcggccttgctagacacgcgagccattctatctcttctctcggagagtgatcccctcgctgccttggacggtattatgggtgatttcacctggaggccacttgtgaagcaggtcggacttacgggtgggactgtgccaccatctactgctgctcctgttgttggagaaaggggttaa

SEQ ID NO: 111590 - DNA, 354 bp, Glycine max
  Peptide Sequence Number=SeqID_228368
atgtccaccccggacaacttgacagaagcagtccaaacaatacctgtccaggctcgggggcttgacaagctttacagacctgacaatatttgtcaacacatgagggctcgacaaactcgtcaccctttacttgtcaaggatactaccctagacaccaaacaatatccctcgacacatgataatccctttcgacactggacaatctcttttgcctgcaagccgactcagagcttggagggcttatgtattgtcaagggtccaaaaaatacatgtggcaccttacatggcacttcgagatacgtgtcaacccttcacatcaaccttggaactggagtacagacactcaacccttag

SEQ ID NO: 111591 - DNA, 210 bp, Glycine max
  Peptide Sequence Number=SeqID_228369
atgcctctctctcaaaactccatccaaaccaccccagaaactcctcctccaccacccacgaccatcgatggccaccacgagccgtcgttgcttgccaccgaaccaccacaccaagaggaacactttaatcagagcggaatcctcaaaatccacctcaaggattcggtggagaaaaatcccttaatccctttctttcatagcttctttgag

SEQ ID NO: 111592 - DNA, 867 bp, Glycine max
  Peptide Sequence Number=SeqID_228370
atgattaaaaattgtgcgaccgacgttaatcgacgtgaggattctagcacgtctgtatcaaatggggtaaatcgcgccgcgttttccgctacggtcgtagcactcaacgctcgcgccgccacgcctcggcggttaacgcttcgccaaaatggctggcaatcagccgtttggttaagtcgtgcagcggcgaggccagcacgtcagcggtgccgccgcgctccaccacttcgccctgatgcatcaccactccagcatcaggttcaccagctgcgaacgcatggtcatgtccagcgaggcgagggcttcatcagcgacaatcaccttcggctgcagaatcaacgcgcgcgccagcgccagacgctgcttctggccgggggccagcatgtgcggatagtagccggcgtggtcgcgcagcagcccgacctgacgcagcgtggcaatgatgcgcttttcgcgtgcttcatcatcaagatcggtattcagccgcagcggaaagtcgaggatctggctgacgcgctggcgcggattgagcgacgtcgacggatcctgaaaaatcatgcgaatccgctggctgcggtagccgtaatcgccgtagctaagcgggtgatcgtcaatcagcatctcaccttctcttggcgccaccatgccgctcagcatcttcgccagcgtggatttgcccgaaccgttttcgccgataatggccagcgtctgcttttcacgcagggtaaaactgacgtttttcaccgcttcaacatgctggcgccggaacagcccggtgcggtagcggtaggttttgctcaggttgcgcacttccagcagggtttccattattggctctccatattcagcgggaagtggcaggcataa

SEQ ID NO: 111593 - DNA, 552 bp, Glycine max
  Peptide Sequence Number=SeqID_228371
atgcatgttgggcatatacttctagggcatccatggcaatttcattgcaaggttacacatgatggttacaaaaatagatatgctcttgttttgaacaattgcaacattatgttaacacctcttcgatccgctgaggcctatgtcgatcaaagcgagtgtaagttgagagaagaacaattgaacattcaagaaaaagagagaaaagaaataaaaaatgagagtgagcaaaagaaagaaaagaataaaaaagaagacaaagaagagaaaaataagaaagtgagtgcatttgcaaagaagagagaggttgagagtactttgatggccagagagcagctacttgtactaatgtacaatgatgtttattttactaacgattttaactcttctttgccttgtgagattgtttccttgttacaggaatttgttgatgtttttttagaagaaattccatatggattacctcttttaagaggccagcctataggtaaagtccagaagaagcaaaggagattcaaagccaagttgatgagttcttgcaaaagggatttgtaa

SEQ ID NO: 111594 - DNA, 639 bp, Glycine max
  Peptide Sequence Number=SeqID_228372
atggaggcaatatttgctggggagcactttcaaaatttacatggaccagcagagcttgaaaggccttatgactcaagctattcagaccccagagcaacaaaagtgttctggaaagagctatttcagattttaggcacccagttggctcatagaagtttagaccatccacagacggatggccaaataaagaatcctatgaagcaattttatggacctttgtggattctgcgtcgaatcggaatagtcgcgtatgagcttaagctccttgcatcttcacgcagtcatcctgtcttctttgtctcgttgctaaaaacctgccatggccaactggcttcacaggtagttcctctccctgtggacaacacaaaccatgtcatacccgagcctctttgcattttggggaaagacaagtttcaaactctgaagggaaatctattagatgcgccaattccgaattctctcgtccattgcttgaagttagacatcctttcacgaaactatttgagtggagaaattcctatgcaacttgcaattaatggcaagctatatggtcctccattaaatgaaaaactagatgagaaactgtcaaggatgttgccaagacaagaatgtggaaggttagcttgtacaattgattga

SEQ ID NO: 111595 - DNA, 324 bp, Glycine max
  Peptide Sequence Number=SeqID_228373
atggatcattgtgatagtgaaatcagcctcaaagagtcccaaagtttgaagcaattgtacccctataacgacatcaactccttgaatgggaaaaatgtaaaagggcacttggaaagtaactatttgaaccaccaatgggatattagggcaaaacccagcatattcaatgtatgctatgttgcccaccatgaccttaaatggttccgtaggtgtgggtacaatgtgcaaaaattccacaacacggtttttcaaaattttatagtgtgttcagggaaggttgaccaaggatggcttgtagagataggtgaaagcggtctaggctag

SEQ ID NO: 111596 - DNA, 639 bp, Glycine max
  Peptide Sequence Number=SeqID_228374
atgatgaggagaattggctttaggccctacggaggagttccaaccaagcagaggattgtgacagggagatcccattgcaccattcctattttttattgtagcagaagcattgagtggtcttatgaggcaagctttgctaaagggattttggtgggggtagctagaaagataactaggttacaaagggagttcctttggggtgggaatgatggggtgaagaagatagcttccgttaagtgggatgtagtgtgtagatcgagagagcaaggagagttaggaattaaaaatattaagttgtttaatatagcactattaggaaaatggaggtggaggttgttgagggaggaaaggttgttgtggagtcttgttctaaaatcaaaatatggggagttggtcaagatgcttgtgaggaaggtttctaatttagattctatttggtggagagatttggtggagacatgtggtgagaggagggaagagtcatggtttgacaataacattacttggaagttgggggatggaaagagattaaatttttggcacaacatatgggttggcaatcaaacattggcctctaagtttaataggctctttttgaattctatgcaaaaagagggctttataggtgatgtaggatag

SEQ ID NO: 111597 - DNA, 369 bp, Glycine max
  Peptide Sequence Number=SeqID_228375
atgaagaggactatttgccaggtttgttccccttgcaagttaagctatttgtttcatgggaaaccagtttactgcttgctctctccaaatgggtcgacgccaagcctgaaaaacctaattgagaatgaatatggggcacagagtaagttgcaaggagctactggtcaaaactatgtgaattgggctgcaaaactggctgtggaaatgggaactggggtcccttgggtgatgtgcaaggaagacaatgccccatatctagtgataaacacttgcactggcttctattgtgataaatttgtttcttctgctgttgatattaaaaatcatgaaattttcttcacatcaattgtgtacttttttttaaggtga

SEQ ID NO: 111598 - DNA, 2946 bp, Glycine max
  Peptide Sequence Number=SeqID_228376
atggctgagtttgtcatcgaaactttgttagggaatttgaactcacttgttcaaaaggagttgcaaccatttcttggttttgatcaagacttggaaaggctttccggcttgttaactacaatcaaggctacacttgaagatgctgaggagaaacaattctcaaacaaagatataaaagattggttgggaaagctaaaacatgcagctcacaacctggatgacatcattgatgagtgtgcctatgaagtaatgaggttggagtacgaaggggtcaagtgtggtccattaaacaagctacaatgctattgcttatcctcttttcatcccaagcgtgttgtttttcattacaaaatttctaagaaaatgaaaagaataagtgagagattaagggaaattgatgaggaaaggactaagtttcctttaattgagatggttcatgagagaagaagacgagtccttgagtggcgccaaactgtctctcgagtcactgaaccaaaagtctatggaagagaagaagataaggataaaattttagactttttgattggtgatgcttctcattttgagtatttatctgtctatccaataactggtctaggtggacttggaaaaacaacacttgcccaattcatcttcaatcataagagggtaatcaaccactttgagttaagaatttgggtatgtgtttcagaagatttcagtttggagagaatgatgaaagctatcattgaagcagcatctgggcatgcttgcacggatttggatctagggtcacaacaaagaagaattcatgatatgcttcaaagaaaaagatatttgcttgttttagatgacgtgtgggatgataagcaagagaattgggagaggttgaaatctgtattgtcttgtggggccaagggtgcttccattttagtcactactcgtcaatcaaaggtagcaacaatcttgggaacagtatgtcctcatgaattaccaattctacctgacaaatattgttgggaattgtttaaacaacaagcctttggaccaaatgaggaagcacaagtagagcttgcagacgtagggaaggagatagtaaagaagtgtcagggagtacctcttgctgcaaaagcactaggaggtcttttacgcttcaaaagaaacaaaaatgagtggctcaatgttaaggatagcaaacttttggagttaccacacaatgaaaactccataattcctgtcctgagattaagttacttgaacttaccaattgagcacagacaatgtttttcttattgtgcaatatttcccaaagatgaaagaataggaaagcaatatttaatagaactttggatggctaatggattcatttcatctaatgaaaaattagatgttgaagatgttggtgatgatgtatggaatgaattatattggagatcattttttcaggatattgagacagatgaatttggcaaagttacaagtttcaagatgcatgatcttgttcatgatcttgcagaatctattacagaagatgtttgctgcattacagaagaaaatcgtgtaactactttgcatgaaagaatactccatctatcagatcataggtccatgcgaaatgtagatgaggaatccactagttcagcgcagttgcatctagtcaaatctttgaggacctatatattgccagatctctatggtgaccaactttcgcctcatgctgatgtgttgaaatgtaattctttgcgggtacttgattttgtaaaaagagaaacattgtcatcttctataggtcttttaaaacatctaaggtacttgaatctctctgggagtggttttgaaattcttccagaatcactatgtaaattgtggaatttgcaaatattgaaattagatcgttgcattcatctcaaaatgttgcctaacaatttgatatgcttaaaagatctaaagcaattgtcttttaatgattgcccaaaactatcaaacttgcctcctcatataggtatgctgacttccctaaagattttaaccaagttcattgttggcaaagaaaaaggattcagtttggaagaactgggaccattgaagcttaaaagagatcttgacatcaagcatctaggaaatgtaaaaagtgtaatggatgccaaagaagccaatatgtcaagtaagcagttgaataagttgtggttatcatgggaaagaaatgaagactctgaattgcaagaaaatgttgaggggattcttgaagtgcttcaacctgatacccaacaacttcggaaattagaggtggaaggatataaaggtgcccgtttcccacaatggatgtctagtccttctctcaaacatttatcaattttaatacttatgaattgcgaaaactgtgtacaacttccaccattagggaaattgccttctctaaagattctaagagcatcacacatgaataatgtagaatacctctatgatgaggaatccagcaatggggaagtagttttcagggccctagaagatctgaccttccgtggtctgccaaagtttaaaaggttatcaagggaggagggcaaaatcatgttcccaagcctttccatacttgaaattgatgaatgtttttctcgcctttggaaattgtggctttccaattgcagagatgtgggagatttgcaagctttacaagatatgacgtccctcaaggtcttaagattaaagaatctaccgaagctagaatcattgcctgactgctttggaaaccttcccttgctttgtgatttgagtattttttactgttccaagttgacttgtcttccattgagcctgagacttaccaatttgcaacaattgactatttttggttgtcatccgaagttagaaaagcgttgtgagaaagaaacaggagacgactggctaaacatagctcacattccccatatatctgtgggctataaacattatgatcatatttccgattaa

SEQ ID NO: 111599 - DNA, 1203 bp, Glycine max
  Peptide Sequence Number=SeqID_228377
atggtcaagagacagaaccaaacccaaaccacccaagttgaccctgacttcaagaacaacccatcatccgcttcatctgaggatgttcttggcattactgtgaagttgtctgtagagaccattgctcaagctattagttgtaagcgtagaagcaccaagttcatgaacagttggtggaatgaacttaaagaccacattgggcttaaaggacttcttgtccaatgcccacaagttccttttgtaccacttgatggaggacactaccttttgtccaatacccaggtggatgattccattctttctgaacttcaccagaagtttggactcaacactgggcaagatgaccaactggatgcggtgtgggagaaagcaactaaggaagaagatagggtggacgtagacacctctcaagctgagaagagaaccaaaaagaagatgaatgcaaattcatccaaggttgcttctgcaccacaacgtccaccgcccactttggttgctcccaagggaacagatgggtttgagttcagaaaaaggaaagttgcaccaccttcgattgagaacaatgtgactcaagtgaagaaggttaaaccaactccaaagacctcaacagtcagtcagcttgaaataagcttaagaagaataaaggttattcacctcaggaagaggaaagtcactgagtccaatgttgatatggacaatgaagttccacaccaagcacctctatcacccatccaccttgatcgcttcgaacatcaaggaccacctgtcatcgaccctagcctcaatgccgaagacattgcaaggttatttgttcttgtggattttctctctgagaatgcttacaatattaaaaaaaagactggatgcgaaattccaaccttcaatcgattggatggattgaagtccttcctccaccaacttggaagtgcattcatcctaagagaagtagtcaactatgacaaagacatcattggatggtgtcaaaagattgatgctcaacatattgacccatcttctaatgatttattgccattgttcatgtgtccaaagcatattcaactctacactccttcccagattgcaatgaggttgcctccattggacctcaggaaaaagaaaggcaaggtgcctcctcataccaagccaatgcctcaccttggtcccaaaggcaacactgccctatgtccaactccctatgattga

SEQ ID NO: 111600 - DNA, 792 bp, Glycine max
  Peptide Sequence Number=SeqID_228378
atgtcttctgattttaactgtaagcttaaggggcatgaggtcttgaaggaactacctcttgagattgtaaaactctatgaagagatagaaaccctcagagataaactaggaaaatttgttggtgaccatgaagcccttaacaaaattattaaggataaacttggaaagtttgactccaaatgtcattctggaatcttacttagatactctaaatcgtccaaggcatatagagtggaagagaccattcatcttgtgtccaacacattagtggatgatcaacctgaagaagctagagaaccaactgaacatttgttgaggaaacatcatctagagtcccggatcattggtgatccaaaggacaaagtccaaactaggaactctctcaagcatacaacattactctcagggactgagccaaaacacatagatgatgctatgtctgatgaacacttggtcaaagcaatggaagaagagctagagcagtttcagaagaacgatgtttggaagcttttagaactccccaaaggaaatactaatgttggagcaaagtgggtgttcaaaaacaagctagacgagacagccttgtatggtctaaagcaagctcctcgagcttggtatgaaaagttaagttcctttttaactaaaaatggttttataagtgggaaggtagatactactttgtttcgcaaagattatggaagtcaattcctaatcatccagctatatgtggacaatatcatattcgatgctactaatgactctttgtgcgaggatttttccaagcttatgtag

SEQ ID NO: 111601 - DNA, 114 bp, Glycine max
  Peptide Sequence Number=SeqID_228379
atggagccatacactcataattttgttataataagagcaatcaagaatcttgagtcaatgactcttgaagagctcattaggattcttaaagtccatgagcaagagctagcttaa

SEQ ID NO: 111602 - DNA, 249 bp, Glycine max
  Peptide Sequence Number=SeqID_228380
atggttatgtcaggagttaggggtatgaccttatactcaatgagaaaatatcctctaacatctattcatgtgtatcgaccaaaccatcattcggggattgtcgcaacctacccttcggcgggagggcgacgcgtgactcgcgggatgcgtgttccacgaaaggaatacgcgcggagtcgccaccaacgtttatttgaggaaaacgtcggaaaaaccggaaaagacgtgatctacaaattttttaagtga

SEQ ID NO: 111603 - DNA, 336 bp, Glycine max
  Peptide Sequence Number=SeqID_228381
atgtgttcctatggagcggtaaaggtgctggtggcggtgctgaagagagggacagtgacggtgaaggagaacgagtcgtgcgtgttgttcggttatcgcaaaatagggaggaagaaaggcagcgatgatagggagggcacatgctatacattcttcttattacttggaacaagtgtccgcaaaactcttgcacccatttttgacgtgttcttagaggttgttgatgttgaagcttctaagcctattacagtagtgtacaaccgaatacgttcttcaaataaaagaaagaaggataaagggaaggtagtggttgttcctttaaaaattaccttttag

SEQ ID NO: 111604 - DNA, 267 bp, Glycine max
  Peptide Sequence Number=SeqID_228382
atgccagctcgatctcgcgatgcactttgccaggagttcatgatgaagcatgagtatgagagcctcaaagaagaagacaaggcatggggtaagaaactgaatttcattgctgaccaggatattgttgattattactggatgattgtgttcattccctccatgattgttttcgtgctctccgttgtgtatctcattgctggtagaagctcacagactgtaatagttgctcctataagtaggacacattggctattctatatcaactga

SEQ ID NO: 111605 - DNA, 174 bp, Glycine max
  Peptide Sequence Number=SeqID_228383
atgaagaaaaagaataccgaaagtagacgagatgaagatgaaaacatacaaagcaagaatggacccctaaggggtgctaaaccttttttcctcagcccttcacgccattttattgcaaaaatgagggtggttgccgcccaactcgcccaggcgagcttggtagcttccacctaa

SEQ ID NO: 111606 - DNA, 231 bp, Glycine max
  Peptide Sequence Number=SeqID_228384
atgggtaagggaaggagatggaaactcaaggttctttcatgcaatggtaaatgggtatgggaggataatctgagtagggtgaagcatgaggtagaagagataaaagaagcagtgtgggactatgatggagataaatgcctgagattggatggatacaacttcacctttgtgaaaacaaattggcacattctccatgaggacttcacaaaagtggtgcaagagtttcattaa

SEQ ID NO: 111607 - DNA, 615 bp, Glycine max
  Peptide Sequence Number=SeqID_228385
atgggaggaaggttcatgcttaatggggtcatggtggcaaatgaagtaacagatgagtggattagaggttgtgtggagtcggcatcaatttcggtgcttgttaatgggagccctatggaagaatttggcatgcaaaggggattgagaaaaggtggtcctctagcacctcttttattcctttgtgtggcagaggtacttgcgagacttatgagggaagcagaggaaaaacggttgataaaaggtgttaagggagttctctgggggaaaggggaggaaggtgggaagattacttggttgaaatgggataagttctgctgtccaaatatggggagtccaatagaaaaggggaggggtactggtgttgggagttacctaggaggagagaaagatttgaatgggaaaaggagatggagaataaattacttgaagatgccttatgactatgaaagaaatgcttttggacagaatccaaacaaaaaggaacttgctaaagagaaaagtggcacgaccaaacaacaactatttgtgccccttgtgctctcagcatttggaaagtgtacaacatctcttcctcggttgcactttttcacaggaagtgtggtctttgtgttttag

SEQ ID NO: 111608 - DNA, 243 bp, Glycine max
  Peptide Sequence Number=SeqID_228386
atggctaagatgttgctgtttggcttgagcattttgagtccaaggcttttgaacaacaagaagctgcacaaaatggtactcaagccagatacatcaattgctagcaaagaccacttaaggtatggtgaaactgtccttggccatatggatctggaagtatcttttaaagacattttctacatcggttttttcagaaccgatatagaaaatccttcaaaacacacaattcaacatcggttttga

SEQ ID NO: 111609 - DNA, 516 bp, Glycine max
  Peptide Sequence Number=SeqID_228387
atggtgtcgtttgcgcttttgcatttgggggtaatgggaagcgttctgacagtgttaacgacgacgctacggaggtcgaaagtcacgatggcaccgcatatggaggccaaaatcatggcactgtcacatttggaggtcggaaatcacggcggcaacgcttcacggagatttttttatttgacagagattgtgttggcatctatagttggggtttttgaggctcatgcagctactgcttgtgatgggaataggcttgggcagtttccccctggaaatctatttgttacggtgaatgaagggttatgggataacggggcagtgtgtggaaggagatacaaaataagttgtgtgagtggaaacaataggccatgcaaaggtggtagcattaatgtaaaagtggtagattcttgttcaaggtcaccatgtcccaacaccctcctcatgtcaaaagatgcatttgtagctatttcacacttccctcatgctaaaatcaatattgaatatacccggatatga

SEQ ID NO: 111610 - DNA, 1458 bp, Glycine max
  Peptide Sequence Number=SeqID_228388
atggctcccattcctgccctggaagcatcagtttctattacaaatggggcggagaagtctggtagagctaaaataggggcttggcataaagcttccttcagtttggtgaatgctttgtctgcctccgggaatcccgagagcccaaggaatccgcgcaggtttcgcactgatcgtggtggtggccattgttgcaccgcggtgaccttttctggaactggttctactccacgtgcggaaaccatgtctgcgcaggtgctccagatgatcagggaaggtcttattatagaccagaatatcataaaaaaatacgatgaggaatttccgcaagtaaggtccaaaaatggtgttcatagtttcttgaaaggaagaaggggcgttgcaaagcccaaacgacattaccagaaactcgtaatggctgtggtggtcaacacagaagcgccatgtcccgtccctcttcttgacgaggagtactggggaggagaagggacttgtaatggggcggatgatgccattctgaagcattgtattgacttgagattcgatttcttgcttctggaagtggggatatcgggttgggaattagctgataatgacaaggatagtgggttgggtacttggtggggttatgggagacgacagagctggggagggctgatggccgttaatagtgtttcagatgagcctttcaactcaatcaatctgccattatgcatgaacttcatgacaaggaagaacatgcaggtcaacggagaaattgattccctaaatgtggactgcaacattcgaacaaacttgggagcactctactgtgttgccattgccgacaagcacacgaagggatcgagtggcctgataaggcatgaaggcttatttgggcctggggcggatcgagcgggtcctggtgggtcagggttgtctatattagggttgggagtgttatctgctgggtcttcatctgcgagaagaagcagaaatcgcgaggggcagcgatggcctcttgtgaatttctcgttgcaatggaaacatagcccgcattctcggcggctagctatttcttccggggttaagcatctgatgggtaaaggtggtggtttggtcggagaaggaagtaatgggagattgagtgtgggcgatactaccgagagggggtgtgtacgagcattagcggctggagggcctgaacttcgcgacagacgtcaggaatccggaccaggtggaaagctgatggtttcgggccatccattgaaacaacgcgagggctggaccatccatgtagaaggacgtgatcgtgagcctctcggcctcaggggtgtggctgaggaagatgatggtgagggggtagggttagctgtgttctcaaggtttgtgaccgcggttaataagttcatcaagtttttcagtcatggagctctctcaatgaaagcaccagttgttatgaattggcactgggaaatctag

SEQ ID NO: 111611 - DNA, 690 bp, Glycine max
  Peptide Sequence Number=SeqID_228389
atgtcaacagtgcaccctcaagaactgagtagacccacttcttatgatcaatcaactacttcaccattagttccattttcttcacctaaccctcaaaggcaatcaaagtcatcactttcattgccgacacctgcacttcataagcctgcaactgcaattgctcctttgacttggccagtatctactcaaatagcaacaactcactcagttgcaactccacctccatcaatacctattgacatcattaactgcaccttggttgggaagacactgaaccagatacataacacaactttttgcaaaaaacttgtcctttggcattccaatggtgttgctcgcattatccttggttgtggagatgtagataagaggaaaatcaaaggagcagttggtgttgcaattgcatgcttgtcaagtgttgctgccggtaatgtaggtgtgacgttacttccttgcagggaccatctatttatcctagctataaaggcgtgtacagaaggctttcatgagtctgtgttcaaactccaagagaatatcagccatcaccagcaggatttttgcaatagtggctatgcttctgtggagcaccatgaaagagtactcagaatgctaaattttgggaggttaaatgtttcttctaagccagtcaagtggtacaccatgccaaagaagttctgcataactggttga

SEQ ID NO: 111612 - DNA, 1677 bp, Glycine max
  Peptide Sequence Number=SeqID_228390
atggcacaggcggtccaaactccagagcagccagtttaccttgcacgtctaatgaaatatgattacacaatccattactgtgtcggcaaacacaatttggcggcagatgctctgtcgcgcctacctgattcccctcaaaacctacctgacaccacacagggccaagaactcaaaatggagctgaccgccaatgacgaatttagggccaaaaggaaacagattcaagaggaaccagagaagcattctgactacatcatcagggatgagttgatactccaacatgatcatatttggctaccacgagaccttcacttacttccgacaatcctagcagaattccactccacccccactgggggtcacatgaggattatgaagacaatggcacgtattcatgaaaatttcacctgggcatcaatgaagcaggacatccagtgctacatcaccaactgcatcacctatcaacaaattaaaacagaccatcgtcacccacctgggctcttgtgtcctcttccgattccagcaaggccatgggaggacctctccttgaattttatcatgggcctaccctcttatcacgaaaaattggtcatactagtgattgttgaccgtttctcaaaggggattcatctgggatccctacctcaacaccacacagctttcagtgtcgcacaattgttcatggagatttccggcaagctccacggcatgcctcgcagcctggtatctgacaaagaccccttatttctcagtcgtttttggcaagagctattcaagatgagtggcaccaagctccgtatgagctcagcataccacccacagtctgacggccaaacagagtccatgaaccggaatctagctacatgggggcgcttcttagtctgggcagagtggtcatataatacatcagtccactccgccacagggttgacaccatacgaggttacctttggtaaacaaccaccaagcctaccacagtatctcgccagaaatttgaatgtccaagctgttgatgaatggttgacacaacgagaaacaataattgcgagtcttatcaaaaagttaaccaaggctcaacaaaggatgaaggagatcacggataaacggcgccgagatgttagctatgaagaaggagatactgtgttagtcaaactgctaccacgccggcaaacgtcagtcataggagaagcatatttgaaactcacaaagagatattatgggccatttcaaattgttaagaaaattggtagtgtagcttatcagttgaacttgccgtcaagctccagaatttacccggtatttcactgttcattactcaagccatatcactcttccaacacagaagttccacttgacttgccagcttcctcagaaggcaatgaacctcttataacccctctcgcgattctagacactaagtgggaaaacacaccgaccggcagacaattgctcattctagttcaatggacaggattagttcctgaggacacctcatgggagaaatgggaaccccttaagagagattacaaccttgaggacaaggttgttttagaagctggcaggaatgttatgaacccaaagctaacacgaagaacagagcaattcaaaggaaaagaagcaggggcaaaaaggagaattagcagaccaaaatacttggatgattacatggcaaaatga

SEQ ID NO: 111613 - DNA, 447 bp, Glycine max
  Peptide Sequence Number=SeqID_228391
atgaacaaagctaaaaaaatataccgccttagggaactcaatttcatcggagcacttgaacttttccatttgatcatctttaatcaaagttattatagaagggagtatgatgatctatcaaaaaggatggtccattatgccaaaggaattccattagttgttaaagttttggctcgtcgtctttgtggaaaaagtaaggaagtatgggaaagtgaacttgacaagcttaaaaaaatgcctccaacaaaagtttatgatgttatgaaactgagttatgatgatcttgatcgtacagagcgacaaatgtttctcgatcttagtttgttcatcaagaatctagcaaagaccttggaagttgtcgttggttgcaggatgctgatgacatttgtgaagtattttaaggcaacaagggtaatgagggcattagaagcttacaaattgacctga

SEQ ID NO: 111614 - DNA, 186 bp, Glycine max
  Peptide Sequence Number=SeqID_228392
atggtggctatgaagtcatcagcaattgctaagttggaaaagagacacaaggagcacattgcagcttacggagaaggcaacgaacatcgtttgactggacaacacgagatagctgacatgaacacctttgtatgggatgttctacaagcaacacgaatgcaattggattcgaaggttagtaattga

SEQ ID NO: 111615 - DNA, 903 bp, Glycine max
  Peptide Sequence Number=SeqID_228393
atgacaacatattcaaataataagagacagtacataaccctcaaagctctaagccaccttgcaagcaaaagaggttgtccaatgttgaaggaaattctctcatgtcaagggagattttctgatgtcgaggttaatagccttgttaacgtgttcgccaccgttgccacatccttgttgagtgccagtgtggaggccactaatgctattgtgatgccgcctcctcctacttcggctccatcgattccactttcttccgtgttggcggcgacactaccttccttgtcatctcatcccatgtctccttgtatcacctgtactcctccaacgaagctgattcactatggggcgcgcgtgtcaggctcttgcatgcatgtcactcgtgaagcagcgcgtactggaaatgcggtgtcgtgcttttgcatacgtgtcactcgtggagtggcatgtactgaagatgtggtggtgtgctcttgcatatgtaatactcatggaatggtatgtaccaacgatacgatggcgtgctcttacatacatctcactcatggaacaacacttactggagacgtggtagcatgctcttgcatacgtctcactcgtggagtggcatgtactagaaacatgagactcaccaaggatggactttgggtttacgagcctagcacatgtgccatgctcttgcatgcctgtaactcatggagtggcacaggctcaccaagggcagaccttgggtttgatgaacctagcacatgtgtcatgctcttgcatacctgtcactcgtggagtggcacgtactggattcatggtgcgtttggagaattgaccagggaattgtccgtcttgggttttggagagacttaccaaagttggaccttggatttgatgagcctagcgcacatttcgtaa

SEQ ID NO: 111616 - DNA, 327 bp, Glycine max
  Peptide Sequence Number=SeqID_228394
atggctctttattctgtttcagcactgctcgttgctaccacgttctgtgttttggctttggtaaccaagttaccccatacaagaggaaaatcagaatatcccagtcaaaagattcttagagagcctgaaagtgagcctcaaattaggcaaaatattccactaggagtgataggtgccattgttgatcctgcgttcattgttgtttccaaaagtgctcctgtgctcattgctggaaagtcaattgtcctgaagcctccaactcagaagtctttcatttataccaacaggctaatagagagcacatcaaaaactaaagcctacttttaa

SEQ ID NO: 111617 - DNA, 597 bp, Glycine max
  Peptide Sequence Number=SeqID_228395
atggacttgagttgtggtttggggtgtgtgcagccttgggaagaccaaaaggagttgttttatgaccaaatgcctgaggcacgggctattgtagttattgctggtttatatgttgtgctttgggatggtgatggaggttcctcagtccagctttatgccaaggaatgtagtaagctcctcctacatgttcttaaaagaggacctagtaaaaaggatgatgaagtggtgacaagcataggtgatgagaaagagaattatgatgtagtgaggcagggattggagaaggaagatgacatactgagggagcagattggtgtacatggaactgagaaatccattgatagttgtgaccagcggttcgttgcctgtttctccaatgcgcctgattcaaggctgaatattagttcaggagaagaagactctaacatccctatcaactgcaaagtagacagctaccactgtcagttgataattatggagatatctgtggttgtgtttggcatagtatggggtgtcagtggtgcattagttaaggctgagttcaacaatggtggcaatgttgctaagttatggtttgcttgcatggtcgagctatag

SEQ ID NO: 111618 - DNA, 273 bp, Glycine max
  Peptide Sequence Number=SeqID_228396
atggcagcttatcttcttctggattcttcctcgcgcttagccactgaaggcagcaacaacgagcttaaactccagagagaagaaagagaccagtcacgaatggaaggcatgattctgaaagacgaattgaagacttgtttgatgtccaaaaggagtttgtctcagcagctgagcgagaccaaagcaaacatgttagccatcatcggaaagcacaaagaagaactgggtttggcaacgacccatgagcataaggtggcggatgagtacgcctaa

SEQ ID NO: 111619 - DNA, 943 bp, Glycine max
  Peptide Sequence Number=SeqID_228397
aagaaagctgaggcctagtggagtagtgggcggtgcacgcaccctcgtgtcaatattcgctgcaattcttctcctattccaaccaaattgcatcgctaagcaacagcaccaaccatgccctccttcatcctgcggcataattggcaacatatcgttcccatttcgcctcaaagacgacccaagccactgcggcgacacaaggtaccagttagattgcgtgaataacgcgacgctgttaaccttgttctcgggaaaataccatgtacaagatatcgattacaagagatacaaaatcaaggttagtgacgcgggtgcagtggaggactcaaattgtttcatccctcgcaatttcttatgggatggtaatttcaggcccacgggcctggtcggcccagatgattttggatcacagccgtttgttttggaccttgatttcaccagaattgggtacttcaactgcgccaatccagtcactggcgatcctagatatgttaaggtggacactactcacactagtcgatgtgcgacccaaggacaagggcatgtctatgctcttttggaaccatcgtatcttgagtatcgtgtgaaggacatcacggttgggtgcgatcttatggtggctaccttggcaaattggagtctttcggaggcggaaaaggggaatttcacctacgatgagatccataaaagaataattgaagggtttcagctgtcgtggttgccggttatttgcgagaatcgatgtggaaagggaaccaagtgtgttatcaatgaatccaacggagaagtgcagtgtgatagacatttctgtcattacgcctaccatacgaccgataagtgcggtatgaacggctcactgacggtgacgcttagacatggcaagaaaacccgtacccgtgggtacccacccgaatccgtcccgactttgacgggtaatacctga

SEQ ID NO: 111620 - DNA, 1305 bp, Glycine max
  Peptide Sequence Number=SeqID_228398
atgacatgtttctatacttacacaaaacctttgcaacaattttggggctatactcgagcttatcttagaggtattatttttggaataggcagcagaataacattcagtacaaaacagttggacaacgcagttggactgcaatatttcgatggaggaatattcgtaggacgaaatgttataccaatttttctggctgccagatatctgattggagttgtacttctatttgtgttattgatctacaaatggcgacggagacatttgtcaatatatgaaaatatcgaaaatttcttgctggatagcaatctaaatcccattagatacggatacaaagaaatcaagaaaatgactggaggtttcaaagtgaaattgggtcaagggggctttggctctgtatacaaaggaaaactccgaagtgggttagatgtagctgtcaagatattgaccaaatccaatgataatggacaagattttatcaatgaagtagctaccattggaacaatacaccatgtaaatgtggtgcgacttattggatattgtgttgaaggaaaaaagcgtggtctagtttatgaattcatgcctaatgggtcattggataaatacattttctctaaagaaaaaggtatccctttaagccatgagaaaatatatgaaatatctctcggaatagcaggtgggattgcatatttgcatgaaggttgtgatatgcaaattctacattttgatatcaagcctcacaatattcttttagatgtcaattttgttccaaaggtttcagattttggacttgcgaagctacatgctgaaaatgacggcgttgtcaatttgactgcagcaagaggaactttgggttatatggctccagaattgttttacaaaaatattggaggagtgtcttataaggctgatgtctatagctttggaatgcttttgatggaaatggcgagtaggagaaggaactcaaatcctcatgcagaacattcaagccaacattacttccccttttggatttatgatcaatttaaagaagagaaaaatattaacatgaacgatgcttctgaagaggacaacattctatctaaaaagatgttcatggttgcactttggtgtattcagttaaatccaagtgatcgtccttcaatgagtagggtagtggagatgcttgaagggaagattgaaagccttgaattgcctccaaggccttcttttcataaaaatcaaacatatgtacatgatgatgatgatatcgtctctgaccaaacatcattcactaattccacttattctgatagttatcttggttaa

SEQ ID NO: 111621 - DNA, 188 bp, Glycine max
  Peptide Sequence Number=SeqID_228399
ttgcttgtgcacgacagggtgacctcgacagttactgcctagttttcctaagtgagagtgtcatgtggaaacgcttaggctatttccttggggatgtgatgatcgtgaacccttattcgtgggagcagaatgacaacagtagaatacatgaagtgagattcttttgtggagccgccgagccgatgtga

SEQ ID NO: 111622 - DNA, 378 bp, Glycine max
  Peptide Sequence Number=SeqID_228400
atgtcaaatagaaagtatgaatctggttatgaaaaattgaagaaaaaacgaaaagttgaaaagctaattgaatctcaacgtggtgcccttgataaatttattattattcataaaaatgacgcagaagcaagttcaataggtgaaaatgtgatagaacaaccactgatagatcatactgacaatgaggaaaatgttatagaacaaccacctatagataatactgacaacggtgtagaacaaccacctagagatgatactaacaatggtgaaaacatgatagaacaaccacctataaataatactgacaacacaaatagtcataatttcaatctagaactagaagactattttagaaataggagtagaagggaatgttga

SEQ ID NO: 111623 - DNA, 270 bp, Glycine max
  Peptide Sequence Number=SeqID_228401
atggaaaccatatcgaaacgctttgagcaactcgatgtttgtggcaaagtacatttgaagtcaaagctacgagaaattgcttatcctgatatgaactccatgtgtcctcctccagaaaaggggaagaccaaggcggatgctaactgtggtcaccaggcaatagctgcgttattgggggtgtgggtagataaggatctagcttctcaaagaagcatcttgagaaagcttctcaaagaagccactaggaagcttcttgaggaagcctcttaa

SEQ ID NO: 111624 - DNA, 963 bp, Glycine max
  Peptide Sequence Number=SeqID_228402
ggagaggcgcgttcagctcatagaggataagtactcagacttccaagaggagatagcacacaggcattggacacctctagtgactcccatggccaagttcaaccctgagatagtcctagagttctacgctaatgcctggcccacggaggagggagacgaccatcggtgcaaattcagccaaaggagggaccaagcctctagctttgacgaggaggtcatcgcccagctattgtgcataccgaggcaagactttgcccagactgctgcggggaggcgggtgtggattatgcgcaccagcatgactactctaactcagataaggatgacgctgctactcagcaacatcctgcccagcggccataattttgacctccctcttcctaagtgccagatggtgtacaccatcctgacactgatgactgttcacgtggcccagataattgctgacgccatttatttgtttgcagggacggcgcccactaggcaccctttggacccagagaggtccaacagggccttgggattttcggccttgatcacgggcctttgccagttctacggggtacttgtcatccccagcaaggtaatccagccgccgatcactcgagttttcatcgagaaacattgcacccctaggcaagcgaagggtgacacacaacaggctgcggatgcaccaccacctcagcagcccgatccggttataccactgagtgtggagcagtatctacggcatatggttcgccagcaaacggccaacaaccgcgtgcaggggcagggctcccctccttttgtacgccctaccccagagcaattcaaggctaaggtcgcgtggcctggagattggcccactgaggagggaaccggacccgcaggatccccgggcgaagcggaggaagcccacatggatgaggatatgaccgacctgcttggttacctgggagagggcggagctacacgaccaag

SEQ ID NO: 111625 - DNA, 231 bp, Glycine max
  Peptide Sequence Number=SeqID_228403
atggtcattacacaagcgttatgcaacagatatactaagactcaatcatatatgcaatgtggtatcatgtcagtgaaaaacctcgtcgggcccctaggagtacatgataagacaaatcacatactgttaggtcaagccactctcactagaatgctccaactatgtgggatcagcacagacttaaaggagcactcaaaccgggtgtatttacccccaatggttagactctga

SEQ ID NO: 111626 - DNA, 699 bp, Glycine max
  Peptide Sequence Number=SeqID_228404
atggtaaaaaaggccaacaacaaatggcaaatatgcatcgactatactaatcttaacaaggcatgccccaaagatgcataccatctgctcaacattgataggctagtcgatggagcattcaggttccaggtgctaagcttcctagaagcttactatggatataaccagatcaagatatacgcttcaaacgaggagaaaaaggaattcatcactaaatatgccaacttctactacaaggtcatgccctttggccttaaaaatgcaggcactacatactatagatggatcgaccgaattatcaagcagcagtctcatagcatagcccaacacgtggcaaacttgggagaagactttggagagctctgtaaatacaacatgtgccttaactcggaaaaatgcactttcaaggtcgacggaggcaagttcctgggcttcatgatcacacatcggggaatagaaaccaacctcaacaaatgcattgctatcttggagatgcaaagtcctactaatgtccaggaagtccaaaagctgaatggaacactagcatcctcatccaagtttctccctaagcttgctgaaaaagaaaagtcgttatataaattgattaagaaaaccaagccattcttatgggacaaaacctgtgaacaagccttcttagccttcaagaagaccattaggttttgcgaaagcctaaactag

SEQ ID NO: 111627 - DNA, 234 bp, Glycine max
  Peptide Sequence Number=SeqID_228405
atggctggtcaggtccctgttgagttgcttgcactacccaagtttgggtccaagatacagcttgacgagctcttcaataggctttcatcgtttaagcttgtttggcttggcaagctccctggtgggaagatagggtgccacttttacgctttctacatagcactgtggtgcctacttttgatctgttgtgactgtcacgatctctcctgtcaaggtgggcaacttcatatttag

SEQ ID NO: 111628 - DNA, 474 bp, Glycine max
  Peptide Sequence Number=SeqID_228406
atggcgtatgggaggccatacctgcatatgaggtatttccaagtgaacttcacctcattggtcataatttttcgcagtggtcttgcctcgatccacttggtgaagaaaaagggagctcagactgcggagattgttaggaggggtgtgtggagtgtctgcaaacttttggcatcgtcttcatgtctttgtgaagtcaagggcatgagtttggagcatctcctggatgatagtctggaggtgtctggtctttttggtgttggccaacttggagagcaagtatgctcttgtgctactttccccgagtatgaagtacatctcaaagcattcgaaattttcaataagagttttggcaatatggtagtacttgagcagcactgtctccttggtgacattgtcaaggccttcaaggatgattccttccctgcttcccttaatgttggacatgccgtcaatgtagatgctccaccagtctag

SEQ ID NO: 111629 - DNA, 1734 bp, Glycine max
  Peptide Sequence Number=SeqID_228407
atgaaacaagagccactggcatcaccaacgacatcgtcactaccacaaccaacaataacaacaaaaaatgtgatcaagattcagaacagtttgactccatcacggttaagacttccttccaagtacagagagcctccaaagactccaccagaggttgtcaacaatgggatggtgtcaacgccattgaggagagccaagtccgtaactccagagttgaagcacaattcaaggatcaaaaagggtcttgtgctgaacaaggccaaacccaatgaagaggttttgggaacaacgcaaaggggtagggaagttgaagaggctaaggttgtttctcgtttcgttaggcctcatgctgtggaacagttttcaaggccaagaagtggagttggagattttgcttttaagagggataaggaggaccctgatgggaagagtaagaaggaattgatggagaagctcgaggcgagtgagagtttgataaagaatctgcagtctgaagtgctggctctgaaggctgaattggagaaagttaagggcttgaatgtggagcttgagtctaacaacaggaaactcactgaggatcttgctgctgctgaagcaaaggtggtgtctttgagtggcaatgagaaggagccaaatggagaacatcagagccccaagtttaaactcattcagaaactcattgctgacaaattagaaaggtccatagtgaaaaaggaatccattactaatggaggctttgttaaagcatcaattccagcacaaactgcaattcctgaggtcacaactacgaggacaggaagaaaacctacatgcaactcgtgcctgccaccacctccaccaccgatgccaccatcaatcccttctaggcctatagcaaaagcgaataacactcaaagggccccagcatttgtgaaattatttcacacattaaagaatcaagaagggatgaaaagcacaacggggtcaggtaaacagcagagaccagtagctgtcaatgtacacagcagcattgttggagaaattcaaaaccgttctgctcatcttttagcaataagggcagacattgaaactaaaggagagtttattaatgaccttataaaaaaggtggtagaagcggcctacacagatatcgaagatgtcttaaattttgttaattggcttgatggtgaactctcatcattggctgatgagcgtgcagtcttgaagcattttaattggcccgagaggaaagctgatgccatacgtgaagctgcagttgagtatcgcgaacttaaatcattagagcaagagatttcctccttcaaggatgacccagaaattccatgtggagcttccttgagaaagatggctagcctattagacaagtctgagagcagcatacagaggctaatcaagttgcgaaattctgcaatgcgttcataccaagagtacaaaattccaactgcttggatgcttgattcaggaatcatgaccaagataaagcaggcttctatgactctggtcaagatgtatatgaaaagagtgacaatggagcttggatcagctcggaactcagacagacagtctagccaagaatcccttcttctccagggcatgcattttgcatatagagctcatcagtttgctggtggtctagatgcagaaactttgtgtgcttttgaagagataaggcaacatgtaccagcacacttggcaggttctcgggaacttttggctggcatagcatcatcatga

SEQ ID NO: 111630 - DNA, 502 bp, Glycine max
  Peptide Sequence Number=SeqID_228408
atggagcaacgatatgaggaggagctcagaaagttgaaggctgaccatgatcagttggacgctcgtgttagacgtccccagggcgacgagcattccacttacacattgcctaagtgcacccaaggggactcacagtcaacactcaagatgatccaagtctctcccacaagcaccatcctgcaggttgacatacccctgggttggaaaccactcaacctcgagagatacgatgagaccatcgatctagatgaacatcaggatgttttcctgacccaggcaaatctatacaccaatgacaatgcaatcctgcgtcatgtcttcctaacctccataaaagaggcgacattgatctcgtacggtggacttcctccaaggtccatcgacaacttcgacactctttcgagaattctatcggagcaatcggaggaaaaacttgagaaatctcagggaaccgctatagatgccgctatcgttgtcggaagacacgtgagtccgcttagag

SEQ ID NO: 111631 - DNA, 277 bp, Glycine max
  Peptide Sequence Number=SeqID_228409
ttgtcagttctacagagtgcctgtcgcccccagcaagttcatcaggccccgtattaattgggctttcatcaagaagtactgcgcccccaggcaggcgcagggcgagacaccacagcagcctagggatggccggcagtgggcaacaaacgcactgccaccacctctagagttcacctcagctcatccacaaacagtcataaggcgtccagctcaagacgttaaagaagcgctactaggaggcaacctagtaccttttaaatctctgcttgttatttga

SEQ ID NO: 111632 - DNA, 216 bp, Glycine max
  Peptide Sequence Number=SeqID_228410
gtagcttccttgagaagttttcatgagaaaacttccttgagaagctttcttgagaaaacttccttgagaagctttcttgagaaaacttccttgagaagcttctttgagaaaacttccttgagaagcaagaacttagctacacacacccctctcataactaagctcacctccttgagaagcttccttaagaagattcctaaagaagctagagcttag

SEQ ID NO: 111633 - DNA, 1095 bp, Glycine max
  Peptide Sequence Number=SeqID_228411
gcttggaccagatatactgacaatgtggttggaagacacatattagctgagaggaaagtggaaatctatcacatagagttggatgaattcaagggagagctggagaggtgtaactttcataagcgcctcacaaacttagctgatagtagcattaacctcgtgttggtaaaggagttctatgccaacctctacagtcctgaggggccttcacctaaacaagtcagaattcggggccacttaataaggattgatgtagatagcctcaatgaatttctagaaacacttgtggtgcttgctgagggtgaatatttgcctgcctactcaagatactgtaggatgcctactgacactagagaaattgaggctgcactgtgcatacccaaccgagggtttattctaaatgctgaaggtcacccggggaagatcctcagaaaagacctaatcatccttgctcaggtctggagtgttctatcctactccaacttggctccgacctcccacacatcggatctgactatggatcgagctagtctaactcctgctcttatcacaactttatgcaggaccagaggagttgctttcgacagtcttgtctttgaacgtctgagcccgatcattaatttggcctacataaggaagaattgttggaaccctgatgatccaacaattattattaaggggaccagaagaccaagagcaagtccagctgagactccttctacatcaatggctcctcatctagcttctacatcagcagctcctcctccaactcgtattacagcagctccttttaccccacatactgcagattttcaacactccatccctacagtagagcaatttaatgaatgggtagcttggccagggactcaacctcctccacacagggacgatgaggatccagccgctcaggtaccacatcagtcatcggatgagtcatcagagtcttccacccctgagccattgatcaggaagaggaggatagttgtaactcaggaagccgcaaccactcctgaaaagtctcctgaggccactccagagcctctgacaccaatggcagataccacttccccacaactggcagcagatccttaa

SEQ ID NO: 111634 - DNA, 542 bp, Glycine max
  Peptide Sequence Number=SeqID_228412
ggcgcggcggtcgctgcaaaacccagggcgcgagcccgggcggagcggtcgtcggtgcagatcttggtgggacgggggaagcccgtctgatagcgctctgtgcgcgtactccgaaagggaatcggcctgcccaccctggaaacggctcagccggaggtagggtccagcggctggaagagcaccgcacgtcgcgtggtgtccgcctctgggtcgatggaacaatgtatgcaagggaaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactgtgctctgaatgtcaaagtgaagaaattcaaccaagcgcgggtaaacggcgggagtaactatgactctcttaaggtagccaaatgcctcgtcatctaa

SEQ ID NO: 111635 - DNA, 234 bp, Glycine max
  Peptide Sequence Number=SeqID_228413
atgcatagccagcaagtcaccagagacaggcagaggcaacaggtctcagtagacatagagcaagtctcgccagagctggagacagggaggcagcagctctatcccgctgtggtccaccatccatgctatttcactgtgaaagcagtcacgacaactgcaatattgaagcacttcatgatggcatgcactgtagcaacaaggggcctccgtgtccatgccgtgatgggatattga

SEQ ID NO: 111636 - DNA, 402 bp, Glycine max
  Peptide Sequence Number=SeqID_228414
atgcaaactccagtaccctcttttgctgaaacgcagaagctgaggtatggtaaagattatgaatttgatgctccggttaagcttctggaaaaacatctacattctatggcacagtctgttgatgagcagcttgttgttgtttctcaggttcttgtgtctgacatcaatattggatatgaggagatagttaacactcaggttcttgctttcaacgataaacctgtgaagaatctgaagagcttggccaacatagttgagagctgtgatgatgattatctaaagtttgatctggaataccaacagaaggtagtgttgaagactagcactgctaaggccgcaaccttagacatcctcaccacacattgtataccttctgcgatgtctgatgacctgaagacataa

SEQ ID NO: 111637 - DNA, 1149 bp, Glycine max
  Peptide Sequence Number=SeqID_228415
atggcccgaactaagagaaagcgtggccgaaagcccaagaacgcaactgacgaagaaaccgcgtcccaagactacagcaccgcctctaaaaacggcgccaacgagcccagcgacccggattcccaggaaccccgtcgcggccgccccaagaagatcatggtggcgtcgctggagcgctgcagctctcggctggccgattcgaaaggcgattgcacggcggcggtgaaggtggtgccgtcgatggaagcagtggtgaaggtcttctgcgtccacacggaaccgaatttctcgctgccgtggcagcggaagaggcagtatagctcgagcagcagcgggctcatcgttgggggacggagggttctcacaaacgcgcattctgttgagcatcacacacaagtcaaactcaagaaacgcggctctgataccaaatacttggccaccgtcctcgccatcgggaccgagtgtgatatcgcaatgttgacggtgagtgatgatgaattctgggagggagtttcgcctgtggaatttggcgatttgcctgctctgcaagatgctgtaactgttgtgggatatccaattgggggtgacacaatctctgtgacaagtggtgttgtttcacgcatggagatactctcttatgttcatggttcaacggaacttctgggactgcagatagatgctgcgataaattctgggaattctggtggacctgctttcaatgataagggaaaatgcgttgggattgcattccagtctcttaaacatgaagatgtggagaatataggatatgtaatacccaccccagttatcctacattttatccgagactatgaaaagaatggggcatatacaggatttccaatccttggagttgagtggcagaagatggaaaatcctgatttacgaatgtcaatgggcatgggaccagatcaaaaaggtgtgcgtatcagaagaattgaacccactgctccagaatctcatgttctgaagccatctgatgtaattctcagctttgatggggtcaatatttcgaatgatggaacagtgataatacattacatagcagcaacgtttgatctggtaagggaaaatattcaaggtggtggtccaattaggtctgaacctgtcaatacatacatgtatatatag

SEQ ID NO: 111638 - DNA, 3423 bp, Glycine max
  Peptide Sequence Number=SeqID_228416
atgttttctttttcttcttctttttcttcctcttcctcttctcatagcagttcagtgatcaaatggaattctctcgcgcaatttctcttcctcgttttcttcctcttcttcgcgtcgcgaaacgacgccgtttcggacaaatccacgctccttcgcctgaaggcctcgttctccgaccccgccggcgtcctctccacgtggacctccgccggcgccgctgactccggccactgttccttctccggcgtcctatgcgacttgaactctcgagtcgtcgccgtcaacgtcaccggcgccggcggcaaaaaccgaacctcgcacccgtgctcaaatttctcccaattccctctctacggcttcggaattcggcgaacctgttccggtagcaaaggttctctcttcggaaatgtttcttctctgagtttgatcgccgagctcacggagcttagggttttgtctctccccttcaacgcgttggagggtgaaatccccgaagcgatttggggcatggagaacctcgaggttctcgatttagaagggaatttgattagtggctatcttcccttgagagtcgatggcttgaagaatttgagggttttgaatctggggtttaataggattgttggagagatacctagttcaattgggtctcttgagagattggaggttttgaatttggctggtaatgaattgaatggttctgttcccggttttgtagggaggcttagaggggtgtatctgtcttttaatcagttaagtggggttattcccagagagattggggagaattgtgagaagcttgagcatttggatttgtctgtgaattcgatggttggagtgattccggggagtttggggaattgtgggaggttgaagacgctgttgttgtattccaatttgttggaagagggcattccgggtgagctagggagcctcaagagccttgaggtgttggatgtttccaggaacattctcagcagctctgtgccgagggagcttgggaattgcttggagttgagggttctcgtgctgtcaaatctattcgatccacgaggggatgttgctgatagtgatttggggaagttggggtctgtggataatcagttgaattattttgaaggggcaatgccagcggaaattttgttgcttccgaagttgaggatattgtgggctcccatggtgaatttggaaggcggtttacagagaagttggggcggttgtgagagcttggagatggtgaatttggctcagaattttttcagtgggaagtttccaaaccagcttggtgtttgcaagaagctgcattttgttgatttaagcgcgaacaatctcactggggagctttctcaggaacttcgtgttccctgtatgagtgtgtttgatgttagtggcaacatgttatctggttcagttcctgatttctccgacaatgcttgtccccctgttccttcctggaatggcactctgtttgcggatggcgacctatccctgccatatgcatccttttttatgtcaaaggttcgtgagagatcacttttcacatcaatggagggagttggtacttctgttgttcacaactttgggcaaaacagctttactggcattcagtcattgccaatagcacgtgacaggctggggaagaagagcggttacacgtttcttgttggtgaaaataatcttacaggaccttttcctacttttttatttgagaaatgtgatgaattagaagcactgcttttaaacgtcagttataataggatatctggtcagattccttccaattttggtggaatatgcagatcattgaaattcttagatgcatctggaaatgaacttgcaggaccgattccccttgatttagggaatttggtctctcttgtatctctgaacctcagtaggaatcagttacaaggccagattcccaccagccttggccagatgaagaacctgaagtttctttctttggctggtaataggttaaatggtttaattcctaccagcctggggcagttgtactctttgaaagtcttggacctttcgtcaaactctcttactggtgagattcccaaggctattgagaacatgagaaatctgactgatgttttgctcaacaacaacaatctttctggtcacattcctaatggtttggcacatgtcgctacactctcagcattcaatgtgtctttcaacaacttatctggatccttgccttcaaatagtggcttgattaaatgcagcagtgctgttgggaatccgtttctaagtccctgccatggagtttctctgagtgtgccatcagtgaatcaaccagggccacctgatggcaactcgtataatacggcaacagctcaagctaatgacaagaagagtgggaatggcttcagttctattgaaatagcatctataacttctgcttcagccattgtttcggttcttatagccctgattgttctattcttttacactcggaagtggaagccaaggtccagggttgttggttctataagaaaagaagttacagtgtttactgatattggggtcccgttgacgtttgaaacggtagtccaagccacaggaaacttcaatgcaggtaactgtattggcaatggaggttttggcgcaacatacaaggcagagatatcacccggaatcctggtggctgtcaaacgactcgcagttggacgtttccaaggtgttcaacaattccatgctgagatcaagacccttgggaggcttcatcatccaaatctagtcactctgataggttatcatgcttgtgaaacagagatgtttctcatatacaactatttgtcaggtggtaatctggaaaagtttatccaggagaggtcaacaagggctgtggattggaaaattctttacaagatcgcattggacatagcccgtgcacttgcctatctgcatgatacgtgtgttccccgtgttcttcaccgcgatgtcaagcccagcaacatcttgttggatgatgatttcaacgcttatctatctgactttggattggctagacttctggggacttcagagacacatgctacaactggtgtggccggaacattcggttatgttgctcccgaatatgccatgacgtgccgtgtttctgataaggctgatgtgtacagctatggtgtggtgcttctggagttgctctcagacaagaaggcattggacccttcattttcttcttatggaaatggtttcaacatagtggcatgggcatgcatgctactgaagcaaggaagggcaaaggagttcttcactgctgggttatgggaagcaggaccaggagatgatttggtagaagtgcttcacttagcagttgtgtgtactgttgactctctctctaccagacctacaatgaaacaggttgtaagaagacttaagcaacttcaacccccatcatgctag

SEQ ID NO: 111639 - DNA, 174 bp, Glycine max
  Peptide Sequence Number=SeqID_228417
atggagaaatcgctcttagcctcatgcggtggatcggaggtttctgacgaagcagcgacaatggcgatgcataagggttatggaatattttttaaaccatcaaaactgaaaggaatgacacactctgaaaagctggcagtgaaacaaccacattggcatctttttgttgaatag

SEQ ID NO: 111640 - DNA, 405 bp, Glycine max
  Peptide Sequence Number=SeqID_228418
atggtttcaaaaactgcctcagggatgcgacctcgttctttgcgggaccttgatgaagccaagaaagacaaaatccgatgcagtcattgcaatgcgactcgacataaaaaggaaacttgctttgaacttcacagctatcccgaatggttcttggagaagaggaggcaaaagagagctaaaggcaagcgttcaggacaagcaaaactcattgattatgtagctggaattgctgctgtagcaacaagtcaagagtttgtccatccgagagctctcaacttgttgttatcagaacgtgagataggaaggtatcagacgggagataagaagttatcagtggttgcaaatatatttgcaaagatatgggatgaatgtggatggaaaatggaccagattcaaaataactaa

SEQ ID NO: 111641 - DNA, 504 bp, Glycine max
  Peptide Sequence Number=SeqID_228419
atgtctacaaggtgcccaaaaatgaagatatatatggccatgaaactgaaacaaaatttatggcatcaattgattcatgtggccaaacctactcaacccagtaagtgggatatagtagcagagaggttcaatttctatctactgaacctactttgcaaaaataaaacttggggtttgattataacacctctatgcagcagaaaagagtacaacaaagccaatggaaaaggtttatattcagctgaaattacaaacactggaaagaagaaaaacaagacacaagctatctactccttaaaaaataactactccaaagcgcatcagccaaagaaggcttcattaagcctgttggacaaagcaaccttgcggggtgacatgattatacatttgaaagagctgaaaacaaatgcagcacaagctagtgaaggcctaatgataccaaagaacaatgataaaataagagtcgaagaaggaggatttctacattcagttctttatctataa

SEQ ID NO: 111642 - DNA, 309 bp, Glycine max
  Peptide Sequence Number=SeqID_228420
atggtgtcatgcatgcttcaatctcacctatcaatagagttggctcgaatgataaattcacagcaacatggccactctgagcaaagacagtctcgtgaacaaaggcagtctcgtgatgtctggctttggtatgtgcatattctgaaacagctaaatatgtgttgttcatcatcatggaagtcctccaccacatgtgaggcggaagctgatgctgttttggaagctttatcatggattggccagctcaacatgcaacatgttactatagagcttgattgtaaaattgttgtgcgtgggagggtgaagtag

SEQ ID NO: 111643 - DNA, 132 bp, Glycine max
  Peptide Sequence Number=SeqID_228421
atgtcctcatttctaatcttgtgtcccattgatacaaacccagagatagaggttcctgctaatagactttcggttggtaccacttcatcaatagttgttgatcctctgcttgcattgggaaaaattgccaag

SEQ ID NO: 111644 - DNA, 540 bp, Glycine max
  Peptide Sequence Number=SeqID_228422
atctcgctcattgctcagtccaactcctcgaggcttggatttccaacgctcatcattgccttatgcaaggcccgaggagtcacctcagattctctcacttatgagtcactcagcccagccattaatttggcttatattaagaagaattgctggaacctggatgacccttcggtcacttttctaaggacctgcaaatccagggctagaggatctaaggccccatcctcttcagctgcccctgctccccctacttctgctccctctacttctgctctccctttagctctagcagccccagttcttccaggtccctttgctcaaagctcggagcctttcatgtctatgctgcagagcctgcaccagggccagctcctgattatgcagagcttgcaggatgtggtccaacagcgatcggttatgagcatggagatgtttttgcaacaggttgcctggccaagagtcctgccttctcctttgggaaggggtgaggcctccgcagcccaggaacctcagccagaccaggaggatgactcttcttaa

SEQ ID NO: 111645 - DNA, 183 bp, Glycine max
  Peptide Sequence Number=SeqID_228423
atgaaggccgatatggaggccttgaaagatcaaatgacctccatgatagaggccatgttaagcatgaagcgaataatagaaagcaacatggccgcaacagccactgaggcggatccgacccatccctctgccataaaccaagcaaaccaacccatcccggacgtgttgggtcaaggaggagag

SEQ ID NO: 111646 - DNA, 897 bp, Glycine max
  Peptide Sequence Number=SeqID_228424
atggcccacttggagctctcgattccatggcgcggctcaacagagcagccgcaccgtcctacctatttaaactatcctgagggaaacttcggagggaaccagctactagacggttcgattagtctttcgcccctatacccaagtcagacgaacgatttgcacgtatgctctcactcgaacccttcacagaagatcagggtcggtcggcggtgcaacccacaggggggatcccaccaatcagcttccttgcgcctttacgggtttactcgcccgttgactcgcacacatgtcagactccttggtccgtgtttcaaagacgggccgaatggggagcccacaggccgacgccaggagcgcgcaggtgccgaggcacgccaagggcgcgcgctgccatccacaatcgcgatgatgacgtctccacgagcatatcaacagcccgggcttgggccaccatcgcaatccgcgtcggtcaatgtcccgagtcgatcggcggaccggctctcaccgttccacatccgaccgggacacatcgccggcccccatccgcttccctcccgacaatttcaagcactctttgactctcttttcaaagtccttttcatctttccctcgcggtacttgttcgctatcggtctctcgccagtatttagccttggacggaatttaccgcccgattggggctgcattcccaaacaacccgactcgccgacagcgcctcgtggtgcgacagggtccgggcacgacggggctctcaccctctctggcgcccccttccaggggacttgggcccggtccgccactgaggacgcttctccagactacaattcggacgccgagggcgaccgattttcatggtgggcttttcccggttcgctcgccgttactaagggaatcctt

SEQ ID NO: 111647 - DNA, 147 bp, Glycine max
  Peptide Sequence Number=SeqID_228425
atgactcttgaagaagagtttaggtttgagattattgataatgaagctgaaagtttgtgctttctctattgtgacagtggaggcataattaatcaaagggtgagaagtaacaaaggaacatacactcggagcaggaaaggtgggtga

SEQ ID NO: 111648 - DNA, 456 bp, Glycine max
  Peptide Sequence Number=SeqID_228426
atgagccaggcaatattttcatacaccaccgggaaatatcaggtcagcgccatcagcgacggcactatgcaagccagtctgagtttattaacggatattcaccacgacgatgcggtcgatctgcaacgccaggcaggcatagcacagccgggcgacatccatgtgttttgttatctgctccgcggtcagggacgcgtgattctggtggataccgggatgggaaaacgcgatgcgcacagcggcaaattactgcctcatctgcagctggccggggtgacgccggacgacatcgataccctgttattaacccatgcgcaccccgatcatattggcggcttgctggacagctcgggtcagccggtctttcgccatgcccggctctgcctcagccacagcgaagccgccttctggcaggatgatgcggcgatcaaccagctgagtgaacgcgcgcagtaa

SEQ ID NO: 111649 - DNA, 360 bp, Glycine max
  Peptide Sequence Number=SeqID_228427
atggcggatgaggagatcagcccgggaatccgtgcgctggcgttgcccggtcatactccggggcattgcgggtttcgcattgattcagacggcgagcgtttattgatttggggtgatattgtgcattacccgcctgttcagctggcctgcccgcaggtttccatcgccttcgatatcgatcccgtcatggccagagaaacgcgccggcgtattttgcagcaggtggcagcggaaaatacggtgattgccggtatgcattttggcgcgtctggctttgccagaatcgtggcgttagagaacggcggttatacggccagctatgtgtcagcgtgtcacgatggcgaagcgggtgagccatga

SEQ ID NO: 111650 - DNA, 618 bp, Glycine max
  Peptide Sequence Number=SeqID_228428
atgacgctaacaccgttaagccggcaaattcagcagctggaaagcgaactgggcatggtgctgtttcaccgtgaaaagaaacgtctgcgcctgacggacgagggtaagcgctttctcaccgaggtgacgccctttttgcagcatcacgaacggttaaaagagtatgcgcagcatctgcagcagggtgacgtcggccggctggatataggatatgtggaggcggctattcactcgcgcctgctgcccgcggcactggcgcggctggcaccgggggcgggcattgatgtccggctgcatgcgttacgttccgcacagcaaattgcccggttagaggcgggggcgatcgatattgccattgtgcatacgctgccgcacgatgacgcggattttgtgcataagaagatcgcgaccgaaccgttgctgctggcgatgccagcatccagtgcgctgaccgcacccgtggcggctgatttgcacggccgggcgtggattgccgaccaggaaaatctcaaccctgccgcgcgggcgcgattgctggcagcctgccagcgcgccggctttcagccggatattcgttttgaagtgaatggtccgctggccgctccttgcctgcgttga

SEQ ID NO: 111651 - DNA, 203 bp, Glycine max
  Peptide Sequence Number=SeqID_228429
atgactgaacactctgcatcaccaatacttgtgcctaaaagatgctttagagcatggactctacatgcagatgtagatgctggtgttggtgctggagctggtgtagcagaagaggaagaaacatcagatggcctcacccttgccctcctggcccctcgaaaagcaactgtcagatcatcaacattccaacagttcttcctaat

SEQ ID NO: 111652 - DNA, 582 bp, Glycine max
  Peptide Sequence Number=SeqID_228430
atggcgatggcgagaggagacggggaggaagcggagaaaataatacgtgacatcgagtcgtcgagggatggagacgcggatggacgagcgtcgcgcgcgcgggtcgcggcgaagaagagcgcgggcgacgacgccggcgcgctgcgcgcgctgacggagtacgcggaacggtacgggggggatgaacgggggtggttggagctcggacgcgcgcacgcggtgaaatgtgcgtacgaggaggcgttgttttgttacgaggaggtgatgtgcgcgatgccgttcgatccgagcgcgcacagacgctgcgcggagacgttgtattcgatgggcggcgagagaaatctgagggacgcgaagaatcatttcgccgcggcgttggatttcaccaacgggcgagacgtgcgggcgatgtatggggtggtgctgtgcgcgaagaaattgcgcgaatacgccgagggtggacgcgcggaggggagggagctcgcgtcggcggcggcggagcgtctcttgcagagatacgtcgaggagaatgaatctttactcggcgtcgcgcgaccgcagctcaagggggcgacgtcgtga

SEQ ID NO: 111653 - DNA, 775 bp, Glycine max
  Peptide Sequence Number=SeqID_228431
atgtattacgattgcggtctcaccaaaccgaacgtgttcgaggaggtgacgagcgtgttggcgcaatcgtcgtatccgggtgacgcagagctcggtcccatgcacctgttgagtctcgagggtttgctctccatcgtgcaaacggtgtccaaccgaacgccgtcggcgacgcctcgaccaacgtttgatttcaccaacacgaccgtcgtcgatccgtggtcgctcgcggacggcatgaacgactccggtccagcgcggttcgaggcgctctcgagaatcaaatacttcaagtgtcgtttactcggcgccgccgaacacttcaatcggtcgtacaaaaaaggtctcacgttcatgcaagagattaaactcttgcccgacccgctcgaaccggcggcggtggcgcgattcttaaagtacgccccggccttggataaggaagtcgtcggcgactacctcggtgagcccgacgagttcatcatcgccgtcttggacgagtacgccaagttgtttgatttccgcgacgtcacgctcgatcgcgcgcttcgatcattcttatccggatttaaactcccgggcgaggcgcaaaaaatttcgagaattctcgagtgtttcgccgcgcgatactacgaggccaatccggactcggtcgccgacgcggactcggcgtacgtgctctcgtacagcatcatcatgctcaacaccgaccggcacaacgcgcaggtgaagaacaagatgacgctcgaacaattcattcgcaacaatcgagggacgaatg

SEQ ID NO: 111654 - DNA, 771 bp, Glycine max
  Peptide Sequence Number=SeqID_228432
cagacgcacgcaccgatgaagacgaagagcgagagcgctgtacgtgtaacgcgtgcgcgagaggatgtcgaggggacgacgcgtggacgtgcgtgcgagcgacggggagggaggaggaggaggaggaggaggaggaggacgggcaacgctcgaacggggcgtcggtggaggggaagagcgcggggttcgggacgatggatgtggacggacgcggcgaggagacgacgggcgtcgcggaacgcgcgccgacgatggaagactcttgggacgatccgaaatcgagcgcgtggtgcgcggaggacgtcggtgcggaggcgttgagcgcggaactggacgcgatgttgatgagcgtcgattcgaaggcgtcgtcgagcgcgagagcgatcgaggcggaggcgaaggtggaggcgagacgagacggcgcggcggcggcgggacgaggcgggacgaaggcacgcgcgacgcgcgacgcgtacgacgatgcgtgttcgaaacagtttgtcgagtattatctcctcgcagacgtcgaaccacgagggacgcgcgcgatgtcaggcaaggtgacggcgcgcgcgcggacgctcttggcgcgctacgccgaacgcgagggcgtcaccgtcgacgacatcgtcgcgaacgcaaaggaagacagcgaatggacgggcgaggcgtacgagcgcggcgaggcgacgaacgtggatgacgcgtacttgaagtttacgaagcgtttgagtcgtgcgcccgatcagtgcgcgcgttacgacgtctcgg

SEQ ID NO: 111655 - DNA, 135 bp, Glycine max
  Peptide Sequence Number=SeqID_228433
atgggtgacaccgaggcggtgcccgtgtgcgacggattccagaaggttcttcatgagagaggcggcctaagactccgagatagcaccatcaaccatgcggtcgaaaaccgtgtaaggctggtggagaaaagatga

SEQ ID NO: 111656 - DNA, 252 bp, Glycine max
  Peptide Sequence Number=SeqID_228434
atggaccggaagcaagggttcttctctgcgctcaaagacgaggtggttcacggcatctcgccggcgtggtcacgcgccaagagccccgccaggagtgcatcgcccatatcctcgctgctccgctgtcgcaatctgatggtgaatgagtttgtgtataagatatggtatgccaatgaatgtcaatgcctttttcctacaacatcttttcaatcaatgtggaaagtggacggagttggagtttttgggcactag

SEQ ID NO: 111657 - DNA, 465 bp, Glycine max
  Peptide Sequence Number=SeqID_228435
atggtttccgcttctcagagttttgtctcgcactcctttccaaattccatcgccaagaagcttgatgattcgaactatctccattggcaacaacatgttgaatcggttatcaaatcgcaaaaactgcaatgtttcgtcgtcaatccagttgttccacctcgctatctcacggaagatgatcgaatcgctgatcatgtgaatccagagtatgaagcatgggaagttcaagaccaaacaccccttgtttggctccaatccactctctcaaagtccgttctattgcgtgttcttggtttgaatcattcctatcaagtttgggaaaagattcacgagcaattcagcctccatacaaaatcttgtgcgcgccaactgcgatgcgcgcagtttcgcttgaagttcgggttcgccatgaggaatacgttgacgcgctccttgaaggcctcttgtccgattacgtgctggtga

SEQ ID NO: 111658 - DNA, 255 bp, Glycine max
  Peptide Sequence Number=SeqID_228436
atggatgatgcaaaagagatgaaaacttcaattcatccaagcacatatcttggactggatgaggaatctaagaaggttgacaaagcccaatacacagcaatgataaggtctctcctatatcttactgcgtctagacatgacattatgttcaaaagaaggagcactagtggaagctatcacttcattagtagcaacttagtatcttggatatgcaagaaacaaggctcaactgcactatctactgttgaagcataa

SEQ ID NO: 111659 - DNA, 1176 bp, Glycine max
  Peptide Sequence Number=SeqID_228437
atggataatcgagtgagctcactagagaaactgaccagcgagcatggagcgaaactgccagagctgaaatgcaacattggctacatcaaggaacatgtgccagacatgaaacagatcaaagatatcttggagtgcatgatgaccaagaaaaagaaaccaagtaccagcaggcactggtctaacactttgcagctgctctttgttttcactgttgctgtacagctgttgtcacccccctcttgctgtcacagacctcccagtactcctacatttgtgttctctgccttcttagatagggatttagggtttcagttgcactttcaaaacagcgggggcactcaactattcattccaaagaaagctggtaccccaaagaaaaacgagattgtgttcactgcaccaacaggagaggagatcaataacaggaagcagctggaaaaatatttgaaagcacaccctggaggcccagctgtatcagaatttgactggggcactggtgagaccccaagaagatctacaagaatcagtgagaaggccaaggcagctcctccaacacagagggagcccccaaagaagcgtactaaaagatcatcagcttcacaaaaggaaatttcccaggaagaaaaagaagaggagaccaaggaagcagagatgcaagaagctgatgacaccactaagggtgataatgatatagagaaggaaaaggttgttgtaaacgaaaatcatgacaagagtgtggaagatacagatgtcaacaaatccactcgttatggagaagaagctaaagctggagaaaacgttgaggtacctattgaagaggaaaaatccaatgctgctgatggagaactacctgcattaaaagataaagctgatgacaaagtaactgagggctctgaagtttttctgagaaaggatgaagaaaagattgagcaaccacaggaagagacaaaagaatatagtggatttggggagccagagaaattggaaacatgcactactgcagacaaaacggttgaagtggaaggagtgaataaagaggatcacgtcaaaagtactcatgaatttgaagttggggaaatagaaggaacaaaagtgaacggtgaagaacatcacaagcttgatgagataaacaaggccgaagcagagttgactgtgaatggcactcacgagagctga

SEQ ID NO: 111660 - DNA, 459 bp, Glycine max
  Peptide Sequence Number=SeqID_228438
atgcacttgccgggttcgaacagcagtcaccacagtggagacaagacaacagctaaagtgctacaatcagttttcttttggccctccatctttaaagatgctcatgactatgtgcgtcattgtgataaatgccaaagaacaggggggatttctagaagaaacgagatgcctctacaaaacatcacggagacaaatagccaagcagaaatctccaacagagagcttaagagaatctttgaaaagactgtggcatcatcaagaaaggattgggctttgaagctagatgatactctctgggcctacaggacagcattcaagacccccatcggactgtgcccgttttggctagtatatgggaaagcatgtcacttaccagtggagatggagcataaagcctattggactctcaaattgctcaacatcgatgaagctgcatctagagaaaggaggaaattataa

SEQ ID NO: 111661 - DNA, 258 bp, Glycine max
  Peptide Sequence Number=SeqID_228439
atgacattccattgttttccacttgatcttaattctaaacccgatgaggaggaggaaccaatttcttgctccgaggaagcaagtgccaatgttggtggaaagtgtgaaaccagagccgcaacttctgcatcagatgacaacattcgaggtcgagcagaagctgctatcattgacagagtcaacgttgttgaacgaggatctgactttgagaataagttttattatttggaacttactaaatgttccatgaggatataa

SEQ ID NO: 111662 - DNA, 801 bp, Glycine max
  Peptide Sequence Number=SeqID_228440
gttggacacgcgcgcgcgagcgtcgggacgtccaagtgcgcgtctctcgccgcgaggtgtcgatcgatcaacgacggtgtggacgtcatcgaacacgagacgtacgcgacgaacgtaaacgcggacgcgttgatcgaatcgtacgatgtggtgtgcgattgtagcgataatccgaggacgcggtacgcgctgtcggacgcgtgcgcggcgcgcgggacgccgttgatttcggcgtcgtgcgtgggatacgaagggcaattgacgacgctgtgcgcgacgtggatctggagtgaggatggagagcgaattgggaggagacgggcgccgtgttatcggtgtttgtttccgagaccgccggcgagcggcgacgcggggacgtgcggcgcgagcggcgtgctcggacccgcgccgggggtgatgggaacgtttcaagcgatcgaggcgatcaagacgctgtcgggagtcggggaatcgatgcgagggaaattgatgatgttcgacgcgctgagcgcgagaccgacgaggacgctcgaggtgagagacgaaccggatcccgcgtgcgagaggtgcggcgcgggtgcgaatttcggcgacgtcgcggcgtacgattacgacgcgtttttatcctccacgccgtgttcctcgcgtgccgcggcggcggcgcgtctacgggagggtggtgtcgatctcaccgcccctcccgcgcacggatcgggcgacgcgctcgacgacgacgtctcgcgcgcgtcggcgtggtctcgcgtctcggcgagagacttcgcgacgacgctcgattcatga

SEQ ID NO: 111663 - DNA, 541 bp, Glycine max
  Peptide Sequence Number=SeqID_228441
atggacccgtataacgccgatccgtacgcaccggcgcccgtgatgtacccgacgtcgtcgtacgtcgcggtgtcgccgggcaatcacggatcggcggtcatggcgggggcgtacgacggtcaaaggggcgctcagactccgtcctcaaccgtcgcgagcggggcgagagcggcgaaaccgagtgagatcccgggtgcgccctcggggaacgtccggtatcggtgcatgtcgctgccgacggccgatggggacgacatagaggatgtgatcgtgcagatgggactggatggagtgaaatgtttcgccggcgacgacgtgacgcgcacgagacaaacgtttgagttgccgagaatcgccaagtggtccgtcgtggattccacgattttgaccatatacgcgaaagatagttctggcgagagaatgttctctctgagcgcggattcgggtacgatttcagccctcgtggacgtcctgacaacttccgcatttcagtggtgtgagttgaacggattcgacgccatggacaccatagtctcgagcg

SEQ ID NO: 111664 - DNA, 716 bp, Glycine max
  Peptide Sequence Number=SeqID_228442
atgaaggaagagccggaggacgacacgtgctcggaggatgacgagttcgaggaggaggttctgcgagaactcgcggcgcaggcgcgcgcggtgaagcgcgaacgcgaggcggacgtcgagggtgacgcggaagagatagaacgaggtggtcgtccacagaaatcggccagagtcgactcagaggtggatccatctatgacgtgcgcggtcgcgggagcgttttcgcgtctgccggaagacgtcgtatctttgatacttcggagactggcaccgaacgaattggtttcgctcgcgatgacgtgtaaattcttttccaagaggtgcgatcaggatttcttgtggcggcagtgtttcatcgagcgattcgggaacacgaaacaagctcgacaaacaaacgtgaagagactttatttcgcggctgatatgcgcgaaatagacagagaaacgcgacaagcgcccaaaggttttgagaaaatatgtggtgaggcttttgcggctaagcgatcgcaagtctgtgcgaatcttgccccgatgagtggaggcaccccaatgtatctcgccgcagtagagtggaagggtcgtcgcaaattcgtcgcagaggagggacatttatgcagtcgtcgagctggatgttcgtaccacgagctacccggaaaagttttcgtgtgcgaaaagactggaaatattcacgtgtgcgatgagacttgcgcgcacag

SEQ ID NO: 111665 - DNA, 783 bp, Glycine max
  Peptide Sequence Number=SeqID_228443
atgtcgtcgaaccgtacggcaagttggcgcgaccgttcccaagcgttgatcctcatcgctgtctccctctactttatcacgtcttccgactctggttcgtacgtcgacgatttgatctccgccatgggttacgaaaacccgccggtgcttcaaaaggtgtactggtgcttcaccgaaggtgcgctcgcgaccgcgctcgtgtacagcggtggtttgaagatggttcaagccgtctccatcgtcgccgggttcccgtacactctcgcgctcaacttcatgtgcttgtccctctggcgagcgctcctcgacgaaggcggagacgaagcgcaccgccgcaagcgcaagagcttcaacacgtgcctctttgacttcttggaagtgttcaagccgctcgatgcgggtgctaacgctccaggtgcccaggaacgcgcgttgtgctccctcaaaaacttgatcttcccgtacgaagccatcgtcaagtgcaaggaagctatcggctccgataaaaacgtcgccatgctcaacggcgcggtcgtcaccggccttctctggaccttcatcggtcttctcgcctccacgggcgccgaggcgaacacgcacggagtcgcgtggctgatgttcttcatcttcgtcttctgcgtcgccaacatcagacgcgaacttcgcgagaagagaaacatcatcggcggcgtcatggaagactttacctccgtcatggctctctggccgtttgcgatcgcgcaaatggaacacgaggccgacgccgacgacaagatggcgtga

SEQ ID NO: 111666 - DNA, 759 bp, Glycine max
  Peptide Sequence Number=SeqID_228444
atgaacattcgaccatggaactacgccgttcatggggcgcgcaactggctcatggcgggtacatttttctggttcatcggcgcggtggttgaatcggcatacacggcggatagaagctcggacgtcttgagaaagcgcgcaaaggcgcagaaggcgcagaatgagcgcgacgctctcgcggaacaaatgggcaagtcgaaggcaaagttgatgaagcatcagtcgtcggtgcgtttcaaggatgtcgcgggacaagacatggtggttcgagagttccagaccatcatagacatcatgaaaggaagtccaaagtataagggtcgcttcgtggaaccgcccaaggggattcttttggaaggtccgccgggtacggggaagacgcttctcgcgaaagcagtcgcgggagaggctgggttgccgttcttttacgccaacggttctgaattcgtcgagatgttcgtgggcgtcgccgcgagtcgcatgcgcaacctgttcaagcgcgcgcgtttgaacgcgccgtccatcattttcatcgacgagctcgacacgatcggtcgtagccgcgccgcgaacgagtttcgcgattcgtcgacgtccgagcgagagcaaggtttgatgcaaatgttagtggagatggatggtttcaacaataaggagacgggcgaggctgtattggtgatcggcgcgacaaacttagcggcgcaactcgatcccgcgctcttgcgttcgggacgtttcgatcgcgtctaccacatcgga

SEQ ID NO: 111667 - DNA, 616 bp, Glycine max
  Peptide Sequence Number=SeqID_228445
atgtcaacagccgttggcgccgcccacggtggaggtgcgagcatggacgaggggccggcgcaaatgcattatatgcctgctcgatttcgcagcctcgccggcggcggctgggtcacgatctcatcgagcgacgtgcgcaagagcctgatgcccatgcctgggatgggcgggggcggggaaggcgcgaatgagtcggcggtgagtggcggcgcgatgaagcacgaggtgaagatcaacctggcgcacggtgacccagacggtgagcgatcgtgcgatcttgtgcattacaagtcatcctcgaataagttggtgtgttcaccacgcgcggtggattgctgtttggacggactcacggcgcaagagctcgccagggtaagccatgggtgcccgtcggtgaaaccagagctgaacgtcgaggtcaacggtcagcgattgacgtggggccgcgttggtagacatggtaggaacacgctcacggacaaaagtctcgaggtacgctacgggcagacgccgacgatagtggcggtcgagccggctgaggttcgtcccggtgagttgatcacggtgtacggacgaacgtgctttggcgatgtttggaagaaagatgaagatgatg

SEQ ID NO: 111668 - DNA, 633 bp, Glycine max
  Peptide Sequence Number=SeqID_228446
atgcgtgatggtagaattgtcaacgcagacgcgttttcgaaaggcggcagatgcagaaccaacatatgcgcgtcggggtgttatggcgagagcagatgggaatttcgtgggcccgcaaagtatctaccgtgtcaggatgcttacgaagatttcctacgcatgttagacgaaagtgcgcacgagggggtacgttccaaaagaggacgggggtggcgcgaagacggtgcgcacccatgggcgcacccgaaaagagaatcctgtgactcgcaactacttcgaaaagatccgtataaagagaagatccggaagtgcccggagtgtatcgatggtgggaacacgttcgagaaaggaatctcgaatttctggggctgcaaattgtccccagaaaacgtcgagaagaaacgcaaggaatgcgaccgcctggctgctgctgctgctgctgagaaaaagaaccagtgtctcgctcaacctgcgctcgggtcctccctctggatcgatggagtggatacgatgagttttgcgcttggggctctcgtggcatgtacgctcggtgtcgtggtctatttcgtacgccgaacccgaggcacaaaaataactgactcacgcgcatacggcgcgacagctgtccaatag

SEQ ID NO: 111669 - DNA, 770 bp, Glycine max
  Peptide Sequence Number=SeqID_228447
atgttgtacaagggcgcgtttgcgatcggaaacccgaagggtgactctttttacaatcctttcgatttcgacgtgaagaatgtggccaacacgggcgtggtaaactggggaggcgagacgtacgcgctgtgggagggtggtaagccgcacaaaatgcgttcgagtgatttggggacggtcggtgaagtggaagaggtgctcggcacgaagcttcgagtgccgcagatggctgcgcactacagaatctgggaaggcgagacggaagcggataagcgtctcatcggatttagcatcgagagccaaccgtccaagtttccgtggacttcgaacagcgcggcgttttacgaatgggacgccgagggtaaatccacggtcgtgaacaactttgacgttcccaacgctacgtttgcctttgctcacgattgtctcgtgacggaaaactggtactttttattccaaaatccaaccagcctcaacccgcaaaagctgttgacggagtacatgttcgccgaatgcgcgttggcggaaactatctgcatggtcgatggcaagagcgctctcctccactgcttgccccgcactgaaaaggcgcgtaagattggtcaaaaggccatcgaactcaagccgcaattctttttccatcacatcaacgcgttcgagcgtgaaaacggagacatcgttctcgattcacttccgtgggtgttcatggacttttcaatgaacttggactcggtgaatccggcgtttttcaacggaggctcgagagtcga

SEQ ID NO: 111670 - DNA, 151 bp, Glycine max
  Peptide Sequence Number=SeqID_228448
gttaattaggaaagtttatgaagtgcttatttccagcttctcgctaagccaatctgccgccttagcgagacatccgctaagcgcaccactcttgcggctgagtgcaccactcttgcagcttagcgcgaggaagaatttggaagaaggatga

SEQ ID NO: 111671 - DNA, 534 bp, Glycine max
  Peptide Sequence Number=SeqID_228449
atggtcgaggcagatgatgctacgcgaacattgatgaactatctcacccccaaggtgggagaaattcaatggaggttcccaaaaggacctcatgatgcacttgaggaggttcttaagcatgagagtggcttagttcactttcagaggatagcattaccaattggacccaatgttccaatgccttcctttgaagtgtcctctcacaacatgactggccttgatgtatgtcaaggcaatttgatcatgaagccaaccgttaatgccattataatcattgaagatatgtgctcaaatccctatcacaattatggggttaggagaatcatgaagacgctcgatcaaccagctaagtctcaagtgcctatctctacacctcccaatcacacttgtgataggtgtggatgtgttcatggtctaggagaatgcactgtggaaggtgagttggctcaagccatggatgagcttaattatgtgagagggaggaacaatcactatgagcagttctttaacaacaacaacttccatcagggatag

SEQ ID NO: 111672 - DNA, 422 bp, Glycine max
  Peptide Sequence Number=SeqID_228450
atgacgacgcgcgacgcacaggcacgtggtgttaccgccggatatcgcgaagatgttgccgaagaatcgtttgttgtccgaggtgcgcgcggagacgcgagaggggagaggcgagacgttggatggatggggacggacgagtgggcttccttcccccagactggggcgggagacgaagacgccgcggacgccgacgacgagactgaccgaggacgcgcgatgatcgcagacggagtggcgtggattgggcgtgcaacaatcgagagggtggattcattacggtgcgagagagagagagtcgaacgcgccgccgcacatcatgctcttcaagaggaagaagagcgaggaataaacgagaggaggatggagagggatgacgcggatgggacgtcgttcatcccgccgacgagacgtttgctcgg

SEQ ID NO: 111673 - DNA, 282 bp, Glycine max
  Peptide Sequence Number=SeqID_228451
gtggccgccgaggacctcgccgctcgactcggcgacggcgccgccgtcgtcctcggcagcgccaacggtcaaaacgtcggtctcgtcgctctcttcgacgacaccgttcaaaaactcgggcatctcaaggctggccaagtcctcggcgccgccgcgaaaaagtgcggcggcggcggcggcggcaagcccggctttgcccaagccggcggtcgcgacgcctctcagctcgacggcgcccttcgcgacgccctcgataccgtcaccgacgccctctcctcgtga

SEQ ID NO: 111674 - DNA, 752 bp, Glycine max
  Peptide Sequence Number=SeqID_228452
atgccctgggagaggtgcgatccgggagaggtggagcgtcggctggcgcctcggggatggtgctcgtggtgcggcgcgtcgtcccgacatcgcgtgacgcgcgcgtcgggacggcgggggacgtatctgagccactgttcgtcgtgcgcgcgggcgacgcacaagtgtgaacggtgtgcggatggatttgcgaagattggtgacgggaggtgcgcggtgtgcgcgggatgggtgtcggattgggacgtcgacgccgagacgtttgcgcggcggacgcgcgtcgtcgcgtggtgttcgtggtgcggcgaaaagtgcgcgcacgtcggtcgaggggtgcggggagaggtgaacggtgtgaatgacgccgcgcgagacgcggtggcgaggtttgagtgcatggtgtgcggtggagggacgacgccgtgcgcgcggtgcggagacgccggggtgatgcgaaaacggtcgagaccgggcggcggcgggtcgtgcgcgcgttgcgtcgtcgcggacgagaggatgaagaagattaatatcggtgggtacgtctccgtgccgacgatcggggcgctcacgaaatcgctcgcgcgcgcgttcacgaaaaggagagatggcggcgccgacggcgcgcgcggaagcgacgacgagacagaggacgaagaaatcgcgcgacgatggaacgtgcgcgtcgcgagacgagacgccgcggacgaacaggcgagttttatcttcgacgttctcgatcgagagagcga

SEQ ID NO: 111675 - DNA, 587 bp, Glycine max
  Peptide Sequence Number=SeqID_228453
atggagtgcggcactgggtccatagtgtacgatagcacggtgtacccgtctgacagccctggacgtgagagcacgccgcagcaatgtcacggtgatgcaacatttatgcaagtatcatggcattacaacgcaaggctcaccgcaggtgattacacgtgtctttacgccgacgggatgctctacgacaaactgtccgtcagtcggtctaatccaaatattgcagggtactctgaagtcagtggcggtctctacgcggcgactaactttacggatatccgtccagtgtctggaacattcgaggacgtgcaagagtctttgattgcaaactttctattcgacggcgatggttctgacgagttgatatccgcgtctccatgtgtcagtgggcaacagggtacaaaaccaaagttgctaccggtgggtaccgtgcgcgatatcaagacgtgcactggtggtaacgggggcttgtgtctttcagccgtggcctcgtcgtccgtgggttcaaaccagtttgggtacgcgtacacgtctgatgaagtatttgccgacgacatggcattgtctacgtggatttatcgcaagtgtgg

SEQ ID NO: 111676 - DNA, 255 bp, Glycine max
  Peptide Sequence Number=SeqID_228454
atgtacgtattacgaagaaacaagctagctaggaaggttttggagagatggaccccccaagacggtgaccagtgcctaatgatgccacctttgcagactggaaaagaaaagaaagtatcacgcagctgcaacagctgtatgattgagacgagtgtgggttgttcctgtgtagctagtcttctgcttctgctaggtggggtgctattgctacctcatcgcacttcctctaattttccaacacattccgccatttaa

SEQ ID NO: 111677 - DNA, 297 bp, Glycine max
  Peptide Sequence Number=SeqID_228455
atggcgtcgagcgaggcgtcgagcggacggatggacgtcgcgagcgagcactggacgacgcgatcggcgacgccgaacgcggtgtcgatggcgttcgacgggatgatgatcgcgagcgcgagcgcgaggagcggcgactcgcgcaagcgtcgaggcgtcgaaccgacggcgatggacgaggacgacgattgcgtcaacgtcaacgggctctcgcaagaattcgagcgagagctcgccgtgggacgcgcgcccaagcgcgcgtgctcgcaggtggacgttcgagacgccgggcggtga

SEQ ID NO: 111678 - DNA, 366 bp, Glycine max
  Peptide Sequence Number=SeqID_228456
atgacgaggtatcgtcgcgttgcatcgcgtcgcgcatcgctcgctctcttcacacgttttgtaaatcgtcctgtatcgatcgatcgattcgtcgtcgttctcgcgcgtccctcgcgtgtccctcgcgcgcccgaattcctcacagagacgcgcgcgaggcgcgtcgccgtcgggcgagcgcggaggatgcgcgcgagagctcccgcgcacgtcttcgatcgcgcgttttacgccaagatcgcgggcgtctccttcatcgtcggcgccgcgttcgagggattcatgttggcgaccgacttttatcccaaagtcttagcaatcgaagccgagcgtcgacgcgaggcggcaaagacgcgcgacgcgtga

SEQ ID NO: 111679 - DNA, 1319 bp, Glycine max
  Peptide Sequence Number=SeqID_228457
ctgctggttactggggcgctgcgggtgccgtagatggtggcggcgcttacactagtcatgccggcactgtcactgcgtgcacggctacgttcacaaatggggggagtacggcgggtatcacctcgaccgcctccactacgacgaccgccaggaatgcatgcaagactgcacccggctacatcatcacctctaacgcaaacgctgccgataccgccatccgcgtggcgcaagtgcctcccggcaagtacgccgccggcggcactgccctcgtcactcaccctaccaatgcgaacacaggaacagctgcggagaccccaacgaactgcgccaccggcacgacctctgacgctggatctgcattttgtggtaaagtagctgctggttactggggcgctgcgggtgccgtagatggtggcggcgcttacactagtcatgccggcactgtcactgcgtgcacggctacgttcacaaatggggggagtacggcgggtatcacctcgaccgcctccactacgacgaccgccaggaatgcatgcaagactgcacccggctacatcatcacctctaacgcaaacgctgccgataccgccatccgcgtggcgcaagtgcctcccggcaagtacgccgccggcggcactgccctcgtcactcaccctaccaatgcgaacacaggaacagctgcggagaccccaacgaactgccccgccggcaagtactccgacgcgggggcgttcgcatgcatcaactgcgccgccggcaagtactccgccgcgggcgcggcctcgtgcaccaactgcgacgcaggcacgtactccgccgcgggcgcgtccgcgtgcaccgcctgcgccgaaggtaagaccaacgccgctggatctgcgttttgtggcacagtcgctgctggttactacggcgctgcgggtgctgcttccggcggcgtttacaccgctcatgccggcactgtcgctgcgtgcacggatacgtttagtgactcctcgactggcagccgcgctcacactggtcatgccgttctcaccacactccacgttcgcggtctcacgcgtctccttccactctggccgcgcggcgtcacggtgcaaatcatcggcggcgccggttcgacgacggcgagcagcggcgacacgttcagttacacgacgtattggaaaaccttttccaacgtcaaagccgctaatgcgtacagccagacgtggactgagatcacggataccggcgtgaacaccggcatcggtgtatacatcaagtgggagtctggcgtgtcggtcaccgccggcgacgagtggcgtctgcacgtcgccgac

SEQ ID NO: 111680 - DNA, 150 bp, Glycine max
  Peptide Sequence Number=SeqID_228458
atgaacattcatcttcctgatgagatacctgtggctaaccccagatggcctccaggaagcataagagcattggggcaaggccaattgctcagtgtgacactagatggttccattcacttgatgcttggaaccgttagtgggatcctctag

SEQ ID NO: 111681 - DNA, 495 bp, Glycine max
  Peptide Sequence Number=SeqID_228459
tacttgaagaaacaatggtgtgtggtttctcaagatgctaatgttgatgatcctaagatggaggatagcttgaagattgcatgtgatgggtcaacggggagcactactttgggtaatgggtcatcttgtgagtggttggataataggaccaaggcttcatatgccttcaatgcgtactaccagttagtgactaatcaaagcataaatggatgtgagttcaatggtttagcaagcatgactgacaaagacccttcaccccccaaaggtacttgcaaatttgatattgggcttgaggtggtggagcaacttgctacaagcccttcacctacatcagcaccaacaacaactgaacccggtccagacaagcccaatcttgagtctagggcatcagaccctaggtccaagaagtccttggcagtggaaactaggcaaccaaacttaattgtcattgttgcaatggtagtatttagtttgatgcttacaatcatcctttga

SEQ ID NO: 111682 - DNA, 1536 bp, Glycine max
  Peptide Sequence Number=SeqID_228460
atggctgttttctcgaccaaacagctgagtacttcaactctgaccaccacattcatcatcttctttgttcgctctgaattcgcgggactcggtggcctgagagtttctccttctgaattcataggctcggtgaccacagtaggcgatgttttgcaaaacgttacctccattctcaagtctgagttcgtcagcaatgtcaacaataatgagtttcatctttatgatgccgccgccatttttgcctgtctcgatttgttagacttgtcagctgatgaactcagctggtccatttccgctgttcaaagtccccaagggaatgataacagtactggtaatctgagctctgatttgaggacatggctgagcgctgtactagcgaatacagatacatgcatggaagattttgaaggtacaaatggtaatgtgaagggtttaatatccacagaaattgatcaagcaaagtggttactccaaaagctactgacccaggtgaagccatatgtgaatgatttcagcagtagaaatagtagggataaatttccttcatgggttgaagcagaggataagttgttgctgcagacaaatgtggtgtctgcggatgctgtagttgctgccgatgggactgggaattttactaaggtgatggatgctgtggaagcagcacctgtttatagcatgaaacgctttgtgattcacataaagaaaggtgtttacaccgagaatgttgtgattaagaagaagaagtggaaccttgtggtgattggtgagggtatggatgtcactattatctccgctaatctgagtcgtaatgaaaatttgaccacattcaagacagctacctttgctgtgaatggcagaggattcatagcaaaaggcattaccttcaggaacactgcaggacccaaaagaaaccaatctgttgctctaagatcagactcagacctctctgtgttctatcgatgtgggatttatggctaccaagacagcctctacgcccactccttgcgccaattctatagagaatgcaaaatcagtggcacggtggatttcatattcggccatgccaatgcagtgttccaaaactgcacaatattggccaagaaaggcttacaaagccagaagaacacaatcacagctcaaggcgaaacgtacaccgatcaatcgtctggtttcaccatccaattctgcaacatttcagcggattatgaccttctgccctatcttaataccacctcaacgtacctcggaaggccgtggaagccgtattctagaacaattttcatgcagtcctacatcagtgaggtgttaaatcctaaagggtggctagagtggaatggaacaatgtatttggacactttgtactatgctgagtacaagaattttggaccaggagctaggcttgataatagagttaaatggccagggtaccatgtgatgaatgattctagccaagcttttaacttcactgtgaccaatcttattttgggggaactatggctaccttcaactggtgtaacattcattcctggactttga

SEQ ID NO: 111683 - DNA, 689 bp, Glycine max
  Peptide Sequence Number=SeqID_228461
gtaaagcagaagagttgaaggacttggtgaccaatatcataaagctggttggaacaccaaacttggtagatttttttccagtgttgaagatggttgatccacagagcatcaaaagacgacagagtaagaactcgaagaaggtgttggacatgtttaaccacttggttagccaaaggttgaagcaaagggaggacgggaaagtccacaatgacatgttagatgccatgctctacatttccaatgataacaagtacatggacaatatgattgaacatctctcacatgatatatttgttgcgggaacagatacaacaacatccacccttgaatgggcaatgactgaattagtccgcaacccagatgtaatgtcaaaagcaaagcaagagcttgagcaaatgattagtaaaggcaataatcctatagaggaagcagatattggtaaactcccatacttgcaagcaatagtaaaagagacattaaggttgcacccaccagttccatttttactaccaccaaaagctggtaaagatgtggacataggtggccacaccatctcaaaagatgcaaaagtgctggttaatatgtggactatttgcaaggaccccacattatgggactcatctaactatacatcccatgtggtggcatcaaagtctctgcaactggcagaaacaagcctcttcttctaa

SEQ ID NO: 111684 - DNA, 252 bp, Glycine max
  Peptide Sequence Number=SeqID_228462
atggtggtctcggatgaagcatcctatacctgttggggtacttgggctatgggaccttcaccttccctatcaagagaaggttgggccccaggccaagctaccctctctaagaactactctactgataagatggatcctaggggagctaccctctctgcagaagtagatgctggagtaggtgttggagctgcagaagtagatggaatatcagctgacctcgccctcaccctcctagcccctcggaaagcaact

SEQ ID NO: 111685 - DNA, 156 bp, Glycine max
  Peptide Sequence Number=SeqID_228463
atggagtttgcacaaaaggttgttcttcaggcatcgatgcacttttcattcctgaaggctgatgtatgtccggaactttcattgttcacactaagttttgtatgtttactgccaatgctgatcaaaatgtcaaaacaaacatctgaatacacctaa

SEQ ID NO: 111686 - DNA, 464 bp, Glycine max
  Peptide Sequence Number=SeqID_228464
ctctagcttctcatctcaaggaggtgagcttagctattagagagcttctcaaggaagttttctcaaagaagcttctcaagaaagttttctcaaagaagcttctcaaggaagttttctcaagaaagcttctcaaggaacaccctctccaagcttcttatccaagacactctcttggtggagaaactccttcttccatggcttattccctagtggatggcgcctcctctcacctcttctcctttgtcttccgctgcatctccatgcctccattgaagctccacaagcaagcttccatcaatgtgatgttgggcgacaaagtggaatgcgatagctcactccctgtgtgctatttgtgtttggatcctgtgatgatctcgaaccttgtgttcgtgggagcagatgaattagtggatgacgactatgaagaacctcatgctagaggacacgggaacacaatgttatga

SEQ ID NO: 111687 - DNA, 357 bp, Glycine max
  Peptide Sequence Number=SeqID_228465
atggtgttttttgggcacttcagcaacaacagaaaggtgaagcatctggggttggatgaaaatgtaggtccacagattagaaagttttacgctgaggtgcttgcacagttatggcccagtggttacatggacaatgatgggatcaaacttggaatttgcaaggcaaaagagaggcacatagcactgtacaacaaacataaggtgcatttggatattgcgagaggaagagaaaaaaccaaactaaaaagggaatgcaaaagaatgatttttttcccaacccttcttgaatggaagaaggagaaactcatgtgcctaaccaaaatcaagcaattgaaccctattgaaaccccaagctaa

SEQ ID NO: 111688 - DNA, 420 bp, Glycine max
  Peptide Sequence Number=SeqID_228466
atggggatgacattatttgaggctcccaggtcaagcatggcatttgtaaaattgcaatctccaatggtgcaagggatgaaaaaagtgtcaggatccttgcgcttttgtggcaaggtggatgctggaatgcaagatcatgcaaaggatgttatgacaactatggaagtgtggacatcactaatagaagtggaaatgaaacttaagtcaagcaaaacaattactgaagacccaaagtggaagctctcgaagatgtgggaatgtagatgcatagtgataataagatcccttactatcgcaacctacccttcagtgggagggcgatgcgagactcatgggtgcgtcttccaagaaaggaaaaatgcgcagagtcgccaccaacgtttatttgagaaaaatgttggaaaaaccggaaaggtgtag

SEQ ID NO: 111689 - DNA, 564 bp, Glycine max
  Peptide Sequence Number=SeqID_228467
atgaggattcaagtgcagaaaaaaatgtgcaccactacaaggtttatgtttggttttgaatcgatcagcagtctaagagttgaagcaaaagatggtgattatgatgaaagctcaaagcctcttactagatatgaagtattggctgcattcatttggaaacacatgaaaccaacatgcaagatggaatctaatagaacaagaccagcagttgctatccatattgtggacatgagaaggaggattggtgaacctttctctagatacaccattggcaacattttgtggccagtgatgcatagccaaagaaaatttggaaatctttcaattgaatggtttttaagagtcaaaagtgatcctaatatcctagggagcactcagtgtatggatctgactcaaggaggggataaggaaactctccccgatgaagttgttatcatggaaatagatgaagccattgaagcttggttgacaatggaaatgcaacatattgctaacttggaaagagacattgagtttctcatattagctttgcctaatgctagtgtttcaaacatctggttttga

SEQ ID NO: 111690 - DNA, 618 bp, Glycine max
  Peptide Sequence Number=SeqID_228468
atgttgaatttttttcccagaattagttactatcttggccttattccaaggcttgttattggcctatgtgtactagcagtggtgttggttgtgtatgtcattgttggtattcttggaagtattgttggtggagcagcctatggatttcttccacctatatttgctacttttgaagttgtacaggaaggaaaagtgacaaatttatccacaggcaagtcattagtcttcgtcctttcactcatttcaatcccctttacaacgttctctaacttagccaaattctttgtagttgttttatggcctccttctactagtccctcactctatccaatgcctatatatggggaggcttctaatcacaggtatcggggatgtgagccattggtcttgtcatgcctacctgctctggcacatttgactgcccactttgaaaggcaaaggccaactagtgtagccctggaggaagctgagtacaatttctggcataagctgtgttgtcataaatgcctagatgttaaaatttctcctgtaatgatagctaatcaggtcaaaaggcaagcagagaggatctcccaccctgagttagctcctgttgtggtttcgatgattagtgtttag

SEQ ID NO: 111691 - DNA, 836 bp, Glycine max
  Peptide Sequence Number=SeqID_228469
atgctgcaatctcgcttcattttctgccggataacgacgctgctcatgatgcaagcacaacaattcgcacaggtggtgcttgactggtatcagcgctacggccgcaagaccctgccgtggcagctggaaaaaaccgcctatcaagtatggctctccgaggtgatgttgcaacagacccaggttgccaccgtcattccttattttcagcgctttatggcccgttttcccaacgtgcgcgcgctggcggaggccccgctggacgaagtgctgcatctgtggaccggcctcggctattatgcccgcgcccgcaacctgcacaaggcggcgcagaccattgtcgcacagcacggcggcgagttcccgacaaccttcgcagaaatcgccgatttaccgggcgtcggccgctctaccgccggcgcggtgctgtcgttggcgctgggccaacactatccgatcctcgacggcaacgtgaagcgcgtgctggcccgctgctacgcggtggagggctggccgggcaagaaagaggtcgaaaaccggctgtggaaaatcagcgaagaggtcaccccggcgcagggcgtcggccagttcaaccaggcgatgatggatctgggcgccatggtctgcacccgctccaagcccaagtgtgaactctgcccgctcaacgtcggctgcctgtcttacgccaatcacagctgggccaactaccccggcaaaaaacccaaacaggccctgccggaaaaaaccgcctacttcttattactgcagcacggcgagcgcgtgtggctggaacagcgcccggcggtggggctgtggggcggcctgttctgcttcccgca

SEQ ID NO: 111692 - DNA, 617 bp, Glycine max
  Peptide Sequence Number=SeqID_228470
aacctgtatcctttagaggactacacgtcctcacctttcaagggctacatgcccttgccatcagagggctacacgccctcaccctcagaggactacgtgtcctcgccttcagagggctacacgctctcgcctttattcctgggccaccccctgatattggaggagggccaactgtgcgagcacaatcagagagggaggctatcacacagctactatgcataccggggcaagatttcacccgtgccgctgcaaagagacaacgaccgcaatgccgatctccccctgcggatgtatcagttggtctgtgtcatcccgacataggtaagtatgcatatggttcaactgatttcttataccatccactatttgcagggatcgtgcccgcaagacacccagtggacccggagaagtccaacagggtcttggggtttccagctctgattacggacttctgtcagttctacgaagtgtctgtcacccccgacaaggtcatcaggtcccctattaatcaagctttcatcaagaagtattgcgcccccaggcaggcgcagggtgaaacaccacagcagcctgagatggctggcagtgggcaacaaacgcaccgccaccacctctag

SEQ ID NO: 111693 - DNA, 1629 bp, Glycine max
  Peptide Sequence Number=SeqID_228471
atggcttattcatctcataaactcttcttccttctgtttgcaattttcttctcacacgctagtgctgtaaactcttccgatgcttccacaacaattcacaccaatctctcttccataaaatctttctgcacaaccacagcttacccagaagtttgtttcaactcattgaagctatccatctcaataaacataagtccaaacataatcaactacctctgtcagtccctccaagtagcaatatctgaaaccacaaagctctcaaatctcttccacaacgttggacactcaaaaaacatcatagagaagcaaagagggtcagttcaagactgcagggaactccatcaatccacattggcttctttgaaaaaatcactatcagggatccgttcttccaactccaagaacatagttgatgcaagaagctacctcagtgcagccttaacaaacaaaaacacatgtctagaaggcctagattctgcttcaggaacaatgaagccatctctggtgaaatctgtgatcaacacttacaagcatgtaagtaactcactttcaatgctccctaagccagagatggggactcccaaagtgaaaaagaataataaccagcctttgaagaatgctccaaagtgggtatcaagcagtgaccaaaggctcttccaagactcagatggggaagattatgacccaaatgaaatgcttgttgtggctgcagatggaactgggaactttagcaccatcactgaagccattaactttgctccaaacaacagtatggataggatagtgatctatgtcaaggaagggatttacgaggaaaatgtggaaattccaagctataagaccaacattatgatgcttggcgatggaagtgatgtctctttcataactggtaacagaagcgtcggtgatggctggaccactttcagatctgcaactctagctgtttctggtgatggttttctggcacgtgatatagccattgagaacagtgcagggccagagaagcatcaagcagtggcattgagagtaaatgcagacttagcagccttttacaggtgtgcaatttatggctaccaagacactctatatgttcactcctttagacaattctatagagagtgtgacatttatggcaccatagattacatatttgggaatgcagccgcgattctacaagaatgcaacatcatatcaagaaaaccaatgcctggccaattcacagtaatcactgcacaatcaagagatagccctgatgaggacactggcatctcattccaaaactgctcaatcatagcaacccttgatctctattccaactctagtagcttcaagagctaccttgggaggccatggaggatctattctcgcaccgtttaccttgagtcctacattgatgacttcattgacccaaagggttggacaaagtggtctaatgagcaaggattggaaactttgtattatggtgagtatgacaactatggacctggttccagcatagataagcgtgtacaatggttagggtaccatttgatggattatggtgatgcctataatttcactgtttcggagttcatcaatggagatggttggcttgataccacttccgttccttatgatgacgggatttga

SEQ ID NO: 111694 - DNA, 1076 bp, Glycine max
  Peptide Sequence Number=SeqID_228472
atgtcttaccaacaaacctgcattgatggtttccccaaagggaagatcaaggatgagttaagcaacatgtttaatgagtccaaggagcttgtgagcaactccctcgccgttgtttcgcagttctcttcgttcttttcgatcttccaaggcgccggggagcttcatcttccttgggagattaccagtgatgatgcacctgcacctactactgcttctgcttctgctgttggtgctggttttgggtctatatttggttctggttcttcttcttttggttctgcttctgctcctggtgttgctcctactactacaggtgttgcttctgctcctggtgtttctcctactactgcaggtgctgctcttgctcctggtgttgctcctggcccagttccttcttgggctgcaggctccattcctgcatgggctggtccagttcctgtttgggccggccctgctgagtttatcggatcaaatgagaaacccacacctaatgtcaccgtggcaaaagatggcagcggaaacttcaaaaccatctctgaagctttggctgccatcccaccaaaatacgacggaaggtacgtggtttatgttaaagaaggagtgtacgatgagaccgtgacagtgacaaagaaaatgctaaacgtaaccatgtacggtgacggacagcaaaagagtatcatcactggcaacaaaaatttcgtggatggagtcaggactttccaaactgcatcattcgttgtacttggaggtggattcttggcgaaagacatgggattcagaaacacagccggtgcagagaagcaccaggcagtggccgcaagagtgcaagccgaccaagccatattcttcaactgcgccttcgagggctaccaagacactctttatgcccaaacccacaggcaattctatcgcgactgctacatctctggaacaatcgacttcatctttggtgacgcctctgccgttttccagaactgcaccatggtggtaagaaagccacttgacaaccaacagaacatcgtgacagcacaaggaaggctcgacaagcaagaaaacactggcttcgtcctccagaa

SEQ ID NO: 111695 - DNA, 135 bp, Glycine max
  Peptide Sequence Number=SeqID_228473
atggaggcgcacttcgaaggaggagctgctagaatgcgtcgctggaaagtgaagagaacgattcgcattgcggcgagagggaagcacttcagagaggctgcgattagaggtcaccaaatggatccaattgaataa

SEQ ID NO: 111696 - DNA, 384 bp, Glycine max
  Peptide Sequence Number=SeqID_228474
atgacggtaaagaatcgtctttactcgttattaaaagaagcttcttcacaccaacgaaaccatggcttccgtgtacagctgtacggactgcggctccaacctgaatttgaactccgtttatgcgtaccctccggacttctacatcgaagccggcaacaagggctccgtctccttctccgccgtcgacgccaccaagttcaaattcgacaaggaggacaagattcgtcccttcttcgaaaccgtcaactactggggaatccagaggaagaggaccaagatcaagtgcaacaccttttaccgatagtcccggtcagtttcacatgggtcccagccaagtcatccccagagcgccccgatatagggagtttccaaacatgctgttag

SEQ ID NO: 111697 - DNA, 423 bp, Glycine max
  Peptide Sequence Number=SeqID_228475
atgggcaggttagagataagcctgactatcctcatccccgacctcatcaaaaggaggatcaggattaatatttattttataaactgcataaagcaaaattcgccggttatcagggaaggagcagagggcatagagcgtcgtggcggcttcttttctttcccttccctttccgtcgcggaggagtgtcacgagggcgtggatggagcccgggaaggcttcgatggtggccttgttaacgtggaggacgacaaggctggtgaggagggtggcggcgagagcatgacagtcgaagggggcggcgtgggagaggaggccctcgacgacgaggctgaccttggcatcatcgtccagggagaggtggaggaggagggagagggcgcggtggcggaggtcggcggcggagatgtgttggaggcaggttag

SEQ ID NO: 111698 - DNA, 450 bp, Glycine max
  Peptide Sequence Number=SeqID_228476
atggagatgaaaaccaacaaaacaagaaatgaattgaaagtctcgaattcaaaaacttaccggttgaagaacgaagaacgcacgaagaacggacgaagaacggtgaagaacgatggaaaatctttacaaaatttttcacgcaaaacaagcaagcttcatgatgaatcaaaattgattcaaagaagttttgatgataacaaaggtgatgacaaaaaactcaaaggtcaagaacacttcatgataacaaagatgatgatctcaagaatcaaagatgagttcaagatggaatcaagaacacttcaaagttcaaagaggaagtttgatttcaagaatcaagtttcaagattcaagttccaagaatcaagatcaagattcaagactcaagattcaagaatcaagagaagacttaatcaagataagtatgaaaaggttttttcaaaaactgagtag

SEQ ID NO: 111699 - DNA, 510 bp, Glycine max
  Peptide Sequence Number=SeqID_228477
atgactagttctcatggagctctgtttacacttttcaaccaatcttggaaaaaatttaagacccgtttgtttagagataggccaaaccctatataccctgaccacaaaaaactcttttacaaaccagatgaggtgacaaggaggtttcctctttattggcaagacgaagatcaaagattcaagtctcagggatctgaattcatcacaaccgatagatttcttacaaaggttgatttaaagctgatggattatgttggggccaacaatagcttggattccactgaggtcttcctctatatacttgttgtttccatctgtcattggaggaccacatatgatgagttggagacaaatggaaggcgaaagattgaaatcattgatggccttcagcaaaaaattgtcgatcatgagaagatggtttctatgaaggttgttgagaatgagatattggttaaggccattgaaagtattaacaagaaattcagcatcgaaatcaaggacttaacataa

SEQ ID NO: 111700 - DNA, 5442 bp, Glycine max
  Peptide Sequence Number=SeqID_228478
atggatatcagatttcctttctctccggcggaggtagccaaagtccgcatggtccagttcggaatactcagccccgacgagatcaggcaaatgtctgttgtacaaatcgagcacggcgagacgacggagagagggaagccgaaggttggaggattgagtgaccctcggcttggaactattgaccgaaagttgaagtgtgagacttgtaccgcgagtatggccgagtgccctggccattttggccacttggagcttgctaagccaatgttccatattgggtttttgaaaactgtcttaaccataatgcgttgtgtttgcttcaactgctctaaaattctagctgatgagaacgatcacaagtttaagcaggcgttaagaatcaggaatccaaaaaaccggctgaaaaagattctggatgcttgcaaaaacaaaagcaagtgtgaagggggagatgagattgacattcctggtcaagatactgaggagtcagttaaaaagagtcgtggtggctgtggtgctcagcagccgaagattactattgaggggatgaaaatgattgcagagtataaagctcaaaggaagaaaagtgatgaccaagaacagcttcctgaaccagtggaaaggaaacagactctttctgcagaaagggttcttggtgttctgaaaaggataagtgatgaggactgtcagttgttgggcttgaatcctaagtatgcccgtcctgactggatgattttacaagttcttccaattcctcctccacctgatgatttaactcatcagctggccatgatcatcaggcacaatgagaatctgaagagacaggagaggaacggatctcctgcgcatattatttccgagtttgctcagttgttgcagttccacatagcaacatattttgataacgagttgcctggattgccaagggctactcaaagatctggaaggcctatcaaatcaatatgtagcaggctcaaggcaaaggaaggccggattagaggtaacttgatgggtaaaagagttgatttttctgctcgaacagtcattacacctgatccaacaatcaacattgatcaattgggagtaccatggagtatcgcattgaacctaacataccctgagaccgtgactccatataacattgaaaggttgaaggaacttgttgagtatggaccccatcctccacctggaaaaactggtgccaagtatatcattcgtgatgacggacaaagacttgatctcagatatttaaagaaaagtagtgatcaccatttggaacttggctacaaggttgagcgtcatttgaatgatggagactttgttctcttcaatcgtcagcctagtcttcataaaatgtctatcatggggcatagaatcaaaatcatgccttattctactttccggcttaacttgtctgtaacttcaccatataatgctgattttgatggggacgaaatgaatatgcatgttcctcagtcttttgaaaccagagctgaggtgttggagctgatgatggtgcctaaatgcattgtatcaccacagtcaaacaggccagtgatgggaattgtccaagatacacttttaggatgcagaaaaatcactaagagagatactttcatctcaaaggatgtttttatgaacatattgatgtggtgggaagattttgatgggaaagttcctgctcctgcaatattaaagccagaaccattgtggacaggcaaacaagttttcaatctcattattcctaaacaaataaatctaattagatattctagctggcacagtgagagtgaaaggggatccataacccctggggataccatggtcagaattgaaaagggggaactacttactggaacactttgcaaaaagacgcttggaacatatagcggaggtctcattcatgtgatttgggaagaggttggccctgatgcagctcggaaatttcttggtcatactcagtggcttgtaaactactggcttttgcagaatgcttttagcattggaattggtgatacaattgctgatgcttccactatggaaaccataaatcagactatttcagcagctaaggagaaagtgaaacaacttattagggaagctcacgagaaaaagttggaggctgaacctggtcggtcaatgatggattcatttgaaaatagagtgaaccagactctaaatagagctcgtgatgatgctggaaatagtgctcaaaaaagtttatctgagagcaacaatctgaaagcaatggtgacagctggttccaaaggaagttttatcaacatatctcaaatgactgcttgtgtgggccaacaaaatgttgagggtaagcgaattccatatgggttcatagaccgtacattgcctcacttcacaaaagatgatttagggcctgaaagccgtggctttgtggagaactcatatctacgtggactaacccctcaagagttctttttccatgccatgggtggtagggaaggtcttattgatactgcagtgaagacctctgaaactgggtacatccagaggcgacttgtgaaggctatggaggacatcatggttaaatatgatgggacagttagaaactctttgggagatgtcatacaatttctctacggagaagatggtatggatgctgtttggattgaaaaacagatgctggattcccttaaaatgaaaaaaacagaatttgacagggtgtttaggtatgaattcgatgatgaaaactggaagcccacttacatgcttgaagagcctgtagaagacttaaaaaccatcagagagtttcgtaatgtgtttgaggctgaagttcaaaagctagaagctgatagatttcaacttgcaactgagatagccactactggtgacagttctctgtttctacctgttaacctgaagagacttatctggaatgctcagaagacatttaaggttgacttccgaaggccttctgatatgcatccaatggagattgtggaagccattgataagctccaggagcgacttaaggttgttcctggtgaagatctcttgagtcaagaagctcagaagaatgctactcttctgttcaatattctgctccgcagcacttttgccagtaaaagggtcttggaggaatacaggctttctcgtgaggcatttgagtgggtagtgggagaaatagaatcaaggttcttgcagtcccttgtagcctctggagaaatgattggttgtgtggcagcacaatcaattggagaacctgctactcagatgactctcaacactttccactatgctggtgtcagtgcaaagaatgttactcttggtgttcctaggttaagggaaatcattaatgtggcaaagagaattaaaacgccttctctgtctgtgtacttgagacctgatgttggtaagactaaagagagagccaagagtgtgcagtgtgctttagaatataccactctcaggagtgtgactcaagctacagaggtgtggtatgatccagacccgatgagtacaataattgaagaggacgttgattttgtgaagtcctactatgaaatgcctgatgaagaagttgctcttgaaaaaatttcaccttggttgcttcgcatagagctgaatcgtgaaatgatggtggataagaagttgagtatggctgacattgcagagaagattaaccttgaatttgatgatgatttgacttgtatatttaatgatgacaatgctgaaaaacttatacttcgtatccgtattatgaatgatgaagcacccaagggtgagattcaggatgagtctgctgaagatgatgttttcttaaagaaaatagaaagcaacatgctgactgaaatgaccttacgaggtatcccagacatcaataaggttttcataaaaaatactaaagttcagaagtttgatgagaatcaaggttttaagcctaatgaggaatggatgcttgatactgaaggtgtcaaccttctagctgtgatgtgccatgaagatgttgacgtgaccaggaccacgagcaaccacttgattgaagtcattgaagttcttggtatcgaggcagttcggcgagctcttctggatgaattgcgtgttgtcatttcttttgatggttcttatgtcaattacaggcatttggctattctttgtgataccatgacttatcgagggcatttgatggcaattacacgtcatggtatcaaccgaaatgatactgggccaatgatgagatgctcatttgaagagacagttgatattctgcttgatgctgcagtatacgctgagactgattacttgaggggagtcactgaaaacataatgttaggtcagctcgcccccattggcactggtgaatgtgccttgtatcttaatgatgagatgctgaaaaatgccattgagctccaattgcctagttatatggatggtcttgattttggtatgactcctgctcgctccccaatatctggaactccatatcatgaaggcctgatgtctcccagttatttgttgagccccaatttacggctgtctccaactactgatgcacagttttcaccttatgttggtgggatggcattttctcctacttcatctcctggttacagcccatcatccccaggctatagtccctcatcacccgggtacagccccacttcacctgggtacagccccacttcacccgggtacagccccacctctccgacttatagtcctagctctccgggatatagtcctacaagtccagcttattcgcccaccagtccatcctactctcccacatcaccgagctacagccccacatcacccagctacagtcccacatcacccagctacagccctacctctcccagctatagcccaacttcaccagcttacagccccacttcacctgcttacagccctacttcaccagcatatagccccacatctccttcctatagtccgacttcaccttcttatagtccaacttcaccttcctacagccctacatcaccctcttacagtccgacgtctccatcatatagtcctacatcacctgcttacagccccacatcacctggatacagcccaacctcgccatcgtatagccctacctcaccatcatatagccctacgtcccctagttacaatccgcagtcagcaaagtatagtccttcgttagcatattctccaagcagtccgagattgtctccatcaagtccatatagtcccacatcaccaaattatagtccgacatcaccatcatattcaccaacatctccatcttattctccatcaagcccaacatacagtcccagcagcccatataattctggtgtgagcccagactatagccccagttcgccccaatttagtcccagtacgggttactcaccaagtcaacctggttactcgccatcgtcgaccagccagtacactccacaaactagtgacaaggatgatagaggcactcgctga

SEQ ID NO: 111701 - DNA, 204 bp, Glycine max
  Peptide Sequence Number=SeqID_228479
atggagaaattgtttcaagttaaacgcaatttcttgaagtttctgacaaaacaacctgcggcggctttggtggtggcctttcagaacccgactaggatgagtccatgtcgatcacccgcacgtgtggtttcgataattccgaaggaagcgcgtaggaagcacaagggcgaaacctttagcgcgagagagcccacatcgcccaaa

SEQ ID NO: 111702 - DNA, 849 bp, Glycine max
  Peptide Sequence Number=SeqID_228480
atgtctgatggacttgttggtggtcatcaagagcatgctcacaatgaatgcaatcttacaagatatcccaatctatgtgctgaaaccttgatggaattgggtttagggaatcaaaatgttgacaacaatattgaggctcttgttaacaaaaccatatttgaaaccagcttgccaagttcatattttgctgaattcaagactggggaagctcaaccagctcattcagttgttgcagactattgtgaagagctaatgagcatgtcactgaaaaggctagaccaatccctgagagcactgaaatcccctaaaagaaacaccaatgacatccaaacatggctaagtgcttctctaactttccaacaatcttgcaaagaccatgttcatgcacacacctcaacactctctacagatgatcaccttatggaaaggatgtccaacaaaatggactatctctcacaattgggaagcaactcattagcccttgttaaccaaatgagcacaacaacaagccacaatattggtgataataataatgaaaaggaacatgaatttcccatttgggtatcatccaaaggacgaaaactgcttcaaggagcaaccataaaggcaaatgcaatagttgcgcaagatggttcaggaaactacaaaacagtttctgaagccatcgaggcagcttcaggaacaacaaggtttgtgatttatgttaaggaaggggtttataaggagaagattaacaccaacaaggatggtatcaccttgattggagatggaaaatactctactcttattgttggagatgacagtgttgccaagggtgctatcttacctgactccgccacatttagttag

SEQ ID NO: 111703 - DNA, 1343 bp, Glycine max
  Peptide Sequence Number=SeqID_228481
atggctgctaccatatccccatcatcacctaattaccatgcctccatatccaacaccaccatcaacaacctctttgatgattccctcaccgaaatcttctgcaagctcccatgcaaatccctcttcacatgcaagagcgtctcaaagcgatggctcaccctcatttccaaccccaatttccattccttattcctcactcaccaacacaccctcttccaaaaaacgcaagccttaggagaagaccttgatcaacccagcttcattctaaaaccatacaatgccttagtcataacaccaaattcaccctctctccaacttgggcctctcgaaaaccacctatctctatctttcctaggcccgaatttcgaacccaccaacatcgtacctcaattacgttcggtcttaaaatttgtttttgcatgttccaatggtttactagtgtatggaaaccctcgtccacgtcacagatgcatataccacatacgtaacccactcacaaaggattcattggaactcccttgtgctttaactctttgtgatcacgctggggttctcgtgggtttcacgtgcgacccttattaccatcttgaaactgataagacgaaaaacgcaaaggtatctatattttctgcttctcagcgaaggtttagggttgttcgcattcccgcgttcagcgacacgaggtctgcattcgacgttgaggttttttactccgagacaggaaaatggaagaacttcctcgtgtcgtgtcccaaagggtttgcgtgtgggttctttctcacggcgtcgagcgttgaacacgaggggaagttgtacttcatgggtggagggagggttcttgtttacgacccttatgaaaatgagcgtgtggcttcggtgattgaacttccccgtggctttggtgaagcgtatagagggtgccttggggtttcttgtggaacattgcaattatctgagtttcctatttcaccctctagtgcctttgaagcgtatagtgggagagtttgggaattgaaacattgtgggaaaggagaagaaacaacaacaacaacaacaacgtgggaattggtgcatgagttttgtctccctgaggttgttgggccaggctttgaagagttgaaggctaatgagagcgaaaatgtgaaagggtgtagtaggattcttgcttttcatccatatgttagggacaccgtgtttttgaagtttggcgataacatcatttgttgcaatttgctaactcgtaggtttaaggtttccaaatacggtggtctctccttgcttttttatcctgtgatcccaattgtgattccttggtggccaactcctattcctgcactaccctt

SEQ ID NO: 111704 - DNA, 282 bp, Glycine max
  Peptide Sequence Number=SeqID_228482
atggctccacctaaagaaattgtgaccgtcatttaccacaatggtcacattacagacgactcagttcaaggattgacacgttatatttcagcacaactactcgacaatgacgatcttagaggcgcggtggaaataattctccagaatacacaattgaattttgtcaaattctatgctgttactgaccttattcctcaaccacaaccatcgtctccacaacattcatgtccacaactacaactaccgcctccacaatacttcatacacacaactattatctaa

SEQ ID NO: 111705 - DNA, 129 bp, Glycine max
  Peptide Sequence Number=SeqID_228483
atggagacaaggagtttaagagccatgacgttatcaagcgtatccgtgggtggcggtgtgtggacaactccgatgaggaaccctatgttgttcttggagatgagggccattctgacggagtgtgactag

SEQ ID NO: 111706 - DNA, 2715 bp, Glycine max
  Peptide Sequence Number=SeqID_228484
atgggagggtactctacgaaccccgcggactacaagcttctagaagaaattggttatggcgccacagccacggtgtacagagcgatgtatctccccttcaaccaactcgtggccatcaagtccctggatctcgatcgttgcaacatcaatctcgacgacctgcgtagggaggcccaaaccatgagcctcatcgaccaccccaacgtggtgagggcccactgctcctttgccgtggagcggagcctctgggtggtcatgccctttatggaccagggctcctgcctccacctcatcaagattgctctctcccacggcttccaagaggacgctatcggatccatcctcaaggagactctcaaggccctccactaccttcaccgccacggccacattcaccgcgacgtcaaggccggcaacattctactcgacacctccggcgctgtcaaactctccgacttcggcgtcgccacttgcttgtacgacgccgtcgacaggcagcgttgcagaaatacttttgttgggaccccttgctggatggctcctgaggtgctgcaaccagctggaagtggctataattccaaggctgatatttggtcttttgggattacggcacttgagttggctcatggccatgcaccattttcaaaatatcctccaatgaaggttcttctaatgacaatgcagaatgcccctcctggacttgatgatcgagataaaaagttctctaaggaaatggttgctatgtgcctggtgaaagatcaaacaaaaaggccatcagcagagaagttactgaaacattccttcttcaaacatgctaagcctcccgagctctctgtaaagaaattgtttgctgacttacctcctctttggaactgtgtaaaatccctcaagctcaaagatgcagcacaactagcagtgaagaaaatgccttctgcagatgaagaggcaatatctcagagtcaatatcaacgaggagttagtgcgtggaactttgatattgatgatttgaaagctcaagcttcattggtgatggatgataatgataatgcagagatgagggaagatgaaaacaaatttttcactaattacaaggctagtgcaattgattcccagtctggtactgtcaaaatgaatacagagaaatcaccacagaataaaatcacatcactggtaggtgcttttgacataaaacagactgagcaaaatgaatacttgaacaaaaaggagaagaatcttgaaagtgatctccaggaacctggattgcccagaaatattatttggaagagaaatgggtcaattatggaggcaacaacatccactatagagaaagatataggtatgagccatcaaacccaaagtgggttaccaggcacagttctcagtcattctgcatcagaaaggagacgaacattagaaaggcttgagaatggaaatcagttattgggcgagaaaaataaccgtgaagcgcgacaacctccaagttttagtggtccattgatgcttccgacgcgagcttcagcaaatagtttatcagctccaataaagtcttctggaggattcagagattccttggatgacaagtctaaggctactcttgtgcaaattaaagggcgattctctgtaacatcagaaaatttagatcttgtgaaggatattcctgtaagttcagtttcacgccaatcttcacagggatcagtatcaccactgcggaaatctgccagtgttagtgattggatgttggattccaaacaaatggccactgaagattctgccaccgacagtatctctgcatcacttcttacgactcaccttcaaaatcttttacagcaaacatctattcaacaggatcttataatgaatctgttaaatagtgtgcaatctgctgaagcaattgaagtttctcagaatggaaagctgccaccattacctcgcagttcagaaatcaatggaagtgttgatacagcagcttcagagagggaacgtcttctgctgctcaaaattttagagcttcagactcggataatcactttgactgatgagctgactgctgagaagttaaaatacatgcagcccgtcctcagtcactgtgacgtcggtcttgaatggaaacaactaccattcctagtcacactccgtcagaatggccctcatctccaagaacaacatagggttcctcatcggagttgtccacacaccgccacccacggatacgctttatgctgccagggaaagatgcaataccttgataacgtcatggctcttaaactccttgtctccatctatttcagatcgatttgggaagagcttgataactataggcctgtcactccctgtgcatgtctaacaagatcttaccatcaacaagatcttgtcatacgattcctaaaaggccttgatgaaaggttctttgttgtccactcccaagtattgctcatggatcctttgccaactgtcaacaagtttgcacctactatggccgaaccagacatactatcaatgaatgctatgctaaacatggatacaccatggcatccacgctatcatggacgtccctggtatcataacccctcaaacaactacaccgtcaatagtgccgccacaagcaacattgaggaaggagacaagaaggaagaagcctctccaagctcaagtctcaaaatcactgcagctcagcatgagcgtctcattgcctctcattcgggggcctttttctaa

SEQ ID NO: 111707 - DNA, 318 bp, Glycine max
  Peptide Sequence Number=SeqID_228485
atggctgcgttattgggtatgggtgaagaattatggtcattggtgcacaaccatctgcttaaagaactgacaagctggtccaaagagtatattaacctggttaccatggacaaatggatgaatattacggatatgggatatgtcattgcttcacgatacaacgtgatcgttgtttctttttcacgacaacaaagcatgacatttttctctcttaaaagttttgttatgagaccattgtcctttaccaccagtgacgttgttgtggagtacacattgtcattctcaggcaaagcagtgacccactccgtacataggtag

SEQ ID NO: 111708 - DNA, 441 bp, Glycine max
  Peptide Sequence Number=SeqID_228486
atggggaatcatcgggcatgccaacaatctctcaggttgagccgattcaaagaagcctttgtattcggggtgcaaatctttcacaaggttgtcagcggtgttactctggtcaacttgaaggcacgatttgggtggagtgacaagagcttcattgaattgcttctgttattgaaaaagatgcttcttgaagataacatgtcgccaaagaatcactacgaggaaaagaagattttatgtccagtgggaatggagcaccagaaaatccatgcatgccctaatgattgcattttatacaaaaatgagtttgcaaaaatatgtaattgccccacatgtggggtatcatggtacatagtcaatgatggggaatgcagtgttgatgcaattgcaaataacaggtgtccaacaaggtgtgtggtatcttccaataataccaaggtttag

SEQ ID NO: 111709 - DNA, 543 bp, Glycine max
  Peptide Sequence Number=SeqID_228487
atggcattgaaagaggctattaaaaaagagttgtcacataaaggatccccagagtcactcctaattcagccggacatacaacaattaggtgcgcctgtcaacactaatggaagtaatgttgttatcaatgtccagccttcatgggaacatggtggtgatgtcataccaatgatgggactgtatgtgcagcgtaaggatggtacactagggttggtggccatggggaaaataatggagggggattcagtcatacacacagtggcttatgcagatgatgttgtaagggatgtagaaattattccgcacaacgaggatgcacatgtgccaaagccggctaatgtggacgcagatgatccgttgcgtggcctgataaagtacagttttgatatttatgagaagccagttgaaatcaactttgatgggagctgctttggaattgcagatgcacctacatcgatattcataacatattcagatgttagtgaaataatagcaggagacaaaactctgaacatatcagtacaacaattatggttaatgtaa

SEQ ID NO: 111710 - DNA, 312 bp, Glycine max
  Peptide Sequence Number=SeqID_228488
atggagcgaaacagacacggcgaggacgaggaagaaccatatggagggcgaccagtcaacattttcggaagggacaatgactacgctgaggaagaaaactggactaaggtggtaagcagaagatcaatgaaggttatgcagaaatcctctttagcgggaagacaatcacagaatctggagataggggacaacaacaaacactatcgccttaactggaggaacaatgccgacattacctccttttatttcacccatttccccgacgaagctaatgcagagttgctatggaggcacttcaaaaagtggggtgac

SEQ ID NO: 111711 - DNA, 393 bp, Glycine max
  Peptide Sequence Number=SeqID_228489
atgaggagcaccgtgcatgagcctcaagcgaacctaggggcagatcaaaaagccttgggtactaatacccaccccttcagagggctatatgccttcactttcagaggactacacgtcctcaccttcaaagggctgcacgccctcgcctttagaggactacacgttcttacgtttagagggctacacgccctcgcctttagagggctacacaccctcgccttcagagggctacacgtcctcaccttcagagggctacacgccctcactttcagcggactacacgtcctcaccttcgaaaggctgcacgtcctagcctttagaggactacccgtcctcgcgttcagagggatacacgtcctcgcctttagagggctacacgccctcgccttctga

SEQ ID NO: 111712 - DNA, 596 bp, Glycine max
  Peptide Sequence Number=SeqID_228490
tgaagttaccggatcaagttctccccgaaacttattcggaagaagattctgcctccaaaacaagttgttcataccgaagctcctgcattcacaagattaaattgttccaccggaagatccgtcttctacaaactctgcggaagaaccttctgccgaaccaccacatagttggtgcacccgacaattatgcgaatggacaaaatcccccagacagttcttccggaaaaatgttcttccggaagaacaatttgtgttctaccggaagaacctttttccggaagaaccttcttccggaagctttccgaaagaaggttcttccaaaagaacaaattgttgttctttcggaagaaggttcttccggaaagtttccagaagaaggttcttccggtagaacaatttattcttccgaaagaaggttcttccgaatgaacaatttgttttaccggaagaaccttcttccgaataagttaccggaagaacttcttccgaccaaactacccaaaacacatcctcaccttagaccagcaatcccgttacaagaccgtgataaggatgaaaatgaaactcaaggagttctggtgaaggttctaagttaa

SEQ ID NO: 111713 - DNA, 1812 bp, Glycine max
  Peptide Sequence Number=SeqID_228491
atgggccttcctatttgggtctttactccacacaggaagagagtacagaaaacccaaacaaacacgtccaaatctactaagggaacagatgttagaaaacagaaaactgtttctgaaaacaggaatcgagctaggcctaagtttttgagactggctacccgtggatgttcacttaatgttgtctgcgtgttagatttagataataataatgttgttggaacggtcttcacacaccaccaaaaatgtgtgattgtggacacacaggctgctggtaataaccggaagataactgcttttataggaggtcttgatctatgtgatggtcgctatgacacacccgagcatcgtctgtttcgtaatcttgacgatgtatttgatggtgatttccacaatcctacattttctgctggaacaagagttcctagacaaccatggcatgatttgcactgcagaatagatggacctgctgcatatgatgttcttattaattttgagcagcgatggagaaaagcaactaagtggaaagagtttgcgatccttttcaaaaaatcctctcaatggcatgacgatgctttaataagaatagaacgcatctcatggatattaagtccttctggtgctgctaccttaaaggataaatcggatgattatactgttccagaggatgaccctttagtatgggtttctagtgaagatgatcctgaaaactggcatgttcagatcttccgctccattgactcaggatccctgaaaggatttcccaaacgtgttgatgttgctctgtcccagaatcttatctgtgctaaaaatttggttatagacaaaagcattcaaacagcatacattcaagcgatcagatctgctcaacactttatttatattgaaaaccaatacttcattggatcatcgtatgcatggccagcttataaagatgcaggggctgataatctcatcccaatggaattggcactgaaaattgctagtaaaattagagctaaggagagatttgctgtctacattgttttaccaatgtggccagaaggtgatcctaaaactggggctatgcaagaaatcctcttttggcagggccaaacgatgcaaatgatgtatgatgcagttgctagagaattgaaatcaatgcagcttactgatgtgcacccacaagattacctcaatttttattgccttggtaatcgggaacactttaatgaagatagttcaagcacaaatggtgcacagttatctgctactgtagaggatgaaattttcttcatattgacaacaataatagtgagggcgagccctggtgcagcggtctcaacagcatataaatatcgccgttttatgatttatgtgcatgctaaagggatgatcgtcgatgatgagtatgttataattggatctgctaatataaaccaaagatctatggctggtactaaagatactgagatagctatgggtgcatatcaaccccattacacgtggtcagcaaagaaaagacatccacatggccagatttatggttacagaatgtcactttggggagagcatcttggcatgttagatgaaacttttgaagaaccagagagattggagtgtgtgcataaagtgaataaaattgcagacaacaattggaaattattcgcttctgaagatttctcacttttgcagggacatcttcttaagtatcctgtacaggtagattccgatgggaagattagatccctacctgactgtgagaatttccccgatgccgggggtaagatactgggggctcactccacgacaattccagatatcctaacaacttaa

SEQ ID NO: 111714 - DNA, 363 bp, Glycine max
  Peptide Sequence Number=SeqID_228492
atggcgccttttgccaaagacgtgtttcgtgaggctctcttccatatgcatccggataaatctcctgctcttgatgggttgaatctacccttttatagaagattttggcatttgtgtggggatgagcttactcttgcttgtagctctaggattaaggatggtgtttttcctccaaatgttaatgatacaactattgtccttattcctaaatgtgtcgttcctttatgcatgaaagatttacagcctatatctttgtgtaatgtcatttacaaatttttatcaaaggtgttggcatggaggggtagagttggtgatatgacgttaaaagtgaatgttagcaaagactatgatcgagttgattag

SEQ ID NO: 111715 - DNA, 765 bp, Glycine max
  Peptide Sequence Number=SeqID_228493
atgccgcctccaccgcccgctccgttccgagctccgtcgccgtcgacttctcgccgctccacctctcaccgctccggtcccgccgccgcagatccatcctcatttcctgcgattcctcccgccgtagatccagctccggcgactctcacgacaacaacaacgattatctcgaagcttctctccttctctcagcgtttcaagaatcctacgatttttctcaggatttcttgcgatggagactatattctgcccattgttgtagggcagattgctattgagaaacttatggatgcggaatctgaacatgaaagtgtggaatgtcctgaccagtaccagtttgtggaaaacctagttggaagactagaccatgaagtgataatggtgagaattacagagagagtagtcagcacttactttgccagattataccttagtcagccagggaaaactgatcttatcagtgtggatgcccgtccctcagatgccattaatgttgcaaatagatgcaaggctgcaatatatgtaagtaaagaaattgttttcacagatgctatcagaattggttatggaatgggcggagtgtgtaataaaaagactatttatgatgtattgcttgacagtgctgtagatggtccagatttggtagctcaagaactaagtatgatgcataatatgcgtatagctatcaaacaggaaagatttaaagatgcagctatatggagagacaaacttgctaatcttcgtaaatcagcccatgagctctaa

SEQ ID NO: 111716 - DNA, 177 bp, Glycine max
  Peptide Sequence Number=SeqID_228494
atgaagctaatttggtctttatgcacttcagatgagccttgggcattttgtgctattctagatttcttaaggaaccaagctaggtttgaaagtggcccttttcagtatgagcacattgtccataaagttatgtctactgccttaatctcaggcaactactcaaatgggatggattaa

SEQ ID NO: 111717 - DNA, 384 bp, Glycine max
  Peptide Sequence Number=SeqID_228495
atgtccgctccttcgatagtctcgtcatctgcgatgcgctgcatcgtggacgcaattccgtcgaaggagtgggagaagctccagagaatccttttcgtctcggcaaaagatttctcgatcggagctggcctcaagggtggcctcactctcttcgcgatcttggcacgattacattgttttatcacgtttacgataactgatgtcattcgttcatttaggaaggaaattgttgtttctaacgacgaagcaattctggcggctctgaaggaaacactaagatacggtttgtttctcgaaaccttcgttggaacgttcgtttccaccgacgaagttatcggttctatcgttgatcaccacaggcatgttctctttctctcctgctaa

SEQ ID NO: 111718 - DNA, 393 bp, Glycine max
  Peptide Sequence Number=SeqID_228496
atgtcagtgaaaaaccaccctgggcgcttaggagtacataacaagacacaccacaaaatggggtgtgtcaggtcactctcactaagtaaaatcatagggagaccagtcagggtcacgttgttttgcaagaatgctccaaccacgtgggattggcacaggcttaaaggagcattcaaaccgggtgaatttacccccaaggcctacactccgaagagtccgggacagatgtcgtaccggatgtcacgacatcacgcttcagaacatgcagattatatgcgtccgtatgaacagattaaacaagtaaataacacaagagaattgttaacccagttcggtgcaacctcacctacatctgggggctaccaagccagggaggaaatccactctcaatag

SEQ ID NO: 111719 - DNA, 255 bp, Glycine max
  Peptide Sequence Number=SeqID_228497
atgaagtcaaagcctgaaatcgaggacgcatctcactctgtctcattagctcgcaccctcttagagtttctttgcgccctttctcactcgcgccgctatcgaaggtgtctattgctaccgtggaaggtgcccagtgccgccgttgaagcttcctttcggagaagaagcctccgaagaagaaggttccttgcaccatcaagaacacaagggaactcaacgagaccgtttgcaagcccgatgatgatgaggttttga

SEQ ID NO: 111720 - DNA, 438 bp, Glycine max
  Peptide Sequence Number=SeqID_228498
atggcagggtcgaaagaaagcatcgacatatcctcaatgtggcgtgagctttgcaatttcaaggaagtctacccattgaattttggggtgaatgggggtactaacactacggaagttgttgtaacagatactattatgtttccaaaacctccagatatacagatcccaaacgctcatgatgagaatgaaccactggggcgtggctatcatgtcaaatatccatgcacttggttgcaagactacgtcatacacacgattcaaaagttgagtccttccacttgttcatcagctcaatcttatttttcacgtgcaccctatcctatcacgcattatgtaaactgtgaaaaattttctttgccacatagacatttccttgcaactattactacagaaaaagaaccactcaatttccatgagacagtgaaagatgctcgctag

SEQ ID NO: 111721 - DNA, 567 bp, Glycine max
  Peptide Sequence Number=SeqID_228499
atgtcttatttggaaaccgctaaagagctttgggatgacataaaggagagattttcagttgtgaatggtccacgcattcagcagctgaaatcagacttggcccaatgcaaacaaggaggtttgtccatggctgcacgtgtggttttgcagcaaaatttgaaaaatgcagagaagaaaaacgagggtgaccgtcccaaaaatgatgataaggcaggtggacaaagaagaggtcagaatcgcactagagtacgtgctcatgctgtacagaacttgggatccaacattagtggagatgtggagaattctggcatgacaggattgagcaaggagcagtgggaaactctgatagaattactaaacaattcgaaggtcactccaaatgaaagcatgactggtaagactaaacttaattcatggatccttgatagtggggcatctaatcacatgacaggaaccttgcaacacctatgtgatgtgaggaaagtgcctgggtgccctgttggacttactaatggacataccgccacatctactaaagaaggaacaataagacttgctggtggttga

SEQ ID NO: 111722 - DNA, 3168 bp, Glycine max
  Peptide Sequence Number=SeqID_228500
atgtcagacaataacactactcctcaaataaagtatgatgtttttgttagcttcaggggcaaggacatccgccaggactttcttagccatttggttgaggcttttgacatgaagagaatatatgcctttgtagataataaacttgagaaaggggaaaagatatggaaatcacttgttgaagcaattgaaggatcattgatttcattgatcatattttcacaaggctatgcttcttctcattggtgtttagaagaacttgagaaaatacatgaatgcaaagagaaatatggacaaattataatccccgttttctaccatttagaacccacacatgtacgatatcaatcatctgatgcattcgaaaaagcatttgctaagcatggaaaaaaatatgagagcaaggtgcaacaatggagagatattttgaagaaatctgctgatttatcaggaatcgagtcatcaaactttaaaactgatgctgagttggttaaaaaaattaccaatgttgtgcagatgaggctgcataaaacccatgttaacttgaaaagacttgttggaattggcaaaaaaattgcagatgtggaattgttgatacgcaaagaaccagaagacatccgtcttattggattatggggtatgggcggtattggcaagacaatccttgcagaacaagtatttattaaactacggtctggatatggaggttgtttatttttagccaatgaaagagaacaatcaaggaaacatgggatgctttctttgaaggaaaaagttttttctgaactactaggaaatggtgttaaaattgacacgccaaattcgttgcctgatgatattgttaggagaattggtcgaatgaaagttcttattgttcttgatgatgtgaatgattcaaatcacttagaaaaattacttggacctcttggtaattttggatcaggtagtagaatcattgtaacaactagagatatgcaagttcttaaagctaacaaagctgatgaggtatacccgcttagagaattcagtttaaatcaagcacttgaacttttcaatttgaatttctttaaccaatgtgatgatcaaagggagtatgacaacttatcaaaaagggtggtcaattatgccaaaggcattccattagttcttaatgagttggcttatcttcttcgtgcaagaaataaggaagagtggggaagtgagttagacaagcttgaaaaaatacctcttccagaagtttatgatagaatgaaactgagctatgatgatctagatcccaaagagcaacaaatttttctagatcttgcgtttttctttggtagatcacatacagagataaaggtggactatctgaaatctttattgaaaaaagatggtgaaagtggagattcagtgtttattgtgttagaaaggatgaaagataaagctctcataacttcctctaaagataattttatatctatgcatgatagtttacaagttatggctcaggagattgttcgtcgaaagtctagcaatactggaagccacagtcggttgtgggatcttgatgacattcatggagaaatgaaaaatgacaaggttactgaggccattagaagtatacaaattaacttgccaaaaattaaggagcaaaagttaacgcatcacatatttgctaagatgagcagtctaaaatttctgaaaatttctggcgaagataattatggtaacgatcaacttattcttgctgaagagcttcaattttcggcaagtgaactaagatttctttgttgggatcattgccctctaaaatccttaccaaaaagtttttctaaggaaaaacttgtaatgttgaaattgctacgcagcaaaatagaaaaactttgggatggagttcagaatttggtgaatttaaaagaaattaacctcagtggctctgagaagttaaaggagctgccagatttatcaaaagccacaaatcttgaagtactgcttctccgtggttgttctatgttgactagtgtgcatccatctgttttctctctgataaaacttgagaaattggacctttatggctgtggctcccttaccattctctcaagccattctatatgcagccttagttatctcaaccttgaacgttgcgtgaaccttagggaattctcagtgatgtcgatgaatatgaaagacctgagattaggatggaccaaggtcaaagaacttccctcatcatttgaacagcaaagcaagcttaaattgctacatctaaaaggaagtgccattgagaggttaccttcatccttcaacaaccttacacaactgctacatctagaggtaagcaattgcagcaatcttcaaacaataccagagcttccgccgctccttaaaactctaaatgcacaatcctgcacctcacttctgactctaccagagatttccttgtccattaaaactctaagtgccatagactgcaaatcattggagactgtatttctttcatcggctgtcgaacaattaaagaaaaataggagacaggttcggttctggaattgcttgaacttgaataaagattctctagtggctattgcgttgaatgcacaaatcgatgtgatgaaatttgcaaaccaacacttatctccaccaagtcaagatcttgttcaaaattacgatgattatgatgccaatcatcgctcttatcaagtggtttacgtgtatccaggaagcaatgttccagagtggttggagtataagacaacaaatgcttatataattattgatctctcttctggtccacctttccccttccttggcttcattttcagctttgtcattggtgagtacctacacacagacaccaagggcagacttgaagttagcatcactataagtgatgatgagagtgaaggcaatcaggatagtgtcagaatgtacatagattttgaaggtaggaaaattgaatcagatcatgtgtgtgtggtgtatgaccaaagatgttccagcttcctaagtagcaaggtcaaaaatcaaacaaggttaaaaatcaaggttacaatgggggtgccagattatgcactgccacaaggttataatagaggtgtgagattcggtgtcagtccaataagcacctcggcttatgagagtttcattcaacaaatgaaattgcgtaattcaatatctcagtttcattaa

SEQ ID NO: 111723 - DNA, 342 bp, Glycine max
  Peptide Sequence Number=SeqID_228501
atgttgattgtccaggaaattctagctcaaatgaagaatgttgatgttcaactcaacaatgtaatttttgatgttggtcacacttatggtattcaaaaatttgaagtagaaaagaatattggtcactataaagcaacacgccatggatttaaaattaattttgtgaaggaaactaaagtcacacctcacgaaatacctaaaacaatgtacaacttcacaatgtttgatgacattatgttattggtaaggttgttgagattgggtcgtggtatttacaatgaaagatggatgtggaagtatcatgagttgtcctttatgggagtcactggctatggagtttaa

SEQ ID NO: 111724 - DNA, 546 bp, Glycine max
  Peptide Sequence Number=SeqID_228502
atggcaactaccttcttcaccctcgcctcgctgtcactaccgtcgtcttctcgtgtttccattggcggcgctccgattcgcgaccaccgttctccgaaccaaatcaggttgttgccacctctcaaatgctcctcttcggagccggaaactgccatgcatgctccctccgaccgaactcacaagttgatctccggtgtcgccggcatcgattcctcgaaaccttgtattcctcttgccttgtttgggatggctgcgtatgggattgagaaatcaactgctcaagtagtgttgcttggagccacaacctccatggcagctgctagtgcgtattttttgtacattctaaccaccagattctctgactcgtcttgctcctactgtttactttcagctttcttgtccttcaccttgttctatgttacagtcaaggatattggattgcaagaggtgtctaaacaactgggtatgcaactgcttgttgctagcttagtgattctctcgctgaacacatcctacagcaattctaaatctgcctcctcaaggtga

SEQ ID NO: 111725 - DNA, 240 bp, Glycine max
  Peptide Sequence Number=SeqID_228503
gagtgtatatgtgtcactgtggctactatatgcaagttagtggtagccaataggtggatttatgatgggtgtcccaaatataacaaaagtgctgatgaagtgggttcgccgtttgtttgtgttgggtgtggtaataacttattaggtttcgtgtgttgcaaagatggagtatttgatgcaagagatataccggaaaaacttgatcgtgttctaggcaaaaatattagcattcagatttaa

SEQ ID NO: 111726 - DNA, 2991 bp, Glycine max
  Peptide Sequence Number=SeqID_228504
atgaaggcgatcttggggagtcaagatgtaagtgatatcgttgaacaagggttgtcgacgcttctcgatggagctatggaggagcagaaggcggcacacaaggaaaacaagatgaaagattgcaaggcgatggtgttgttccaccattcgcgagaggcttggaagattcttgaaaggtgtaacgtaggagcgaaacagctgaagaaggtgaaattacaaacccttcgtcgtcaatatgagttgatgcagatggaggaaaatgagagaatcgttgtctacctcaataggatcataagtcacacaaatgcgacaaaggttgaagagttgcaaggctcactcgaggctcatgagcaaagactcacggagagatcaatggcaaggtctggtgaccaggttctacaagatacggtctccaagaaaggtggttctggaggaagatctagtttcaggaatcgaggtaggggaagagaccagagaggtggtggcttcaaaaattcccagaatttctctcaagaccaagaaaggagtgatcaagatcgaccagaaagctcaaataaaaagggaacttccagtaaatggcatggaggaaggaaaatggttgatagaaaaaatctcaaatgtttcaattgcaacaagattggacatttctccactgaatgcacagcacccccaggtcagaatgacaatcgtgggaagcatcatgaggaaacacacctagctaaggaaggcaccgagacaaatttagaggaaaaacctcttatgctcatgatggtcacgaaccataatcccaaagatgatgaaagatggtacaatgactcaggaagctcgagtcacatgacaggacacaataattggtgtttgaatcttgatgaaaccaagaagaacattgtaaggtttattgacaacagggtaatccaagcagagggaattggtgaagttctgattaaaagagatgatgagagtagtgttatattatcagaatgtctctatgtgcccaacatgaagagcaacctcatcagcttaggtcaactagtggagaagaaattccacattgacatacacaatggataccttgcaatttttgagccagtaattgagaaactggtgataagaacaaaaatggcatctaacaaaacattccaggtaagcctcagaaatctagaatctcagtgtatgactgctgaaatcctagctaaagatacttggctatggcatttgaggttagggcatttaaatttcagggatttgagcatgcttagaaataaggagatggttctagggttacctgcaatccagattcctagtaaagtctgtgatagttgcttaatcagtaagcaacctagaaactctttcagtaatttcacaccatctagagccaatgacttactccacattgtatactctgatgtatgtgacccctttgatgccccatcactaggagggagcaaatactttgtgacattcattgatgatctaagtagaaagatatggatctatccaatacaactcagaagtgaggtattttcagtgttcaaaaacttcaaagcactggtagaaaaacagtctggtaaatgcatcaagatattcagaactgatggggatggagaatttacctcaaaagagattgaggatttttgcaaggaccagtgcattgtgcatgaggtcactgtcccatacacaccacaacataatggaattgcagaaagaaggaacataacctttttaaacatgaaaagaagcatgctcagaagtaagaagttaccacacagtttctgggctgaagcagccacaactgtcgtgtatgttttaaataggtgtcctataaaaaaacttgatggcaaggtacctgaggaagcatggtctggagtaaaaccctctgtgaggcactttaggatctttggatccttgtgttataggcacataccatatcagaagagaaagaaattggatgacaaaagtgaagctatgatatttgtagggtataattctattggatcctacaaattatataatcctaagaagagtgaagtagtgctcaacagagatgttaactttgatgagacacaagcatggaactgggaaaaatctcaagaaaggctcacctctgaattccagattgatgaagccagacctcaaagacaaaggaatctaccagctagactcagagattttgaagtatatccagataatgcaatctcaaaggatggagatttggttcaacacatggcattactggctgatacaggaccagtgagctttgaagaagctatcacaagcagagtttggagggatgctatgttagaagaaatcaagtcaatagagaaaaataatacctgggagttggtgtcactcccagtagagaaaactccaatagttgtcaaatggattttcaaattaaaattgaagcctgatggtactatagctaagcataaggccagacttgtcgccaagggcttcatgcagaaggaaggactggattactcaaaggtctttgccccaatggctagacttgaaacaattcgattactagttgccctagctagttggaaaggatgtatattatggcaacttgatgtaaaatcaacattccttaatggtctctttgaagaagaagtttctgttacacaagcccctggtttcacaaataaagggagtgaggatcaggtactaagattgaagaaaaccttgtatggccaaaaacaggctcctagggtttggaataggaggatcgattccttcttggccaagacaagatttcataaatgcagtgttgaacatggtatgtatgtaaagcaattgagtcagaaagctaggaatctctacatttgtctatatgttgatgacctactcatcacagggagtagtgcatcagaaatcgaagcattgaaggaaaaccttaagggagagtatgagaagactgaccttggtgtcttgtcatatttcctaggcttaaaatttcagaagcatgattgtggtctgtttatgcattag

SEQ ID NO: 111727 - DNA, 447 bp, Glycine max
  Peptide Sequence Number=SeqID_228505
atggggttgaaccaagcacatgtttttaaggaaaggttcatcaagtcaaggaaagaacacgctttacagagcccttaccacacgtatgctagagctagagtaatgagtgaaataaaggatgatgtagctccatgtggagcttgtaggccttggatcttcttcatcaatggattcctttgcttcttgaggtctgattgtagtggaatggagaaggagaaagatgaatgtgtagaagcaaagcttcatgatgaatcaagattgattcaaagatgttttgatgatgccaaagaatcaagagttaagcaaagtttcaagcaaagattcaagaatcaagtttcatgttacaagattcaagattcaagaatcaagtttcaagaatcaagaataaccaagatcaatattcaagactcaagattcaagaatcaagagaagactcaatcaagataa

SEQ ID NO: 111728 - DNA, 702 bp, Glycine max
  Peptide Sequence Number=SeqID_228506
atgggtgcctccaagtatagatgttggaggccatgtaaagatggaaatacaattggcaagcttaactgggtgcctccaagtactggagaattgtattaccttaggatgatgttggttgtggttaaaggactgaccacttatgaacaaattcacacagttaatggtcaattgtattcttcatttagagaagcttgctttgctatgggattattgcttgacgataaggaatatattgaggctttaagagaagcatgccattggggtattggccaattcttaagaagattttttgtaataatgctcatatctaatagcattgaaagaccaaatcaagtatggactgaaacatgggagtgtctaattgatgatgaacaaagacatatctttaatttaaccatcaatgttgtcaatggacaggctggtggaatgtttttcctgtatggatatggaggtattgggaagacctttatgtggaaggcattagcttctgcattacgttcgaaagacaactccacatgtaatatccaccaaggtacaaaacaagctgaactgttaaaggaaaccaagttgattatatgggatgaagctcctatggctcataagtattgttttgaagcactagataaaacattgaatgacatcatgtgcatgtctaattccgacagtgttccatttggtagaaaagttgttgtttggaggtga

SEQ ID NO: 111729 - DNA, 340 bp, Glycine max
  Peptide Sequence Number=SeqID_228507
cctcgatcagtcgcttattggcaaacatcttctatttttaattgaaagagaaagcactgaaggtagatgtcttcaagatgttgttaactctcctaatgcatatacggtacatcaaatctatcatcgcaagcaagtgctaaggatgtttcattctaaggagttcttaactgtggcacaagagttaggtgcaaagatagttgcacagagatcatcaattgaaaatgctaagatcattattacgcatcctgctccacctatagtgttaattgaatggattaaaaagcaaaaggaagacctcatgtgtcaaggttttggtggaagcaagaatgatgcatcctag

SEQ ID NO: 111730 - DNA, 426 bp, Glycine max
  Peptide Sequence Number=SeqID_228508
atggatatgcatcttggatccttcatttctagtcagattacactcatggcccagcacaactcctcgaggctcggcgttcctgtcctaatcactgctttatgtaaagcccggggggtccactctgatttcttgaccctggagagcctgagtcctgccattaatttggcatatattaagaagaactattggaatcttgatgatccaatagtcacattcagaggacccaggaaggccagaggtaagagatttgaggccccttccacaacaccaccagcaccagcaccatcaccagcagcagcagaggaggagaccactccagctcagagcccacagccatctccactatctgcacctgctcctaaggagattcagccttcagcactggatcttaatgaagaccaaccacaggaggagcaggacgtttaa

SEQ ID NO: 111731 - DNA, 357 bp, Glycine max
  Peptide Sequence Number=SeqID_228509
atggcttcccataagagaaaagccacaactttagtgtctcaggccgactccagtggttatggagcaaggggagagctagcctcttactccaggtttcctaaactgaggcctgatcctcaggagcttgcagcccggctatgtatccctgggacgggatttgtacttaatgttgagggtttgtcgtggaagttcttgaggaaagatcttaccactctggcccaaacctggagtgttttatcttattctaacttagccccgacatcccatacttctgatcttaatctggatagggccaagttagtctacgggcttgtaatgaagatgaacatgaactcaggatcacttatttctggatag

SEQ ID NO: 111732 - DNA, 441 bp, Glycine max
  Peptide Sequence Number=SeqID_228510
atggtgatttttcaccatggagatgcagcggaaggcaaaggagaggaggagaggggaggagcttcaccaccaagaattgccttggataagaagcttgaagtggatgctttaatggaggaaaagaaagagagaaggggggagcacgaaattgaaggaataaaagagggagagaagtggaactttgaaagtggacccaaccttgacccatgggctcacaaatctaccctaaggtttatgagaaccctaaggccttctttatcaactctagcccaatcctcttggagcctcttgctcatggctctgcgtatctatgatgcactttttattcttgatgaatcatcaaatctatgtgaggtcttgtgcattcaaattatggttgttgtcaatatggtcttcatgttccagctgaagagaagtgagattggtgcaatcattggctag

SEQ ID NO: 111733 - DNA, 516 bp, Glycine max
  Peptide Sequence Number=SeqID_228511
atgtccaacttcacaatgtttgatgacattgtaagtggctcaatcaacaaactttttgatagtggaagtatcatgagttgtactttgtgggagtcactgactctggagtttaaggattgttttgataagcatgtttctggtcttgtggtgttgttgctcagtttggctaaaatcaaagaagcaaaaggcacttattcaatagcaatccagaattcaatgtatggttctcaaatttttgtgaatactgacatgaaagaaattttggagttcaaggatcggtttcatgtagatgatagagctgttcagcctaatgagtctgtaattttgacactatgggatagagaatgttatgctttgataaaagagactgcaaatgagattaagaagaaaatgattgatgaggatgaagtatttgatgcaagagatatactagaagaacttgatcgtgttttgggcaaaaccctagcatttagatttaaggttgtccctgggaataaacgccattcaatgtcttag

SEQ ID NO: 111734 - DNA, 507 bp, Glycine max
  Peptide Sequence Number=SeqID_228512
atgtcgagttcgaaaaagaaaccagaggaagttgtacaaccccattttgagcttagacgtgatatcgaaatttccaacggtgagaatgctcggaaattggttgcaaacatgctgtttaaatttcacgacgatccaacggtgaatgagtccgagatcgtcatttatctgagacagcctggtgctgagaatttactcagagctgccactttaaagtttgaaaaattgaagagggagtgctataggcatgccatgaagctcgatggagaagaatgccaacaagctaatttaggtttggaagagaatgaagaacttgacaatgttgaagatgaagaggatgcagctgagggtaatgatagtgatgaagaatgggaagaagagcatgaactggatctttttgttaacttccctcctaatgaaattgattgtgactatgtgcaagcaaatgtcagcgaagaagaatatcaaatatacggggaagatagtgagggcaattactctgacgaatga

SEQ ID NO: 111735 - DNA, 946 bp, Glycine max
  Peptide Sequence Number=SeqID_228513
agcaactatggcttctaccttttcaccaaaacattctcgtggctatgccattcgatccataagcttgccaactagatcacatccaagcacagttccaattgaagaggagctgaacaagctcaaatcatgggaaacatcatcttcctctgaggtggagagaattttctttggtctttcaggccttgcaaacttgtacaagtgcatggaagatcttttgaagttgccactcacccaacaagcactatctcatcatcacaaccaaaaatgggttgatgagttgctagattgtccagtgagattcttggacatattgggagaaacaagggatgcaatcatgcaaatgaagggaaatgttagaggccttcaatcagcccttagaaggagaaaagttggagacttggtggttgaaagccatgtttcttcatattggattctcagaagaaacacaaggaaacaatgcacaaaatctcttgttttattgaagcacagtactgaagggtcatcatttggggcatctcctcctttggacctcaatcaccacctctcagcagttgtcagggttctaagagaagctagtttgatcaccagctccatctttcagtcacttgtggggtttctttcttcaccaatcttgaggtcaaagattaataataagtggacatttgtgtcaagagtgatgcggaaaggggtgcttcagcttcaatgcaacaatcaagtggagaatgtgaatgaacttgaaaaggtggaccttgcactttgcagaatggtcatggataatgcaaccaaggattttgaggctgagaatattcaatttgcacagaaagagcttgaggctgtggtggtagtcattgaagggcttgaaaatggattggattgcttgtttaagcaccttattaatactcgtgtgtcttttctgaatatagtttctccctcaggtagaatatga

SEQ ID NO: 111736 - DNA, 945 bp, Glycine max
  Peptide Sequence Number=SeqID_228514
atggcaaacaagtttcatgttcgctcaattagttttcccaatggatctcatcctagcaccattgcagtagaggaagagctgagcaacctcaaaacttgggaagccacatctacatccacatcaaagtccattggcgttggcttatccttgcttcaagatttgcatacttgcttggaagatcttctcaacatgggatcaacccaaaagctgatttccaaccatcaaggtgagaaatgcatggaagagcttcttgatggatcagtgagaattttggatatctgtggcatcacaagggacaccatgttgcaaattaaggaaaatgtccaatcccttcattctgctcttagaaggaggagaaagggggattcaagcattgaaaaaattatagctgaatataatttcttctcaaagaagatgaagaagaatgccaagaaattgatcacatctttaaagcagatggagagcaaacatggagtatccccactcttgaatcaagacaaacaactcgctgctttgattaaagtgcttagagaagttattgtaatgaacatgtctatcttcaaatccctgttagctttcttggccgtacctgcttcaaagtcaaaggcaaccaaatggttattggtagcaaaattattgcacaagggagtgatagcatgtgaagagaaccaagagaactacaatgagttgcagtgtgtggaggcatctttaagcacccttttaagtgaaggtactaatgttgcaaagatgcagggtgcacatgaaagattggaagctttggagaatgccattgaaagcatagaaaatggcgtattccaaagcagtaaaccaaaagaaatctgccatcccaagactgcaacagccaataacatagctccaaaccagcagcatcagcccacaacagaattctaccaacagtccataaaactaggttcatcaaagtaa

SEQ ID NO: 111737 - DNA, 876 bp, Glycine max
  Peptide Sequence Number=SeqID_228515
atggcaagcttgtaccacgttcgctcaaatagttttccttctggatctcatcctagctccattagaaaagaggaggaactaagcaaaatgaagacatgggaagccacatccacttcaacatctaaatcaattggcactggcctatccttacttgaagatttatatatttgcttggaagatcttcttaatgtggcatcaacgcaaaaagtgatttctaaccatcaaggtgagaaatgcatggaagaattgcttgatggttcagtgggaattttggatatttgtggcattacaaggaacaccatgccacaagttaaggaaaatgttcaagcacttcattctgctcttagaaggagaaagggggattcgagtattgaaaaaagtgtagctgaatataacttcttcacaaaaaagatgaagaagaatgccaagcagttgatgacatctttgaaacagatggaaagcaaatttggagtatacccaattttgaatcaagatcaagaccttgctgctgtgatcagagttcttagggaggtcatcacaatgaacatgtccatcttgcaatcccttttgtcttacatggctggacctgcttcaaagtcaaagtcaactaaatggttgatggtggcaaggttgatgcataagaagagggtaatatcatgtgaagaagactctcagaatttcaatgagttgcagtgtgtggaagcatctttaagcacccttctaagtgaaggtactaatgtttccaaggtgcagagtgtccgtgacagattggaggctttggaaaatgccattgaaagcctagaaaatggtttggagagaatgtttaggcgcttggttagaacaagagccaaccttttgaacataatgactcaatag

SEQ ID NO: 111738 - DNA, 867 bp, Glycine max
  Peptide Sequence Number=SeqID_228516
atggcaaacaagatccattttcgttcaaatagttttcccaatggatctcatcctagcacaattacagttgaggaagagctgaacaagctcaaaacttgggaagccacttccacatccacatcaaagtccattggcattggcttatccttgcttcaagatttgcatacttgcttggaaggtcttctcaacatgggatcaacccaaaagctgatttccaaccatcaaggtgagaaatgcatggaagagcttcttgatggatcagtgagaattttagatatctgtggcatcacaagggacaccatgttacaaattaaggaaaatgtccaatcccttcattctgctcttagaaggagaaagggggattcaagcatagaaaaaattatagcccaatacaatttcttctcaaataagatgaagaagattgccaagaagttgatcacatctttgaagcagatggagagaaaatttggagtatccccactcttaaatcaagaccaacaacttgttgctttggttagagtgattagggaagtcattgtaatgaacatgtctatcttccaatcattattatctttcttgaccgtgcctgcttcaaagtcaaaggcaaccaaatggttattggtagcaaaattaatgcacaagggagtgacagcatgtgatgagaaccaagtgaattccaatgagttgctgtgtgtggaagcatctttaagcacacttgtaagtgaaggtactaatgttgcaaagatgcagggtgcacatgaaagattggaagctttggagaatgccattgaaagcatagaaaatggtttggacagcgtatttaggcgcatgggaataccgggtaaacacaagggtgatctctattaa

SEQ ID NO: 111739 - DNA, 2718 bp, Glycine max
  Peptide Sequence Number=SeqID_228517
atggcttctactgccccaaactcagccttgaagagatcagattcgatcacagatagcatgccagaagccttgaagcaaagccggttccatatgaagagatgctttgccaggtttgttgcaagtgggaaaaggttaatgaaacagcagcatgtaatggatgatgtggagaaaacagttgaagataaagctgagaggaaaaagtttctagatggcatgttgggttacatcttcagttgcactcaggaagccgctgttgttccaccatatgttgcttttgcagtgaggcctaatcctggcttctgggaatatattaaagtgaatgctgatgatttgcaagtagaaggtattgaggctgtagaatacttgaagtataaggaaatgatatttgatgagaaatgggcaaatgatgaaaatgctttggagctagactttggggctattgatttctccacccctcagatggttctttcttcttctattgggaatggactaaactttacaaccaagatcttgacctcaaggttgagtgggagctcccaaagcataaatcctttgctggattacttattgagccttaactatcaaggagagaatcttatgatcaaagacactttgaataccatgccaaagcttcagcaagcactgaaagtggccgaagcatatgtatctgcactcaacaaagacacagcataccagaaatttgaagacaggttcaaggaatggggatttgataaaggttggggcaacacagcaggaagggttaaagagacaatgaaattgctctctgaggtactagaatcagcagatccagtgaaattggaatcacttttcagcaggcttccaaatatgttcaacatagttatcctctctattcatggatactttggccaagcagatgtcctaggattgccagacactggaggccaggtggtatatattcttgatcaagtaagggccttagaggaagagctactccataagattgagctgcaaggccttgacgtgaagcctcagattcttgtggtaactcgtctcataccagatgccaaaggaaccacatgtaaccaagaactagaacctgtcaccaacactaagcactcaaacattctcagggtccctttctatacagacaagggaatgcttcgccaatgggatgctactgccaagatttttgacctcatggaagacaagcctgacctcatcattggaaattacactgatggaaacttggtgtcatccttaatggcttctaaacttggagtgactcaggcaaccattgctcatgctttggagaagaccaaatatgaggactctgatgccaaatggatggcgtttgatgaaaagtaccacttctcatgtcagttcacagctgacataatctcaatgaatgcagccgatttcatcataactagtacataccaagagatagctggaagcaaacaaaagccgggacagtatgaaacacacactgcattcaccatgcctggactttgtcgcgcagtctccggcatcaatgtgtttgatccaaagttcaacattgctgcacctggagctgatcaatctgtctatttcccttccacagcgaaagagcagcgattgacctcatttcatcctgccattgaagaactactttatagtaaagatgacaatgaagaacacataggacttttggaagacatgaagaaaccaatcatcttctccatggctaggcttgacaaagtgaagaaccttagtggcctagttgagtggtatgcaagaaacaagaggctgaggagcttggtgaaccttgtggttgttggaggattcttcaatccagccaaatccaaagacagagaagaaactgaggagatcaagaagatgcatttcttgatgaaggagtacaatctcaagggacaattcagatggattgcagctcaaactgaccgctatcgcaacagtgagctgtaccggtgcatttcagatacaaagggagcttttgtgcaaccagcattgtatgaggcctttggtcttacagtcattgaggcaatgaactgtggactacctacttttgcaacaaatcaaggaggaccagctgaaattatagttgatggggtctcaggctttcatattgatccttataatggagatgaatcaagtgacaaaattgctgacttctttgaaaagtgcaagactgattctcagcattggaacagaatgtcaaaagccggtcttcagcgtatcaatgaatgctatacatggaagatatatgcaaaaaaagtcttgaatatgggatcaatttatggcttttggagaagattgaacagggagcaaaagttggcaaaggagagatacatccatatgttctataaccttcaattcaggaacttggcaaaacaggtacctattcctagtgagacaccccaagatcctacacaaatgccaaagccttctgctccagctccatccagaagatcagcagcaaaagcaaggcctaaaaaagtttctgaacattggatagttggtgctccactaaccctattaacagcagcagcaacaccaaaaattaaagatcatccaacgccaagcggtgaaggtgtgagtgagggaacagctacttctgaacaaagtggtggtggtggtttgtttggattacgttggttggtccccataattgcttttgtgtgcgccattcattatttcttgaagaatttggatcgtctcttcacaagggagcaatga

SEQ ID NO: 111740 - DNA, 282 bp, Glycine max
  Peptide Sequence Number=SeqID_228518
tggaacgaggataagggctacgtgggagtgcgtgagctcaatttgaagagtggtacctggagatatgtcgcgggggtcaggagaccttggggacgtcagggtgacagggcactggtaatcgattaccagttgggtgtaatcgatctgtggaggtcgatctgtggtcatgctgggtctccgactctcttgataacattgaagcctcatctagagttttcctcttttcgtgatgcactgtcgctagtagtccctattgccacaatgtattacctaagaggatga

SEQ ID NO: 111741 - DNA, 318 bp, Glycine max
  Peptide Sequence Number=SeqID_228519
atggaggccatgaaagagcaaatgaccacaatgatggaagccatgatgagtataagaaaaatgatggaggtcaacacagctacagtcattgctgcaagtaccaccactgaggtggactcgactcacctatctggcttcaatcaaggaggcaaagcattgggaagtgcgggcggcccccattttgtgcaggttcagaacaagcattccttcccaccatatggcttgcctcccaactatacaccacccaatgttacacacactcccaatgagaatgtcaacaactctgcacccatacccattgagagccaacaaccctaa

SEQ ID NO: 111742 - DNA, 435 bp, Glycine max
  Peptide Sequence Number=SeqID_228520
atggcaacggttaagctaaagctcgatagtgtttgggtgaaaagaaggtggccacaaaatatttttgctgtcataaaggggtctaaagatgatcgatatgttctgcttgggaaccatagagatgcatggacgtatggtgctgttgatcccagcacgagaacagctgcactactcgacattgctcgtcgattttctgctctattggacttggggtggaagccaagcgagactatcattttctgcagttgggatgctgaggaatttgggatgataggatcaactgagtgggttgaacacaatcttattaagcttggctccaaagctgtaccataccttaatgtggactgcgctgtgcaaggtcctggtttctttgttggttcaactcctcagctagacagtcttattcttgaggtcacaaaaatggtatttagttga

SEQ ID NO: 111743 - DNA, 276 bp, Glycine max
  Peptide Sequence Number=SeqID_228521
gatgtcacaactttcaaggtgcttcttaatgaatacaaggccacgtgcagtagcttggatattccaagtagtatgtactactttatgaaagagaaacggttcacacaattgaacataacagactatgtcgaatgccatattgtttacaatgactggcaaaaaatggcaaaaattggatctggatggagagatttttccaaagcccaaagcttcaaagctgacatggaattagtgttcgaatttcctgaccccaatgtcaactatgctttcatttag

SEQ ID NO: 111744 - DNA, 885 bp, Glycine max
  Peptide Sequence Number=SeqID_228522
atgacggaagagaatcatcctccaagggttacacttaaggatcatgccacatacactggtccattgcacttcaacacaattgaagccagcattcaccagtgtgcaccgtttgtaaagatcaatcatgtattggatgaggctttgcgtttgtgcttgtttcccttctacttggctgaagatgccatttcatggttgagatccttccctcccaacaacttgactagaactcaaagtaagcttatgcttgatgcttcggctggggaaaagatctttcttaatactccaaaaaaggctatagagatcattgagaaaatggctaccaatgctaagaaaattctaagtgatagagccatggtcccattaaagagacttcttgaagttagcacccaagatggtctcttagcccaacaaaaactgctcactaggaaaattgaagagcttacacaacaaaacaataacttcctcaacaattcaagcttcaaacagttgcttcagaccataaactccaataacaatcaaggctacaaaccttatggaagcataggtcaagagcaagggagtagttctaatgccatgcctaggcataatctttatgagaagacaagaaaacttgaggagaccctcactcaatttatgcaagtatctctttccatccgtaagagcattgaagcctccatcaaggagatccttaaatcttctatcaagtgtcaagctcgtgacattaaagaagtgctactcgtgaggcaacccaagaattttaaacacttgcatcatcagaagtatggagcaaaattgattcatggaggtgaggcactctctacttgtaagctcactccagcagagagggatctcgccacaatgaaagctttggaatggcaacaataa

SEQ ID NO: 111745 - DNA, 510 bp, Glycine max
  Peptide Sequence Number=SeqID_228523
atgaaggtgttagagaaacatgatcttgatgtcgaggctttggacaagtttaataaggaggaggtggcaagattggggtctgctttggccaccactgagagggaaaataatgctgaaagggaggagaagcttcagattgagcagataacatataacgatgcttacgaacctcatgaatgcagcttcaatcactgcctccgacaaggggaaacgacgacccctgaacttgtgtttttatgcttttttgtgaagttaatggctgataatgccatttttagtatttcttatggttttagccttttaaggacattagggatcagtattcattggaaaaagatgttaagttcaatcttagctaaagagggtatttgggaaggaacgtgtattgatgcaatcctccctaggaagggaccaatcactagaaccatgagcaagagactgcaagaagattgggctagagctgctgaagaaggccctagggttctcatgaaccttaggatagatttctga

SEQ ID NO: 111746 - DNA, 369 bp, Glycine max
  Peptide Sequence Number=SeqID_228524
atgggttgtcgaagggaactccaacatttgttacttcatcctcttcaactctttatgcccaagatctttgtgctcgaaaggttccgcctagccattcttatgattatggctctgcttgttattcttgggtttatcttttcccttgggctctttcgtagtaaggggtggtatcctcctgggggtttggacttagaatttgctcgattcattgtaacttcacaattctccattcatctctcttgctcaccccaattcactaatgcattctaccccagctcctacaaggtcgcaaattctaaactacttgcccgatacctaatcccttgcacataccgactcaagaaatcaacattaatggtcgagaactag

SEQ ID NO: 111747 - DNA, 1242 bp, Glycine max
  Peptide Sequence Number=SeqID_228525
atggaaaaagaccaagaggctcagcatcatagggaaaatcaagggtctttggttactaccgtgaaagtagaagggtcagaggctgttaacaacaatgagcatcgttcttgggtgtgtcatatctgcaagaaagggttcggctcaggtaaagcacttggtggacacatgagaatacacaacctttccaagaagcagcaggttcatagggctaaacaaggcactactattgttgcaaagcccaaaaccaacaaatgggtgtttgtgagtggcaaccccacttgttctctttgtggaaagagcttttcttccatgaagtccttgttcgggcacttgaggtctcaccctgagaggatgaggaaggggattcaaaacaacactccttcaatcaatggtgcatcctccaattccacatcttcatcaaccctttctgatgactctactgctgttgatctctcccaagctctcaggggttgttggtctgtctctgccaagagaggccgcagaagcccttcttgtagcaagtcaaattctggtttagaagatgatggggaaattgagccacgtatgcaagaggctgtgtataacctcatgttgctggcaagtgggaatcccaagcgggaggaagagcttgacggtgatcagattgaagagaagaagctgttaaacccagtttttggggattctgatgagatgaagagagatagaaagagagtgacaaagaaaatgaaattaacagaattagaagcagctgaggagggggacaagctatgcagaatatgcaatacaactttcccaagtccccaagttttagagggtcatctatgcagcagcaaaatttttaagaacattcaagtcatggatgaatctgaatcagatggtgtgttagccacaaaagaggagcatcatgccaaaaaaccaaccatgcaaggagaggaaacaactgttcttgggggtaatgctgtggaagccattagagggtatcattgtaaaattttcatcaagactttctcaactggtcaggtctttggggaccacaagatatctaattggaccagcacggcagaagctcagtcatcagctcaagcaacttcctcacctgtgggaaatgctcagaattgttccaagattttgacttttgatcttaatcagcttcctgctatggatggacaagatggtgttcaatcagacttgtttattcctgccaatattgtgacatcattcagttatggttcctcctcctaa

SEQ ID NO: 111748 - DNA, 294 bp, Glycine max
  Peptide Sequence Number=SeqID_228526
ttgatccggaagaggcttacggatcaggtgatccgtaaacagcccaacaacttcccaatggcgatttccgccatcgacgacaacaatggaggaagaagaagcaacgcgaaggagaaacatacctcgaggaagaagctaagtgtcgaagatgaagcagaaacgcgaagaagaaccacacccactgtcctacgcagaaacgcgaagaagatgccaagaagcagaaacgccaacagcagtgaagaagatggaatcgcggcggcgcacaagaagaagattgaagaatcagatgaatga

SEQ ID NO: 111749 - DNA, 468 bp, Glycine max
  Peptide Sequence Number=SeqID_228527
atgtcaactagaaaatatgaatcatgcaattcaaaacttcagaaaaagagaagagttgaggctttaattgcatcacaaaaaggagctatgtataaatttataaaaacagatgagaaaaatggattagaaaatacaggtcggtgctctttgaatgaacaagataacaatttagatataagtgaaaacaacaatagagaagtagttagtgatgaggataattataattctgattctcaaactcatgataacaaggaggagattgggagactagatgattctacttttgaaaatatatatgatccaagccaatggaagaatattgatacgactttgagagatttattagtgaaaaatggccctattaaagttactgatatggatttcccaaagggtaaatattctaggcacttttcttcatcaaattacattcaaaagttgcctaatggagaaaaacatgaaagaaaatga

SEQ ID NO: 111750 - DNA, 297 bp, Glycine max
  Peptide Sequence Number=SeqID_228528
atgagtgatggattttgcggtactcatttgcagatcatggttaggaccagaggattaggtcgtgccttaggtcagcgagtcgctgtgactgcggagcacgtcgatgagccagtcatcgctgacccagacgttcaggatgacccgatggaggcaccagctgctgtggaggacattcctgcggacgcaggcgcagaggcggctgaggatcagcctcagggatttccggatggtccgagcgacccatctgtgctgacagcatatgcggatcacgttgcttgcagcgtatggacgggagag

SEQ ID NO: 111751 - DNA, 231 bp, Glycine max
  Peptide Sequence Number=SeqID_228529
atgtttggagaggacaaatggttgtatcaaagaactaatgatggtcatcgaggaagaaagtggagtgaaagaggtgcacccatcattattactggtgcacccagcattcttgaaaaatcccaaaattacccttacttagttttccactttcggatcagcttgatccggaagagacttacggatcaacttacggatcaagctgatccggaagtctcttacggatcaacttga

SEQ ID NO: 111752 - DNA, 180 bp, Glycine max
  Peptide Sequence Number=SeqID_228530
atggaagaccatggattgtacaacaacgaagacttcttcaggtgcaaggtggcagagaacaaaaatgtagtgtgcttggaatggtggaggcgttcgacgtcgacagaggctatggtgtccagcgttgacggaggctatggtgtatggcgtccacaaaagaagttgcaggggttggagtga

SEQ ID NO: 111753 - DNA, 345 bp, Glycine max
  Peptide Sequence Number=SeqID_228531
atgacacgacgaatgaaatccgggggaaaaaacaatgaaatcaacaccgcaatggaagagatttggcaccatttgcgaatgtgttttgttcccgaacctttccctggcaacaaggtcattgagcaaggtaatcatactaggctcacaatgaaggccatggaactgggttacttcggaatcccttacaagagcgacgacaatggagtcgtggcgcagatgattcagggacattgcggagttacgttggtcattgttggaggcatgcatggtagatgtaggagaagaggacactatggaagaaatgttcatgataatattatacaccttgatgaatctaaggactaa

SEQ ID NO: 111754 - DNA, 204 bp, Glycine max
  Peptide Sequence Number=SeqID_228532
atgtcccgccaggagaaatggtggtacacgttttaccccttacctgtcccgctgctgcgactggcggtatccactatcccgccattggcactggcggttcaagcttcccaccagtgtcgatggcggtacccacttgcattgaaattggaagtatcagcaggattcaaggttgcatatgaagaaattcatggaattcagatctag

SEQ ID NO: 111755 - DNA, 399 bp, Glycine max
  Peptide Sequence Number=SeqID_228533
atggcaacctgtgtgaatcagattctaccacaaaagtttttaaaccacgactccaaggaatccggattccaaatagaatctcctgaagctcatcttgcaccacagagcataaacctaatttggaagcaaaggcaaaaaaaaactcgttcgctatggtctcttaaaaactccacatgcaattgcaatactcccttactcctgaacaaaaccatcacaattaagcttgtattgacggctgggaggaggcacaggcgaaagggaaatggatcctctccatttcctttttcatctatttcctccatttcttcaatttttataagcttttggaaaaataaatcaaatggagatatgataaatagaggaatctcttcaaaagcatgtggagttggaaagcactaa

SEQ ID NO: 111756 - DNA, 749 bp, Glycine max
  Peptide Sequence Number=SeqID_228534
cgtcggtggacgagacgccggcgttgcgcgtttcgggcgtcggtttgggaacggagacggtggaaactcgcgagctcgatctgagcgcgcacgaggcggtggtggaggcggtgcggaagaatctgacgctcaggatgtatgcggtggtgtcgagacgcgctcggacgattttcgaggaggatgaggcgtacgacgcgcgggacgtgttggtggcgtcggtcgatttgacgacgcggcggcggaaaaaaatcgtcaagacgaggaagcttttgggagcgaaatcgtcggacgagggtgagacggtgacggaatcggtagatgacggcgtcgaggacgagggtgaggaggacgcgtcgcgcgagacggtgatgacgtattttaaaccgaacgccacgctgacggtggtggacgattttgtggcgtacaacccaaccactctgccggatattttggcgtcgcagatgcggttcacggatgagaggcgctcgagctacgatcccacggtgtactttaacgagttttggatgattaagagttacctgcgacagttcaacgagacgagcgccgcgacgctcaaggttaactttaatttcgaagtgctgtcgcagcttcgatggcaaatgtacacgtccatggaacagtcgtggaagacgcagcgagattttggcgcggcgggcgaaaacgacgcggacaacatcaagcgcgtattcttggaaggtaatccggtgttgctcgcggtgacgagcgtg

SEQ ID NO: 111757 - DNA, 770 bp, Glycine max
  Peptide Sequence Number=SeqID_228535
atgaaggagcaactgaccagcgtcattggttcgaaatcggcgcgacccaaatgggcgggcgacgcgttttcgctcaattgcttgctcgccattcgggaacctctgcgtacgtacccagccgcgggcgcgaaagtggacgaactctcgcgcgccatcgcgacgaaaatctcgcacgtcgcggacgccgaggctggtaaaattctctcggcgagcggtttgagcgacgccctcgagctcgtggtgttgtaccaagagcaaggattttcgagcggatcgagcgtcatggcgaacgatccggcgctcaagattgatgccttagccaccgcattatcgtctctcgtcgacgccgtcggcacggacgcgcccgagtttgaacaggtgcagagtcccgccgtcagaagagacgtcgtcgccagatacaacagccagctcgtcgaggcgtacacgcgcgtctacgccgccgtgctcaatcccagcgccggctacggcgccgacgcgcgctctaagatcagacacggtccggacgctctcagcaccgtccttggcgcagatggtgttgagcgcgcgagcggcgtggagagggtcgcgcgcgcggcgggacgcgcgatggacggcggcgcgcggtcgacgtcgacgcacggaatgtcgaggcgtcagccgagcgggtcgcgaggcgcgtccggcgcgcgcgcatcggggaagagggagacgtcgaggctggagatgctcgaggctttggagagggagttggacgagaccgagtcgctcct

SEQ ID NO: 111758 - DNA, 585 bp, Glycine max
  Peptide Sequence Number=SeqID_228536
atgaggtttggagtcgcgaggttgcttgaaggttttggaaataagggtttagacgagatgagagtggctgagagtgagagccagaagagagtgaaacaaactcaatttgagaaaaaacacaatgtcggtttatataacatcgacttacaacattgggttacatcgggttttgaaaaaccgaagcatacaagaaagattttaaaggaagcaataagagaaatatgtaaaatacatcagttaagtgcattcaattccttacatatggatggaagttgctttgggcaacctggtacagctgggtttcaggctatatattcttcgagatcgtacaagaaaatggttgaagggcttctatggagatattggggaagtcgattgataatctcaaagtggagatttcaatgttgtgtgttggattgcaacttgcttggagtacccaatttagggatattttatgcatctcggtcagactctctacatgcggtaaagttggtacagcagtcggtgagggggttcattttttacgtgggtgctgccattgacactggcgggaagcttgaaccgccagtgccaatggcgggatag

SEQ ID NO: 111759 - DNA, 477 bp, Glycine max
  Peptide Sequence Number=SeqID_228537
atggaaatgtcctgtttggatgcttggtattctgacagagatggcaccttagagtgcccaacaacatacatcgtgaaaggactttgtcggtggtgctgtctcccaaaagtcattctttattgcatgcaaagctggttggcaatcctgaaactgactttcttcacttgtttagtcaacaacaattacaggcaagattataatttcacatttctcaaagaaacattagaggctctttgctttaaacttcatcctttgtgtgttagccgcaaagttatgagacctatagtcgtatttttttcattattgtcttcaacacacatgagtaattggatggagacagacatgatatctgttatgaatcagcccatacatagcacagacaagggcaaggaattattagacaaagatgagacaatcatgcatccaagaaacaagattaggataatttcaaaatttgttagtgctagcaccatctag

SEQ ID NO: 111760 - DNA, 291 bp, Glycine max
  Peptide Sequence Number=SeqID_228538
atgtggaggattccaccgaaacacgcagaaacagctctatctgcacttttgagccttatgcctcatagctcctccaagctcctctctcaagtcaatcagcccccaagtctccctttttctttttccccaactttcttccattttccacaatttttggttttgtgcaatgtggaatgtgacaaggagttcattttgtgcgaatacaatagagatgtcgactcttacaagttcatttcatttttcataatcatccctcctgtatctggtttttgctggattcaatatgcttaa

SEQ ID NO: 111761 - DNA, 195 bp, Glycine max
  Peptide Sequence Number=SeqID_228539
atggagaaggtgctgatgatggggtcgtccgtgccggagagggtggaacgtttgccgagtaaacaaaaccagcacaccccctacgaccttcaccctctttctttaaatattaagcttcctctattgctttacaagtctcttcctcagttgttcaacaacttcataatagctctgacattcaacctcctgttttga

SEQ ID NO: 111762 - DNA, 357 bp, Glycine max
  Peptide Sequence Number=SeqID_228540
atgtatgcgatgcgtcatttgaattcggagaatattcttcatctgtttcatgattgtggtcccattaaggtggcttgggctttgctgattcaaggaagggtggatggaatttttttcgttgagactaattggcaggttattgatgctaaaaaagtgatttatatggataatatgataggttcttctgttatagttcaacaagatatccattgggtgccacctaagtgtggggaagttagtctaaattgtgatgcttcagtcactgacatgggacagcatgtggtggccttattaggaaagtggatgatgtttttatttgtgattttgctactcaagttggggaatgttctattctga

SEQ ID NO: 111763 - DNA, 300 bp, Glycine max
  Peptide Sequence Number=SeqID_228541
atggcggctcacatcatacgagccggcataattgatttcaaagaatgtgatggtcaaattgatgggttaacattctcggagcagtcgcaaagtgggagaaggaacaagaggaactttggaattgatttaggggaggttgctgcctctttagggaaggtgagagcaaaagagaaagaagaagggaaaaaaggagagggaaagaaaaaaaaaaatagggtggggcgatgcgtcaaaaattgcttccggcaagaacatgcgtcagagatcggcggcatgcgctatggagggcctataaaataa

SEQ ID NO: 111764 - DNA, 387 bp, Glycine max
  Peptide Sequence Number=SeqID_228542
atgatttttcactctcctcttctccaaaatgccacccaaaccctaacacctccttctccaccacccacgaccaccggtggctgccacgagctgccgttgcttgtcgtcgaacccccacaccaagaggaacatcttaatcagagcagaatcctcctcaaggattcggtggagaaagttcccccaatcctccatttcaaagcttctctgagtgaccttgttggatattcctgctgggggaaaaagagtgtttcttatgaggaggaatacttgtacttgggggcatgccactcgatttggaactcccttaagactcaggctgatcaccgtgaggggggggggggagggttgcctgtgcacgacagggtgaccttgacacttactgtctag

SEQ ID NO: 111765 - DNA, 135 bp, Glycine max
  Peptide Sequence Number=SeqID_228543
atggttcgcgctctagcccttcccaaaatggtaaagtcaacgaaattaagagaatacgaaatgaaaaacaggatttggtgcaagtgtagggatagaactctgactctgggttggtctcttgccgacgatggatag

SEQ ID NO: 111766 - DNA, 360 bp, Glycine max
  Peptide Sequence Number=SeqID_228544
atgctaaggttccattgctatgctaacagtgatgcacattacaagctaagggtaaggggaaggggaactaacctgttcgcggagaagaagaagaaagccttggcgcgcctcgcggagaagaagcttcacggagaagagaagaagcaggttccgggagaagaagaagctgttccgggagagaagaagctgtgttccgggacgggagagaagaagaatttgttcgaaaaaaactggcaaaatggtactttcaatcaattgctgggtgccccagcaataatgctgggtgcacgtagcaactcccgggttgcttatgcaagttgggtgaagttcagtagggtccgcaaagtaatgaaccattag

SEQ ID NO: 111767 - DNA, 429 bp, Glycine max
  Peptide Sequence Number=SeqID_228545
atggtgacccttggtggagcagatcaacataagaagtcaagagcccccttcagtctccgagctctaaagcaggctaccgagtttatgtccgatttgggttgcctttcctctaccagcccttcgtgttcgccttcagatcctccaattgttcaagttgttgctgcaactgttgctgactctccagctcttccatctcctcatattcaagtggttcctgctcctccttctactgtgttgactgtgtcaacccccttagcaattcttgtttcaatttcacctacttctattgcaatattattgctaagtgctggtgtaacaacaaatgtcctaggacacttgtctcatccttctttagctttcccatctccagctctgactgtcttgcctttgacaatgccttcctcctctttgcatccaaatgtctcataa

SEQ ID NO: 111768 - DNA, 233 bp, Glycine max
  Peptide Sequence Number=SeqID_228546
gacgaatcccaactctctttgaggtttcgtttgtaatgtggtttcctggcagttttcccttcaccagttatcccaatttcgtgaatattaatcagtgcacgcttcgtgttcgattaattgcctctgagcctaacttgcgttcatgcttaatggacgaagggctaactggttggttgactgttagggacgaattctccataacccaggataagagagtggcttctgaatcagag

SEQ ID NO: 111769 - DNA, 183 bp, Glycine max
  Peptide Sequence Number=SeqID_228547
atggcggctcgcggcggtcaccagtggtcgtgggtggtggagaaggaggtgttaggagagcttgtcttgctaagaaggagtccacttttctcgcttagcatgcaaattctcgctcagcgcaacttcctctacactatggctcgctcagcgggccaattctcgctcaacgcaattccctcttga

SEQ ID NO: 111770 - DNA, 474 bp, Glycine max
  Peptide Sequence Number=SeqID_228548
atggaggattcaatcgggaaaataacaaagatcacatttcccagtcaagacggtccgctcttgacggtgaagaacacgttggagaatggaggattcaatcgggaaaataacaaagataacatttcccagtcaagagggtccgctcttgacggtgaagaacacattggagaatataggaatcctatcgggaaaataacaaatatcatatttcccagtcaagagggtccgctcttcacggtgaagaacacattggagaatggaggattcaatcgggaaaataacaaagatcacatttcccagtcaagagggtccgctcttgacggtgaagaacacattggagaaaggaggaatccaatcgggaaaataacaaagatcacatttcccagtcaagacggtccgctatcaagcttatcgataccgtcgacctcgagggggggcccggtaccaacttttgttccctttagtgagggttaa

SEQ ID NO: 111771 - DNA, 372 bp, Glycine max
  Peptide Sequence Number=SeqID_228549
atgttactcagatactataatgtcgtaaaaaaccttgttgatgatttcgattgtttcgagatgtaccacataccaagggaaaacaatactagggcatacttgctctccaaggtggccactaagaagactggacaccttaagaccatcatccgggagacactccaagcaccaaccatagacaccaaagaggtcatggggtgttactatgtcatccttgatggtgaactattcaaaataaggatgacaacacccttgcttaagtgcctgaacaaccaacaagtagactacgtcatgtggaagttgcataaaggaaactgcgacctgcatactgggggtcgctctttggcaaccaaggtagtatgcagtggctaa

SEQ ID NO: 111772 - DNA, 246 bp, Glycine max
  Peptide Sequence Number=SeqID_228550
atggaggattgccttgagggtccgcacttaggcaatcatgaaacacagctccaaactcgaaggtggaggacacatgaacaacgcaaggcaataacattcatagggctccgaaaaagggggagaatggaggattgccttgaaggtggtgtgggatatcgccagtcgagaacgaccttgaatggcaatctgaagggaagagacaccaaaaatgggttttcctttgccggcaatcccttaccttgctga

SEQ ID NO: 111773 - DNA, 1365 bp, Glycine max
  Peptide Sequence Number=SeqID_228551
atgacctctttggtgtctatggttggtgcttggagtgtctcccggatgatggtcttaaggtgtccagtcttcttagtggccaccttggagagcaactatatgtctgtatttgtgactggtgaggtccctactgagctaagtacattgtctaggcctttgttgatagcgtcaccgcgtggtcaaggtctttgttgggggttctttgtccatgctcatgacttgactgtcactgccaccagaggtggtatgaggcttgcatggctccctaagataaggagcaaccttcaagctttcagcatacctctatcgggcctgctttcggtttgcctcgacaattatgatttctccgatcaaggttgggaacttcatcttaagtatacttgtggaactaccttggtcgatgaggactttagacaccatgaaattggtgatgacaatggagacaaccatgggatcatcctggttgatccttttgaaatctttgtcagtgaatgttatgggagggaggcttcttggttactatatgtcgacccagttgacgtttgtcttcttgctcttgctaaggttgacgttcatgcctctaggagtgatgcctatgtctccctccctcctctattcggtccctctttctatcagcatctcggctcctgcaatggtcgtcctagtgccccccgaccctacttcctttttggttgtcatcaagcttttttacgaattgggatagtgattggttatgtccagtccaggtctaggaggaggcttcttcaagaatggtggctcgatttgttgtcaaaggcatgtgatgctcgtaccttggtcccttcggaaaaggctaatcctttggctcgttcacatagctcatccatgcttctaggaggtttcttgtacaaactatccacaaacttgctaggtcgtaaggctaatagcatggagtgtaaagccacctcaagatttagattcctaatttggacagtgattcaatcgaacctatccataaatttgctaagtgactcatcatctacctggcgtaaactagccaaggctgtagatgtccaacgtttcatcatagcactccgtgttgagcagtttccaaccaatgggcaggtcgacctccatgatgtgatctacaaaaggatgtcaacgagtcgttcatccttcatggcgatgtacgtgcaagatgttgtggtcgctgtcgcaacgtgccctattgcgggcgagcgaaggcgaggctcacgggtgtgctttccaaaggaggaaagatgcgcggagtcgccaccaacgtttatttgtggaaaacgtcgggaaaaaccgaaggaaatcggtcaaaatgaaaattctaagttcaggagttgtatttacgcttga

SEQ ID NO: 111774 - DNA, 320 bp, Glycine max
  Peptide Sequence Number=SeqID_228552
gtccttctaacaactcttctggaggtttttcaaatagaggtccacaacaacatcaagctcaactagatagaatgtcaaagatggaagatactttaacacagtttatgcaggataataatgagaaaaagaataaagaaggaattgaaaaagaaaatgagataaatgatgaagtggtgactagtgaaaaagtggtaattgaagaagagaagaacaaatcaaatgaacaaaccactgataaagttaaagctatagaagaggatgaagacatggcagagcttgttgattatttcattggaggagactgggctcctcaaccatga

SEQ ID NO: 111775 - DNA, 372 bp, Glycine max
  Peptide Sequence Number=SeqID_228553
atgacacctaagaagcaagaatctacaagaatccctaggatcataaatgaggaagatgccaaaaggacatttccagagaaaattaatctgcctaatattattttttactactggtcgcgggcgttgaaggatcatttcaactctaagcgaaaagagaaacccatcccttattgcatgtacttcactcagatcatgaaaaatattagggtggatatgtctacatttgctccatttgaaggacttaatcaattcacaagttccacttttatcaaaatggggattgttgagatttttctagattggacaaaacatcatatcaagaggaaagttaagaaggaaccacagtctatagaggaatgtagaaggatttga

SEQ ID NO: 111776 - DNA, 276 bp, Glycine max
  Peptide Sequence Number=SeqID_228554
atggcgtctatcctgacttatcttccttcactgaaagtggcatcatccaaactggaggaactatttggtgatgtatcaagcgatccgctcctagaaggaaaatctattgataatatgtttggaatacaacaagtcctcctaaaaggtctggaagctctagggcacaccttcacaaaggccaagattaacttggacatgctagacaactttcccaagatgtgggaaccaaacacaacaaccatccaagaagccaaaaacatgaaaaccctatcttag

SEQ ID NO: 111777 - DNA, 307 bp, Glycine max
  Peptide Sequence Number=SeqID_228555
atgggtgcttgtcagagggggttggaggacaacaacatcaaggaattcaatgaatggattgtggatctggaggtagaaggggtgctatgggtggggagaaaatttacttggttcagactgaatggatctgcaaagaacaagctggacaaaatttttgtatctcttgaatggcttgctaaatggcctagaagtacacaattcaccttggataggaacttctcggaccattgccccatactgctcagatctaaacacattgattggggacccaaacctttcaggatccttgattgctggttcaagacag

SEQ ID NO: 111778 - DNA, 756 bp, Glycine max
  Peptide Sequence Number=SeqID_228556
atggctgcccaatcacatgagtctttactgaggaagaaggcgaggttaagatggattaaagagggcgattgcaactcacgctatttccaaatgttgatgaatgtgaatcgtagaaataattctttgaaaggaatgatgattgacggatcttggattgatgaaccgggaagagttaaagaggcaaccattggacaacaacaaaatgatatcctagtggggcgcttccatgaggatgaaataaagaaggctgtatgggaatgtgggagtgagaaaagtcctagtccaaacagactaaattttaagtttactaaggagttctggaaagtaatcaaacccgacgttatccggtttttggatgaattctatgtcaatggaatttttccaaagggctgcaacacatcttttatagccctaatccctaaggtggctggtccacaaaaccttaatgaatacagacctatttcgctaataggctgtatgtacaagattgtggctaagttattagctgaaagattgaagaaggtgctgccagccataatagatgaaagacagtctgcattcatagggggcagacatttgttgcatagcgtgattatagcgaatgaggtggttgaggaagctaaaaggagtcaaaagccatgtatggtgttcaaagtagactacgaaaaggcatatgattcagtctcatgggatttcttgatatacattttgaggaggctaggtttctgctccaaatggatccaatggattgagtga

SEQ ID NO: 111779 - DNA, 384 bp, Glycine max
  Peptide Sequence Number=SeqID_228557
atgttagttgtagctaatgttaccaattacttcatgaattatattgtgaaaaatcaatgtagagattcaagcatgacaggtgatgtaagctccattggagcttgtaggcctaggatctttttcatcaatgggttcctttgcttcttggaagatgaatggcagcagaatggagaaaggaagagagagaggagacgccacttcaaggagaagatgagtctagaagaagctcaccaccataggaggccattgataacagcttggaggaagaagaagatgaatgaagggagagggagagaagagcacgaaattttgtgctctaaaagagctctgaaatctgaagttaatattcaaatgattaaagttccaaaaaatgcacacacatga

SEQ ID NO: 111780 - DNA, 366 bp, Glycine max
  Peptide Sequence Number=SeqID_228558
atgtctctcaatcaagatcctgtgaaaagaaagaaagcagaatggtgtgataaaaatactgagattatgttgaaagtgtgcatagaagaggatagggagaaaaaaaccattgctgctagtgatgaatggtgggaagccaaaattcagggaaaaatggtgaaatttgggaaggcagagagtgaagtgagaaatagtggagtggatggattttacaaattcttaggctgtgaatatggaaaaagaagtatctacaagcttgctaaacgtagagaaagaaagagtgaaacaaatcgaagaactggtgccatgatgcttgcttttgctctgttatgttgtttaggatttaaaaagtcaacgaggaaataa

SEQ ID NO: 111781 - DNA, 600 bp, Glycine max
  Peptide Sequence Number=SeqID_228559
atggacaatgtcacggtctgcgccgatggcgacaagtattgttcacccatgaaaaaagcaagaggatccaccggggatgccatgaagcagagaagagaagatcaatatgacaatacccatagatgcatcatgtgtcgtgtgcataaacttcatgcgccaaggcctgcgtggggccatgtgcagcggtgttttgagttggctgcacacatggacagtgtgacggtcttcagcgataggcaacaacgatcgaaggtgagagctccaaagaaaaggtgttgggaagtctgccaaaagagggcaaacgagtcccaaaatggcccgaaactgactgggctttgtgcacctcagtcactaaacgaaaagctcgtcagagctccggctgcagcttctggaagaggagaaaaatcgccagaaggacagcgacataaaagttcactagaacgcggaaacaggtcaccggaagatgggaagacgagcagaaaggtccaccggaatgtgaaaatagataagaatgttgtaaataaggctacaagtagtgctacttcttttgcaacattgcactctaggcttggtcaccctagtgttcctgctatgaaaatt

SEQ ID NO: 111782 - DNA, 1207 bp, Glycine max
  Peptide Sequence Number=SeqID_228560
gatgatggagaaattgaaggggatgtgaatcatcgcattcaagcaggatggatgaaatggagaaaagcatcgggggtgttatgtgatgcaaaggtaccgatcaagctaaagggaaagttttatcggactgcggtaagaccggcgattttgtacggaacagaatgttgggcggtcaagagccaacatgagaataaagtaggtgtagcggagatgaggatgttgcggtggatgtgtggtaagactcgacaggataaaattagaaacgaagctattagagagagggttggagtagcgcctattgtagagaagatggtggaaaatagacttaggtggtttgggcatgtagagagaagacagccagtagttcaaaatatcaaggtggataatcatccaggaggaggacactggtttgccgctggtctatcacctaatgtttcaggcaaaagcagagcttccctttatagcagtccacattttcagatggttcaacatccgcctgccaatagttatggcagtgtaggaagtcatgggagctataatgatagtgttgggcttggaagcagctatggaagttacggagagagcagtaacatgtttgcttactattcacctattggtccatctggtatgaacatgcacaatcagggaagtatgtcaatgcttgggaatagtccggatgcaaggaggagagttaagtaccaacctgggaatgggctggggataagtccgtcagctggaaattttgctcccctgccccttggtgccagcccatctcaatttactccaccaagttcctatagtcaggtttcagtcagttctccaggacactatggacctacatctcctgcaagaggaacttctcacggatcacctttaggcaagacagctgcagttagccagtttaatagaagaaaaaattggggacattctggaagtcctcaaactcaagaaacattttcttcacattggccaggtcaatatcctgacagcacaagccatactgagggaacatcacaagctcttggcagttcaccatcatacctacagtcaaatagtaatcctggaaactggaagcagcgaggaagtggagggttatctgctaatcagaacatttcatccttaatgaagcccagtgctagtatgaacccacaatcaacagaagtggttcatgacaatgcggagacaggcatttctttgcctgatcctg

SEQ ID NO: 111783 - DNA, 201 bp, Glycine max
  Peptide Sequence Number=SeqID_228561
atgactaggtggattgctttaaggaaccatgtgctgaaggacgtcgagacacaacgctctgataggatgtggcattggggtatagggttttatagacggccttgtttgagccgaaagggtgtcacaatggatgaactaaaggatttgataaagcaagttgcgcctcgtgggattcccctttatggtgttgatgaaacataa

SEQ ID NO: 111784 - DNA, 795 bp, Glycine max
  Peptide Sequence Number=SeqID_228562
atgacaactagaagtggtggacaagttaacaagggtacccaaaaaagtggtggacaagttaacaaggttgcagaggaattttctatgggggggtgcgtcggagcaaaacaaaatagcttggatccgttggaaaacggtgtgcttgccaaaagaagatggagggtaatagagtcaaagtatggcgggtggaggaatttgagtgaagcaaggtcagccaataatgaatctacatggtggagggacttgaagattgtagatcagcatcctcaacagggtcaattgctaaatagttcgatagcgtggaagcaaaattatttcattcagcaaatgggagaattcaaagattcagggtgggaatgggacttcaaatggcggagaccgttgttcgacaatgagatagatatggcggtatcatttctacaagtacttgaggggaacagaattcggtcccacagggctgaccagtgggtatgggtggcagattctagtggccactatacggttaggagtgcctacaatgtgcttagagaggacttattacaggaggaccaggacggagagttcaaggagctatggaaggtgaaggttccatctaaagtagctgtgtttgcatggaggttactcaaagataggttaccaacaagagacaatttgaggagaaagcatgtggagttacaagattttatgtgccctttctgcagaacaatagaggagagtgcagacatcattttcttcagcacatatatggagcatttgaaggaatacagctggacagatggaaggggtggtggctag

SEQ ID NO: 111785 - DNA, 531 bp, Glycine max
  Peptide Sequence Number=SeqID_228563
atggtagttgaaaaatttatgaaaattcctccacatctaaattcctccaatagatgtgaaaattcctctgcaacctttgatgaattacttcttcaagaggatggttcagatgaaagcagtttgacaactgagtttggcagaagtatgaatcttggttctactgaaacatgggctggatttggaaggttcaatcatgtttccagcacaagcactccaataatcatgcaaagactaaatgcaccaagtcaagcatttactaatgttgagatgggtagccttccaactcatgatcttcaaacaacatatgtaccctctatgtctaagcattttcatctcatgcctcatattttacaaaattctccaagccgttttggacaccaatctgttcaaagattcacacatggtagacccccccagggtgccgagtggaatcaaattaagattcaggctacttcttctggtttcagcagtgtgggccctcgttctcccaggaataactcattcaccaacagtatgacatggggtatataa

SEQ ID NO: 111786 - DNA, 396 bp, Glycine max
  Peptide Sequence Number=SeqID_228564
atgtgtaacttgtggtgggttgtacaacacgttggctactccatgcaagctcttcttcgtggcttaggctgccgtcggaggcgatggctaagaggacaagcgggttgtgctacgacatcgaagcgggggaggctgcactcggtggtggatggaggtaatctcgtcgtcgatctccttgcagtggaaattccgatggtagttgcaggcaacgcagatgacggtctccagcgtgtcatcctctctggccgccaagaactcgcaacagtcgttggcggcatggccgccgaagctcatgacgtggttcttctggcattctcagcaccgcaccttcaccgtcgccgcaccgaatgcgctcttccgcccctcaccgctgccaagtttcaaccttgtcgttga

SEQ ID NO: 111787 - DNA, 789 bp, Glycine max
  Peptide Sequence Number=SeqID_228565
atggaatccaattccttccacctgaagtttttgattcctccaagaatcagaataacctggcaaacacatattgatgttggatcctctaggagtgttataaccaccccttgtgcaatcataataataaacagaagaaatagtctctcagtaaggaaaaacttttctttcccaaaacttcttaaagtagttaaaaagtgggaagaagctaagaagtgccaaccacaaggtttcatcaagaatgaaacagattctgaagacattgacgaagatgaggactttatttttagacaaaaaatgttttcaacaataaataaagaaaattcagatatcgatggtactgaaaatttaattgagaagattgatctacaagattcttatgaaaaagaaatcaacttgaaaaacacattagaaattacttccaagattgatgaaacaaaatcattagtttcttttcctgaatcttacaaaagcctcatggctgatacttccagtactagttcaaattttatcccacaatttgactatagtatggaagattaccaaatggggttcctcccccgcgaaaaatttgttactcttgcagatttatctttaggagataatataaagtcaaaagggaaaacatttcccattgtaccagtgtttaatatgtcttctctcctattaaacatagggagtattgaccctcaattacttacaaattatatagaacaatggacttctgctgttataagagactatagggtaaaccatgagaatcatgttacgaattttataattcctaattaa

SEQ ID NO: 111788 - DNA, 495 bp, Glycine max
  Peptide Sequence Number=SeqID_228566
atgtggctggtcatcaaacataaaaagccaaggaaaataactcaatattggatccgctatacatgtggtgcagttggtttgtcagtatgctccatttggctcttgcggcatagtagattggtggggagttctgatcttgataattgggttgaggaagctaggaactcaacatatagctttttcaagaatcacgtagaggaaccgattttgtccattagggatgaactttttgacacattcaagaagagacatcaaggtattatggacgttgaagaggtgcagttaacttccaactcactacacagaatgttgttggctttcagtgagcagacaaagggtcagaagttccctgtgaatgcttcagatcaggaaatgatggagatagtcatggatagtaagggttcattggtaatagcttggttgttttctggatttagtactaaaatagttctccatgccaatgactttctgaggaatgaagatactgctctatag

SEQ ID NO: 111789 - DNA, 684 bp, Glycine max
  Peptide Sequence Number=SeqID_228567
atggcggttccaacatcggaaagcgaatccgtagagaacagaacactcctttcacagttttactctcactatctcgtaaaccgaatcaagactctctatccctacttctccacaaatttcttctccaactttgctctccgcttcagatcaacgcagcgtcgggaatgtctccctcttccgctaccttcctcttcactcgactctcccgtgctcatgaccaagagatctagagtgcatgatgttgtggaggatatattagagcgtgttttgataaatttgcacagcgtccaaaagaatctgcacttttggcagtccagagccaagagtacggattccgagaaggcacgtttcatgatatttgagaggggtccgagggcttttattgatgaaacagttaagttgttgtgtggcctcactgttcaaggttcgtccacacagaatctgagccaatctgcatctgattatattggcgagagagtaggctttttgaatagcttaagatattcactcgccacatttttggctcagatgtggggttcaagttcttctggcatatcacatgattctgtttatatggaagttgataaaattggagaggagttggtggaagatccagagactaagctgcccttgttgttgaagcttcaattggacatctgcatgcaacgcgtcaggtttatataa

SEQ ID NO: 111790 - DNA, 169 bp, Glycine max
  Peptide Sequence Number=SeqID_228568
atgacatatcctaaaaaaagtgccgatggcctaatatattgtggtggtgagcatggtgttgttgatgatctggtggagcttcttcatgctgaaatagtcgaggagaatacgatgctctatgaggaggtagtccatgatggcattgtcaatgttgcacacagtgatggtg

SEQ ID NO: 111791 - DNA, 321 bp, Glycine max
  Peptide Sequence Number=SeqID_228569
atggcacgcaaactgaggcaagattttagcatttcaaaagccaaaaagttcagaagcttttccctcactctcacgttgctttttctccctttctcctccaccattgaagcctccatcaaagctccaaactttactcaccatttctactccaaatcgcaaaaggaagccattttcggagtcgtgaagcgcacctcaacgttgtgggacttcaaatttcaggtttgggtagacttcttctcacatgatttcgtgggtattgggtgtttgggagatatgatgggtagttttactaggtttatgtcttatggtagttatttgtga

SEQ ID NO: 111792 - DNA, 195 bp, Glycine max
  Peptide Sequence Number=SeqID_228570
atgtcacattttatgcttttttcccttgcttttggtggaactatttgtcaggtcattaatgtcaattctttccccgttggcaggttgtctattaatcggatggtggaatggagtcagcaacttaatgtgagacatcttgcattccagttcacctttcctcttgctgacacttgcacttttgtgttctacatatga

SEQ ID NO: 111793 - DNA, 426 bp, Glycine max
  Peptide Sequence Number=SeqID_228571
atggaggacttcagccaaatatcaagtgtgggatccatcatccatgcttttaaccctttgtcctgtcttcaagccatgcaattggttatgagaactctagtgcattttggagctccaaaacagatattgattgatggaaagcctcacttaggaacagataggttggttcctttacttcgcaacgttaggcaacatctgcaagatttgggtgtcaccataaagtttgggacaaaagtagatgatttagttataaaagatagacatgttctgggggttatggtatctgagtcagctgataaattacatttaacaagtcagaagatggaatatgatgcagttattctggctgttggtcattctgctcgttatatatatgaagtgcttcttgctcacaatgtggaattaatacccaaagattttacttga

SEQ ID NO: 111794 - DNA, 762 bp, Glycine max
  Peptide Sequence Number=SeqID_228572
atgggaagaatttatttcattgctacaaattttggggggaaagaagagtatgctgaattggcttccgaggtttgtcatggacgtggtaaaattccagtggcagattacaaagttgccaattatattgacaaggaggatttcaatgacgtatctgattcaggggtaacaaatcgtagttgctactctttctgcatgtgtccaggtgggcaggttgttctcactagtacaagtccatcagaaatatgcatcaatggcatgtcattttctcggcgagcatctaagtgggcaaatgccgcacttgtggtgacagtcacaacaaaggatttcgaagctttgaattattatggtcctcttgctggggtcaaatttcagagagtgttcgaacaaagagctgctatgatgggaggaggaaattttatagtgcctgtccagacagttacagattttcttgagaacaagttgtcagatttcttaacttttcagttaccaggatttatctgcaatgatgctctccttcatggtgtagagactaggactagttccccaatccaaattccacgcaatggtgactcttatgaatgcacttcggtaaaaggactatatccagttggtgaaggagcaggctatgctggagggatcattagtgcagcagtagatggaatgcatgctggttttgctgtggcaaaaaaattcagcttgtttcatggagatgttgagtctgttctgggcaaggctcaaaatgttggagttgtcaagtactag

SEQ ID NO: 111795 - DNA, 483 bp, Glycine max
  Peptide Sequence Number=SeqID_228573
atggatgtccaaaaactcatcagtctggagcctcgttgttgggactttatttctcggctggagcctaaagttggccttgtggaacgtgtgcatgatgaaagagattttggtgatctggcgagtatcattcacgactgtaaagaaaataaagaagttgcattgaaagggggaaatggacatagcattttctcaacagagttgtgcaagaaccaggctacgagaaaaccaaaaattgcagtagtgggaagtgggccctctggcctatttgctgctcttgttcttgcagagcttggtgcagatattactctgatagaaagaggtcaaccagtagaaaaaagggggcgtgatattggtgctcttgtagttcgtcgaattttagatttggaaaggtggtgcagtgcaggtacctggagtgatgggaagttggtgaccagaattggacgcaacagtggcagtgtccttgcagttagtttccttatgtag

SEQ ID NO: 111796 - DNA, 223 bp, Glycine max
  Peptide Sequence Number=SeqID_228574
atgagtgaaatcaaagaggtacatgaacaaatgaaggctaatatggaggccattaagcaacaaatgacaacgatgatggaagcaatgatgagcatgagaaagatgatggaggataacaccgctacagttgttgctgtgagtactgctattgagatggacctaattcacctggccgatttcaatcaagtgaatcgtctagtctccgatgtagtatgtcaaggag

SEQ ID NO: 111797 - DNA, 273 bp, Glycine max
  Peptide Sequence Number=SeqID_228575
atgggagaagaacgatgcaaacctgtcagagaagaagtggacaaactcctcaatgctaactttattagagaagtcagatattccacctggctcaccaacatcgttatgctaaaaaaggccaacgaaaaatggtttcaggtgctaagcttcctaaatgcttactccggatataaccagatcaagatgcatgctccagatgaggagaaaatggaatttattatcgacgatgcccactttttctacaaggtcatgccttttggcctaaaaatgtag

SEQ ID NO: 111798 - DNA, 246 bp, Glycine max
  Peptide Sequence Number=SeqID_228576
atgtctcctccacttctagaacctcacaatcactcaaactcatctcaagctctcaggacgacttcctcttcaagctctgttctctgcagctcatccttcttccagattcttcctcacgctcagccgaggagtgttgcgctcagcggatggctcgctaagccagaagattgggttaatgaggggatgaaaatcagcacttcacaaacttgcctaattaacctgaaattgagaggaaatggttattaa

SEQ ID NO: 111799 - DNA, 282 bp, Glycine max
  Peptide Sequence Number=SeqID_228577
atgggtgtccaaggtggaaacaagggaggcataggcacagttctccttgatgaactggaggtcatcatcagaaacttcaaccttcgtcgtcgggaatttccagcggaagctccgttaggaagaagaaaacaatgttgccccaatttaacgtgtaagccaaagcggggtcatccgataacccgatatgacttttcgggtcggtcttggagatgctgtattggtttgtgcctctgtgggttgaaagtgaaaactgaaggagtgacgtgcgacctgcgaagatag

SEQ ID NO: 111800 - DNA, 576 bp, Glycine max
  Peptide Sequence Number=SeqID_228578
atgaattgcgttttcgttcatgtgtcctccacccttaagttgggagccatgcgtagtgatagcttagggcaattttccattgtcaatttttttcgaaaccccatgaattgcgttttcgttcatgtgtcctccaccttcgagttgggagccatgggtagtgattgcttagtgcaattctccattgtcaatctttttcggagccccatgaattgcgttttcgttcatgtgtcctccaccttcaagttgggagccatgcgtagtgattgcttagggcaattcttcattgtcaatctttttcgaaaccccatgaattgcgttttcgttcatgtgtcctccaccttcgagtttggagccatgcgtagtgattgcttagtgcaattcttcattgtcaatctttttcggaaccccatgaattgcgttttcgttcatgtgtcctccaccttcgagtttggagccatgcgtagtgattgcttagtgcaattctgcattatcaatctttttcggagccccatgaattgcgttttcgttcatgtgtcttccacccacgcgtttggagccatgcgtactgattgctta

SEQ ID NO: 111801 - DNA, 183 bp, Glycine max
  Peptide Sequence Number=SeqID_228579
atggtgaatattggcaaatgttcatcattttgcctaagtgctttgaaaggacttgatgatactccacaaactaaatccaaggctggtgctaggtggattgttgttaaatatttcaatgatgctagaccattagaactagagagattgaaggtgttttgcatccagtgggcaaagtattattga

SEQ ID NO: 111802 - DNA, 887 bp, Glycine max
  Peptide Sequence Number=SeqID_228580
cacgtcctccccatcagaggactactcgtcctcgccttcagaggactacacatccttgcctacagagagctgcacgccctcaccttcagaggactacacgtcctcgccttcagaggactccatgtcctcaccttcatagggctacacgcactcgccgtcagaggactgcacgtcctcgtcttcagagggctgctcaccctcgctatagaggacaacacatcctcgccatcagagggctacacgccctcagctttagaggaatacacgtcgtcgccttcagaggactgcacgtcctcgtcttcagagggctgctcgcccttgcctttagaggactacacgtcctcaccatcagagcgctatacgccctcaccttcagaggactccacgtcctcaccgtcagagggctatacgccctcacctttagaggactccacgtcctcgccatcagaggtctgcacgccctcacctttagaggactatacatcctcgccatcagagggctagggctgcacgccctcacctttagaggactgcatgtcctcaccttcagaggactgcatgccctcaccttcagaggactacacgtccttgccatcagatggctgcatgccctcgccttcagagtactgcacgtcctcaccttcaatggactgcacgtcctcaccttcagaggactgcacgccctcaccttaagaggactgcacgtcctcaccttcaaagggcagtacacactcgcctttaaagggcgacacatcctcaacttcaaaggactgcacgccctcatgtttagaggactccatgccctcacctttagaggactgcatgccctcccctttagaggactacacgtcctcgccattagagggctgcacgccctcaccttcaga

SEQ ID NO: 111803 - DNA, 699 bp, Glycine max
  Peptide Sequence Number=SeqID_228581
atgccatccaagacgacgctttatccctccctcgtgacctgggacggtcacaacggtttgcccaaatttgatgcggtcaaggatgaggatttcgctccggctttcgaggcagcgcttctctcccatgaacaggaaatcgatgcgattgcgggcaatgcgcaggcgccgagcttcgaaaacaccgtgaccgcgcttgaaatcgccggcgatgagctttcgcgcatttcggcgctgttctggaacagggcaggcgccaataccaatggcgtgatccaggcgctggagcgggagattgcgccgaaaatgtcgcggcactattcgaagatcggcatgaacgaagcgctgttcaagcgcatcgatacattgtgggaaaagcgcgagacgctggggctgacgggcgaggaaagccgtgttctcgagcggcactggaagggtttcgtacgctccggcgcgaagttgccgaaagaccggcaggaacggctggcggcgatcaatgaggagcttgccggtctcggtgcaaagttcgggcagaatgtgctggcggatgaaaagaactggaagctcctgctttccaccgaagaggacttgccggcattcccggctttctgcgcgacgcaatggcgggtgcggcccgtgagcatggcgaggatggcatgttcgccgtcaccctttcccgttccatcatcgagcccttcctga

SEQ ID NO: 111804 - DNA, 297 bp, Glycine max
  Peptide Sequence Number=SeqID_228582
atggtacctaatgcgttgctaactaggaaatggtgtttcttcgggcatctcaatctcaacattacattttccatgcatagcatacgtattctcgagtctttcatctctatgaaaggttgtcgaagtattggcgatcagaaatgtcattccttgaattatggggttgaaccaagctcatgcttttacgaaaaggttcatcaagtcaagttgaagtatggaagtaaccatcttgcaaaaattggggcaaaagatggattgggttacatcactgcttcgtctactgccaaacacatttag

SEQ ID NO: 111805 - DNA, 249 bp, Glycine max
  Peptide Sequence Number=SeqID_228583
atggagtcatcatctgtcacaacctaccctatgacgggagtgcgaggcgaaaagaaaaaggagcatgttccaaaaaggaaaatgcgtgggagtcgccaccaacgtttattcaagaaaaacgttagaaaaaccaaaacaaggtctgggacttttgaaaataagggttcgagagttgtttacgcatggggaagggtgttgcccttgctcctacgtatcctcaggtgcgatgagaaatctagatccacatag

SEQ ID NO: 111806 - DNA, 900 bp, Glycine max
  Peptide Sequence Number=SeqID_228584
atgacaggcgggatgggcggcgtgctcggctcggtgaccatcatcatcggcctgggggcgatgcttggccgcatgatcgaacactcgggcggcgccgagtcgctggcgcagcgcttcaaccaagggctggggccgaaacgcaccgtcgccgcgctgaccctcgccgcgtttatcctcggcattccggtgttcttcgacgtcggctttatcattctggcgcctattatctacggcttcgccaaggtcgccaaagtgtcgccgctgaagttcggcctgtcgatggccggcgtgatgttgacggtccacgtctcgctgccgccgcaccccggcccggtggccgccgccggtttgctcaacgccgacgtcagttggctgaccatcatcggcctcgcgatctgtattccggtcggagcgatcggctatttcgccgccagctacctcaaccgcaaaacctatccgttatcgatagaggtgctggaacagctgcagctggcggcgccggaaccgcgtccggaagggcaagcgccgctcagcgatcgcatcaacccgcccggcgccgggctggtggcggcgctgatcgtcatcccgatcgccatcatcatgctcggcaccgtctccgccacgctgttgcctgccggctcggcgctgcgcgatacgctgtcgctgctgggctcgccggcggtggcgctgatgatcgccctgctgctggccttctacttcctggcgctgcgccgcggctggagcctgcaacacgccagcgacgtgatgggcgctgcgctgccgaccgccgcggtggtgatcctggtgaccggcgcgggcggcgtgttcggtaaggtgttggtggaatccggtgtcggcaatgcgctggtggaggttctgacggccatcggtttgccgctg

SEQ ID NO: 111807 - DNA, 699 bp, Glycine max
  Peptide Sequence Number=SeqID_228585
caatgatcgacgcttttctcgcctatcgtgaccacaaggaaagaccggttgtcgctatgctagccgacctatatgacacctttgaccgaagatgtgagaagagcagtatgaggattgtttgttgtaccccggctctttatgtatggttggttttgcacctttttcgccaagagatgaggcatgcttgcccactagaaagccaccgttcatgcacaaagaaaggaggggcaaattgggaccaactcttagcaaacaaagaaggagcatctgtcaactggttccctcgatggaaagaaggaagaattggagttcttatttcgtgcggaggatttccaaatgttcccttaatggggacaaggggttgcattagttacaatcccgttcttgctataaggcaacttggctaccccatgagagggggcacctctagaggaagagctcacgcctgtcatgtcacgaggggcattaacaatgggcctgtcggtggctaccgtaagtggttaaaagcccacatgcaaggtttggattggctcccgagtttgagaatcgctaaaagggaggaagttgaggtaccggaggaagacgaagaggtgcaggcccttagggcagaactcgagcaagcccaaacagtcaaagaaagggctcgcaaggaagagcatggccgtgaaaaatttcgtggagctttgtggggtagcaaca

SEQ ID NO: 111808 - DNA, 180 bp, Glycine max
  Peptide Sequence Number=SeqID_228586
atgcaatgtggtaccatgtcactctcactaagtaagatcatagggagaccagtcagggtcacgatgttttgccagaatgctccaaccataagggatcagcataggcttaaaggagcactcaaacccggtgacccccaaggcctacactccgaagagtccgtcagggcctctccctcctga

SEQ ID NO: 111809 - DNA, 258 bp, Glycine max
  Peptide Sequence Number=SeqID_228587
atggtggcaatcttctggcaaatctaccgatcctcaatggaagtccttgagattgtggagaaagaatattcaccgcttgcagaagatgctacaaaagaacacaaggtggcatataatgagaataagaagaacgactacaaggccctatgtttgatttaccctagtgtggacaatgcccattttgaaaagatcgttggagcaaaaacctcattggagacatggaagatcttggagaaaggaaatgaaggcgcggaatag

SEQ ID NO: 111810 - DNA, 2254 bp, Glycine max
  Peptide Sequence Number=SeqID_228588
atggaggaaaatgaaagagtagctgagttctttaatcgtgtctttactctgaccaatgcaatgaagtcatgtggtgaaaaggtcactgatatcaccatcgtagagaaagtcctacgtatcttgaatcccaaatttgaccacattgtggtggccataaaaaaatcaagaaatctggagatcttgaaagtagaagaactccaaggctcactcgaagcccatgaacaacggattcttgagcgctcaggaggaggacataaaggaaagggttgtgatagggtagccaaagataatctagagataaataatgaaactcaagaacattttagaaccgagcaagatgtacctaaatcttcaagaagaggagggtacaaggggattggacatttttcatctgaatgtcaatacccaatccagaatcagaataatgaaagacaaggcaatgaagcaaatatggccaaggaagcatattcaaaagatgatgttctcttcaagaagttatggacctatccacttaaagataagaatgaagtatttgatacctttaaggtgttcaagatactagtggagaaacagtcagggaaaagtttgaagatcctaagaacagatggtggaggggagttcacttctggagaattcgagaacttctgtagagataatggcataatccatgagatcacaactccatatacacctcagcataatgcagtggagacagctaactatatactaaatcgatgtccaactcagaactcagtttcactagtaccagagcaggtttggtcaggtagaaaaccatcagttcaacatctcagggtctttggaaccttatgctacactcatgttccagatcagaaaagaagaaagctagatgataagagtgaagccatgatttttaatggctatcaccctactgatagagacaaccagaaagagcaagcaactatcagcgtgcaggtgcctatggagaattcagttagacatcaagatgaatctataccacatggagaaggtaatgctgaacaaatcacagaacaaataagatcaggaagaatgatgagcatgcctgtaagactcagagattaccacatgtttcctgacagtgcaatcatagatgagggtgagtttgtgaatatagccttgatgactgctacaaaaccagagttagtcactttaccaattgggaagactcctatagcagtcaagtgggtttataaaaccaaactaaagcctgatggcagcatagccaagcacaaagctaggctagttactagtaagcttgacctgttggaagaattggaaaatttggtagatgtcaaatctgcatttcttaatggccctttagatgaagaagtttatatccagcaaccccctgtatatgaagtcataggcagtgaagacaaggtgttcagacttagaaagactctgtatggactgaaacaagttccaagggcctggaataaaagaatagactcatttctaaattatgaagactttaagaaatgtactttagagcatggtatctatgtgaaggcaactaagaatggtggagtcctgttaatatgcctctatgtggatgatttgctgattacaaggagtaatccagttgagatagaaaagttgaaaggcaatcccaaatctgaattcgagatgttagatttaggcttgctatcatacttccttggtattgagtttgctaaaactaaggatggaatagtgatgcaccaaaaaaagtacattaaagaagtattgaagaggtttagcatggatcaatgtaataaggtagatactccaatggaagggaatctaaaattggatacaggcgatcatgaagcttcagtagatgccatattgttcaggcaactcgtgggatgcttgagatttgtctgccacacttattctgactcagactggtgtggggataaagtggagagaaaatctacttctgctgagtacatttcagcttgtagtgttgcatgtcaagcactgtggattctgtctcttatttctgaattaaatttgaagactgatgactttgtggagctgcaagtggacaataagtctactattgacttagcaaggaatcttgtgtcccatggccatagcaagcacattgaaactaagtttcatttcataagggatcaagttaacaaagggaggataaggttgaaacattgtgggacaaatttgcaacttgttgatattatggcaaaggcgttgaaggctgatatattcaagttgctgagaaatatgctgg

SEQ ID NO: 111811 - DNA, 111 bp, Glycine max
  Peptide Sequence Number=SeqID_228589
atggattctgaaggttttgggtctttgagggaaaagagaaagctacgatgcgaacaacatttctcttacctccgacattgtttcacaaattccaatgttgggaatgtttga

SEQ ID NO: 111812 - DNA, 147 bp, Glycine max
  Peptide Sequence Number=SeqID_228590
atgggtttaacatggaagatcaacatagtgctcccttgtaattgtgttatgcctggggacactttctatgaagaggatattgatttcaagaaccctgaggcaagagtggtcttaccggtaagcgcactgggtcgccaagtaaaataa

SEQ ID NO: 111813 - DNA, 177 bp, Glycine max
  Peptide Sequence Number=SeqID_228591
atgatgatcatgatccgtcctaatggtgttgtcacgctcttcagctctcaaaagtcctcaagtttcttaaagatatctcacgaaaagatgcactacggctatggtgaatccaccatgaccattattgagatggcattgaagctttgggctgttatgaatcatgaccctcttggttga

SEQ ID NO: 111814 - DNA, 135 bp, Glycine max
  Peptide Sequence Number=SeqID_228592
atggcattaggggtcatggcagctcgcccagaggagctgggaagtaaatataaggacactaatttcgttcgagcgatcttgctattcgatcgagcaactggcaaaaaccaaggaagtgaaaccgagaaaacatga

SEQ ID NO: 111815 - DNA, 612 bp, Glycine max
  Peptide Sequence Number=SeqID_228593
atggcaaagaagaagaatccgctggtgtttatggatgtgtccatagatggtgatcctgttgaaaggatggtttttgagcttttctatgatattgctccaaagactgcagaaaatttccgtgcactatgtacaggagaaaagggtgttggtccaaataccagaaaatcactacactacaagggttctttctttcatcgaataaaaggctcctttgcccaggtggggattttgttaatcgaaatgttgtccaagttgcaagccttgttccattttcatgattcctatgacaatgggactggaggagaaagcatatatggttccaagttcccagatgagtcacctaggctaaagcatgatggtccaggccttctatcaatggcagttgctgatcgtgacatgcttggttctcattttaccctcacttttaaagctgacccccatcttgataggaaacatgtagtctttggcaagcttgtgcaagggcatgatgtattgaagaaaattgaagaagtgggtgatgaagaaggacttccaagtgtaactgttaaaataattaattgtggtgaacataatgagggtgagaattcctcagccctttatggagaatactaa

SEQ ID NO: 111816 - DNA, 1906 bp, Glycine max
  Peptide Sequence Number=SeqID_228594
atggaatcttcagaaagtaatagtgattctgactcagatgtatcttcatcatcttacacaagttcctccagcgatgacaggcggagaaagagaaaaaggtctaggaaaaataaacttagacgtggaaaaagaagagacaaacacagagacaagagacaaaggaaacaagacaaaagatcaaagcttagatcaagaagggaattggccagtcataccaattcagatagtggaagtaggagtgacaacaactctgatggcaaaagtggtgctgctcaagcgaaagataagaagcataaaggtcattctcagagacatgctgaaggtcaaccttccgtagttgcggagaaagagttacatcacatgcaccttgaaaagagggagaaaccgaatatgctagaggaggaagaattcccaaaggaaaatggagagtggcatagcaacagcactggggctaaccatagatctgacagaagggaagggaggcagcctgatgtgatggatgatcaactaggcaaatctaggaatcaaagcaggagccccaagcgaaccatgagtatgagtattagtccaaggagtgacagaaaaagcccaagcattgatccaaaaaggaggttgagcagaagtccaggtggtagtagaagccctcatgctccattatggaggagtttgagcaggagtccaaacagaagaagcattaaaagaagcccagtgagaggtaggaagggaagaagtgttagtagaagccccgtgagcactcacaatcatggaagtatcagtagaagccctgtgagatctcgtgatcatagaagtggcagtgcaagctctgtaaaatccctttctcagggccgtcgaaggagtttacccagagcaccttcgcgaagatcaatcagcagaagtcccgtgaaatcacatggtcatagaattctcagtagaagccctgtgagatcacgtggtcatagaagtgtcagtgctagccctgtaggatccctttctcgtagccaccgaagttcacccagagcaccatcacaaagatcaatcagcagaagccctgtgagaactcagaatcatagaagtgtcagtagaagtcctgtgagatcttgtgatcatagaattgtcagtgcaagtcctgtaagatccctttctcgtagctgccagaggagttcacccagagaaccatcatgtagatcaataagcagaagccctgtgagaacttgcagtgataaaagtgtcagtagaagtcctatgggatctcatggtaatagaaatggcagtgcaagccctgtaagatccctttatctgagtcatcgtaggagttcaccaagagcaccatcaggaagatcaattagcagaagccctgtaagagtgtcaagaaagagtataagcaggaatccagttagatcatctgccagaagcttgagcagaagctctggtagagtccctttgagaagcattagccgaagttcagttagagcaccaagcagagtcaatcgccgcagttattctaggagtcgtagccctgtttgtagggcaaggactcctcgtggtaggagcttgtctagaagtgtgtcacctgatgtttctccgaaacatcataccgctatagtggctatagtggacgaagtgaccgtgacagatattcaagttacagaaggtactcccctaggcgtaacaggagcccactgccatgcagaagaactccaccgagtaggaggagcaggacaccctttatatcacgcagcccacgttactgagctcgacaatatagccgaagtcgtagcctggtctgcagtcgttcacctgttgatacatatagacctcatgtggagaggagcaggtcatcgtcccaaagcaggagttcatcacgatcccgggcagaatcacagtctccaccaaaagcgagcagaag

SEQ ID NO: 111817 - DNA, 213 bp, Glycine max
  Peptide Sequence Number=SeqID_228595
atggctctcgaggaagagtttgcaattgcatatctaaaagtgttgcaacctacccttttgcggacgagcgaggcgaagctcatgggtgcgtcttccataggaggaaaatgcgcggagtcgccaccaacgtttattgaaaggaaaacgttagaaaaaccaaaggaaaccggtcaagaagaatattccagattcgggagttatctttacgtttga

SEQ ID NO: 111818 - DNA, 243 bp, Glycine max
  Peptide Sequence Number=SeqID_228596
atgtcaggatttacacgcaattctcctcaaatttcagccagcccgcatcaattagaccttgcaccttacgcttcagagccctacaatgctcaatggaacgccccagggctcctccacgatatgcacatgttgcgttcgagtcgtatcctcagaaaaatggaggtggtcttcgtcatcggaagtgcggtagacagactttgtggttggtttagggatgggcctttgtggataactgggtggtag

SEQ ID NO: 111819 - DNA, 180 bp, Glycine max
  Peptide Sequence Number=SeqID_228597
atgacggcgacagcgacgaagtctatttcattgaagcccttaggaagagacaggaccgtgaggcgccatttggcggaggagattccgattatggtgcctaggtacgccatcaagcctctagcgacaatggcattggaaaaaggcggagtggagggcgcaaaagccggcaatgggaattaa

SEQ ID NO: 111820 - DNA, 219 bp, Glycine max
  Peptide Sequence Number=SeqID_228598
atgaagcttcattctctagctagttaccttagccaggagatactggcagagcaagaagttgatagagtgcatggattacctgcgcagcatccggtgaagttcaacaatatggtggttatatcactgtcaatgaaactcaaggaagagcactgttctattggtttttcgaggccactcacaaaccagaacaaaaacccattctcttatggctcaatggag

SEQ ID NO: 111821 - DNA, 407 bp, Glycine max
  Peptide Sequence Number=SeqID_228599
tggtggtgaccgttaaggagtgtgagggtgacttagtggaatcttcatgtgatggcaatgaggttgtagagaatgctatggatgaacaaggcattgttatgccacaaatctctccattggaagaagccaaatgggcattccaaggtatttggtatctttggtatctagacattttacaggtggatgtgattagtaactatgatcaaatggtccacatgagagtgcgatggcgcaatgctcaaccttggtttctgatagtggttcagtgcccccaattcgctaggagacaatcgttgtgggaagctttgatggaagtgagttttgatttagatggacagtgggttgtgatgggtgatttcaattgtactcttttgccatctgagaaagtgggaggtaactctgagtaa

SEQ ID NO: 111822 - DNA, 513 bp, Glycine max
  Peptide Sequence Number=SeqID_228600
atggttagaattctcagaattgggttgcgaatgtggtgctcaaatttcacgatgatccaacggtttggtaggctgcgggaaaaagagaggattttgagaggagaaggaaaaaacgaaaatgagggaaagaagaggcacctttacgaaaattgggatgctacacctttgatgaccattcaaaatcatttgaaaagatgtgaccgttgggagttattttcaaaaattcctcactggaaaattagaagaaaagatttagaacaacaatttggaagttccaaggagtttatcatatcaacaactcaagctttgggagggagtgcatattctgctaatgatatcactccttccaactttattgagtcaacaacccaagttgctaattgtgaatatgaagatgacactttctgggatggggcaagcacatacctcattgcaaatgagctccacgctggtgctaatgagatgttagagagatgggagaagcgaagcaagtgtgggcctcgtcataaatga

SEQ ID NO: 111823 - DNA, 285 bp, Glycine max
  Peptide Sequence Number=SeqID_228601
atgtatagtgtcgttgccaacgccagaattcacaagcgattattaagttctaaagttgatgtctcgctaagcgagctcaatgcgcttagcgagtgtcatccgctaagcgaggcatcaacgcgcttagcggataggaggaatctggaagggaatctgtcacgcaggcacatactcagcgcgttatcaactcactcagtgagttatttgtctccttccaggcttagcgtgggtttggcgctgagcgaaaattcacttactcgcgctaagcgcgaaaaatggcgctaa

SEQ ID NO: 111824 - DNA, 369 bp, Glycine max
  Peptide Sequence Number=SeqID_228602
atggagatgcttgagttagtgtcggatggtgttgtgaaggtttatggaatcttagggggtggaacattcaatgaggtgcatgttagtagggatgatgttagcagtataagtaggtctaacaatattgaaagcaattcatcagatgatagtggacccacgaagggtaagcagttggatgatgagatggtgatgaggttaggagcagttagtgtcaaagagacgctccaccagattacagaagattggacgacctatacaaaagacaagagtactggactagatgacaaatgttgtcgtcccactatctctatcatccatcgtccaacaatcaagaatctccacattatttcaataatatttttgaattaa

SEQ ID NO: 111825 - DNA, 354 bp, Glycine max
  Peptide Sequence Number=SeqID_228603
atgtcatcattctcttcgctggacttccttgacgtaatcttgcagatactaagtcatctaacaattgagagacagagtttagtcacctttgctggtacatcctcctccactcaagaggtcaggtctactggtttcgtcccccatggacgtcaggatgttctcacagctgctattggacgtccagagcaccctggacgtgtctgtgctactggagccggtgtcaccatcaagcaatactttggatcggcaccatggatgttccgcagctcttcctcgctgcctcctgaagaattccagcagctgacccagcaaatcaaggaccaactagaggagtcaatcacaaaaaaaaagtga

SEQ ID NO: 111826 - DNA, 864 bp, Glycine max
  Peptide Sequence Number=SeqID_228604
atgatcccggatagaaggactagatttctagatcaacaacttgatagattcaggacagccaagggactttttggaataagcatggcaatagacactaggaacgaagcaacctggaccagcaaggtggcacctaagcatacctccgccatcaatgcaggggctaccgccgaaaatttggtagctgagcttcttgacacaagggagcttgttggagtggttcggggaatcattaagaatgtgggcactctttctgggccattcttgaaaatgggttgtatcttaggcctcagagtctctcctacttacaggagaaaaagggttgcactaagacttgtgaccgcaactgaagaatggatggtgagaaatggagttgagtatgcattgttagccactgaaaataacaatgatgcgtctaaaaacctattcaccatcaaatccaactatgtgaatctcagctcacttgtcatatttgtccaaccaactagttcccttacaaagaaaatttccatggatataaaaatagacaaagtggacatagatctagcaatttcgttgtacaaaagaaccatgaggaccaaagatttgtatccattggacatggatgttattctgaaggagaaactcaacttaagaacatggaaatattacaaggaaaagtattccttagtaatcccagagcctggctcctctaaagaatgcaaagaagcactatcccaaaaagctataggatataaagcatggaaacaagaactagagcatgaaagaaaggagtacacaacaacagtgaaggaagaaagtagatgcagaagcacaaagaacaaagagcacaaagagcatgtatgcagaagcacaaagttacaatga

SEQ ID NO: 111827 - DNA, 198 bp, Glycine max
  Peptide Sequence Number=SeqID_228605
gcgttcagaaaggatgatagagccacacttgataggaaggagttgtttaaaaacaccttgagaaaagcagcttatgcatggaaaaggatcaacgagctccgtcttaatggtgagttttctgttgctcttgaacaggaagcttataagctcagatcttttgtggatcaagctgcatttacagatcttcattgggtataa

SEQ ID NO: 111828 - DNA, 2571 bp, Glycine max
  Peptide Sequence Number=SeqID_228606
atggcctcctatggtgtggcgtctcctctctctcttcctttctccattccgctgccattcatcttccaagaagcaaaggaatccattgatgaagaagatcctaggcctacaagctccaatggagcttgcatcatgctccgacgacaactaattcgcccgagtcggagtccttattcttctccggtactcctggtcaagaagaaggacggcacgtggcgattttgcatggattatcgcgctttaaacgaggtcacgatcaaggaccgttttccccttcccactatagatgagctcctcgacgacctcggccactcttcttggttctcgaagctggaccttgcccaaggtttccaccaaattcgtatggctgacccagatatacccaaaacgatgttccatacttatcagggccactatgagtacgtcatcatgccgttcagcctctgcaatacgccttcgacatttcaggccaccatgaatgatctattacggtcgttcatcagaaaattcgtattggtctttttcgatgatatcttaatctatagccgcgatttccatactcgcttggaccaccttgaacgcgttcttcaaactttgcaacagagtgactttcatctgaaggcatccaaatgcatcttcgggcaacgccgcatcgaatacctcggccactttgtatctcttagaggtgtggaacctgatccttcaaagctccaggccatgcaacaatggccaaccctgacatccccgcgccagcttaggggattccttggtctaaccggattttatcggcgctttgtcaagaattatgcccgcattgcagagccactcacgcaaattttacgcaaagaccaatttgcgtggtccactgaggcacaatcagccttcgatgatttgaaagcagccatgacctccactcctgtcctctctgttccagatttcacgattcccttcgtggtggaaaccaatgcctcaggaacaggcatgggcgccgttttgatgcagcgtggacacccaattgcttactttagtaagcaattctgccccaaattacttcgttcctctacttacatcagggaattacatgccattacctcagccgtgaaatgctggcggcaatatctactgggacatcctttcgtaattctgactgattacaagagtctgcgagaactcatgacccaaccaatccaaacccctgagcagcacgtttatcttgccaagctattaggatataattattccattcaatacaaggccggccatagtaacgtcgtagctgacgccctttcgcggctaacggaggacgacaacaccgcagcaatgtattccattctatctatacctcaccccaaattcttggaagacctgaagcgtgaactggcctcatcggaagaatttcatgacctcaggaagagtgtcaccgacgaccctcaccaacatcctgtgttcactctcagggatggcctcttactgtacaaggggcgcatttggattaactgtagcagcagtttcattgccctccttcttgaggaatttcacaagtccccattgggtggccacatgggattggccaagaccctcagtcgactacaacagagcttctactgggaaggaatacgccaggacacacaaaaattcattaagcaatgcgtggattgtttgcagaccaaatatgttcctcagaaaccggcggggctcctccaacccatccctccactgtcgcgtccatgggaggatttggctctggatttcattaccggcctccccaactcccaaggagccaccgaacttttccggctctgcggcacaaagctacgaataagcaccgcctatcatcctcagaccgatggtcaaacggaggtgctcaatcgcgtgctcgagcaatatctacgtagcttcgtccatcacaaaccaacacagtggggtaagtttcttagtctcgtggaatggtgctacaacaccacttgccactcttccactaacctctctccctttgaggttacttacggcaaaccaccgccgacaattatagactatctgcctggctcgtcctcagtggaagcagtagattttctactttcatctcgtcaccacttgtttgagacccttcgccgaaaactcgaacgcactcaagcaaagatgaaaacgcttgccgatactcatcgccgagatgccaatttcaatatcggagattgggtctatgtgaagttgcgaccctaccgacagacctccatagctgataagtatcagaaattgggcaaacatttctacggtccttatcagatcactgattccataggcaaagtggcatatcgagtggcgttacctccttcagccaaaatccatcccgtcttccactgctccaaacttaagcttcatcagggccccatcactacagatcactcacttcctccaacttcttgggacaacaaccccgtgatagaaccgttgaccataatggaccataagtgggatactaacgacccaccacagctgttagttctagttcaatgggccgatttgcaacctgaagactcctcgtgggagaattgggccgaactcaagacttag

SEQ ID NO: 111829 - DNA, 204 bp, Glycine max
  Peptide Sequence Number=SeqID_228607
atggaaaggaaaagtgggagtgttttgatggaaaacgacattcttcttgttggtgacgacccttgggaagaatttgtaagctgtgtccagagcataaagatattgtcatctgctgaggtacagaaaatgagcttggatagggatttaggtcatgttccagtccccaatcaagcttgtagtggaatagataacaacaatgcatga

SEQ ID NO: 111830 - DNA, 1129 bp, Glycine max
  Peptide Sequence Number=SeqID_228608
atgggttcggatagagagagagaaagctgcaactctcgccacttcgcatggctcatgaagtcatgcttccccaacccaaacgacgccgtcgcgaaactcgcgtcaccgccgcaatcccaccgtaactcccctgtacccgcaaccaccatatcctccctccccgatgacatcgttttagactgcctctcccgcgtgcccacctcctccctccccgccctctccctcgtctgccgccgctggtcccgcctcctcagctcccccgacttctccgacctccgccgccaccgcctcctcctccgtcacaccgccgtcgccatcgccggcaccaatcttggcctgtcctccgccacgctcctcgacggcgcgtggcacccctccctcttcgtcccttgctacgacgcacactctctagataatttccactccttactcgcccacgcgcgcgcgtgctccgtcggtccgagaatttacctcgtcggaagaaacaacaccttgctatacgacacgtggaccgctacggtctccacccgcgcatccatgatcttcccgcgcaaaaagttcgccctcgccgccgtcggtggaaaaatctacgtttccggcggaagttctggaacctccgctgtcgaagaatatgatcccgagactgacacgtggagcgtggtttgcaacgcgccgaggaagaggtatggctgccttggaacatctttccaaggggtgttctatgtcattggcgggttgagaattggcgccacggaacagaatttaccgaatttgttcccacgtgcttctcgcggagttgaggctcacgcagcgtacgccagctcgatggatttgttcgacgtggaggcgcgcgtgtggctccggagtcggaccgtacccggtggaggctgcgtggtggcggcttgtgctgcggtcgggataaagagcccgccgctaccggcgcaagttagagtggacagtagaattaggtttagttgtgtgggaattggggataaggtgattttaattcaaagtttgaatgaagtgagaggagttaaagaagggtttgtttttgtttatgattgcgtcgccgaagagtgggggagaggggtggatttgccggaggtttatcgacgcgctgcctatgtgg

SEQ ID NO: 111831 - DNA, 603 bp, Glycine max
  Peptide Sequence Number=SeqID_228609
atgtgctccaccattcataagcccagtagccataggggatacacacaacaaagcagcgagctagggagctgtcatatcaggaatttggcagaagggaaaagggtagatgttttcagtgtggcctaccatttggtctcatgcctaggggggattgttaaagatggtaattctgggaggaaggacagtgtgaaggatatggctactatagaaaaccgcttgcaaaaattcaagctacctgaacctgttctgtgcattggaggtgtactgctagttgagctgttgggtagagttcaaaagcaagaaatggatgaattattctatatatgcatctctcatgttcaagttatgggacgactgctttttccggaatttgatgtcaaaattcatcattggtcaggaaagtgtaccttgaaatactgccctcaaacagattgttatatgtcttctccaacatcatcaccgagaagcaactcgagtaatccgtcacgcctgcggaccataacctcaagcataatgcagaggggtgtgagacgttgggagcaatttctcttgggtgcattgcttggtactggtcctgttgtagttgataatgaagatcaatga

SEQ ID NO: 111832 - DNA, 453 bp, Glycine max
  Peptide Sequence Number=SeqID_228610
atgggggccggtgtttctacaactgcaatagaaaatgatgatgggggcactttttctttgtcaacaaagactacccttgatgatatccctgagaattgcatctcttcaatgatgatgagttttgatccacaagagatttgcacattggcaagagtgaataaggcctttcacagagcttcctctgctgactttgtgtgggaatcaaagttgcccccaagctataaattccttctaaataaagtacttggtgaacaaaatcttggttccatgaccaagaaagagatctatgccaaactgtgtagaccaaatttctttgatggtgccaacaaagaagtttggctggacagaagcagaggacaagtttgtatgttcatttcatcaaaatccttcaagattacaggaatagatgatagaagatattggaataatattccaactgaggaatccaggtga

SEQ ID NO: 111833 - DNA, 162 bp, Glycine max
  Peptide Sequence Number=SeqID_228611
atggctgttttgtgtggtattgacaaagcaagttggtacagtttaccaggtcacaggcatatttgcagaagctttaagactggtcttaacacaagttcttctgcagaaaaaggggttgactttaaatcctattacaagcttatattacatagctccctgcag

SEQ ID NO: 111834 - DNA, 240 bp, Glycine max
  Peptide Sequence Number=SeqID_228612
atgatgatcaacaaaacgctttttctcacttatgtctacttgttcatctacatcctgctctcttccggcgtcattttgtacaataagtgggttctgtcgccaaaatacttcaactttccccttcccataacgctcacgatgattcacatggccttttctggggcagtcgcatttttccttgttcgggtctttaagctaacagcaatgcatcctacattaagtgcaagttggtatatgtaa

SEQ ID NO: 111835 - DNA, 384 bp, Glycine max
  Peptide Sequence Number=SeqID_228613
atggttggagtattctcgcaaaacagagtgaccctaactagtcaccttatgatttcacttagtgagggtgacctgacatacccattgtgtggcatgtcttgttatgtactcctaggcgccttggtgttgtttttcattaacatgaaggtgtcacagacaactacaactattgccgaggatattgagcatgtggatgatgttgttgacaaggctcatgaggagcctcatgatctagttacgaaggatgaacgtactaagttgaagttggcctctcatgggaggaaggtcgagaaattagcaaggtttgcacctgaaattgaaggtttagtggctgatacagacttaagttctctgattacatgttcattggatagaggagactaa

SEQ ID NO: 111836 - DNA, 230 bp, Glycine max
  Peptide Sequence Number=SeqID_228614
aggaaactctgggtccaacaaagataggagaaaatcactcaaagtgtatcaatctcacacagtgcatggcgagaaagtcgctagcgcacaggattttgtcggcaatcaaaggaagaagaccactttaggtcgtgggcaaggattgacattctcaccctgggtcaaggtttatgataagttgggattttggctcaaggcttgtagaacggctggtcatgatatatgtcagg

SEQ ID NO: 111837 - DNA, 153 bp, Glycine max
  Peptide Sequence Number=SeqID_228615
gttaggaagcctcctagacatccacctatggtgcatgatcctacaacaattatgccacatccacctatgttgcctgatgttatagcaactaggccacatccacatgcaacatcacctattgatatagagatgcctcaacatgtagtggtataa

SEQ ID NO: 111838 - DNA, 516 bp, Glycine max
  Peptide Sequence Number=SeqID_228616
atgtctcttgccactctttttggaaagcttcaagaacatgaaatggaacttatgagactccatcaacatgaagagaatgataaaaagaggaaaggaataacattcaaagcctcatcatcttttattcaagaagaaagtgacaaagaggacttgaatgaaatagaagaagacgatgatttcagagtttttgtgaagagattcaatatgtttctgagaaacaaaagaaatcaaagaaaagcaaacatcaatccaaagaagaaaggagaagattcctccttacccccaaaatgctatgaatgtgatcaacctgaacacttgagattcaattgtcctatccttaaaggaagaatgaaaaaatccgacaaaagaaatttcaaagaaaagaaagcatacatcacttgggaagacaatgacatggattcatctgaagattcatcaagtgattcagaaaataaaatcataaattcgggtctcattgcaaaagactatgaaaatgaagaagagttggcacattga

SEQ ID NO: 111839 - DNA, 747 bp, Glycine max
  Peptide Sequence Number=SeqID_228617
atgttgcttcatatcagaataaaatccagtgatgttgttaaactctacaactacaagtcaaatggtgcaaaccagtctgatgacaacaccaagctcaagattgcaattgttggttttggcaacttcggacagtttcttgcaaaaacttttgtgagtcatggtcatcgagtgttggcatactctagatcagattacactcacgtggctcaagaattgggggtttcatatttcaataacattgacgatctttgtgaacaacatccagaagtgattttactttgcacttcaatcctttccacagaaaaagttcttaaatcattgcccgtgcaaagattgaagagaattagaataggaatagatgaatcaagaacatcacggtgtgatcggtttcttgacatttttgctagtgaagggtgccgaatggttgaaatgtcatgtgctgaacatgattggcatgcagctggatcacaatttatcacgcatactaccggaatatttttagaaaaactggagttggagagaacgccaattgacacaaagggctatgagactttgttgagtttggtggaaaatacagctggagatagttttgatctatactatggtttgttcttgtataatataaatgccatggagcaaatagaaagatttgatcgggcttttgagtctgtgaagaagcagctttttgatcgtctgcatggcttctaccgacagcaagtatttaaacatgaagaaaaactcccatga

SEQ ID NO: 111840 - DNA, 171 bp, Glycine max
  Peptide Sequence Number=SeqID_228618
atgtgggactgggaatgccgttcatcagggaaattctcggtcaactcggcatataaggttcttcacgcacaagaagtaggctcccaggaagtggttttgataaaagccaaggtttcaaatatctcggaaagtgatttgaaccgcaacatcaaagtttttaagtgtttgtga

SEQ ID NO: 111841 - DNA, 393 bp, Glycine max
  Peptide Sequence Number=SeqID_228619
atggagcttctagacacaaatctcgaaggaaaagcgaagctgtacaaagaagtaccactaagctgcatatttatgatgaacgaaagaacttaccacaagaactaccaggttgaaacatggagcaagattctgagttctcttagccctaaaggtttgaacgagaatgggaaagtgcataagtcgatgctgaaagagcggttcaagagcttaaacatggtgtttgagaagattcacaagacgcaaaatgcgtgggtggtgtacaacgaacaacttcggaacgccgaaggaggagtagttgttgttaacggtgccttggtcgtcccattggggctcttcagcgagggttcacaagagcttgggtggaacggagaaagagggtttgaaaagcctagg

SEQ ID NO: 111842 - DNA, 369 bp, Glycine max
  Peptide Sequence Number=SeqID_228620
atgaaaaagatgaatagcacacttttgttttctgtaaaagaacaaagtttggaaaccagaaaactcagaaagcctttggcaaaggaagaagaagaagaagttgaagaagatgttcaaagagattcaaaggaaactggtaatcaattaccagagagtaaaaactctggaaaactaggcagcaaatgtcgaggtcaccctgtcgtgcataggcaactccacacccccccccctgcccatggtgatcagcttgagtctcaagggagttccaaacagagtgacatgcccccaagtacaactatttcccctcatgagaaactacaagtactcactgataaagtttatgctatttccatgcaatatgaagtatga

SEQ ID NO: 111843 - DNA, 246 bp, Glycine max
  Peptide Sequence Number=SeqID_228621
atgataggatggccaaattcaagaaatagatggagatgttacaagggaagaaggagaaactacctattgaaaaactcacatgggacgtgccacatcaagtgcgagttgcaacttcattcttttatagagaagataggtcaccttaaccaaaagcctaccaacatgactctacaattttccaatggttctaaaaagaaagcactatggaaagcggtaaatgtgacaataaaggaagatctttcatga

SEQ ID NO: 111844 - DNA, 1627 bp, Glycine max
  Peptide Sequence Number=SeqID_228622
atgccatctttctcattcttaagaacactcaggctctctctttttccgccttatcccccaattgcaattccaactgcaaccctccattatcaatcccattctcaacctcactatcaccatcatgctgttgcctcattcaatctcatgcttcttatgcgccctcccccacccaccttcctttttaacaacattctgagttcccttgtcaagaacaagcgttatcccactgtcatctccctttttaaacaattcgagccaaatgggattacacctgacctttgtactctgagtatcctcatcaattgtttctgccatcaggctcacatcactcttgctttttctgtattcgccaacatcctcaagaggggttttcatccggatgcaattaccctcaacacactcatcaaaggcctctgttttcgtggggagattaaaaaaacactttactttcacgatcaggtggtggctcaagggttccagttggaccaagtcagttatgggacgttgatcaatggtttgtgcaaagcaggagagacaaaggctgtcgcaagattactgaggaagctggaaggacactcggttaaacctgatgtggtgatgtacaatacaataattaatagcttatgcaaaaataaactcctgggagatgcctgtgatgtgtactctgaaatgattgttaagggaatttccccggatgttgtcacctacactactctgatccatggcttttgcatcatgggtcatttgaaagaagcattttctttgttaaatgaaatgaaattgaaaaacatcaaccccaatctttgtacctttaacatattgattgatgcattaggcaaggaaggtaagatgaaagaagcattttccttgttgaatgaaatgaaattgaaaaacatcaacccggatgtttatacctttagcgtattgattgatgcattaggcaaggaaggtaaggtgaaagaagcattttccttgttgaatgaaatgaaattgaaaaacatcaacccggatgtttgtacctttaacatattgattgatgcattaggcaagaaaggaagggtgaaagaagctaaaattgtgttagctgtgatgatgaaagcatgtgttgagcctgatgttgttacttataattctctaatagatggatacttcttggttaatgaagtaaaacacgcaaaatatgtattctattctatggctcaaaggggagtgactcctaatgttcagtgttatactatcatgattaatgggttatgtaagaaaaaaatggtggatgaagctatgagtctctttgaagaaatgaagcacaaaaatatgattcctgatattgtgacttataattctcttattgatggtctgtgcaaaaatcatcatctggagagggcaattgcattattaaaggaaatgaaagagcatggaattcagccagatgtatactcatacacaatacttcttgatgggctgtgcaagggtggaagacttgagattgcaaaggagtttttccagcatcttttggttaaaggctgtcatctgaatgtttggccatataatgttatgatcaatgggctttgtaaagcaggcctgtttggtgaagcgatggatttgaagtcaaaaatggaaggcaaag

SEQ ID NO: 111845 - DNA, 267 bp, Glycine max
  Peptide Sequence Number=SeqID_228623
atgtctcctccacctctagaacctcacaatcactcacaaacttatctcaagctctcaggacgacttcctcttcaagctcgattctctataggtggtcttgttgttgcttttgcgcttagcgcgactatggaccgctcaacgcttattagtggatttcagcttagcatgtgctttcttcgcttagcgaacatgcacagtgcatccttcttccagattcttcctcgcgctcagctgaagcaatggtgcgctcagtgtatggctcgctaa

SEQ ID NO: 111846 - DNA, 537 bp, Glycine max
  Peptide Sequence Number=SeqID_228624
atggcgaaggctcagtcgctgaagaaggtcgtcaattgtggaggccatggtgtcgacggcagtggcaagtttgagttgattgggggtgagttttgcgatggttgcttcgatgcgtgtagaagcaagcttcatgatgatgaaccaagcaattttgatgatgccaaaagcccaagtacatcctttgtggtgcaagtagagcatacatctacttgggttgtaatactgagaacaagagatgatatatctcttgtggatcagttcaagtcacttgatccaacaatgcgatccataatggagtccgcaacatctacgtggaaattcctttccattttcgggtgtaagatgggagataatggtggaagagttcgctcgataccaaacaagcctagcaaatgtgtgcgggggataggtcctgcagaaataggtgctggtgggtggctatgtggaacggatgtcgtgggaagaggtggtttgggttggcatagcagccatggaaggcaaccattgaagctcaatgaaagcaccaaattgttatga

SEQ ID NO: 111847 - DNA, 624 bp, Glycine max
  Peptide Sequence Number=SeqID_228625
atggctctggtagtaaagcatgttcttcttttcaatggctctggtattgaagagttggattattatggattagttgcacaagttctgattcagttggccaccattgttccaggccacgacctgcacataatttcggtttttttgttagacacaacaaacgagttttggttagctgctgaaccgggatttgtcaaagagcacccaagtgaccctcatgtgtcaacctgtgaaaaagccgcaaaaatcatttctagaatatgtgacatagtgctgccacaggcattgacctacacaaatgcatactttggtagtgctgctcaaacgtgtggcatctttgaaggctaccccaaaaaaagcatgctacgtgatcctggacaagaaggttttaggcaagcacaagcaccttattatgagaagttagatactgattcaaagaaaccattgtataccggatacactaaatacacacggttatcaagggtgttagctttggtgaatttgaaagtaagatttgggtggagtgtgtcgcaacatgcccttcgcgggcgagcgagggcgaggctcacgggtgcgctttccaaaggaggaaagatgcgcggagtcgccaccaacgtttatttgtag

SEQ ID NO: 111848 - DNA, 297 bp, Glycine max
  Peptide Sequence Number=SeqID_228626
atgaagaaaagacatgagctatctattgtgtccacccttgtatgtccgatgggcgcaacctcattcccacaaaggtcaaaagacctaagtgagattgatgaagaagatgaaggccttgtacaattagcccttcagaaaaggcaagcagctgccctggttgctcctgccccaaaaagggctaagaaagccttggatcttcttcatcaatggagtcctttgcttcttgaagatctggcagcgaaatggagaatgaggaaggatgattggagatgccactttaaggagaagatgagttaa

SEQ ID NO: 111849 - DNA, 126 bp, Glycine max
  Peptide Sequence Number=SeqID_228627
atgttatgctctattcctagcaacctcaggcgaatttgtgacttagtgctgaaggcaccaattcgcccagcaagttgtagctcacccaggcgagttggttgcttatggctgaagaaatcttattag

SEQ ID NO: 111850 - DNA, 378 bp, Glycine max
  Peptide Sequence Number=SeqID_228628
cctgctgtggatgcccttgactttctagagggtgatgaggatccacttcttgaggtggattctcccgaggaagtcatgttggcatctgaggcagactctacggaggatggtggtccgggggagatggcgatcagcggaggctcttcatcctacccactaatccaagatcaagtccaagattctccactaagtgtgcttaggtgtcatgaggcattgtccgctaagcgcaacactcatgggctaagcacgaggaagactctggaagaagatgagttgtacagggggagtttggactgggattcaaagctttgcatgactagagattctagagagagaaagagactagagcttgaagcaggagccggtttgagagcttga

SEQ ID NO: 111851 - DNA, 288 bp, Glycine max
  Peptide Sequence Number=SeqID_228629
atgactggtacattcttccttttgagacagcaaaatagtttagagattatgagcgattattaccatcaaaccagtcattattttggggacgccacatttttcacgccatatattatgccagcaaagggagaattctttttggcaaagggagaagggaatgaaaagatgaatagcacaagttttcaaggtttagaaaaccagaaaaactttggaaagcttttagcacaaagaagaagaagaagaagaagaagaagttcaaagagattcaaggcttgtaaagaattgtaa

SEQ ID NO: 111852 - DNA, 1089 bp, Glycine max
  Peptide Sequence Number=SeqID_228630
atggaagaaggattctccaccaacaaaccacctctgtttagaggcataaagtatgattattggaaggagcgtatgatagcccactttgaattgattcatatagatctatggggcatggtggaaaatggagactatatttcgtatgatgatcagttgaatgaagttcctagaggccaatggatgaagggacaaagacttagatttatgctaaactgcaaggctcaaaatgtgatgttgtgtgctcttttagaagaagaatacaccaatgtcacaatgctgagagcattaaagaatcttgactgtatgtccattgaggaacttgctagtacccttaaggttcatgaacaagaacctcaacaggacgaaggaaccaaaagagaaaagtatctagctcttagtagtcaaaagaacaagaaggcatcatcatttagagaaccagtcttgagaagttcgtcaaaagatcttaaagttgatgattcatctaaggaagacttagatgaagatgagcttgcctttattgctcaaaagattcacaagatgtggagaagaaaaagaggctctaagtggagaaacttctcaagaagaacgtccaaagaaaagaaagataaagacaaaagctccataattttctatgagtgcaaaaagcctggacatttcaagtttgaatgccaaaaattgaagaagagtcatgataagaagaaattcttcaagactagagaaaataagggtcttatgagtacctgggaggacctggacaacacctcgtctgatgaagattatgaggtaaattttgatgatcctgaatctcttagaaaagcttatcatgagattctatcaaactcatctattctctcaaaagcttacaaaaacctacaaaaatatttcaagaatctaaccatagatcatttaaaacttgagaaaacccttcaagatcaagtagatgtttcattggatgagtccactcagacatgtgaagcttgtataactcttaaagaaaaagattccaagtcatgtcttgagattgagacaagtgctagagaaagagctattcttctcaagaacgttcagaagttgaaaaacaaactgtaa

SEQ ID NO: 111853 - DNA, 966 bp, Glycine max
  Peptide Sequence Number=SeqID_228631
atgtcatataaggatgatttgctttgtgaggcatgtcaaaaggggaaacaaattgaaaactattttactagtaagaacattgtttccacctccagacctctacaactactacatcttgatatgtttggtccaactagaactgcgtcctctagtgggaagaggaaaaatccagagacagaagcgtccactcaacaaaaagttcaagaagaggtaagagaacccattggacgcatcatgagaagaaatcatctagaaaatcaaataattggttatctagcacatcatattcaaacaaggtcatcactcagaacacaagggcacattgcattgatatctaaaatgaaacccaaaaacattgatgatgcaacacaagatgacaactggttagttgaattacaaaaaggaaagaaagttgttggagcaaaatggggctttttcaacaaattggacgaaaatggtaaggttgtgagaaacaaagcaaggttagttgctaaaggatactcacaacaagaagacgaatttgaattgagcatgatggaaaagttaaaattctttcttggatttcaaataaaacaaacacccaaaggcatctacattcatcaaaccaagtatgtgaaagaagagaaagttaaacatatttgtagatatccaattggaacttctaatcttcgtcttatgttcaaaagaagtgaaagttttagacttacaagctactgtgatgtcggtgataaagttgaaagaaaaagcacatgtggaagttgtcactttattggtgtcaacttactaacatggatatgcaagaagaaaggcttaactgcattgtccactgctgaagctgaatatatgtcagcaacaagctattatgctcaactactcgggataaagaatcaacttgaagactacaatatttgtgagagtaaaatttccatctattgtgacaataaaactgctattagtctttcataa

SEQ ID NO: 111854 - DNA, 408 bp, Glycine max
  Peptide Sequence Number=SeqID_228632
atgtccccttatcgggttgtctttggtaaggcatgtcatcttcctgtagagatagagcacaaagcctactgggctgtaaagacctgcaacttctctattgatcaggttggagaggaaaggaagttgcaactaagtgagctagaagatatccatttagaagcctatgagaattccaaattctacaaggagaagaccaagaagttccatgatagtttggtagctaagaaggatttcgtggttggacagaaagttttatcatataactctaggctcagactcatgagtgttaagataaaaaatgaatccacagataagagcttcaaggtcaatggacaccggctgaaaccattcctcacaaatccctccttagtgggtgtagtggtgggaggagatctccaaatttattga

SEQ ID NO: 111855 - DNA, 597 bp, Glycine max
  Peptide Sequence Number=SeqID_228633
atgggctcagatatctatcctaaggttcatgagaaccctagggccttcttcagcagctctagcccaatccttttagagcctcttgctcatggctctagtgactggtcccttcctaggaaggattgcattaacctctccttaggctccaaaaccacgaggggccacatcgatgtggtcatccggttgcctggtcaaggctctactccatcaatgcctcttgagctccttatggaactcatcatattgtgtaatctgcatctcaacattcctctcgaggaggatgttcatggcatgaatgttttgctcatatcgctctcaggcgacctcagaaacgaatcaagtggtatcgtacggctcctgaggtctagaagtggaagcacgtctctttctggaggtcatctgcaccaaaacaagcaaaagaaaagaagtgaggcagggctcgctaagccttattctaaaatagagaagaaattgcgcttagcgagcatgattcgcttagcgcatgtacagaaatctacagaactaaatttccttgggcttagcgagacagactcgcttagcccaggattattcacaatcagaggcatgctggcttag

SEQ ID NO: 111856 - DNA, 1057 bp, Glycine max
  Peptide Sequence Number=SeqID_228634
atgcaaaatggatttcggttgaagaccacacctgcaacaaagagggggccacatcaaggatttgtttcttgcaggagcaccaaaagagacataggcttgagtgagacaaccataagcagctttggccgtgttaatgtcattctgagcattatcccaaatgatggaatctgggctatcaaggctccacgatctcacacgttggactgtgagtaccctttgttaaaaggacaagagaaaggaccttcaaaacaaaagactctaacgcttaagcaagtacatgaattaggtgagaatgagagagtgaaaagggtgagatggaacctgatacttatagagtggagtgggagttgcggggcgagacgtccatgctcctgtgttagggctgaaatggagggttggcatgtgtattggagtgccacgagaaatttcgtgtcgagcatagtagccttgacaagtaagagggttgtcagtttgttgagccccaagcatggacaagtgttgtctgatgttgatggtgataaccttgataggtacgcgagttgtaggtctttcaagcttgtcaaggcccccagccgggacaagcgaatgttgcgcacgggcgttacttttgcatacgtgtcactcgtggaatgggcacgtactggagacacggtattctttctcttgatcgtgtcttttatttctcactcaaccatgggtatgggcggtagtgactctgggggtttgattcagcaacccctagtggaccgagaggttatccccatcaacgattcctcggaggaggagactcgccatggggcttctgataacaagtcctcttcctcgaagaggttgacgatcttgcactgtgttggtggaggcacatctcgcctccgtaggagggcattaccttctgttgcttctttggatggggaacctgttccaatcaccacaattctccccccttctacttttgggagagtgaaaaggaatggtggcaaggacattatggcttcccctcgtgtgtgtcgtagccacagtgctgggtcgccatcgtcccctcctaccattgctggtt

SEQ ID NO: 111857 - DNA, 705 bp, Glycine max
  Peptide Sequence Number=SeqID_228635
atgaacgtggatcacgatcagcctccctcggtggccaaggcccaagcgctgcagaccctaacggcaggttctctctcgtcgtcggtggcgaagctcgccgcatcctcgcggtgcatcccttccgacaaggacttccacttctaccgcaacttcgaggagttcaaggtccccgtcgacgaaatcgcgcgggagtctcggtcgatgctcgaggccttcggcgctgtggcggcccacgcggcgttccctggcgacgtcgacgacgacgccgcttacgactggctagtgaacgcgaatgacgacattttggagcggttcgacgtgtcggcggacgagttccggaaggtgctgcaggaggaggaggctcggcgtccggcgatgcattccatggaggaagacgggtttcagttggtttctgggaggaagaagaaaggggggagaggaaatgtgactctggcggctacggattctgagacggtggcgtcaccgggagttacggtggcaaccaaggataagaagacgatggggccgaagtcgaaggttccgtttcatataccgacgattaggaggccgcaggatgagtatagtatagtggttaataatgcgaacatgccgtttgagcatgtttggttgcagaggagtgatgatgggttgaggttcattcatccactggttagttacttagttcatttgccttcagcttggtaa

SEQ ID NO: 111858 - DNA, 411 bp, Glycine max
  Peptide Sequence Number=SeqID_228636
atgtttggaaagaggaaaaccccaaagattagcaatgctaatatgtccacaacctaccctttggcgggagggcgacgcgagactcacgggtgcgtcttccaagaaaggaaaatgcgcggagtcgccatcaacgttttttcgaggaaaacgtcgaaaaaaccggaaagatgtggtctacgaactttaatcgtgaaaggttcgggagttgtttttacacacgggaaagaattttgcggattatgcaacaatgcttgtttttcctttcagaatgttgcgaaactttacggattacgcaacgatgcttgtttttccttccggaatgttgcgaaactttacggattacgcgacagtgctctttttgactttcggaatgttgcggaactttacggattgcacaacaatgcttgttaa

SEQ ID NO: 111859 - DNA, 607 bp, Glycine max
  Peptide Sequence Number=SeqID_228637
ccagtgtccacggcggttctgaccgtgccgtcacggaggttgacgaggtcggcaatgtcgtcgatgtacttatcggctccgtcggggaacatggtgccgcctccggggaagtggaacctgtcgccgtcgtagcggatccagttctggacggccttctccaccgtgagctcgcggtggggcacgttggcgtaccacgccacgtcgcggctcgccggccaggggaaggggttccggtagccgtgcggcgcggggacacggcatttcagaacctcgttgttcctcggacagtgtcgctcgcggtagaccattcttctgcgcgagtattggagggagcgcgcgtggtcctcgcagggggtgtactcgctgagcgacacgtggcaaggagggaaatggaggggcatggtgttgttgttgttgttgttattgttgttttggtggtggttccttggtatgcaccgaggaggcgaagtggaatcggcgttgagcatggtggtggtggtggtggtggtggtggtggtgtggttcagaagtggggcgtggtttcgagaaaagtgaaagggtgtgtctcgccaatgcttgggtgtgtttctgttgctggaggggaagg

SEQ ID NO: 111860 - DNA, 534 bp, Glycine max
  Peptide Sequence Number=SeqID_228638
atggctgcagcaacaaagtctctcctctctttaattcttctcttggttgtgtcacatgagacacaaatggccatgacacagagcagcacctgctcaagccagctgagtgacctcaatgtttgtgcaccatttgtggtgcctggtgtcaacacaaaccctaatgctacatgctgcaatgcccttcaagctgtggaccgtgactgcctttgcaacaccattaggattgcttctcaactcgcttctcagtgtcaaattccatcccttagctgtgatatcttcaatgaaggtaactggaatctgaatatatgctctagcacccgcttgaatcaggccgtcagggacatcattaacaacactttccttgcagctgatcttcatgcaatctacaatgggcttaagctggcttggcaaacaggctttaaagacatcatttgtgtaactgattcaaagtgtgctattgagttgatagcttcctcaactcaccaccatgctcctctcgttaatgcaattcgtgatcttttggctaaggactag

SEQ ID NO: 111861 - DNA, 1342 bp, Glycine max
  Peptide Sequence Number=SeqID_228639
atgggttttctccggcgactcttcggcggcaagaagcaccacaacccaccaccctcctccgacgcctccaaacccagcaaagacaagaaaacatggagcttcgtcaaacacagtacgaggtacaaacccaacacattaccaacaacacttaacaacaacagcaactttgacccttccacttcctcctctcctttccccgaatctttggacgccaacaaacatgccatcgccgtcgccgccgccaccgccgctgtcgccgaagccgctctcgccgccgcacacgctgctgccgaggttgtcaggctgaccagcagcaccggctgtgcctccagcctgcccgccgcggcgccgcagtcccggcgcgtggcaaatgaaaccaccgccgccgcagtgaaaatccagtcggcgtttcgaggttacttggcaaggagggcattgagagcacttaaagcattggtgaagttgcaagcattggtgaggggtcacattgtgaggaagcaaacttcagatatgctaaggcgcatgcaaaccttggtgagactgcagtcccgggcacgtgcaactcgtgggaacttgtcagataatatgcattctttcaagtcttcactttctcattaccctgtccctgaagattatcagcactcacttcgtgcctatagtacaaaatttgatggatctattctcaagagatgtagttccaatgcaaattttagggacattgacgtggagaaagctcggttcggttcccattggttagacagttggatggaagaaaattcttggagacaaactagagatgcatcattgaaaaatggacaccttgatgatgagaagagtgacaagattcttgaagtagatacttggaagccacacttgaactcacaccatagtagtggcagctcatttcagacatcatcacatcattatttgtcttctgattacaacaatgagaattttgtggcctatgagtctccatccaaacgttcttccaaagctctaaatccaagtctatcttctagggaggttcttccctttggctctttgaaatctcacaaaggaaaagaagaagcggctttgcaaaatgttgaggatagtcctcaagcattttctgcctcctctagacttggaagtgatgcaaggagaggtccattcacaccaactaagagtgagtgtgcatggagtttcttcagtggctacccgggtcatcccaattacatggcgaataccgaatcttctagagccaaggttaggtcacatagtgctccaaggcaaagaatggaatttgagagatatggtcattccacaagaaggtctcttcagggtctttgggaagcagggccta

SEQ ID NO: 111862 - DNA, 1215 bp, Glycine max
  Peptide Sequence Number=SeqID_228640
gttgctagttggggagcctatcttctgtcacgtgacatcataacagtgtcaattgcaccaagggacacccacgaagcacaagttcagtttgctcttgaaagaggagttcctgcattaattggggtcctagcatcaaagaggttgcctttcccttctagagcttttgacatggcacactgctctcgatgcctcattccttgggctgaatatgatgggctttatctgaatgaaattgatcgaattctacgccctggtgggtattggattctatctgggccaccaatccggtggaagaaacattggaaaggatgggaaagaacaaaggaggatttgaataaagagcagaccaaaattgagaatgcagctaaaagcctgtgctggaacaagctagtggagaaggatgatatagccatttggcagaaagccaaaaaccatttggattgcaaatccaatcgtaagctcactcaaaacagacctttctgcaaggcacaaaataaccctgacaaggcctggtacacagatatgcaaacatgtttgagtcctatgcctgaagtgtccagcaaagaagaaactgcaggcggggcattgaaaaaatggcctgaaagactaaaagccaccccaccaaggatttctcgggggaccataaagggtgtgaatcccgaaactttctcaaaagataatgaactgtggaagaaaagggtagcatattataagaaggctaataatcaactaggaaaagctgggagataccgcaaccttttagacatgaatgcttacttgggtggatttgctgctgcacttgtagatttacctgtttgggtgatgaatgtggttcctgtccaggctaaggttgacacacttggtgcaatttatgaaagggggttgattggaacataccataattggtgtgaagcaatgtctacttatcctagaacttatgacttaattcatgctgattcactgttcagcctctacaatgacagatgtgaattggaagacattttgttagagatggataggattcttagacctgaaggaagtgtgatcatcagagatgatgttgatatattggtaaaggtaaaaagtatagtcaatggcatggattgggacagtcaaattgtggaccatgaagatgggcctcttgaaagggagaaacttttatttgctgtgaagaattattggacagctccagccgcttccgacaagaatagttaa

SEQ ID NO: 111863 - DNA, 951 bp, Glycine max
  Peptide Sequence Number=SeqID_228641
atgtcatcaacaacacggagagatctagaaagtggaggggcgaacaagaactacaacaacataagctacagtgctgctcccacttcctatgtttacgatcccgaagttcattggacgtcatggctcgtgccgctgtttgtggcggttaacgttgtggtgttcgttgtggccatgtatctcaacgattgtcccaggaaaaatctcggctttgaaggggaatgtgtcgccaggtttctgggtcggttctcctttcagccccttagggagaatccgttatttggtccctcttcgtccaccttaacaaagatgggagcacttcggtgggatgatgttgtgaatcatcatcaagcatggagactcgtcacttgcatttggctgcacgctggagttgttcatttggctgccaacatgttgagcctggtcttcattggcattcgtcttgaacaacaatttgggtttgtgttcatgttcttttgtgttcttcaaattttgcttttgaatggttatgacctgacatttttcaaaacggcagtgaggataggaattatttacttgttgtctggattcggcgggagtgtactatcttccttattcattagaaacaacatttctgttggtgcttctggtgctctttttggacttcttggagcaatgctttcagaacttatcacaaattggagtatttatactaataaggcagctgctttgttcacacttctgtttattattgtcatcaatcttgccattggaatgttaccacatgttgataactttgctcatattgggggattcctcacaggatttctccttgggtttattttgctgctccgccctcagtttgggtggttagaacaacgacgtccccctgctggtgttcgcctcaagtcaaaatacaaggcttaccaatatgttctatggattgtctcggccattttactaattgttgggtga

SEQ ID NO: 111864 - DNA, 171 bp, Glycine max
  Peptide Sequence Number=SeqID_228642
atgcttggagtgacgcgaaactgccaacgagtccttgtctgttgggtgacagggttaacaggaattgtggattgtggccgtggcatgcggtgtttcgctttcggggaaagccacgttgtcttgtggttgggaacttgggatgctttcatgggatttactttttatttttag

SEQ ID NO: 111865 - DNA, 411 bp, Glycine max
  Peptide Sequence Number=SeqID_228643
atggtttgttacttgcattgtcgcaatggtttgttacctgcattgccttcgttgtcgttgtcattgtcgttgtggtgggtgttgtggtggcaacggtctggagacacgggagaggaacttgttgtagttgaaaacattgattgttcttatgccttcaatacttctcaggtgtttcctactagtgaggacgtattgcaatgggctcgtactgttacgtatgatattggttttatgactatgataatgaggtctgacacatcaaccggaaagagaggaaggacctcatttgttttaattggttgtgagatgagtggaaagtatagggcatacaagaaatatttagtaccgacgatgactagcactagaaaatgtggttgtctttttttaagctgcgagcaaaaccaatcctag

SEQ ID NO: 111866 - DNA, 762 bp, Glycine max
  Peptide Sequence Number=SeqID_228644
atgatgcatctaggaaacacaacaactaacagatctcgttgtggctgcattatgagaactacttatagtctctcatgtgcatgtaagctagctagatatgatgttggcagcataccacttgacacagtccatatgttttggcagagactaagattttcagaccaaggtttatctgagcctgaagtctgcataacccaagagatggaagccatattcaagaggtataaagatcttgatatatgttgcaaagtagctttaaggagtaaacttcaggaacttgcataccttgatcttacttcgatgtgtgctccttttgaaaatgtgaaaacaaaaggtgctcaaaagaaatggatgaccaaacggcaaagatcaacgaagcgtgatatgtcttactttgagtatgtggatgcattacattcggtgcaagatagttcctccacactaaacggtctggatcatcatctgaacaaacaaaatcaaaaaggaacatgtcaatgttggatctatttcatccatgcatgcaggatttcattgaagacattgttgatgtcaaagttgatggtaaccatggataaatggatgaatattaccaatatgggttatgtcattgcatcaaggtataacgtcatccttgtttctctttctctccgacaaagcatgatatttttccctcttagaagtcaacctccgagagatagttatgttcatcgcattatatgtattgatcatgtctatggaaatcattttgttcaggttttgtaa

SEQ ID NO: 111867 - DNA, 510 bp, Glycine max
  Peptide Sequence Number=SeqID_228645
atgtaccctcctgtcgcaacctacccttcggcgggagggcgacgcgtgactcgcgggatgcgtgttccacgaaaggaatacgcgcggagtcgccaccaacgtttatttgaggaaaacgtcggaaaaaccggaaaagacgcgatctacgaacttttaagtgaaaggttcgggagttgtatttacgcacgaggaagatcgaagaacgatgaagaacgaatgaagaacgtcgaagaacggtcgaaaaccttcgcgaaattcctcacggaaaacgttacggaaacgtttcggaagcgcctcggcttagattttcttcacggaaacaatttttccaagcaaattcgaaagagagagaacaaaataggagaggtggttgccgcccagctcgcccaggcgagctcagctcgcccaagcgagccaggttgcttcctccagaagcaacagccttctggaggaaaattctggagggcccaagtgggcctgggtgctatttgcaccccccatttttactaa

SEQ ID NO: 111868 - DNA, 480 bp, Glycine max
  Peptide Sequence Number=SeqID_228646
atgaaaaaggcacaagcaaggagggcggccataaataaagtaccagaacaggttatattatccgaggttcgtcgaatggttgaagagatgcaggctttgaataagaagctggaagaaacagaggcagccgttgaagactatttcaaacctctagacaaggaagctgagttaataatgaaaatgcaactacaaggggaagagaaaacttcagagatgatgatgaaggcactggagaaacaagcttcacttcaacaagttgaagcagaaaaaaatgcaagtaagcatcaagttgacaactctgaaaccaacctgaatgaatctgagatgatggaagaagagaaaacattgaaggagatgttgaaagcactacaacaagaagttttgcttgagaaagctgatgcagaaagttctgataatgtgcatcaagcagacaagtctcatatcgacttgacctcagcatctacaaccactcctaaatga

SEQ ID NO: 111869 - DNA, 405 bp, Glycine max
  Peptide Sequence Number=SeqID_228647
atggacatagatacactggggtgtagtgggcagagaggttcgaagaacctaagggaattagcgagtagtgactacttggcatttggtgcacttatttggtataggagcagcggagtcactcttgcaactaccaatttcgggggaggtcatggagaatcattgttcttcgggcacaatgtcaaccaaaggcctactagatctacctatcaccaggactcgaccattgaagttcatgaggatgtgggagatttcagtgatgatgaggatctcacgccgtccaagattgccttctaccaggatgtcatcggtgaagagatacttaagggagagttgctttcgtccgacaaggagtgggattcctcaggagatgagggtgaccctttcgaagatataactttgccttaa

SEQ ID NO: 111870 - DNA, 778 bp, Glycine max
  Peptide Sequence Number=SeqID_228648
atggctagagatagattgcaagatgttcaggtgaataatatcaagttgaaattgattgctaatcatgagaaagatggtcgtacatataatgtacctactgttcctgaagttgcagcactaatagtaggcgattttgatgcaaattcaaaaagagatattattattgaaactcagcatggacaactacaaaggatccatgaattacattctagctatctagctctacaataccctctcttatttccttacggggaagatggatatagacctgatattttacatagcagtcggtcagatggtaagaaatggaaaagaaatcgtcttacaatgagggagtggttttcttataggctacaatgcatatcaaatgaatctataactttgttgaattctaagagactattccaaaaatttgttgttgacggctatactatggttgacaagttttgtagcttacaacattcattggataatggaagtaggagaggcctaaataaaggtaaaagagtcattttgccttcaacttttgttggcagtccgcgctatatggatcaactttattttgatggtatggtcatatgtagccatgtgggcttcccaaatctgtttattactttaacctgcaatcaaaactggcctgaaatccatagattgctgagtccgttgaatctgaaagcagtagataggtcagacataatctccagagtcttcaaactaaagtatgaaaaaatgcttattgacctgacaaagaatcacatgctaggcaaagttattgcat

SEQ ID NO: 111871 - DNA, 258 bp, Glycine max
  Peptide Sequence Number=SeqID_228649
atgcaagttagtataacacactatgagaagtatagaagagaatataaggcttttgtggaatattcacttaaaggccactttcattgcgaacaaaaatcacatgtcattgtttgtactatggataaaatcctttcccttcagagattgacatgttgccttattcttctatgtgagacaatgatgagaatcctgaaactggccaaatacaggttaaaggcccaagtggagaaggacgaaggcctaagtggagaaggataa

SEQ ID NO: 111872 - DNA, 358 bp, Glycine max
  Peptide Sequence Number=SeqID_228650
attttcctaatctatatcactatcatcccaatcaattgcacgcttgatgacaacctcccagatcttctcagcacgcctatagtagaattagagctcgtctccatggctaaaatcaccttcttgaaggaatttgtaccaagggagagtgacatacttgtcactgatgcctttgtcgagcacaactacattccattgcagtggaggtctgaatcttctgagaattgtcatatgatcaccacaatggataaggcattgtgtgacagaggctggaagttgctatgtgttttcttgttgcacggcgccttttgcatttttgctggtctaatggtggagtgcagtggaggtcaaattttgaagg

SEQ ID NO: 111873 - DNA, 525 bp, Glycine max
  Peptide Sequence Number=SeqID_228651
gacgccatagaaataccaggcttctatcagtgccaatggctaccaaattatcctgaaattgttgaatttaagtatgatggggaaacctaccaaattcaagtcagacaacacaaaggccaactttactttgctgatggcctaacaagattgaggacaaaactacagatttatgaatctgtcatgataaatttcctggcctgcaatcacccttcaaaatttgacctccactgcactccaccattagaccagcaaaaatgcaaaaggcgccgtgcaacaagaaaacacatctggacatatgaaatcagccaatcaatgctaggcgcaccatatccactgcaacttccagcctctgtcacacaatgccttatccattgtggtgatcatatgacaattctcagaagattcagacctccactgcaatggaatgtagttgtgctcgacaaaggcatcagtgacaagtatgtcactctcccttggtacaaattccttcaagaaggtgattttagccatggagacgagctctaa

SEQ ID NO: 111874 - DNA, 294 bp, Glycine max
  Peptide Sequence Number=SeqID_228652
atggagtacatttgtccttccaacagtcatccaaaaccaaattgtgtaagatcaatgagttttgggagttctagtggtagttttaggattctcatcattccctctgtcgcaacctacccttcggcgggagggcgacgcgtgactcgtgggatgcgtgttccacgaaaggaatacgcgcggagtcgccaccaacgtttatttgaggaaaacgtcggaaaaaccggaaaagacgcgatctacgaacttttaagtgaaaggctcgggagttgtatttacgcacggggaaggtattag

SEQ ID NO: 111875 - DNA, 717 bp, Glycine max
  Peptide Sequence Number=SeqID_228653
atggtgcaggttaatagaggtccaaggccaaacttgcctttaaggtttgaaccgactgactacaatacactcctcacttacaaatttcttatacaatccatgattgtgttacacctttttgctgctccccttccttcttgcactaccattacatgctccaaacatttttcccatgacaaccactttgtgcgatcttcaacggttccgcggctatccctgagccatgtcagaacaaggatattcttatgtagtgctagaaatcgacagaaggatttgaatggtagggacttcagtatagacattgttaaagaagatcaagagcttgaggatgatggtgacgatgggtttttggctcaaggaatgtatgcaagaagggatgcaaaagacattgatgaagaagaagcacaagaaaatgaagatgatgatagtggatattcaggtcgaggaccatatacaggtaggccagggaaggattatgatagagatccagaacttggtaacattctcgggagttttctagaggacccccaagcagcacaatccaaattggaagacagactaagaaagaaaaggagcaaaatattgcacacaaagactggatcaggaaaaccaatgaaagtgtcatttaacaacctaatgtcggtatatgttgctctctcgcgtggtacactggtactgccagactggtcagtctaccattcggcatttacgtggtag

SEQ ID NO: 111876 - DNA, 472 bp, Glycine max
  Peptide Sequence Number=SeqID_228654
ccgcagcagtggcagtagaaataccaacggtgatcgcggtggcagtggcgatagtggcggtggtgatggtagcgatgttggtgggggtagttgtgacgacgttggtggtggttatggtggcagtgatggagatagtggtggtggtggtgacaatgccggtggtaatggtgatggcgatgaggatggtggtggtggtggtagtggtgctggtagttgtggtggtgataatgatggtggtgtggcggtggtggcgatgatgaaggtggcatttgacatggtaaaatacagagtgaggtctaaggcaattgtgcaaattcatagcaaccacgaagatctccaacaatgcaaagacatcacagaactctcctatagaggtttgcgctcctgtatctcctacagtaaaatccaagtccacaatgcaaactcaaaaagagaaagaaaccaaacaaggcaaaaacagaagagaaaatga

SEQ ID NO: 111877 - DNA, 726 bp, Glycine max
  Peptide Sequence Number=SeqID_228655
ttgagattgcctgctatcagaaaaccattgatattgcaatttaaagctgtcttccattgtgacaaggacgccatagaaataccaggcttctatcagcgccaatggctaccaaattatcctgaaattgttgaatttaagtatgatggggaaacctacgaaattcaagtcagacaacacaaaggcaaactttactttgttaatggcctaacaagattgaggacagaactgcagatttatgaatctgtcacgataaatttcctggcctgcgaccacccttcaaaatttgacctccacttcactccaccattagaccagcagaaatgcaaaaggcgccgtgcaacaagaaaacacatctggacatataaaatcacccaatcaatgctaggcgcaccatatccatttatatcttccatacaaatattaatttcaatgcctaactcttttttttccctgcagcaacttccagcctctgtcacacaatgcctaatccactgtggtgatcatataacaattctcagaagattcggacctccactgcaatggaatgtagttgtgctcgacaaaggcatcggtgacaagtatgtcactctcccttggtacaaattccttcaagaaggtgattttagccatgaaaacgagctctcattctactataggcgtgctgagaagatctgggaggttgtcatcaggcatgcaattgattgggatgatagtgatatagattag

SEQ ID NO: 111878 - DNA, 241 bp, Glycine max
  Peptide Sequence Number=SeqID_228656
atggagatgtattgtgtgctctgtgtcacgaatgtcaagaaattaagtgcgaatcatctttttgtctcatgtaaatttgctcatgatacatggaaaagatggtatagcttgctcggcaaaagctcaacactccctcatgcagctattgatcacgtttatcaaaattctcatggtatatggtacattctagcttggacatttggtggtctctggggtggagttcgattatttggaacatttg

SEQ ID NO: 111879 - DNA, 240 bp, Glycine max
  Peptide Sequence Number=SeqID_228657
atggggatgagtcaactgggtctttttgatttggtaccatgcatttcaaaacaaaggagaatggaaggccatagcgagatgggtctaatgggagaaagttttgatactagtaatttgctagggaggatgagggatgacgaatatgaaagccgggccggaagtgataattttgatggcggatctggtgatgatcaagatgctggggatcatcagcacataaaaagaagagaaataccatag

SEQ ID NO: 111880 - DNA, 1103 bp, Glycine max
  Peptide Sequence Number=SeqID_228658
atgcgagtctttgcctctcgaacctccaatctcttcaagctcaatgtcgagcactttctactaatccacaaccctaatttcaactccgtcagagaattctcgcaatccaccgcaatccccaaaaagcaacttagggttcgcgaccatggctatgacaactacatggaagtcgagaagaaaacgcgcaaggtcctaaaattccagaacctcatcctctcggaaccttcccaatcgctcccaatctcgcgccttgagacgcttgcgcggcgcttcggcttcacgcgccacgagtccggcgcgttcgtcctcaagttcccgcacgtgttcgaaatcttcgagcaccctgtgcagcgcatccttttctgccgcctcacccgcaaggccatcctccagatcgagcaggagcgtcgtgcactagccgcggagctcccacgcgctgtcacgcgcctccggaagctcctcatgatgtcgaaccatggccgcctccgcctcgagcacgtgcgcatcgcacgcgccgcgtatgggctcccggacgactttgaaaactcggtggtgctgaggtaccctcagtttttccgtttgattgatgctaaggaaactaggaacaagtacattgaggttgtggagagagaccctgggttaggaacttgtgcaattgaggaagctagggaaagggtttatagagagagaggaagtgatgctgaggatattaggttttcttttgtgattgattttccacctggttttaagattggtaagtattttaggattgcaatgtggaagtggcagaggcttccttattggtccccttatgaggatgtttccgggtatgatttgaggtccattgaggcccagaagaggatggagaagagggctgttgccaccattcacgagttgttgtccttgactgtggagaagaagattacgctggagaggattgcgcatttccggatggccatgaacctgcccaagaagttgaaggattttttgctgcagcaccaggggattttttatgtctccacaagggggaatcagggaaagcttcacactgttttccttagggaggcatataggaagggcgagctgatcgagccgaatgagtt

SEQ ID NO: 111881 - DNA, 2080 bp, Glycine max
  Peptide Sequence Number=SeqID_228659
gtttttcaaggagtgtcctcatcccgacgagaagcaaagaacagatcttagcaagaggcttggcttggagaacaagcaagtcaagttctggtttcagaatcgacgaacccaaatgaagaataagttgttaaaaattaacattatcgttatcagttgctatttgtttggcggaagccaaatgaagacacaactggaacgccatgagaacatgattcttaggcaggaaaatgacaagctccgagctgagaacagtgtaatgaaggatgctttggcaaatccgatatgtaacaactgtggtggcccagctattcctggtcaaatttcattggaggagcaccaaactagaatggaaaatgcccgactgaaggatgaattgaaccgaatatgtgcattggcaaacaagttcctgggccggcccctctcaccactggccagtcccatggctctgccaccctcaaattctggtctagaacttgctattggaagaaacggacttggtggttcaagcaattttggcatgcccttgccaatgggatttgatgtgggagatggagctttgggctcctctcctgcgatgtctactatgggtgctagatcaccaatgggaatgatgggaaacgaaatccagcttgagagatccatgcttttagaccttgcactgagtgctatgaatgaattaattaagatggctcagcctgatacctctctttggattaaaagctctgatggcaggaatgaagtactgaaccatgatgagtatgcaagactgttttctccttatattggatcaaaacctgctgctggttatgtgactgaagctacaagaggaactggagtagtatcagccagcagtttgggccttgttgaaatattgatggatgcggatcaatggtcggagatgttttcatctatgattgctagtgctgccactgtggaagtactatctagtggcacgggtggaaccagaagtggagcgttgcaagtgatgcttgctgaggttcaattgctttctccactagtccctgctcgtcaagtgagtttcctcaggttttgcaagaagcacgctgaaggtttatgggctgtggttgatgtttcagttgacattggtcgtaatgttaccaattcacatccattaatgagctgcaggaggcttccctcgggctgtgttattcaggacatgcccaatggtttttccaatattacttgggttgaacattcccaatatgatgagagtgtcatccaccaactttatcgcccattggttagttctggcattggttttggtgctcagagatggattgccaccctcctaaggcagtgtgactgcttggcaatcctcaggtctcctcaaggcccatctgaggaccccacagcccaagcgggtaggacaaacatgatgaagctcgcacaacgcatgaccgagtgcttctgctcagggatctgtgcttcatctgcttgcaagtgggacatactgcacattggtaatctggctgatgacatgagaatcatggcccggaaaatcgatgacccaactgaggctcctggcattgtgctgagtgcttcaacttctgtttggatgccggtgtcacggaaaagggtgtttgattttctgcgtgatgaaaatttgagaggtgagtgggacctgctgtccaaagatggaccaatgaaggagatgctccatattgctaaaggacaagaccgtggaaattgtgtttccatccttcattctgctaatagcgagtgcaatgtgctatatctgcaagagtcatggagtgatgcctctggctcgatggtagtgtattccccgatcaacatgcaagccttgcagatggtgatgagctgtggagattcatcatttgtccctctccgtccatcaggctttgctattctgccagatggcacttcaaacaacggtgatggcagtgacggtggtggcagctgcttgcttacagttgggttacaaatgttgccaaatggcaaccaccaatcagccaagttcacaatggagtcagttgatgctgtcaataacctgatctcatttaccattcagaaggtcaaagatgcacttggagttgcatga

SEQ ID NO: 111882 - DNA, 177 bp, Glycine max
  Peptide Sequence Number=SeqID_228660
atgaatcctttattctttgccaggatactttcagggaataagtttgtgaatgcctctgttgggaaagcacattttttgtattctttgccatgttccgaagcttactcaatgcttgttggaatttacaccgactatgcttttacatccaaggcatccgaagatgatggacgtggctga

SEQ ID NO: 111883 - DNA, 174 bp, Glycine max
  Peptide Sequence Number=SeqID_228661
atggctggccatatgggtagaggtgtcatagaggagcaggtatggaggaagggaccttggactgctgaagaggacaggttgcttgttgagtatgtcaggttgcatggtgaaggcagatggaactctgttgctaggcttgcaattttagtcaatctctacgtgatacgtagttga

SEQ ID NO: 111884 - DNA, 192 bp, Glycine max
  Peptide Sequence Number=SeqID_228662
atgatgaagtggccgacatggttcaaccagttacaattgttcaaccaagagaagatggaattcagaatccattttagaatgacgctttccattatagcaatatcaattggagtcatcctgatgatgaagacatttgtggtttggagatgccatctacttttaatgttgggcaagaattatatgttggtatga

SEQ ID NO: 111885 - DNA, 1065 bp, Glycine max
  Peptide Sequence Number=SeqID_228663
atgatgaagatgaagaatattagtagtagcaacaataataataggacaaatggtctttcttccatcatgaatggaggaggctcaggtggttgtagatctgagcctggttccaaggaatgggagatgaggccaggtggaatgctggttcagatgagaactgctgactctgatcggaacccagcacttgtgcccacaattagagttagggtcaagtatggttcaatttaccatgaagtcaacattagttcacaagctacatttggggagttgaagaaaatgctgtctgggccaactgggttacaccatgaagatcaaaagctgttatacaaagacaaggagagggattcaaaggcttttcttgacatggttggggtgaaggacaaatccaagatagtgctaatggaagaccctattagtcaagagaagaggttgttagagagaagaaagaatgctaagatggagaaagctgcaaagtcgatctcagaaatcagcttggaaatagatagacttgcagggagggtatcagcctttgagtcaattattagcaaaggtgggaaagttgtggaaacagatgtgcataatctgattgagttattgatgaatcagttgctcaaattggatggtataatggctgatggggatgtgaaactacaaaggaagatgcaggtaaaaagagttcaaaagtatgttgaaactcttgatgtgctgaaagttaagaattctatgcctagtagcaatggagaccatgccccagtgcagcctcaacagaagcattcaaatgggcaacaacaaaagtattcaaatggacatcatagattagccttagtaccaattcaggagcagcaacaagaacaaccaaggaactcaaatgagaattctctggaactataccaagagcaacaacaccaaccctcaaggaattccacctcaggagttgtagttaccacaaattgggagttgtttgattctgtcccaccattaatccctgtgcaatccacatccccaccctcctcagtgaccaataattcaggtcctcccaagttcaattgggaattcttcgactaa

SEQ ID NO: 111886 - DNA, 1083 bp, Glycine max
  Peptide Sequence Number=SeqID_228664
atgatgaaaatgaaaaatatcaatagtagtaataacaataagacaaatggtctttcttccatcattaacaatggaggttcagatggtaacagagccgagcctggttcaaaggaatgggagatgaggccaggtggaatgctggttcagatgagaacaactgactcggatcggaactcagcacttgtgcccacaattagagttagggtcaaatatggttcaatttatcatgaagtcaacattagttcacaagctacatttggggagttgaagaaaatgctgtctgggccaactgggttacaccatgaagatcaaaagctgttatacaaagacaaggagagggattcaaaggcttttcttgacatggttggggtgaaggacaaatccaagatagtgctagtggaagaccctattagtcaagagaagaggttgttagagagaaggaagaatgctaagatggagaaagctgcaaagtcgatctcagaaatcagcttggaagtagataggcttgcaggacgggtatcagcctttgagtcaattattagcaaaggtgggagagttgtggaaacagatttgcttaatctgattgagttattgatgaatcaattgcttaaattggatggtatagtagctgatggggatgtcaaattacagaggaaaatgcaggtaaaaagagttcaaaagtatgttgaaactctggatgtgctgaaagttaagaattccatgcctagtagcaatggaggccatgccccagtgcagcctcaacagaagcattcaaatgggcaaaggcagggaccagttcaagagaaaaaacaacaaaagcattcaaatggacatcatagattggccttagcaccaattcaggagcaggaacaacaacaaccctcaaggaattccacctcaggagttgtagttaccacaaattgggaattgtttgattctgtcccaccattaatccctgtgccatccacatccccatcaccacaccccccggctattccacatttagaaacattcccttctttggcctcaagcaaagaccgtgaggccggaggagtgaagaataagcgtgtttcaatctgctaa

SEQ ID NO: 111887 - DNA, 510 bp, Glycine max
  Peptide Sequence Number=SeqID_228665
atgcggagacaaaatttggtcattccgcacccctttgccattcagacacagtcgtgtccgatggcgcgcagagacaaaatttggtcattctgcatcctttgtcatccaaaggcggcgggcccgatgacatgcggagacaaagtttggtcattccgcacccctttgccattcagacacagtcgtgtccgatggcgcgcagagacaaaatttggttattctgcaccctttgtcatccagaggcggtggcccgatgacatgcggagacaaaatttggtcattccgcacccctttgccattcagacacagtcgtgtccgatggcgcgcagagacaaaatttggtcattctgcaccctttgtcatccagaggcggcgggcccgatgacatgcggagacaaaatttggtcattccgcacccctttgccattcagacacagtcgtgtccgatggtacgcagagagaaaacttggtcattctgcaccctttgtcatccagaggcggcgggcccgatga

SEQ ID NO: 111888 - DNA, 318 bp, Glycine max
  Peptide Sequence Number=SeqID_228666
atgagttcattagccaggtggcttggccaggagtctagccttctccttcgggagggggtgaggcctctacagcccaagagcttgtgcccgaggatgaggacgagtctctctcccctaagcctttcatttatgatccagatgcagagatttctcaggaggaggcagcatcaccagagcttattcctcagtaatccccatcaccagctccagttcttgaagacctacaaccgtctgcaccagcataggtgcctgattagcccattgttcagcatctaccagttgcaccggtgttggatcttaatgagcatgcacaagtga

SEQ ID NO: 111889 - DNA, 261 bp, Glycine max
  Peptide Sequence Number=SeqID_228667
atggctatgactgaagagatagaatctcttcagaagaaccagacatgggatttagttgtgctacctgaaagttttgaggtggaaggaaaggataatttggtttgtagattgaagaggtctctttatgggctgaagcaatcaccaaggcagtggtacaagagatttgatgagttcattgtctttcattggtatatcagaaatccttataactcatatgacatgctcatagcatctcaaatgttggaatatataggaatctaa

SEQ ID NO: 111890 - DNA, 243 bp, Glycine max
  Peptide Sequence Number=SeqID_228668
atggaactctcgaaggtctcaaacagtcaaaatggacgttgtccaacatggcctctattgtgtgcacaacctttggaaacttcacctgatgttgtttctccattggagcttgtaggcctaggatcttcatcaatggattcctttgcttcttggaatatgaatggtagcggaatagagaaggaaaagagagaggaaacgccacttcaaggagaagatgagtctaaaagaagctcaccaccatag

SEQ ID NO: 111891 - DNA, 210 bp, Glycine max
  Peptide Sequence Number=SeqID_228669
atgtctagcttacctaacaaagaaattggtccctttagtgaggatgaagacaaagctctatgcaatcaaccccagaaagatgatgagaaagaaactaagcttggttcgtcaataacaaccgtacaaccatactatgtaccaccacacatgcataattatgaagaatctaactttgaagattctaaatacggtcataacttggatcgttaa

SEQ ID NO: 111892 - DNA, 183 bp, Glycine max
  Peptide Sequence Number=SeqID_228670
atgccaccacaaggaggtcataaagtagagggtttcgtgaaattccattgtctttttgggagtttcaaatctttcattgatgggtttcaatattgcaagcctatggctcagttcaatggaacatggttgcacgacagatatgagtcaatcaaaagtttttattcaagacctgatagtgggtga

SEQ ID NO: 111893 - DNA, 504 bp, Glycine max
  Peptide Sequence Number=SeqID_228671
atgttagatgaagggttcattgctaggttaggagattttggtttagcgaggcaaacggagcatgacaagtctcctgatgccactatggctgctgggacaatggggtaccttgcacctgagtacgtgcttactggtagagcctcggagaaaactgatgtgcttagctatggtgttgtggttcttgaggttgccaatggcaggaggcctattgagaaagatgctcctgctgctgggaatggtaaagttggaattagcagcaattttgtagaatggatttggagtttgcgtcaagaaggtaagttgctaatagtagctgatccaagacttgaaggcgagtttgaggaaggggagatgaggaaggtactcttggttggattagcttgctcacaccctgattcaattgcaagacctactatgaggggtgtggttcaaatgctgttggatgaggctgaagtgcttattgtccctagaaccaaaccgtctactagttacagtacttcttaa

SEQ ID NO: 111894 - DNA, 243 bp, Glycine max
  Peptide Sequence Number=SeqID_228672
atggtgattttgaatcttcctttggagaagagctcgaaggttgcgacgacaatgaggtttctcttcagattgttgcgagcggcgaacatactaaacgcttttgaagcctatagagatgcgttggagaagaaaatagggttacagctcaaagaggccacgctcggcaaccacgggtctcggttagggcatccactcacccaggcgagttgcttgcttatagatgaagtaagatttttagcccag

SEQ ID NO: 111895 - DNA, 408 bp, Glycine max
  Peptide Sequence Number=SeqID_228673
atgtccaaagatcacaggccattatgcattaaggaaagaaagaggataaagtctctaggtggatacatagataatggttacttgaacagccagttaggtgtgactcatgcactaggcaactggaatctccaaggaatgaaggaaattaatggaatgggtggaccatttagtgttgagtctaaacttaagttaatcacattgacaaaagaagatgaatttttcataattgggagtgatgggatctgggatgtttttcacagccaaaatgccatacactttgctcgaaggagtcttcaagagcataacgatgtgaagcagtgttgcgaggaggtgataggggaagcaataaagagaggagcaacagacaacttaacagtggtgatgatatcattgactaagactgtttag

SEQ ID NO: 111896 - DNA, 456 bp, Glycine max
  Peptide Sequence Number=SeqID_228674
atgaaagagaaagacaaagaaaatggtttgaaagaagtgcaaagaaagggacgaaagagggtgagcttggaattggacgaggctggggctatcgaagctgatttttgtttcatagaagtctttgttggtgaggaggcagaagaagaagttgaaggtggcggcatcaatgaagtgttcagagaggttgttgcgaaagagagggaggaatgtgtggtgtttggtggtagtagcacttggcggaaatgtgtgggagggttcagtggtgtcttggaaggcgcacacacgatagttgtcgttgaaggagatggacagcatgaaagtgccatcaagaacattgcgcttttcgaccttggagttgtcgaagaagatggggaaggaccgagtgccatgttggttttgaaggagtggagaaggagttttgttgttggggagtggatgtacaacctcagttcttaa

SEQ ID NO: 111897 - DNA, 348 bp, Glycine max
  Peptide Sequence Number=SeqID_228675
atggctgcccgcaagattaaactttctggaaagcctggaccatttcgaatagctgcacgtcttccatggtggcattgtcgaatgaaactaccagaaaatgcacaacaactgccacttgcagacatggagaaatcaagtgaacaagcagcagcgactgagcctcagagtagaagaagaagaagcgactcagcgtgggaaaccagcttcgtaaaccctaatttatttggggaagaagaagaagcaaccttgcgtgagagagaatttatagatgcaaacctcagtgccacgttggatagtctacgtggcactgaattgccacctatacacctcactaacgccgtcacctga

SEQ ID NO: 111898 - DNA, 312 bp, Glycine max
  Peptide Sequence Number=SeqID_228676
atggatgctaaccatagagctcagatgttgctatttgagcatctcaaaggcattattgccaatgtgcacctagatatcaattcccatctcaggaggagattgaggctattgttgattggtccattctccctagatactagggatatgagggccaaaggggtggtacaacaaccaatgaggatgcttcttaaggtgaggagactagagctggggacattaccattgaggaggccagaaaagatgatgggagttgggacagatggagccgctaatgacatgacacctcttgctattggtgttgaggagctttaa

SEQ ID NO: 111899 - DNA, 207 bp, Glycine max
  Peptide Sequence Number=SeqID_228677
atgcattctttggtcttgtatcgatatgcaggaaatttgttggaaggattttctcagacccagattagcacattagccgtcaaggataatcttcttgttgctggtggcttccaaggagagcttacttgtaaggctatagatacatctctctcttggggacaggggattgctattgtagttacttcacttgccaatatgattatttaa

SEQ ID NO: 111900 - DNA, 363 bp, Glycine max
  Peptide Sequence Number=SeqID_228678
atgagagtgcatgaaagagaagatcaaatggacaacacacacgcactgattcttttggtttggcgttcttatcattatgttcaacaattatgctgcaaacaagaggttggatcgaaagcgaaaaatcgaaacttttacatcccaactttggccattacagaagatatcaacatacattttgaggaagactataacaagttttatgaaggcttctctaaggacctgaaacttggtattcatgaggattctcagaacaagacaaagctagctgaattgctcaggtatgactcgagtaagagtggtgatgagatgaccagcctcaaggactatgttaccaggatgaaggaaggacaaaatgaataa

SEQ ID NO: 111901 - DNA, 285 bp, Glycine max
  Peptide Sequence Number=SeqID_228679
atgacagtgacatggcaaaacgacatggcaaaacgcacgaaacctggttttggtgctgctgaagccgagctatggaaacgactgataaaacgaaacgaaagaaaaataaaagagaagcaagcacaaggtttgatttgcaacgaaagaggggctaggattcaacgtgtacgacctcaaggagctaagtacttcgaacttaaacccgtgggagctgagtacttcgaacacgtgcctaattatttttttccaccaattacgacgggcttcaacttaaacccattgtaa

SEQ ID NO: 111902 - DNA, 648 bp, Glycine max
  Peptide Sequence Number=SeqID_228680
atgacgtctaaggcagcaaaggaaattgctgacaagattgcctcacaggatttttttgtcacccatggatgtcaagatgtattgactgctgccattgggcgactagaacaccctagtcgtgtgcgtggtgctagacccggtgtaatgatcaagaaatactttggaccggcttcaaggacctctcgcacgtcttcctccatggcttccaaagacctagagaagctgacgcaaaaaatcagggaccagctggaggagtcaatcacaaaaaaaagttgtgttgatcctttagggttgtacgtcaaagaaaatcctcctcacctggttgccctaggaaaactttttaaggggtccacaactattcacaatattcctttgctccttgatcaagtcaaggttggtgttgaggaggttagagatgcagatgctcccattcctgtacccatagaaaaggttatgtgggatgctaccgtgtttggggtgtttaatgagaacttccccttgtacataaagcatgaagatttgtctaaaatagcaccggtggtcaatgtctcagcatctctattatacagttgtggattccgtaagcatatgactaagacaagtatgcgagcagggaatgccgaggtgtatggattccttaagccatag

SEQ ID NO: 111903 - DNA, 1004 bp, Glycine max
  Peptide Sequence Number=SeqID_228681
gaccaggttgttcctcattggggtatggggcatttgaggagctgggaccctttagagtcaactctgatggcaaaacactatttcataacaaatatgcttggaatgaagtggcaaatgtgctgttcttggaatcccctgctggagtgggcttttcctactcaaacactacctctgactatgatcgttcaggagataagtctactgcaaaagatgcctatgttttcctgatcaattggctagagaggtttccagagtacaaaacccgcgagttttacataactggagagagctatgctggccattatgtgcctcagcttgcatacactattttggtgaacaataaattcagtcaacaaagcattaacctcaaaggcattgctatagggaatgctttgattgatgatgttacaactatcaaggggatatttgattacttttggactcatgctttgaactcagatcaaacacatcatttgattaagaagtattgcgacttcacttcggaaaatatttcagcagcatgtattaatgcaacaataagttccatacttgagaaaggaagcatagactcctctaacatctatgctccactgtgttatgactcttctctgaaaaatggatctactggttctgtatatgattttgacccgtgttctgcctactatgtggaagcctatctaaataggccagaggtccaaaaagctcttcatgcaaaacccacaaattggacccattgcagtggtgatacagatgcaacggtcccagtcacatcttccagatattcaatcaacaccctgaggctccctattcaggttgattggcatccatggtattctggaaatgaggttggaggatatgtggtgggatacaaagcagtgacgtttgttacagtaagaggagcaggacattttgttccaagctggcaaccagcccgatctttgaccatgatctcatcattcctctctggaaccctgcctcctgcttcaccatacgatggattctaa

SEQ ID NO: 111904 - DNA, 597 bp, Glycine max
  Peptide Sequence Number=SeqID_228682
atgtggccaatgtatgtagctgcaattgtggttgcagagggtgctcaaccagtggatgaaaagactataccggatggtacagagcaaatatttgtcatgtcaacagatagagtggatggcctgaaggaggacctggcttgggcatcatatgttctgttgtgcaatacaaatgccatagctatgagtatatggattactcagcctgctgagctgacagagctaatttttattcaaggagaaatatgtgcaaggggatactggaacataccggatgatacatcaaaagaaattcttcctggttggtttaagaaaaaaattgaaaatgctggcctatatgatttgaaagacaccctatattttcctcaagatgcagattctgaatttcaggatctggtacctatagggactcgctgtcttctaatccaaccagtgttacaagtttctaatgaaagtgatactggcttgcaaaaacctgggggattcattctgctggcctcaactacaagatatgcatttagcaataaagacaaagcctggattgcagccgtggcaaacaaatttagaggtaatagcattagcatgtttgaagatttgtag

SEQ ID NO: 111905 - DNA, 693 bp, Glycine max
  Peptide Sequence Number=SeqID_228683
atgacgtgtagtcctctgaaggtgagaacctgtagtcctcaaaaggtgaagacgtgtagtcctctgaaggtgaggacatgtagacctctgaaggcgaggggatgtagccctctcaaggcgagggcgtgctgccctctaaaggcgactacttctagtcctctgaaggcgagggcatttaaacctctcaaggcaaggacgtttagtcctctaaacgcgagggcatgtagccctctgaaggttaggacgtgtagtcctctgaaggtgaggacgtgtagtcctctgaaggcgaggggatgtagccctctcaaggagagggcatgctgccctctaaaggcaaggacgtgtagtcctctgaaggccagggcgtgtagacctctcaaggtgaggacgtgtagtcctctgaaggcaaggacgtttagtcctctacaagggaggacgtgtactcctctacaggggaggacgtgtagtcctcagaaggcgaggccgtgtagccttttgaaggtgaggttgtgtagtcctctgaaggtgaggacgtgtagtcctctaaaggcgagggcgtgtagccctctaaaggcgagaacgtgtagtcctctgaaagcgagggcctgtagccctctcaaggtgaggacgtgtagtcctctgaaggtgaggatgtgtagtcctctgaaggtgaggacgtgtagtcctctgcag

SEQ ID NO: 111906 - DNA, 337 bp, Glycine max
  Peptide Sequence Number=SeqID_228684
tcgtttcggcaaaatctggcgcgcggcggcggcgggggaattggcgcactggcgcgcccccatcgaggggcgcctggcggaggtgatcgtgctcgatcagttcagccgcaacctgttccgcggcacgccgcagtcgttcgcctgcgacggcatggcgctgatcctgggcgcaggaggcgatccgcagcggcgagtgcgaacggctgagccgcgagcagcgcggtttcctttatctgccgttcatgcattcggaatcgccgctgatccaccagcaggcgctggtgctgtacaccgagctcaacaacggcgaccagctggagttcgagcttcggcataa

SEQ ID NO: 111907 - DNA, 501 bp, Glycine max
  Peptide Sequence Number=SeqID_228685
atgggtaaagcggaggaggtacaagagcagatgaaggccgacatggaggccatgaaagagaaaatggccaaaatgatggaggccataataagcatgaaaaagataaaggaagtcgatacggttgcagtttccgctaccagtgttgttgctaaggtgaacccgatgcccccatctggcctcaaccaaatgaatcatccaacctcaaatatggatgtcaataactccgctcccatactcattgaaatgtctctcaacccatggggggaggcacatgaaattccccaccacaatctagccgacttcgagccttgcctcggatatgccactgaagggcaagcaattggtgcccctcctgctatggctgaaaagggaaaggtggatcatctaaaggaaaggctcagggccattgaagaaggtgaagattatgcctttgctaacctagaagagttgttcctaatacccaaacatggacattcccaagttcaaggtgccggactttga

SEQ ID NO: 111908 - DNA, 1652 bp, Glycine max
  Peptide Sequence Number=SeqID_228686
atggcaggcggcagcgtcagggtggcggcgggtgaaggactccaggttgtggtcccagaattcggttttgccgccgaagccgcgcagcttaatcatcgacagggcaaagtcgaagtgatagtgctcagccttgagcacaatcgctttgttgagctcaaaggtcggcttgtattgcggggcatgcgtggagatgagccagccattgttgccaatcggaacgaaaacgccaattttcatggcacagcattaggcaggaaacagggcgtttgttatgatgcgatttcgcaggatggaagaggtaacagtgtgaaaagcgatgaaaaaaagccaggacgccgatcgcgggccgttgcggcgaaacgggcagctattctggaagcggcattggccttcttctcacagtttggcattcacggcaccagtctggataaggtggctgagcgcgcggacgtctcaaaaaccaacctgctttactactatccgtcaaaagaagtgctgtatgtggcggtactgaaagagattcttgatgtgtggctggcgccgctgcgtgcgctgcgtcatgaccaggatccgctggtggccatccgcaactatattcgtctcaagctggaagtgtcgcgtgaccacccgcaggcatcgcgcctgttctgtctggagatgctgcagggcgcgccgctgctgaagggcgagctggcgggggatttaaaagcgctggtggatgacaaagcggcgattatcgaacagtggatcgccgaagggcgtattgccggcgtgcagccgcagcatctgttctttctgctgtgggcgaccacgcagcactacgctgatttcgcgagagtgcatggattcgctatcacaactaacgctgggcgcggcggtgaccgtggccgtaatgggcaaacgcgtgccgctgtggcaggcggcgctggcgggggcggtcgcgggcacgctgccggacctcgacgtgtttatcgaccacggcgatgccatccgcaacatgacgctgcaccgcaccgagagccacgcgctgctgtggctgacgctggtggcaccgttatttggctggctggtggctggcgcgacgcgcagccggcagcactggcgcgcctggtgcctcgccatctggctggcattgatcacgcatccgctgctggacctgaccacggtgtacggcacgcagctcgggctgccgctgaccgattacccgttcgccatcggcagcatgttcatcatcgatccgctctacacgctgccgctgctgatcgccctgatcgtcgcactgtggcggcgggatgcgtgcgggctgcgctggaatcaggccggattgctcatcagtacgctgtacctgggctggagcatggtggcgcagacgctacggggaagcctggtggtcgctactgtcgcccgatcgtcccttacagatccgctggtacgatcgccatcccgcgcgggattgcgccgtttaaaggccagtggcacgcggaacgcgttgcgtggttcagccatggattttatgccatgcgccagcagggcaacgaaacgctgattgtggatttgcgcatgggggaagagccggattacacctttacctttaatctcggttccgccgcagcgccggcagcagcaccacagcgggaagattcgctgcggcc

SEQ ID NO: 111909 - DNA, 327 bp, Glycine max
  Peptide Sequence Number=SeqID_228687
atggagggaggcataggtcccatactagaccttactcccaaagaagagaaaaggatagaagataatgttgagccctacctagattgggaaatgaaggttgaacaactctttgcttgccatcatattagtgaagagagaaaagttccattggctacccttagcttccaagggtatgccttctattgctggacttcctctgttagggaaaaaagaattcatggggatcctctagtagagtattggaatgatcttaagagtgcccttaggaagaggcacatttcctcctactatgaaagggttcttatggacaagctccaaaggctttga

SEQ ID NO: 111910 - DNA, 635 bp, Glycine max
  Peptide Sequence Number=SeqID_228688
ggtgaacccttgggtactagtaccctcacctccagaggactacatgtcctcgccttcagaggactacacgtcctcgccgtcaaagggtcatgtaccttcacctttgtagggctacacgccctcacctttagagggctacgcgccctcgccttcgtagggctacacgccctcaccttccgaggactacatgtcctcacctttagagggctacacgccctcgccttcgtagggctacacgccctcaccttccgaggactacatgagctcaccttcagaggactacacgtcctcgccttcaaaggacaacatgtcctcgccctcaccttccgaggactacatgtcctcacctttagaggactacatgtccttgcctttagaggactacacgtccttaccttcagtgggctacacgccctcgccttcaaagggctgcacgccctcaccattagagggctacgcgttctcactctcagtgggctccatatccacaccgtaagagaatttaaggttcctgggccaccccctgatcctggtggagggccaactatgcaagtacaaccagaggaggaggctatcgtgcaactactatatgtcgcaacatgcccttttgcgggcgagcgatgcgaggctcacgg

SEQ ID NO: 111911 - DNA, 348 bp, Glycine max
  Peptide Sequence Number=SeqID_228689
atgtcagtattgtattggtactgcttaatgaaggcagtaatcaaatccttccacgagtgcataggagaggcttccaaattggtataccagatggccgccgccccggccaagatttcttggaagaaatgcatcagcagtttcttgtccctagactatgcccctattttctggcaatacatcttcagatcaagtttctctctcccttccactgccggaggcggccccctactgagaaatgcagcggttgcagagggttgggttgaggagctcccacagtattgggttgaggatatgggtcaaagtcaccttgggcatgctctcgaggttcttcatgggcgcctcctatag

SEQ ID NO: 111912 - DNA, 294 bp, Glycine max
  Peptide Sequence Number=SeqID_228690
atgggggtttttgcaaaatacatagtgtcatctagagcaaaggtgccctctaggcactccatctccactcgatcatggattagttgcgctgccatcgcgatctacaagaaagaaaaggaaaggggtagactctttcacgagagatctaactgcggtagcaacacaatgcgtcccataaccactacatgcaagttaaagggtatctcaaggcttttcatctctggtaatcgattacactttattggtaatcgattaccagaggccaaactcgaattacatagcttcagaatgtga

SEQ ID NO: 111913 - DNA, 360 bp, Glycine max
  Peptide Sequence Number=SeqID_228691
atggctcgcaaaggcttggggcagctgacgcaaaaaactagggaccggttggaggagtcgattacagaaaaaatgcaatcacatgaactcacatttcctcctaagcctgaggttggcccccctgcttcccgtgtcggcacaaaggagagttgtgttgatccctcagggcacgacccagacacgggtgacttagagaaatatggattgtacgttgatgaaaatcctcctcgtctggttgcccttggaagactttataaggggtcgaccaccattcacaacatccctttgggcaatgatcaagtcaaggttggtgttgaggaagttcaaaatgttgatgctcgcattcccatacccacttaa

SEQ ID NO: 111914 - DNA, 366 bp, Glycine max
  Peptide Sequence Number=SeqID_228692
atgaattgtgttttcgttcatgtgtcctccaccttcgagtttggagcgatgcgtagtaattcattagtgcaattctccattctcaacctttttcggagccccatgaattgcgttttcgttcatgtgccttccaccttcgagtttggagccatgcgcagtgattgcttagtgcaattctccattctcaatctttttcggagccccatgaattgccttttcgttcatgcgtcctacaccttcgagtttggagctatgcgtagtgattgcttagtgcaattctccattctcaaccccttttcggagccccatgaattgcgttttcgttcatgtgtcctccaccttcgagtttggagccatgcgttgtga

SEQ ID NO: 111915 - DNA, 498 bp, Glycine max
  Peptide Sequence Number=SeqID_228693
atggcccacgagcataaagtggcggacgagtatgccaagtgtacgcggaaaaggaggctagaggaagggaaaaacaccataactaaacgcgccccaaggcatccctatcgcaccagatccaaatctagaacgatgggtgatcaagaggagacacaggaacagatgaaagccgacatgtcggctttgaaagagcaaatggcttccatgatggaggccatgttaggaatgagacaactcatggagaaaaacatggccaccgctgccggtgttagttcggctgccgaagcagacccaactctcctagctaccgcgcactatgcccccccaaatgcggtaggacgagaaaggagcacactggggcacaccagcaaccctcatttgggatacaaccgggtggcttatccttatggattaccacctaattacacgccgccagtcatgcatgatgacgtgggtcatgtctcttcccccatccttgaaggggagcctcctcgatag

SEQ ID NO: 111916 - DNA, 369 bp, Glycine max
  Peptide Sequence Number=SeqID_228694
atgttagctatcatcaccaagtaccaagaggaactaagtctagccacggcccacgagcatagagtggcggacgagtatgcccaagtgtacgcggaaaaggaggctagaggatgggtgatcgactcgttacatcaagaggcaacaatgtggatggaccgattttctcttactttgaacggaagccaagaactttcccgattgctagccaaggccaaagcagtggcgaacacctactctgcccccgaagagatccacgaacttctcagctattgtcagcataggatagacttaatggcccatatgattagaaaccgccaggaagtttgtattgtcgctcaaatcttgactagttataaactttctgaataa

SEQ ID NO: 111917 - DNA, 1077 bp, Glycine max
  Peptide Sequence Number=SeqID_228695
atggagacaaagaagaacgccaaggcagatactggtgaatctcctaatcctgcacacagtggatcatccaaacccaaacgtgtaactttttcggatcaagtggatgtttgttgtgatggcttaatccgtgggaaaaggtttacaccagaggaagatgagaaaattaagttggctgtttttgattatatagagtctcatggtttgggagatgaaggtctagatatggttctccattgcaaatctcatcctgaaattagagattgttggaaggaaattggagcagccttacctcagaggccttatgttagtgtgtatactcgtgctcatattttgtttgaaaggggtgaggatcgtaagtggacacctgaagagtatgaatttttacggaaggtcaaggagcaacatggatctgattggaaatcagtagctgaagcattgggcaaacatcgatttcatgtaaaggatgcatggcgtagaataaaattaaccaacacaaaccaaggacgatggacccaagaggagtatcaaaatttatttgatttagtaaacctggatctacgtgtgagagcttcacaggattatagaaaatcaaaacatggtatgctgcgagataatattggttgggaggcaattggtgacaaattgaccactagatccagtgtgctctgctgcaaaaagtggtatgataaattaacgtcgcctatggttgccaatggtgtatggagtgatactgatgactatcgcctggtaaatgctttatttactttggatgcttgctgcatggaggaggtagattgggacaatctgcttgagcataggcctggtgatgtatgtagaaaacggtggaaccaaatggtccaatatattggagagcatggggggaagtcatttgctgagcaggttgaaattcttgcaaaaagattttgccctgacttattggaaatttttcaatgggggactggtttgtacgtggaaaatgccaccatgcatgcatatcgccagcatgcatggcgagatgcaggtgggaggggattcgccattccttctggcgatttggcatgtctatgtcattactag

SEQ ID NO: 111918 - DNA, 282 bp, Glycine max
  Peptide Sequence Number=SeqID_228696
atgtctggcttttgtatgtactttgtctatggaatggagacttctaatatgaagctaggatgttcttacactggtaatacaccttttgaacttgcatttgtttcgaggtatttgacaagttcccctaaatggatcaaagtgaatgaaaggagaacactccacgatgttctcaaagagcctaatttcatcattcctgggatcccagtcttctatgttgtttctaagcgatccagcttttatggcaagttcaaagctgggaagtgggcacctccaagtatatga

SEQ ID NO: 111919 - DNA, 441 bp, Glycine max
  Peptide Sequence Number=SeqID_228697
atggcttgttgggttcccaggccaccgcggcttcaccatgaaaacggtttcagtgattcacgtgggtggcattctgagcatcaggcatggggtcgtaggttaaagataaccggagaaaaaggggcccttaatacgcaccgttttgttcagattgttctcagcacaatcgattttcctcctcctccggttgtttcttcccgaagagtagttgtcactggcatggtgacgccacttggttgtggagtggacacaacgtggaagcgcctcgttggtggggaatgtggggtaagggctttgtctttggaagacctcaagatgaatgcttttgatagggaaacccagttgagtacgtttgatcagttgacatccaaggttgctgctgttgttcctaccggaaccaatccgggcgaattcgaccaccaaatctggctcaattctaag

SEQ ID NO: 111920 - DNA, 213 bp, Glycine max
  Peptide Sequence Number=SeqID_228698
atgaaagataaaggcttaaataagtcaagaggtgttgaacttgctttaaagaagaatgaagaagaataccagagaaaaatggatgaaaagaaggcaaccaagcattgtccacggtggggagggatcaattgtgattgtagaacgttttgtttctacaagacaatggtaggcaagctgttagcgtggggcagcacaagtggctgtagtgaatga

SEQ ID NO: 111921 - DNA, 294 bp, Glycine max
  Peptide Sequence Number=SeqID_228699
gggatcgcgcccacaagacacccagtggacccgaagaagtcaacagggccctggggtttccagctctggttacgggcctctgtcagtcctacagggtgcccgttcccccagcgagggtgcccgttccccccggcaaggtcacgtcatcatgacatagggatcgcgcctgcaagacacccagtggacccgaagaagtccaacagggtcttggagttgtcaagctctaattacgggtctctgtcagttctacggattgcctgtcacctccagcaagggcatcaggccccctactaa

SEQ ID NO: 111922 - DNA, 842 bp, Glycine max
  Peptide Sequence Number=SeqID_228700
atgataccagacgacctgtcaaagtcaagtttattatctgcattagatggagtgaaaattgcttattttgatgggagtttacctgatactgctctagttgttgcccaagaggcagttagaaagaatacacccatcttaattgatgcagaaaggccaagggaagggttagacgatctcttgaagttagctgattatgttgtatgctcagcaaattttccagcagcatcaactattccacaagcacttgtttctatgcttttaatgttgcccaacataaaattcgtgattgtaactttggggaaagatggttgtataatgctggagagaagtgttgatgatacgtccttccatggaagaagtggatgtagacagctcattggaatcattggagttaaaaaggaatatgacggagatgaggatgttgcggtggatgtggtttgggcatgtagagagaagaccggtagactctgtagtgaggagagtagaccagatggagagaagacaaacaattcgaggcagaggaagacccaaaaagactataagagaggcagaggggataggaacagtagcgggaagttatatgttgaaacagctgagagtattccaccattagagcttgttgataccactggtgctggcgatgcatttattggagctgttatctatggtaaatgcaacagctttgctctatcttttccttatgctatctgtgccaagattacaccagagacaatgatatcctttgctgctaatgtggcaggtgccaagtgcagggatctaggagcacgaagtggtcttccttaccgtgcagatccacgcatagcatcctttgtattggagaa

SEQ ID NO: 111923 - DNA, 245 bp, Glycine max
  Peptide Sequence Number=SeqID_228701
ccgaagggatagaagaatctgtgtgtgggaggttatattatgggacatctgaaaagattccaccatcagagcttgttgatacaactggtgctggggatgcatttgttggagctgttttatattgtacgtgcaacctcttcataaaacctttgcacatgcaagcagctgccaattgtagagctcttggagctcgcagaggtcttccataccgcactaacccacgcctggcatcctttactgagtag

SEQ ID NO: 111924 - DNA, 519 bp, Glycine max
  Peptide Sequence Number=SeqID_228702
atggtccaaggtggtggaaataatggaaatactatgacatgtgctgcccgtttgggcttaaagccaagaataatttctaaggtttcaaatgatggtccaggtaagactatgctggaggaactagaagctgaaggggtggatacctctttttttgtgtctgaagagcttagagttacaagcacgtggagattcttcctcctacaaatgcaaaaaagggaaggaaaaaaagtctcgaaggaagggacttcaccatttagctacatcatcgttgacaaccaatcgaaaacaaggacttgtatattcactccaggatatcctgaaatggtccctcaagatctttcacgagccaatttgttatctgcactggatggagcaagagtggtctattttgatgcaaggatgcctgacaatgctcttgtcatcgctcaagaggcatttcaccagaatatatctatcttaattgatgcggaaaggcctagggaaggattgaatgacctcctgagtttggctgattatgtt

SEQ ID NO: 111925 - DNA, 216 bp, Glycine max
  Peptide Sequence Number=SeqID_228703
atggtcattctgcgccttgtgtcaaccaagaggaacgaattcgacaatatcaggatgatgttggttgtcgtgtcttatctttacttcccttttatctccaataaaagacaagtaaagaggggcaaccgtcataccctaatttcatccggggaccatctgtttgttgggatgcgaccctcgtttaaccactttgaggtacttggcacccatcgttag

SEQ ID NO: 111926 - DNA, 687 bp, Glycine max
  Peptide Sequence Number=SeqID_228704
atgaccactatagcccagtctaacacttctagacttgtgttccctactctaatcgtcgcattatgtagagccagaggggttgtctctgatagcctcacttttgagcgcctaagcccggtcattaacttggcctacatcaagaagaactgttggaaccccaaggatctaacagtttctattcgaggggctaggagggcgagggtaaggccagctgagcttccttctacttttgcagctcctactccagcatccacttcagcagctccttctgtcccagctcagacagattctcagcactttgcagccatgcttcaaagcattcatcagggacatatcattttattacagagtttacaggtggtggcacctccaggatctattccttcaactgagcagtttagggagatggtagcctggcccaggacccaaccttctcttcacaaggaagatgaaggtcccacaacccagccatttgttataggagaagaggcagaggagacacaagtgagacaggtagttgctgccacgcctgagcgatcccttaaggctacttcagagccttctgcacaaggggaggacataccttcacctcagcctacagtagacccctccactcctcttctagagatgccaaaggacccaactacaccgatcctagctatggacacttctcctccagctactcca

SEQ ID NO: 111927 - DNA, 360 bp, Glycine max
  Peptide Sequence Number=SeqID_228705
atgaccacagattcacctccactccttatgttcccatggacccagcatcaaagagttatatacaagaatgtaagacaagtaaaaaggaaaccgacaaaagaggaagtcatcatattgcacgagattagaaggcctaactctctaaaagcaatccccagtggagtcgccaactatcgcaacctacccttcagcgggagggcgacgcgagactcacgggtgcgtcttccatgggaggaaaatgcgtggagtcgccaccaacgtttatttgaggaaaacgttggaaaaaccggaaaggtgtggtctacgaactttaatcgtgaaaggttcgggagttatttttacgcacggggaaggtattag

SEQ ID NO: 111928 - DNA, 198 bp, Glycine max
  Peptide Sequence Number=SeqID_228706
gtcccatatctacagctaatttctaatcccacatggcattctcgggcttcgtcatggacaatctacatggaggttcctcaatctattcttcgtggtagccaaaccaaaacatctgattattatgagctggtggtaaatgatgattgcatcaacgttaaagctgaaggttctccaaatgtcgcaggcctgttcaaatga

SEQ ID NO: 111929 - DNA, 876 bp, Glycine max
  Peptide Sequence Number=SeqID_228707
atggataattatgcaagtagcggtgtatttatttctactccttccgtaagtgaagaatctgccagtgttcagatcagggggaaagtttctgtcagcaaaaaggttaaaattacaacaacgatttatgataaagaaggcaaagaggtcgccgtttctgaaacggatcctgataagggtggaagctttacggttcaggtaaaaaacatcaaaaaaccaaatttatggagtcctgaaaatccttacctgtataaagttgtgaatgtattgagagatgcaaaaaatgagatcgtatatgacgaggtggtcaatcctttagcctttagatggtatcatttcgatgctgaaaaaggattttatctgaacggtaacccctataaaattatgggagcgagcaggcatcaggattttaaaggcatgggatctgctctttccgacgccttgcatatcaatgatgtgcaatggctgaaggatatgggtggaaattttttaagggtttctcattatccccaggatcctgctgttatggaagcatgtgatcgccttggaatattaactgctgtggaaacaccgggtaacaatcagatcaccgaaagtgaaggctacactcataatatgctcgatatgcaacgtgaaatgatacggcagaattataatcatcccagtgtaattatatggagctatatgaatgaagttcttattcagcccttgtataaggacaaaacgccggaaagagaaaagtattggaaaaatcttcatgagcttgctctgaaaatggaaaatctctgccaggatgaagataaggaaagatatactatgattgcatttcacggagatttcgataaaaaacaaaaaagttggacttatcgatatacctaa

SEQ ID NO: 111930 - DNA, 612 bp, Glycine max
  Peptide Sequence Number=SeqID_228708
atgacgcttgaggccacaaaggaaatcgctgagaagattgcgtcacaggaacaccctggccgtgtgcgtgctactggagccaatgtcaccatcaagcaatacttcagatcagctccacaaagctcccacaattcctccttcatccctcccaaagaactcgagcagctcactcaacaaatcagggaccagttggaggagtcgatcatagaaaaaggacttgcattgcctccggagcctgaggttggtccttcaactgctcatgttagcaccaaggggagttgtgttaatccctcaccgaccgatccaaagatgggtgactcagacaaatgcgggctgtacatcgaagaaaatctttcttgcctagttgccctaggaagaatttatgagggatccacaattgttcacaacatccttttgttgcatggccaggtgaaggttggtgttaaggaggttaaagatgaagaggctctcgttcctgtacccactgatgaggttcaactagtggggcaggcattgaacaccttccttgcttggtcgacacatctcatgaagcgtgtatcaaaacatgcagctgtgtctccagcaaagcctccagataggccagatcctgag

SEQ ID NO: 111931 - DNA, 162 bp, Glycine max
  Peptide Sequence Number=SeqID_228709
atggagaagactcaatttgaccagcggggtccccgagatggggacggaccaatttatttgatccgtgtaagaagcggggcggactggcccggtccgctgccaatgcgggcttatgcaggcgggcctcacgcggggcgggccgacccacttacccacccctag

SEQ ID NO: 111932 - DNA, 1181 bp, Glycine max
  Peptide Sequence Number=SeqID_228710
taggagaaggaggatttggacgtgtttattgtgggacattggatgatggaaatgaagttgcagttaagctgcttacaagggatggtcagaatggagaccgtgaatttgttgcagaagttgagatgctaagccgcttgcatcatcgtaatcttgtgaaactcattggtatatgcatagaagggccaaggcgttgcttggtttatgagctttttcgcaatggtagtgttgagtctcatttgcatggtgatgacaagaaaaggagccctctaaattgggaagcacggacaaaaattgcccttggatctgcaagaggattggcttatctacacgaagattctactcctcctgtaattcaccgagattttaaagctagcaatgtgttgttagaagatgactttacccccaaggtttctgattttggattagcaagagaagcgaccgaaggaaatagtcatatttctacaagggtcatgggtacttttgggtatgttgccccagaatatgcaatgacaggccatttactcgttaaaagtgatgtttatagttttggtgttgtgctgcttgagcttctgacaggcagaaaaccagtggacatgtctcaacctcaggggcaggagaatcttgtaacgtgggctcgcccactattgagaagtagagaaggtttagaacagctggtggatccatctttggctggaagctatgactttgatgacatggcaaagatggctggtattgctttcatgtgcgtacacccggaggtcaatcagagaccttttatgggtgaagttgtgcaggctcttaagttgatccacaacgacaccaatgagagtaacaaggagtcttctgcttgggcctcggattttggaggtgaacttgtcttttctgatagcagttggttggatgctgaagagttagccccaagattagcttatggacaagcatcaaccttaatcacaatggatttcaattctgatcatcttgaaatgatggaaaacagaccgttttcagcttcaagcttcaatggagatgagatttctttgccgatggggcaccaggttagatcagaccccttgagaactgctcagagtaagctaacattttataagcttactcgatgtcagagtgaacatgtggtacatccttccaaacgtgtttggaatgatgatggttactgggtttaa

SEQ ID NO: 111933 - DNA, 732 bp, Glycine max
  Peptide Sequence Number=SeqID_228711
ccgcttcacgcaatattcgctcttttcctcttctcgccgccagccgcccatgcccgccatcgccctggactccttcgaccgcgccattctcgacgtgctgcagcgcgacaacctcacgccacagcgcctcatcgccgagcgcgtgcacctttccgcgccggccgtgcagcggcgcatcaagcggctgcaggagctgggcgtgatcgcggccaacgtggccgtggtcgatccggcgcgcataggccggccgctgaccgtgctcatcaacgtgcagctgccgactattcattgatcgtcacggctgccgatatggaggagtaccaggcgctggcggctcggctgtttgcgggggacgacaacatccggcgctacaccacctcgatagcgctggaacgcaacgccatcacaggcagggagacttcaatgagcgcaccgcatccggacagcatggccaatctggtggccatccgcaccctcgacaagtacgagaacgactatttccccaagcgcgaccgcatcaccatcgcctttcgcggcgatctggcagagcagttcaagtacgacaagatccgtccgctgtcgccggcccagcgccatggtcaccgcgtggtgatcgaggccgagagccagaagaccggcaccaccggccactactgcatcgagtgcaacagctggaacctcatcgaggccgtgggcacctgggcaccggagccggagcaggcggcgggctga

SEQ ID NO: 111934 - DNA, 1551 bp, Glycine max
  Peptide Sequence Number=SeqID_228712
atgaaaatcagactagtactggatgtggctcctttggctgtttttccagtaattgatgagttggagattgaacttgcatctgcgacatatttgaagcagagccaggtgaggataatgggtgtcacttctgacagtcaaagtcagggaagaaccatagttgatattaacttggttccacttggggaaaaatttgacaataccacagcagttctgttgtgtaagaggttttggcacaacgaagttcctcttattaggagcctttttggtgattatgccatcttgtatattacttatccaggtagttgtttcattgctcctaatgacatttactttattcttatcatatgttactgctcgagactaaagcagttggtatcaggtataccatcagcgctgccacctgaaaccataattgggagaggtcacatgcccagggagagtgttaatgttctcccaatcactgcagatatgaacagcgagaatgagaagatgaatcttagaactataatcatcattgctctatcttctgttatactcttgttggttttggttggagcattttacatcattttgaaatggagggaaattaggagaccatcaggtgctgttggccctgcattcaaatcatatctaaacaagagatctggcatggaatatatgttgtcaagcagaattatgagctcaagatctatgtcccttgtgtccactctcgctcattctattctctctgttaaaacattttccttttctgagcttgagaaagcaactgctaagttcagttctcagagagtattaggagaaggaggatttgggcgtgtttattgtgggacattggatgatggaaatgaagttgcagttaaactgctaacaagggatggtcagaatagagaccgtgaatttgtcgccgaagtggagatactaagccgcttgcatcatcgtaatcttgtgaaactcattggtatatgcatagaagggccaaggcgttacttggtgtatgagcttgttcacaatggtagtgttgagtctcatttgcatggtgatgacaagaaaaagagccctctaaattgggaagcacggacaaaaattgctcttggagctgcaagaggattggcttatctacacgaggattctattcctcgtgtaattcaccgagattttaaagctagcaatgttctgttagaagatgactttacccccaaggtttctgattttggattagcaagagaagcgactgaaggaaagagtcatatttctacaagggtcatgggtacttttgggtatgttgccccagaatatgcaatgacaggtcatttactcgttaaaagtgatgtttatagttttggtgttgtgctgcttgaacttctaaccggcaggaaaccagtggacatgtctcaacctcagggacaggagaatcttgtaatgtgggctcgaccaatgttgagaagtaaagaaggtttagaacagctggtggatccatctttggctggaagctatgactttgatgacatggcaaaggtggctgctattgtttccatgtgtgtacacccggag

SEQ ID NO: 111935 - DNA, 734 bp, Glycine max
  Peptide Sequence Number=SeqID_228713
gcggtgctggaagcgcaggggcatgaggtgaaggtgtttgaagatccgtcactggccgactggcaggcttacagcaatgaggtcgcgttaattgttacctcgaccaccgggcagggcgattttccggacaatatcgcgcggctgtatgtgcaggtgcgcgatgagctgggctatcagcctgagctgcgctatggcgtgatcgctttaggcgacagcagttacgaccatttctgcggggctggaaagacttttgatgccacgctgcaggagcagcaggcgcagcgtattggcgaggtgctgctggtggatgcgacggaaaatccggagcccgagtcagtgacctcgccgtgggtggagagctgggggatgaaacttaatggttcacccgaacagcttcctcttccgccaggtttgcgcacatcacgtcaccggtgccggattgaatactgccagctgaatcagctcaaacagccgccagccgacctgttcaatactctcttcacccgtcgcgatggtgccggtattgatgtccatcagatcatgccagcggttcgccagcgcgctgcgcgtcgccattttgatcaccggaattgccgccaggccgtaaggcgtgccgcgcccggtggtgaacatctgcagcgtaatgccggaagccatctgctgggtgccacagacaaaatcgctggccggcgtggcggcgtaaatcagcccgcgctgcgtcgggcgctgtccgg

SEQ ID NO: 111936 - DNA, 335 bp, Glycine max
  Peptide Sequence Number=SeqID_228714
ggatcgcgcccacaagacacccagtggacccggagacgtccaataggaccatggggtttccagctctggttacgggcctctatcagtcctacagggtgcccgtaccccctcggcaagagatcgcgcccgcaggacacccagtggacccaaagaagtccaacatggtcctagggtttccaggtctgattacgggcctctgtcagttctacggagtgcctgtcacccccagcaaggtcatcaggccccctactaatcgagctttcatcaagaggtactgcgcccccaggcaggcgcaaggcgaaacaccacagcagcctggggatggccagcaatag

SEQ ID NO: 111937 - DNA, 276 bp, Glycine max
  Peptide Sequence Number=SeqID_228715
atgggtctgttgttctggagtttggatgatctgagtcaagagttctttcaggctttgatgatcagtgaggattacaaaaggatgtccgaggaggtaatgccgccatttgcacaccgccgccgtaatggcatcaccgtgcccattgcaaaaccagacgcgtctgtttcaagggtgaatggaattgagaaatcagggggaagcaaaacaggggcatgggtcattgcatgttttagcttatcgaaagcttcctgggattcagatgtccataagaattga

SEQ ID NO: 111938 - DNA, 1262 bp, Glycine max
  Peptide Sequence Number=SeqID_228716
atggtgctcaccctaggcctttctccgacagagaccactccattcaaagtcacagtaggcaacggcgatgagcttcactgtcatcagctatgtcaagcggttacggtccaaattcaggaccactccttcaccattaatttccatatcctacccctttgcgatgccgatgttgtgcttggggtacaatggttgaagactcttggcccggtccttacatattatacaactttaactatgaaattcatcattgtgggtaaattaatcgagttgcatagggatcgtgaaaagaactttgagttagtgttgccctcgcagcttcgtcggctgcttcacaccaacacatcctgtacctttttccacattcgacttgacccacccactacctcagagtcaacagtcgagtctacaccttcagccattacccaattcaccactaaatacgcagacctgtttcaacccttgaataccttgcctccctctcgcccaactaaccatacaatcaccttacttccaaacttcactccgatgaacgtgcgtccctaccggtacccatattttcagaagcaagacattgaagatcaagtggcttccatgcttgcgagtggtttcattcaaccaagttcaagtcccttctcttcaccagtgttattagtgaagaagaaggatggctcttggcggttttgtgtagactatagagccctcaacaccatcattgtgcacgaccatttttcgatacccaccattgacgagtttcttgttgaactcggcggtgctcgatggttttccaaactcgacttgatgcaaggataccatcaaatcctgatgaacgaagcagatatcaacaaaatcgcgttccgcactcaccatggacattacgaatttcgcgtaatgccattcgggctatgtaatgcaccatcttctttccaggctacaatgaaccaattgttccagccattcctgcgtaaattcatcattgtcttcttcgatgacattttgatatatagcagaagtttttctgatcatctcctgcatttggaaagcgcttttcaggttctcaggaatggcaagttctcccttaaactttcaaagtgtacattcgctcaacaacagcttgaatatctcggccatctcgtgtcaggagagggagttcgaccgatgtcaagaaaagtgcaagccattcaacaatggccaacaccacggtcaccacaagccttgcgtggtttcctcgggctggctggattttaccaaaggttcatcaaggg

SEQ ID NO: 111939 - DNA, 414 bp, Glycine max
  Peptide Sequence Number=SeqID_228717
atgtctgtagaagccagtgagaccaagaaaaccatgcagattagtggtagaggctgggtttttgggatatcctcctctgccattcgtatttggtggaagccctaccgaaggtccaatttcaagaaccataacgctgcaccaagttcatcgagaagctcatcaatggttggcatggggaacctgtctgtgatggggatggcatttagggcattgaataaagccggcatcgagcatggcttggacctgattctccagttcagtcttttggctatggagataatggtagggtttgacattaatggggttggagttgggtggtgggtggttctggacatggagcgggtttgtgaggaggtgtgggtaaatccggaattggctggagggacagattgtcaccatcatcatctgctataa

SEQ ID NO: 111940 - DNA, 339 bp, Glycine max
  Peptide Sequence Number=SeqID_228718
gtggcctggccaagtgcccagccttctctttctggagggggtggggcctctgcaacccaagagcctgagccagaggagccagcagcagcagcagagggggaggatgagctcactcctcctgagcccttttattttgattcaggtgtacagatggctcagaaggatgagacttccacagaccaaattcgaaagccatccccagtacccatacctgatgaatccatgccatcttcaccagcatctgagctagagcaacatatccctcagaattcaccagctgctcaattgttggatctcaatgagcatgcacaagagcaatcacaggagcaggacatttaa

SEQ ID NO: 111941 - DNA, 342 bp, Glycine max
  Peptide Sequence Number=SeqID_228719
atgagctacgctcagatccggagtgtagatccgaacgcgagagcggctccggcggcgagaacaccggcgacgaatgacggcgacacggcggcagcgggagaggtagggctcggagccggagcttcagcggcggagatgacggcgacgaacaccgacattacgacggcgaggaacaatgctttggagaaagccattgtgagagttctctttgagaagaggagaaagcagaggttttatatagagggagagagagaggagacgttacgggcagttcgggtagctgcccgcctgcccgaagtacagactggcaataggtccgttgccagctgcatctacttctga

SEQ ID NO: 111942 - DNA, 282 bp, Glycine max
  Peptide Sequence Number=SeqID_228720
atgtcgtcaaagcgaggtacgtccaacttcatacggtggttggtgtcggccatggaaccagcagaaggccccgactataacgaggacgataagatcatcgactttggaggacatggagaggtgagaagcggtgagtttagcaatagcctcctccaagtgatcggaggacgaggaagatgttttagagcgggtggcgcccgctatggcaatgaaagcaccaatgatacacttggatttcgaggaccaagtaccctcccagaattaaagataagagatagctga

SEQ ID NO: 111943 - DNA, 927 bp, Glycine max
  Peptide Sequence Number=SeqID_228721
atggataaagagtctcataacaatggcaatagcgttagagaaagagacaaagttggaggaggaggggataatagtagtggggccgggtcgttgttgctgagaggtggctccgatggaatgaggcaagcaacgacgtcggatttggggctgcagtggggtaacaggaagagactaaggtgcatgaaggtgcaggtcaaacacgactcttcttcttcaaacaacccggttcagaggacaaccacaacaacggttcgggtggatcggagagtggttagaaccgagaaagattcttcttcaaatattattagtagacccttacccactattaacaacatcagcaacaacattactaataataactttcataataataataatcagagtaacaacgggtatctgaatctccgtcaacgcccaccttccccgcagcaacctcctccgcgaattctcaggaattcggagacttcaagtgctatgagaggaggccaaagcaacgggagtgttaggggaattgcctcaccggacaggggtgcgcacgataagaaggggacccataacaaccaccttaatgacaataataacaacaagtctgtggtctcatcagacaccgcgcacgaaagcaagaagggtggtggctcgccgtccggcagtggtgacgtggctccgccggtgtggccgccaaagttcgtgattgccttgacgaacaaggagaaggaagaagattttctgctgttgaagggttcaaagcttccacagaggcccaaaaagagagccaaattcatacaacgaaccctcaatctcgttagtccaggtacatggctgtgcgatcttactctggaacgatatgaagttagggagaagaagatatccaaaaagagaccaagagggttgaaagcaatgggcaacatggactctgagtctgaatag

SEQ ID NO: 111944 - DNA, 1155 bp, Glycine max
  Peptide Sequence Number=SeqID_228722
atggttgatcttgaacttcaggacaaagtgaatttcttccacatcagggagatggagatgaggataaatatagtgcatggcgtggctgtgtggggagccacaattgtgctgaactcattatttggaggttctgcgccttccattttggagagctataaaagtggaagccataacgaacgaacagacggagcagaggacaagatgggtagtgtgagttatagcaatctgaagaacgccatgatagcattcttggtccctctaccctccatcctattctacctctcattccaatcggccattagtactccttcttcttggtcttctctgtggacatggtgctatcaccaccctctgctattggccaatgtccttttcttcttcaatgtcaatttcctcttctggctcatcggcctaatccaatccagccactggatgattgacccgtattggacagtgatacctgtgatgcttgttcattactattcaactcaccctttggcacagtatcagtggtggaggtcgaggatcgtaacgttgttgacttgggcgtggagtgttaggctgatccacaactacttcaggcgagaaaagtggcagtggggtgccagggaggattggcgtttcactgatttgagccatcgctatggaaggcattggtggtgggcttctttcttcgccatctacgtccctcagcaggtgtttctgattggattgtctcttccgttctatgtcatccactcggtgaaccagcctctgagcatgtgggacttggtagccatagttgtgtgtgtatctggcattgtcacggcatacattgctgatactcagctttacaactttgtgagtagaaagaacaaggaggtccctattcttgacaaagggttgtggtattattctcggcatccaaattactttggagagcaggtgtggtggtggggaatggctgtgtttgcttggaacctgggacatggatgggctttcataggggcattagccaataccatgtgtttggcttatgtcactaagcttgtggaggaccgaatgttgaaacaagatagcagagcagaggcgtttaggctctatcagaagactacttccctatggattccttggttcaagtcatctcctttaggactcaaatctaaggatgcttga

SEQ ID NO: 111945 - DNA, 195 bp, Glycine max
  Peptide Sequence Number=SeqID_228723
atgtatggttcaagcgagggtaagcgagagccgtcagatcagagatcaacggtcaacaatttccggagcgtggcagaagatgtatataaacagagagcatttcgttctatcactgagagcaaagacgaagaagaaacacccagtgtatgtatcagacaagtatttgtcagaatcacattgttaattctcttctaa

SEQ ID NO: 111946 - DNA, 279 bp, Glycine max
  Peptide Sequence Number=SeqID_228724
atggggttctataaacaaatatctcaccaattttcaacgcctagcgaatcgtatcatcgggctagcaccgtcttcactcctcccttgcccaaaacacctcccacaccaccccctgtccaaaccagaccccatatgaaacttgactccccagatttgacggtcaggacccccttgtgtatcccagaagcagagaggctcactgtatcagccttctatatggaaggtcctgctttatcatggtaccagtggatgtatctgaatggtttcctcacctcctag

SEQ ID NO: 111947 - DNA, 1116 bp, Glycine max
  Peptide Sequence Number=SeqID_228725
ggaaaggagagaatcaaccaatctaataagcctttgagaccagtgcggttacttgtgttgttttttgctctatgtgttctgttctcagtgatcagcatatacactgttaagcattttggaattgagagtgtggtgaccacaatgagttctagttttcagccatgttattatgaggaacctggtggtttggataagtggattaggccaccttcaagcctgatccacaatatgagtgacgaagagcttctttggagggcttcctttgttccaaggatcaagggttacccttatcctagagttcccaagattgcattcatgttcttgaccaagggaccattgcctctggcacccctttgggagaggtttctcaaggggcatgagaagttttattccatatatattcattcactgccctcatatcaacctcagtttcctccttcatctgtcttttacagcaggcaaatccctagccaggtttctgagtggggaaggatgagcatgtgcgatgctgaaagaagactccttgctaatgcattgcttgatatctccaacgagtggtttattctgctgtctgaatcatgcatccccctctacaatttcagctttgtctaccactacataatgaaatccaagcacagcttcgtgggtgcatttgatgatcccggtccatacggaagagggcgctacaacgagcacatggcccctctggtgaatgtcaccaagtggcgcaagggctctcaatggttcgaagtaaaccggaagctcgccatcaccatagttgaagacactacatttcatccaatatttgaacaatattgtaggccggcttgttacgttgatgagcactatttccccaccatgctcaccattcaagcagccaatgtgttggcgaacaggagcataacttgggtggactggtctaggggtggagctcaccctgctacatttggaagaaatgatatcactgaggagtttttcaatcgagttcgcagaggtcacacttgcctatacaacaatagaaactcttcagtttgtgctctttttgccagaaaatttgctcctagtgctttggaacctttgttacatatggtggattcaaaggttttggacttttga

SEQ ID NO: 111948 - DNA, 927 bp, Glycine max
  Peptide Sequence Number=SeqID_228726
atggcactcagactcagaggaaaatgggttttgattccattcttttggttttgcctgattccgttttgcttctcacaacagaagctgcgcttgcgctttggaaaaaatggagagttcaagatcttgcaaattgctgacttgcactttgccaatgggaagactacccactgcttggatgtgcttccttctcagtatgcttcttgctctgacctcaacaccaccgccttcatccaaaggatcatcctttctgagaaacctaaccttattgtcttcactggagataatatatttggatatgatgcttcggatccagctaaatcaatggatgcagcatttgcacctgcaattgcttcaaacattccttgggtagctgttttgggcaaccatgatcaggaaggatccctctcaagggaaggagtgataaaatatatcgctgggatgaaaaatactttatctatagtcaatcctccggaagtacacataattgatggttttgggaactataacttagaggttggaggagttgaaggcactgattttgaaaacaaatcagtgcttaatctgtactttcttgatagtggagattactctaaggttccttttattcctggctatggctggatcaaaccctctcagcaactttggttccaacggacatctcaaaagcttaggtttgtggatcttctgttagcaatacaaaccaagacagcagcaggcccagaagagtcattagaaggcccattcatttggatgactacgtttgaagaccattggaaattccctgcaccttatcaggcaatcatgagagaattagtggaatcaagctggatctttgagcttcaatggggtcctttaatggtgattttccaccatggagatgcagcagaagacaaaggagaagaggtgagaggaggcgccatctcctag

SEQ ID NO: 111949 - DNA, 1227 bp, Glycine max
  Peptide Sequence Number=SeqID_228727
ggtggacccttgggtactagtaccctcaccttccgaggactacacgtcctcaccttcagaaggctacacgccctcaccttcagagggctgcatgccctcgccttcaggggactacacgtcctcgccttcagaggactacacgtcctcgccatcagaggagaacacgttctcgccttcagaggactacacgtcatcaccatcaaaggactacacggctatgcagcctcaccttcagagggatacatgcacgccctcagaggactacgcgtcctcaccttcagagggctacatgccctcgccttcagagggctacacgccctcaccttcagaggactacacgtcctcacctttagaggactacacgtcctcgcctttagaggactacacatcctcgccatcagaggacaacacgtcctcgccttcagaggactacacgtcctcgccattagagggctgcacgccctcgccttcaaagggctacgcatcctaaccttcatagggatacatgccctcgccttcagagggctacacgccctcaccttcagtggactacacgtcctcacctttaaaggactacatgtcctcgccatcagaggactacacgtcctcgccttcagagggctacacaccttcacctttagaggactacacgtcctcacctttagagggttgcacgtcctcgccttcagagggctgcacaccctctcctttaggctacgtgtcctccctttcagtgggctccacatccgcaccttaagagaatttaagttcctgggccaccccgctgatcctggaggagggccaactgtgcgagcacaacttgaggaggaggctatcgtacaaccactatgcatactggggaaagatttcacccgtgccgttacaaagagacgagtgtggatcatgtgcaccaacatgaccactcttacacaaagacacccagtggacccgaagaagtccacagggccctggggtttccagtttggtttacgggcctctgtcagtcctacagggtgcccgtcccccccagcaaggtcataccatcgtgacatagggatcgcgcccgcaagacacccagtggacccaaagaagtccagcagggtcttggggtttctagctctgattacgggcctttgtcagttctacgaagtgcccgtcgcccccaacaagcgggcaacagacacaccgccaccacctctagagttcacctcagctcatccaaaaaag

SEQ ID NO: 111950 - DNA, 1972 bp, Glycine max
  Peptide Sequence Number=SeqID_228728
agaaactgtgcaacaaatcaatgagagtttgtttgtgattgttgctgaggagagtgatattgttcctgcaaagagggcaggtaatggtatttgtggtgacatcttggtagcgaccttagctttcctccttcagagatttggcatagacacactgcacaacaatctccttcaccatcaccacgactatgcaacaacctttggattgtgtatttttgaacaactacgtacaatggctgtgagggtggtgatcatgttggctcttgtgcttcatgtaacaatcgatgaaaacaatacattatcctatttggttcggctttgtggtgtgcgtgcttcttcttccaatgcacttctgaattgcactgacccgagctcccatgcctttgttagccttagaattagaaacttgaatgtcattaaggctgttgccaccttggatgctaaacctcgcttggatttggatgcacctcacccgcctggctttttgctcgaattctccgacccacctgatgatagggagaagttgagaagattgagaatttccaaagctaataaaggaaacaccccctggaacaaaggacgaaagcacactcctgagactttgcagaaaatcaaagaaagaacaaggctcgcaatgcagaatcctaaggtcaaaatgaagctcattaatcttgggcatgcacaaactacagaaacaagaaagaagattggtgttggagtgagaaggcgatgggaaaagaggcgtggaaagaaaatggtgcaggaatcttgctgcactgagtggcagaatttaattgcagaagcttctaggcaaggctatgttggtcaggaagagctgcagtggaattcttatgaaactgtgaatgaacagctgaagcaggactggttgatgagtgttgaacagaggaaacaaatggcaaggacaccatctagcaaaagagcacccaagtcccctgaacagagaaggaaaattgcagaagccattgctgccaaatgggctgatccttcttacatgtgttcaaagttcaagcaacttgttacaccaaatgtggaataccgcgaaagagtttgttctgcattggccaagtatcatggcagtgaagttagagctgaaaggaaacctagaagaaggccaagtgatggtacccaacctaccaagaagaaacctgcaaaaaaaagagatattgatactagcgctcatgttaagaatgactccaagacccgtaagcctatcctgttgaaaaaaagcaaatccccagcctataaggatcctttggtgaattctaagcttgaaatgattaagaatattagagcacagagagttgccgcagaaaccacacaaactcaggccattgaacaagcaagttattggcctctttgtttctatggtcatggtggatacactaaacattggtcaattgagtttggtttgttttggagattaggtcatagaaatacagctgagaaggctgccaaggcactcgaggttgctgcgacaaagagtcctattgcacagtcttctttgatagaaaccagaaagctaatagctgaagctattcaatcacttgaatccattgatacacaagctataactgaggaaaaaggatcagcatttgaagttctaaaccaatctcaaatggcccaagtaaatggacacacaatgttatcatcaagtgactacaagttctctgaagattttggcaaattttccttggagaagccagttaatggtgatgctgaacttctgctaaccaatggttgcacatccttaccttttagtttgaatagtcagatgaatgaatctagtccatcaaatcaacaaagggaagcagaacaggatcagagaagtgaatacgaaacagatccttctccaacagtgatgggaattcactcccttgaaaatcagacaatgtctgtagtaactaaaaagtgggttcgtggaaggctcgttgaagtggctgaagagaaacaataa

SEQ ID NO: 111951 - DNA, 351 bp, Glycine max
  Peptide Sequence Number=SeqID_228729
atgtataaattgctagatgagtatgtagccactccaacccaacaattggatttgagctgggagtgtggagtacatatggagaagacaagagttgtattgatgattgggaggagcattcctggctattggaagcctctcacatctaaggcttccaatcgggctgcagttcatgagcctcctgttcctcacatcctcctactggggttagacaatcagaagaggaaagaggaagtagaaaaggagattcaaaaagccaaacaagagaaagaagccaagaggaaacagattgaggacactatagaatcccatatcaacaactccaccaaatctgaatcctgttctgctcattga

SEQ ID NO: 111952 - DNA, 657 bp, Glycine max
  Peptide Sequence Number=SeqID_228730
atggaaagggacttgatccatgagaatgcccctccatcttcatcttccttctcgccattcatttccaacctcagaaactcacaaattcaacaagttcttgtccagcagtggatcagaagttgtcagaaagaagaaccattgagtggaagcctaaggctgataaatatggttgcagtgtgcgtttggggtcagatgtctaaccgtctcatttgcttggagaagcacatgttgttcgcggctctcctgaaccgggttttggtcattcccagctccaagctagattataaatacaatagagtcttggatattgatcacatcaataaatgtactcaagctaataataaagtgctcatctcctttcaagagttttctagtattaagaagcgcatgcatttgctatgttatttttcattgcctaaaccgtgttatctagaccaggagcatttgagcaagttgaagtcgtttgggatgaggatgccaggaagcccaataagaggaccgttgaagatgttctttcaagggacggctcatctttgtccatatatattgtcatcgtgcggcaacggtgggaacaattgcagtggcggcggtggtgaggctacggaggaaggaaaggaatccgatggcctgaaagttgtcttgatcatcaaggaatag

SEQ ID NO: 111953 - DNA, 531 bp, Glycine max
  Peptide Sequence Number=SeqID_228731
atgttggctgtgcgaagtgatctttccaagacaaaacagggctcttacctattaaggaaactagatattgacggatttgctgcgagtcctgatcattggaggtcaaaacaagcatcccaagaatctacttataaagatttttataccatgtttggttccagtgatacgaagttgacgaaaaattatgcctttcttgctgacacttcaaataataaatcaaataaaaaaactgtaaaggaaatgagtaaagaaattgatcaatccctaggttctggtgcaccatttctgagcacccaaaacttcaagaaaaacccaaaaaaagaaaaacacaaaagtaagaaaaatgctcagactagtggagatgatgataactctaacaggaagaagaaaaggtctaacaaggaaaaggttgaaagtgggtttgatattgctgctactgcagcaaccaagaagacattgaagaaacgacgaagagatggtgacctttccgaggcttctctgaagaaagtgaaggcatcaaatgcagagtga

SEQ ID NO: 111954 - DNA, 1008 bp, Glycine max
  Peptide Sequence Number=SeqID_228732
atgtggtggagatcagcatcattcatcatggacaggcagcagcagcagaaccagggggactcctcaaaccctaatatctctgcctactatgagaccagagcggcgcaccacggcgtggtcaccagcgactggctggcccaggctcaggccgctattggccccgaacctcaacctcaacctcaactcagccccgatcctgacaagcccttcagtgtcatcgaccagtttaacagctggcggaaacagccccatttggccgaggccgtcgccgccattcgcgccctggccgccgtcataagatccagccaggctaccaccatgatgcagctcgaaatcgagctcaagaaggcctccgattctctcaaatcttgggatacctcctctatctctttgacagccggctgtgatctctttatgcgatatgtcactcgcacttctgctttagagtatgaagacttcaattccgctaagtctcgcttgatcgaacgtgctgagaatatgtatctttggcatcttcattgtggtctgcacttcaacctttgtgtctacaaattcacagagggaagaccagaccgaacaggtttgcggttgtcgaatgagctggccaagcttgatgttcctgtgaaacttctaatagattctgctgttgcatatactatggatgaggtggacatggtttttgtgggtgcagatggagttgtcgaaagtgggggcataatcaacatgatggggacctatcaaatagcattggttgcacacagtatgaataaaccagtttatgtcgctgctgagagctacaagtttgcccgcctttaccctctcgaccaaaaggatttagcccctgcgttacggcctattgattttggcgtacctattccatccaaggttgaggttgaaaggtccgcgcgggactacacccctcctcaatacctgactctgcttttcacagatttaggtgttcttactccatctgtcgttagtgatgagcttatccagctatacttatag

SEQ ID NO: 111955 - DNA, 2307 bp, Glycine max
  Peptide Sequence Number=SeqID_228733
atggcttactcccactctcgtatcatgattctgttgtttctgctctccttgggcacagcatcagaagaaaagaagacaacatacatagtgcaagtccagcaagaagccaagccttccattttcccaacgcacaggcactggtaccagtcttcccttgcccttgccgacagcacagcctccattcttcacacataccaaactgtcttccacggtttctctgcaaggctctcccccgccgaggcaaacaggcttcagtcactctcccacgtcataagcctcattcccgaacagcttcgccaactccacaccacccgctcccctcagttcctgggcctcaacactgccgacagggctggccttctcaaggagaccgatttcggctccgatctcgtcatcggagtcatcgacaccggcatttcccccgagagccagagcttcaacgaccgtcatctcgctctccctccccctaagtggaagggccactgcgttgctgctaaagactttccccccacctcctgcaaccggaaactcatcggagctcgctacttctgcgctggctacgaagccaccaacggcaaaatgaacgacactttggagtcccgttccccgagagactccgacggtcacggcacccacacggcttccatcgccgccggcaggtacgtcttcccggcctccaccatgggctacgccaaaggaatggccgccgggatggctcccaaggctcgcctcgccgtctacaaggtctgctggaacgccggctgctacgactccgacatcctcgccgcgttcgacgccgccgtggccgacggcgtcgacgtggtctccctcagcgtcgggggcgtggtggtgccctaccacctcgacgtcatcgccgtcggggccttcggagcctccgaggctggcgtcttcgtgtctgcctcggcgggtaacggcggtcccggcggcctcacggtgaccaatgtggcaccctgggtcaccactgtgggcgccggaaccatagacagagatttcccggcggatgttgtgctggggaacggcaaggtgattggcgggatgagtgtgtacggtggaccgggtctgactccaggtcggctctatcctctggtgtatgcgggttcggatggttactcttcctctctttgcttggaagattcgttggatcccaagtctgtgagggggaagattgttgtgtgtgagagaggcgtcaattcaagagcagccaaaggccaagtggtgaagaaagccggaggggttggaatggtgttgacgaatggacccttggacggggaaggcttggtggctgactgccaagtcctcccggcgacctccgtgggtgctgaaggaggggacgagcttaggagatacatggcattcgccgcacagctgcggacaccagcaacggcaaccataatattcaagggcacaaggctcgggattaaaccagcgcccaaggtggcatctttttcggccagagggccaaacccggagtcccctgagattctgaagccggatgtgatagctcccggattgaacattctggcggcttggcctagtacgctttccccttccgggcttccctctgacgagcgcaggagccagtttaacattctgtctggcacttcaatggcttgcccccacgtttctggtttggctgctcttctgaaagcggctcaccctgactggagtcctgccgccatcagatctgccctcatcaccactgcttacactctagacaacggaggaggccctctgctggatgagtccaatgccaatgtttcctccgtcttcgatcatggggctggccatgttcatcccgacaaggccatcaaccctggcctggtctatgacatctctacctacgattatgtcgatttcctctgcaattccaactacacctcccacaacatccgagttatcaccagaaaggctgctgtctgcagtggggccaggagtgctggtcactctgggaatctcaattacccctccttagctgccgtctttcaacagtatggaaagcagcacatgtccacccacttcatcagaactctcaccaatgttggagaccccaactcgctctacaaagtcactgttgcaccccctcccggcaccgaggtcacggtggttccggacacgctagctttcaggagattgggtcagaaattgaacttccttgtcagggtgcaaaccagggcagttaagctttcccctgggacctctactgtcaagactggttccattgtttggtcggatgccaagcacactgtcacaagtcccttggttgtcaccatgcagcaacctctctaa

SEQ ID NO: 111956 - DNA, 471 bp, Glycine max
  Peptide Sequence Number=SeqID_228734
atgggccaatccgacaccaattttattcttcctcacggagaactctggaggaatttgattgatggctgtaaactgtacttcctcaattcgaatcccaattcagaaatatggatcatttctcaagtaccccaacaaaaaattgatgtccaaacgcagctatgtcccaatgaaaaaggcatcggtactgaggatcacagcatccatcaagaacaagagatctttttggtttatgaagatcactcccagggcataatctgctaccaagatgagtttggagaaatagtttgtgaagggtatgatgaagggccttgtttccaaagaattccagagacgaccaatcgtccaagagatgctcaaatcacgaagaatcttcttttacgacaaagttggattcagatagttaaaggagagaactcgaatgatggtctgcaaaaggacttgaactgtaatggctttaactcattctgctaa

SEQ ID NO: 111957 - DNA, 900 bp, Glycine max
  Peptide Sequence Number=SeqID_228735
atgtgtggaggcgctatcatctctgacttcattctcctttttgagacttctaatatcctcagggttttttgggagaattggctaaaaaatgggtctaccacagcgaaatctgtggcattccaagttcgagctgagaaatttgcaaataggaagaggaaaaatcagtataggggaatccgtcaacgcccttggggaaaatgggcagctgagattcgggatcctagaaagggggttcgtgtctggcttggaaccttcaacactgctgaagaagctgcaagagcttatgatgctgaagcacggaggattcgtggcaagaaagccaaggtgaattttcctgaggaggcaccaggtacttctgtaaaacgttccaaggtaaatccacaggaaaatctgagtcacaagttcggtgctggcaacaatcacatggatctggtggaacagaaacccctagttaatcagtatgctaacatggcttccttccctggaagtggaaatgggctcacatcccttccgtcatctgatgatgtcaccctttacttcagttcagatcaggggagtaattcatttgggtggagtgaacagggccccaaaactcctgagatctcatccatgctttctgctcctttggattgtgaatctcattttgtgcaaaatgccaaccagcagcctaactctcagaatgtggtatctatggaagatgattctgcaaagagactctctgaggagcgtgtggatatcgaatctgagttgaagttctttcagatggcttatcttgaagggagctggggcgatacttcgttggaatccttgctatctggtgacacaactcaggatggtggaaacctcatgaacctttggagctttgatgacattccttccatgtctagcggagttttctga

SEQ ID NO: 111958 - DNA, 528 bp, Glycine max
  Peptide Sequence Number=SeqID_228736
atgacagttaaatgcctaagtatgtttgccaatatctgctcttctgcatcatcagagaaccctcatgccacactgaacaaattttttgccctccagcaactcatggaccagccaaatggtacaactcagtcgaaagataaaccacttcaactatataagattccaactgcggcagaaaaacataaatcgggcaagacggcaggtgtgatgcctgttaaaagcacgtcaaagactccaaaacccttaaccaatctatcaagaactgagaagcaagaatgggccaaagaggatggcaccaaagagatcaatgagctgaaagaggtctttttaaatgaaacaagatcatggtttctgatgtacttgaaaaagacattagatgctgggttttccattggctcccaagagaagggcaaggaaagtagggataatgcaggaagacagatggagcaaaccaaccatttagctctcacgttgtcacaccttaagcatgcaaatgagtggctggacaaaattgagaagcagttctaa

SEQ ID NO: 111959 - DNA, 1101 bp, Glycine max
  Peptide Sequence Number=SeqID_228737
atggcaagtctaaaattcagtttcctagttctttttgtatgctgtggcatactgattccaacttgctgccttggtgatatgtgccagccaaaagaaaacgctgcattatttgtatttggagattcattatttgatgttggaaacaataattacatcaatactactgctgataatcaggcaaattactctccatatggggaaaccttctttaagtatccaactggtagattttctgatggtcgcgtgattccagatttcatagctgagtatgctaagttgcctctaatccaaccatatctttttcctggtaatcaacaatacgttgatggagtgaattttgcatcaggaggagctggggctttggttgaaacccatcaaggactggtgatagatctaaaaactcaactaagttatttcaagaaagtcagcaaggtattgaggcaggacctaggagatgcagaaaccacaactctgctcgccaaagctgtttacttgattagcattggagggaatgattatgaaatctctttgtcagaaaattcgagtagtacacacactactgagaaatatatagacatggtagttggtaatcttacaactgtgatcaaggggatacacaagacaggagggaggaaatttggggtttttaacctgccagctgtgggttgtgttccattcgtgaaggcactagtaaatggatcgaaaggttcctgcgtggaagaagcttcagcactagccaaactacataacagtgtgctttctgtggaacttgagaagttaaagaaacaactaaaaggatttaaatattcatacgtcaattattttaatttaacctttgatgttataaacaacccttctaaatatgggtttaaagaaggcagcgtggcatgctgtggcagcggcccttacaagggatattacagttgcgggggtaagagagcagtgaaagattatgacttatgtgagaatcctagcgaatatgtgctttttgactcgcttcatcccactgaaatggctcatcagattgtttcccagcttatatggagcggaaatcaaactattgctggctcatacagtctgaaaacactatttgaagaataa

SEQ ID NO: 111960 - DNA, 318 bp, Glycine max
  Peptide Sequence Number=SeqID_228738
atggctggtaaaatttctgaacctggttcacgagccattgagatagtagctggcctggactatggtggattgtctaaagagtttctgactgacatatcaaaagcagcattttctcctgagaccttttcccaaacctcgacatcagacagacttctaattccaactgcatctactagatatttggagaatggtcttcaaatgattgaattccttggaagagtagtgggtaaagctctatatgaaggaatattacttgattactctttctcccatgtttttgtacaaaagctattgggacgatataactttcttgattaa

SEQ ID NO: 111961 - DNA, 183 bp, Glycine max
  Peptide Sequence Number=SeqID_228739
atggcgaagttgtgttttatcgttacttggtgttccgacctcaagtctatagacatcgttaggtttccctattcgaggtgcctcggtgggttgagaggaaaaggtgtttatagacgattcttgacctcggttcctaagcgatgtaggactttgtggctactggaacacttggctaatgtttag

SEQ ID NO: 111962 - DNA, 771 bp, Glycine max
  Peptide Sequence Number=SeqID_228740
atggcagagtatattaaaaggatcactgtgccggtagcgttcgatgagctctgccacctccacctcactaagcggttctccgagaatccggttccgctcctcctcgaccctctcccggtccggttcaccctgaaccggagcggaaacaccggtccatttccggtcgatccggcccggcccaaagggggagaacttgggcgattcgcggaagctgatgggcccaacggaagggtcggactccgaataagagtatctgaagtcgaacggaaggttcgacttgaaaggaagggagaacggcgggtcgtattggtggtcgggaatgaagtggctgagaaaacgacgctgatggagtggtcttctgctactaaagctcctgattggctggaagctgcaatccgtgactccaaaatggattccatggaaacttcaactagttcttctagtgggagggctattagaattgtcagtgtaattctctgtgaacatgggaaaaagtatttggctcaaaaggtggtcatcatggatttgttcactttctgcggtggactttcactttattgttgccatattgtcactattgatatggaatttggatggcaaattgtcgtgggtacttttgttgggttttgtgtagccacgtttggaagcgttggtggtgttggtggaggtggcatattcgtccctatgcttagcctaatcgttggatttgatgaaaaatcatccacagctaaacataagatccgaaacgcgcatgctgaaattaaaacctga

SEQ ID NO: 111963 - DNA, 555 bp, Glycine max
  Peptide Sequence Number=SeqID_228741
atgcagagccgtatcctctgcttctcaacgcgtcgtttaccactccatcagcgtcgttttctcagccacttcattcccgaccaccaatacgacccgccgttctccccttccccaaaaccctactacaaatcaaagaagaaccacgcggagaagaagaaaaagaacaattccgaaaacggtgatccgaacaaaaacggagccccgaaacttcctttcaagtcgaaccttccgttcgacttcagatactcttattcggagtccgacccttccgttgggcccatcagcttccgcgaatcgcccaagttctccccctttgggccgggccggatcgaccggaaatggaccggtgtttccgctccggttcagggtgaaccggaccgggagagggtcgaggaggagcggaaccggattctcggagaaccgcttagtgaggtggaggtggcagagctcatcgaacgctaccggcacagtgactgtgccaggcaaatcaatttagatggttattcctgttatgcatatatctgggttaatatactatcggagatgcttctgtaa

SEQ ID NO: 111964 - DNA, 571 bp, Glycine max
  Peptide Sequence Number=SeqID_228742
gcaaagatccacaagggatgtaccctcccttgttctctttgaaaccctagtggatgtaccctccactagaactgatccacaagagatgtaccctctcttgttctcagtcaaacccaaggaaagggaagaatcaaaagaattctcagactgtgtcgttttgaattctttgacaagggagaagggagacacaaaagaattcaggcggttagtcctttgttcttttggaaaagggagaagagagacacaaaaagaattcaggcggttagtccttggcgaattctttttggcaaagggagaagagatgaaaagaatgaatagcacaagtattcaaggtttggaaaaccagaaaactttggaaagcttttggcaaaaggaagaagaagaagaagttcaaagagactcagaaatcaatgtggaaaaaactccattggagcttgtaggcctaggatcttcttcatcaatggattcctttgctccttggaagatgaatggcagcggaatggagaaggaagagagagaggagacgccacttcaaggagaagatgagtctagaagaagctcaccaccatag

SEQ ID NO: 111965 - DNA, 516 bp, Glycine max
  Peptide Sequence Number=SeqID_228743
atgggtctctgttttgcacgtgaaactagccatccatgcatgcatatcgccagcatgcatggcgagagaagcctgcaagggatctgccaggggggttggcgatttggcacccctttgtcgccactatgcctggcgatttgtctttggcgtgcaaatgacgcaggctttgtgcaaagggtgcaggctagggggtcacgggctatgctggtgtcgcaactagggatggcgatttgtgtggagcctaaatcgccacttgtattggcgatatgtgatgatgacaaaaagctcaaaggtcaatcaaagaatgagttcaagatgttcaagatagaatcaagaacacttcaagattcaagaagaaagttgaagaacacttcaagattcaagaggaaagttgatttcaagaatcaaaaatcaagattcaaggatcaagctttcaagaatcaagatcaagattcaagaatcaagagaaggtttaatcaagataagtatgaaaaggttttttcaaaaactgagtag

SEQ ID NO: 111966 - DNA, 186 bp, Glycine max
  Peptide Sequence Number=SeqID_228744
atgttggaagataatccaggttttttcccacagactacgaaagtgaagtgtcttagtgatgcaggattatttcttgatgcgattgatgtctccaggggacataccatcaggaattttttcagtggtgacgtaaggctacaggtttttcaccaaatctcagtaggaacttatattgtttgcagttaa

SEQ ID NO: 111967 - DNA, 835 bp, Glycine max
  Peptide Sequence Number=SeqID_228745
atgggatttttacaagatgataaagaatttattgaggcaatcaaggaagcaaaagactggggttcagcacattatataagaaagctatttgtgttgttacttttaactgcaacaatgagcaaacctgaacaagtttgggaccaaacttggcattggatggctgatgacattgtctataattataaaaaatcatcaacaagtccagcattgcagcttgatgatagaactcttcaaaatttggtcttgcttgaaattgaagaactgctgcaagcaaatcaaagatcgcttagagactatccttcaatgtcatatccagaggatgcaaattgtccagcttatctagacaatagccttatattagctgaactgaactacaacaatgaagaacttagatcagagtttgaacatctattttctcacaagacagatgaacaagcttcaatttacaacgagattgttgaagctcctctagcgggcatagcttctctgctattgcctggaggtagaaatgcacgttcaaaatttaaaattccagttccaatttttgaagactcaacttgcaatatccatcaaggaactcaattagctgaactattaaatcagacaagtctaatcatttgggatgaagcacccatggctcacaaattatgttttgaggcacttgatcacagtcttagagatatcatcaaacacaactcaaaggacaataaaatctttggaggtaaagtcatggtctttggtggagatttctggcagatcccgccagtcattccaagaggcagccgctctgatattgttaacgcaacaattaattcctcttatctatgggatcact

SEQ ID NO: 111968 - DNA, 652 bp, Glycine max
  Peptide Sequence Number=SeqID_228746
atgccgtggagtttggctggacgcctcttcaaatggggttgggaaaagatcacacgattatggttactaaaaacctatcagaaatcgcatgagtataaattccggcgctatcatttaggcgcacactggaaaccacttggtgagcatttagagtactcggtgcggcttgcccattcagccgatcatgagtcggttaaatcccgcgtggcgtttcgggcaaaaggggcgcttgtggagaacctctcgctttatttcgaggcgtcagggcatggtatccgttaccagcagaaaattgagctggccaatctggaccagtctgtgctgattgttaacctaaaccagataccgcgtcaggaactcatggaggtttctgaacgcggaatttatttttcaattactgaaataaagtttattcagtgcgtcattacgctaccaggtggcaaaaaacaaccatcttttaactcgcaacggttttctctgatgcatggctggctcttaagagacacatggaaaagacgctggggtgtggtctggaattgtaatgcaattgaggatgcaaaaactgaaatgaagtcgttctggcgctggcgactgggggaataccgctatttctcgcttaactacccgagttttaggccccttactttgaatg

SEQ ID NO: 111969 - DNA, 111 bp, Glycine max
  Peptide Sequence Number=SeqID_228747
atcaaccccttgtgtgttcatgggatgcatggacaggatctcccaccctgagttagcccttgtagtgggcgtaaaccttaagtttgaacaagtttacggaagtgagaagtg

SEQ ID NO: 111970 - DNA, 624 bp, Glycine max
  Peptide Sequence Number=SeqID_228748
atggtatggaaggttgaacatggggataaattcaaattttgggaagacaattggacaggaggacacactcaattatcagagaagtatcctaggttatacagcatatcggatcagcaaaatcaactaattcagcatatgggagttcataaagacacaggatgggaatgggatctcaagtggcgaagaccattgttcgatagtgagatagacatggcggtttcatttttacaagaagtggaggggttcagaattcgggctcacattggggatcactggatgagggaggcagattcaagtggacagtattctgttaggagcgcatatagtttgcttagacaacacgtagcagaggaggtacaggttgaagaattcagggagctatggaagctgaaagtcccatcaaaagtggctgtatttgcttggaggttactcaaggacaaactaccaaccagagacaacttgaggaagaagcagattgacttaggagacagctggtcatttgttctttcactgcaccaaagttattccggtgtggtgggaatcgctgtcatgggtgaatgtggtggctgtctttccacatcaaccaagacaacattttgtccagcacatgaatcaaacatatga

SEQ ID NO: 111971 - DNA, 1145 bp, Glycine max
  Peptide Sequence Number=SeqID_228749
atgtcatctgcaaaaagcatgcatctcggcgctatctcttggatttgttccgtcaggacatccaaaattaaggggcgcagagaaacttaccaggcacagaaacacacagcgacgccgggcctggtacgcgggtcttttgcagatgtggtagctaggagagaaccacgtatacagcagaggaggacatcggcagttcagaatgctaaaaccaacacttcgagatcagaagtacatctcgacagacctatgacagcaccgaaatggctacaggatgcatgggtgggaaggctaaaaaatcttgcactccttgacagagtagaggagaatatgctatgggactggggattagacgtagtgccgaaatacatcggcgacgacatggtacttctccccggacttaccgaagacaaggcaaaacaaatgatggaggaagggaatgcaggaagggaggtgatgttctactcggtagaaaggtggaacaagaagatgcgtgctgggtctagacttacatgggtgcaatgttggggagtgccgttggtagcatgggactcaacacacataagggagatcgtgacggccataggcgaggtagtggaagtagacgaggagatggaggatttgaggaagatggacagggcaaggctccttgtaagaacaccgtggaaaccactgattcagcacacggtgagcgtccatattgaaacggaggtgttccaggacatttgctcggaggaaagcgagatgggttcgttatcggaactgatgacggcgaaacctcaaagtgggagtcagaaggttgaaacgctggaggagcgaagggcaacgtcggaggcagacacagcgccggaggatgagaacgacatgcaaggaccgacagcaagcacctccttccagttattatccaatggtcgcatcacaaccagcgaaccactggacaataacctggactgggggatagaggacgagagtcgttgcagggtcagcagggaaagctacggggcaaccaaaagtcaaatgggaatgtacggtgaggccagagcagcagtgaccaggtgcgattcaggggcagaacggattatcggggccataactcctgtcgggaaggggaaagcaaagcatgaacaaggaaataagaaggcaggagg

SEQ ID NO: 111972 - DNA, 354 bp, Glycine max
  Peptide Sequence Number=SeqID_228750
atgcataagtgccctaggtgtaggatatcatggtacaaagtgaaggatgatgatgagtgtagtagtgatgaaagcaccaagaaaggccccctagcgatgctattatggtatcttccaatcatgtcaaggttcaagcgtctgtttgctaatacagatgacacaaaagaccttacatggcatgcatatgggagaaattgtgatggaatgttctaccatctggctgattcctctcaatggaagaagattaatagtctatatctggattttggaaaaaaggaaaaaaatctttggcttggacttaccagtgatggaatgaatctctatggtagtttaagctctcagcacagttcatga

SEQ ID NO: 111973 - DNA, 420 bp, Glycine max
  Peptide Sequence Number=SeqID_228751
atgtggtaccattcatcaaggatattgcctaagcatgtccacatgacactttcacttaagaaagctaggcagcaagtgtcgaggtcttgtgcacaggcaactccccccccccccatggtgatcagcctaagtctcaagggagtttcaaagcttagaagtcaagattgcctcagagaagctacgaaagaaaggattgagggatttttcttcatcgaatccttgaagtggattatgaggattccgcttcaattaaaatgttcctctcagtgtggtggttcggcagcaagcaatggtgactcgtggtggtcaccagtggttgtgggtggtggaagaggagtttctagggtgatctcgcttagagagctcgtctcgctaagcagaagtccacttttggtactaagcgtgaattttcatgcttag

SEQ ID NO: 111974 - DNA, 1102 bp, Glycine max
  Peptide Sequence Number=SeqID_228752
ttgctggagagtaaaaaccgtgaaggactgggatttgcttcttctgcaggatccgcaacgaacagtgttggatcaagctccattactagcaccttttgtagcgccgggttcatcaacaactcgccagaagccaatgctgtcttggaagatgctcctgaagagatagtgcttgcatttgtcacacctggaaaacttgttcgcaactgggacgcggttgacatcccttcagtggttcatgcatcaaaactaggcatttatgagcccgttgaacataataaccctgcactctctcccaactacgaatctcctgtctacgaggctgaagaggaggaggatgatgaaatcccggaggaacttgctcggttattggaatatgaaaagaaaaccattcagcctcatgaggagttagtagaggtgattaacttgggaaccgaggaagataagaaggaagtcaagattggggcatcgcttgaggcaactgtcaaacgaaagggatatgcccggcttggatcccgtattgtggagcaccgtttgcctttgaagcccgaatgcccaccggtcaagcagaaattgagaagaactcgccctgacatggctctcaagatcaaagaggaagtacagaagcagatcgatgcaggttttcttgtcacatcagagtatcctcaatggttagccaacatagtgcctgttccaaagagggacggcaaggtcaggatgtgcgtcgactaccgagatttgaacaaggctagtccgaaagatgactttcctctacctcacatcgatgtattggttgacagcgctgcaaagtccaaggtcttctccttcatggacggtttctctggggtaatgccctttgggttgataaatgcaggtgccacttaccaaagaggcatgaccactctctttcatgacatgatgcacaaagagatagaagtgtacgtggatgatatgattgtcaagtcaggcactgaagaagaacatgtcgagtacttgctgaagatgtttcaacggctgagaaagtaccaacttcgactgaatcccaacaaatgtacctttggtgttagatctggaaaactcttaggtttcattgtcagtcagaaag

SEQ ID NO: 111975 - DNA, 410 bp, Glycine max
  Peptide Sequence Number=SeqID_228753
gaacgaggataagggctacgtgggagtacatgagctcagttggaggtgggcaacaggggatggtgggttatacatgatttgtggatgcggagaatcgttttgcaccatcgcccgaccgccacctagtaccacatgtgatggagtggtacctggagatatgtcgcgggggtcaggagaccttggggatgtcaggcaagctcctggcaatcaacagataaaaggaacaaagaccacaaagcaagaaggcttgtgtggtggctggccagctgaagctaagatggtctctggtaatcgattaccaagggagtgtaatcgattaccaggcttgaaaacgaggcagcaggttttggaggcctctggtaatcgattaccaggctgtgtaatcgattacacagaggaacatgccactg

SEQ ID NO: 111976 - DNA, 234 bp, Glycine max
  Peptide Sequence Number=SeqID_228754
atgccacttcttctctgtaaacaattcattgtagcagcgctaagagtgctatcctgcactaagccccaagaggcgctaagcgccaatctcttacggtttttgaactcttggaagtacgctaagcgcgcctattgcgctaagcctgaactactctctaaagcgctaagcgcagcttgctgcgctaagccccagatgttcactgtaccttacaacttcaagttgggcttagcgtga

SEQ ID NO: 111977 - DNA, 165 bp, Glycine max
  Peptide Sequence Number=SeqID_228755
atgggtttcattgtttttctaatctcgtccctagcagaatgtgaaagattaccttttgatttaccggaagcggaagaagaactagtagcgggttatcaaaccgaatactcggttctttactttggtggttcaaatatctctattccatacatattcgttttctga

SEQ ID NO: 111978 - DNA, 252 bp, Glycine max
  Peptide Sequence Number=SeqID_228756
atgggaaaagaggaccgaaacatgccactgaaagactctactgagacaaagacgggctgtcaagaacgtagaggagaggatcaagctggcccttgcgaacagcttgatgcactatctcccttcaaccctttgagcgaaatgtggcaaaaggaaaaagaatccatggaccgaccccatcgtctccaccccgtaggaactacgagatcaccccaaggacgccttcggcatccaggggtcgcggaccgaccatag

SEQ ID NO: 111979 - DNA, 705 bp, Glycine max
  Peptide Sequence Number=SeqID_228757
atgtcaagcacctcacaaggaccaaagaaaggtcgcatgtcatcaagcaaagttagctggggtgcaaaatgctatggacttcaccaaagtcttccttcagagaagtttgatgattttggaggagaacaaacatcgataccaagagactatgtgcaaggtggtgtcctaggaagtagaggctgccaagtggagggctactgctcgcacggtttggagataggagcgccccaaggtagagtcttggccaagttgctatgcataaggttggatggtgatgaactgtttgcacgccacaaggggttgcaagaagagaaaacggatttggctggcaaggtggaacacattgcgacagagagggacgagcttgccaaggtggttgctgatttagaggccctagtgaaagagtcagagtctaggctggaggagttcgagctatgggtggccaagaagagggaggtctacaaagagcttgaagaggagctgacaatgtataagaaggaggttatggagcagcatgaaaagggctttcaaaaggccgtcaggcaggctgggttctttgccaaggaccttgacttgggtctttttgacctattcaaggaagtgaatgacggtgttttgcttgacgaggaagaaatttctacgaaggaggagactactgatgaggagaagggtgctgaggagcaaggcaatgacgcccaagtttag

SEQ ID NO: 111980 - DNA, 285 bp, Glycine max
  Peptide Sequence Number=SeqID_228758
atggcagtaggaaacgatgtatgcatgattcatgattttgagggggagttgtatgaatatgattttgagggggagactgctgctgaggatgaatgttgtaagctactagaagatgctgcaggggagcagaagcagaaagctgatgtcacgagagatgtcttgacatcctggagaagacttgtagatttgcaacttgaagaatttccgctgtgcttgattactctgataatggaagttgctgatcccacttgcataactgctcgtacctgctcaggaagtgtctaa

SEQ ID NO: 111981 - DNA, 462 bp, Glycine max
  Peptide Sequence Number=SeqID_228759
atggaacgaatgttccctcctaagaagccttcaactatgaattcccatgacaggtccatgtgtgtgcaaggggactcagggcttgtcctcaccactgacccaaagccacgcctccgttggactgttgaactacatgaacgctttgttgatgctgttgctcagcttggaggacctgataaggccactcctaaaacaatcatgagggttatgggagtgaagggtctcaccctttaccaccttaagagccaccttcagaaattcaggcttggaaagcagccccacaaggatttcaatgaccactcgattaaggatggcatgagaggttttatctttacagttcatgaagttcttctacatatattcattgcatcttttatcctggcagcttcggctttagaacttcaaagaaatatcggctcctcttctgccatgattggccgcaacatgaacgagtatgcttag

SEQ ID NO: 111982 - DNA, 267 bp, Glycine max
  Peptide Sequence Number=SeqID_228760
atgttcacccctctagctcttataatcacagcaatattctcagcacttgtggaaagaaacactttacttgggaaggttcaaattctactctatcaatctcaaaacaagcacaaaattgttggtggcactgttttactagtggttggactctacaatgtcctttgggagaagagcaaggagagtgtaaaggagggtgtaaaaggtgataacctagaagttgaagaaacaaaagaggaaaccagattggagtgcattgtacaacactga

SEQ ID NO: 111983 - DNA, 366 bp, Glycine max
  Peptide Sequence Number=SeqID_228761
atggctacgtcaagatggaaagggtggtggatagcattgacttggatcatatggaagcacagaaataatatagttttctccaatagcagtttcaacgcaaacagaatgatggaggagccactgtttttggtatggacttggatgaaacacttagagaaggatttcaacactcactataatcaatggtcttcaaatcttacacaaggttctgttatgagccccatcctggggtggaccaaacagctggctgaatttagatacagcagatttgtaatctcaatcccgaaccttttagtgcctctggggtataggccttgggaagaaaacaaggattttgctcctcttaataagggtgcaaaaatttga

SEQ ID NO: 111984 - DNA, 141 bp, Glycine max
  Peptide Sequence Number=SeqID_228762
atggggggtcaaaccaagcacatgtttttaagagaaggttttcatcaagtcaaggtcaagtatggaagtaaccagcttgcaaaagttgaggcagaagatgaatcgagttacatcgcttctttgtctactgccaacacatga

SEQ ID NO: 111985 - DNA, 579 bp, Glycine max
  Peptide Sequence Number=SeqID_228763
atgactaatgcaaactctctgcaagaatcattgcattccgtctcaaacgggaatctaagggtgtgtgtgtgtgtgtgtgtgtgtgatgagggtgtgtgtgtggatgtgattagggttcatcggtgtgtgtctgtcatgagggtgtgtgtgtgtgtgtctatgtcattagggcttgtctgtgtgtctgcgtgtctcattaggggagggtgtgtgtgtgtgtctatgatgaggaaggcaccagaggtaacacagcaaggccaggtttcgcgcagttgcgctgtttactatcttggtgttgtcataattgagatactgacagcgaggttcccttctcagtatgtcagcaatggaaagggtggggctgatgtggtgcaatcggtggaaactgcaatctctgagggaagggaatcaaaagtgcttgatcctaagattgcaggctctaggaattggcttgtatcaatggagcaactcctccacattggtgctgcttgcactaaaagcaaccctcaacagcggttagacatggtggaagccattagaaggataatggagattaaattcgagtgtggtcatgaataa

SEQ ID NO: 111986 - DNA, 666 bp, Glycine max
  Peptide Sequence Number=SeqID_228764
atgtgcttccctaagcctggatttggggtccatgatcttactctttttgatgtttctggcgttcacgacttgcccggttactttccccatgacgatgatagaggagggctccgagtaattagagatactgaatcccttgatgcatcttatgagcgttacctccgtagtgcgcaagtttcatcatatggttcgggacagtctactagaaccattagtgggagaattcccaatcgtgctattgatgattcacatgttgcaaatattgggggaatagacagaggaacaaatgcaaaagacaaaatgctgggattaagtagtggaaggactgaccattctcttccacctgatgctaccagtacactgtttgtggagggcttgcctcccaactgtacaagacgggaagtagctcgtatcctttcatctgtcatctgctttgtcctccttaacttggaggtgcagatatttttcgaccttttgttggctacaaagaagtcagacttgttagcaaggaatcgagacaactggtttggctctgatgaaaatgatactcaagcttggaaaggttacaaatttgatgagcttgaccgcaactctgtcaatttaaggtttcaatttgctcgctatcctggtgcaaggtcaggtggcgtgcatcgtggcaagcgttga

SEQ ID NO: 111987 - DNA, 207 bp, Glycine max
  Peptide Sequence Number=SeqID_228765
atgaaagcacaaaagcaaaaggcacgaaacacttacgttgacggagaagcaccaacaaagaagaagaacgaaagcaccaccacgacgccatcaataatggtgaacaacagcaccaccacttcgccagaagcaacaacacccagtggtcgtagaagcagcaaagcgcaagagaagacgagaggatcgcagaagaagaagacaaactaa

SEQ ID NO: 111988 - DNA, 219 bp, Glycine max
  Peptide Sequence Number=SeqID_228766
atggcattgatgcaagcaactttgatattattggcagtaaagcaatgtaccagatttaagccttcaagtttaaggagtggattcagacctctcgagagtataaatatcagaaatctattgcctcctaggggcttctccttagggagtgtgtatcccggtgttggtgacttgatggggtcatggggagctatggaggtagagcagcaggggtttgtgtag

SEQ ID NO: 111989 - DNA, 729 bp, Glycine max
  Peptide Sequence Number=SeqID_228767
atggtgatttacatgtcagtttcttccagattttcaggtgaagatgtatctgcacagaaccaagtgaaggcatctgttcaacgaaaaatacggcaaagtattgctgaagagtatccgggtcttgaacctgtgttggatgatatacttcccaagaagtcccctctaatagttgctaaatgtcagaaccatctcaatctggttcttgtgaacaacgtgccactgtttttcagtgtccgtgatggaccatacatgcccaccttgcgtcttctccatctatatccaaatataatgaaaaagttacaagttgaccgtggtgcaattagatttgtcttggcgggtgcaaacataatgtgtcctggtcttacatctcctgggggtgttttggatgaggaagtaggggcagaatgtcctgtggccatcatggctgaaggaaaacagcatgctcttgctattggctttacaaaaatgtcagcaaaagacatattgcagcatacaacaaagtcgccccttagcacaataccctcatctgctgtagacgaacaccaacaagcatccccgttgctgttccccatgcactgtcatcaactgtgccatacaaccaaaactactcttcttttagatgcacctgatcacaagcctgagacagctgcatttcaagctcctcacactcagtaccatccagcttgtaaccttacaaaacaactcagcaatgctgctctctgcttttaa

SEQ ID NO: 111990 - DNA, 179 bp, Glycine max
  Peptide Sequence Number=SeqID_228768
ttttgcagtatgaagctaaggatgatacagaagctaaactcgatctgcatgtaccttgcaatagtgattatcaatgccctggctgtccttgcatagattatcagtgtatatgtgatctggagaaggaagaagaacagaagccagtgtctattgcacctgtcaaagaagaatttccatga

SEQ ID NO: 111991 - DNA, 6396 bp, Glycine max
  Peptide Sequence Number=SeqID_228769
atggaggagttgctgctttacgagacgcgtcatcacgcctccaatcaccctcctcaacaccaccaaaaccaacaacaacagcaacaacaggaaaacgagagtgccaagggttccttgctgtccctgctttcttctcgaggcgtgagccaactgaaggaaaaatggagcgaatataatcaaccgaagagacttagaagattggtttcgctttttgtttccgccacagccaaacacgtcgcagttgccgcgggaaatcggattacgtttctcagtaaagaggatgactatcaaaacccacgcgccattttcaccacaattggttcgttaggttctagctttggaacgtttagtgtaggagcttggtctgaaaatgaggacgttcttggagttgctgatgattctgatacactctattttatcaaattcagtggcgaagttgtggccgaaatctcgaagaaacatttgaaagtctctactccaatcgttgccctattttctgatatcgatttggatacacacgagtcttacttgttctctattgttacatcagatggctcacttcaacgaattgagatcagtcatggacagagtggctctacttttcccaatcacacgagtcgtattagcaacaatattttctgctttgaccgccatagtgaacttaacctttttgtggctgttcacaagaattccgtcggttatgtggagggtagtcctatcattagagcaagagggagaataagaaaaactacaggcaaaactattaaggatttagagttagagccaaaaggttacagtggtcatctgacatatccaaaggtgctaatctcaccagaagctacattcgttgctactctggatttgacagggtgcttgcatatttttaagctagacaaagaaggctttacactctcccggtttgtcttgggagagagaaatgattctccaatgtctgataatttatcaaagggagggaacaaatcttttgtgggttttatggattttacttggtggtgtgaccatatccttgccattatagataggggtggcgtggttatgttgattgacatccttaatggttctaaagttccggaagatggtcctgcatattttttacctattctggaaagagcgccgaaatacaagggctatatttttcttttagcgagtcaatcatccatagaaagatataatccgtctgatattggatcgacagaagagttgcatcagccagagtggataattgaagatagacttaatcaatttcacctttctagattgctctggaatcttgtttcatttactgagaaatctgtccctgaaatgtatggtatactgattagcaagaaaaaatatcaggctgctctggattttgctgatagtcatggattggataaagacaaagttctgaagtcacagtggttgaattctagccatggagtaaatgaaataaatatttttttatcaaatattaaggatagagattttgtactttctgaatgtgttgatagaattggacccacggaagatgctgtgaaggctttactggcttatggtctacacattactgaccatcatagattctcagaagtagatgatgataattctagtcatgtatgggattgccgattagccagacttcaaatcttgcaatttagagacaggctggaaacatatcttggaataaacatgggcaggttttctgtgcaggaatatagcaaattccgcattatgcctattaatgaagctgctgtagcacttgctgaaagtggaaaaattggtgcgctaaatttgctcttcaagcgtcatccgtattctttgtctccatatatgttggaaattttaactgccatcccagaaacagttcccgtacaaatgtatgggcagcttcttcctgggaggtctcctccgtctggtgttgctgtgaggcaagatgattgggttgaatgtgagaagatggtttacttcatcaatgcatcagttgaaaaacatgacatgctaatccaagtcaaaactgaacctcttgttaagcatttccttggatttccttggccatcaattgatgagctctcaaattggtatacaaatagagctaaagctatggatgattttagtgggcagctggataattgcctcagtctactggagtttgctcttcgcaaaggcatatctgagttacagccgtttcatcgggatgtcttatacttacatcaaattatttattccaatgatgatgatagtgaaatgagcttcaacatgagtcttgccatgtggggagaattttcaaactatgaaaaatttaaatttatgctaaagggagtcaaagaggaaaatgtaactgaaagattacacaatagagccattccttttatgcgtgaaaagtttcacaaggaaacttctttggagaataaattggacatatgcttggtggtaattgaagaagggtgcagaaacttccaaagtaatgactatttcaaaactgaggttgaagctgttgattgtgctttgcaatgcatatacttgtcaacagttaccgataggtggagtattatggcttccatactatctaaacttcctcaactacatgatggtgcaattcaagttgaggatcttgagagaagacttagaattgctgaaggtcacattgaggcagggaggcttttggcattttaccaggtcccaaagccattaaactttttcctaggggctcaattggatgaaaaggctgttaaacagattatacgtcttattctttccaaatttattcgccgtcagcctagtcggtcagatagtgaatgggccagcatgtggcgagatatgcagtacttgagggaaaaggcatttccttttctggacccagagtatattttgactgaattttgcagaggactgcttaaagctgggaagttttctcttgcacgaaactacttgaagggtacaagttcagttgctttggcatctgagaaggctgaaaaccttgtcattcaagcagctagggagtactttttctcagcttcaagcctttcttgctctgaagctagagaatgtcttaatctatatccgagtagtggaaatgtgaaggcagaggcagatattattgatgcacttacagttaaacttccaaaccttggggtgaatattctgcccttgcaattcaggcaaataaaggatcctatggaaattataaaaatagcaatcacaaatcaaactggagcatattttcatgttgatgaacttattgaggttgccagacttcttggcttgagatctgctgatgacatatcagctgttgaggaagctattgctagagaagcagcagtttctggtgatttacaattggcatttgatctttgtcttggtttggcccgaaaaggacatggtaacatatgggatttatgtgctgcaattgcaagaggtcccgcccttgataacatggatgtggactctcgaaagcagctattagggtttgctttaagccactgtgatgaggaatctattggtgagcttctccatgcatggaaagatctagatatgcaaggccagtgtgaaacattgatgatatcaacagggacaaatccttccaaattttcagttcaaggctcatctgtaaactctcttccaaagcaaagttttcaaaatatattagatgaaagtggttgctttcaggagtttgatagtattagtgctgacaatgaagatgttcatcttgagaaaactagagatatgctttcgatcgttgcaaaaaccttggctattggggatcgaactgattgggcatcgatcttgactgaaaatgggaaagttctgtcttttgctgctttacagctcccttggttgcttgaattaagtaggaaaggagaacatcataagaaatttagtaccggaaagctgtatctaaacatcagaacacaggctgtggtaaccattttgtcctggttggccagaaatggatttgctcccagagacaatctgattgcctctctagcaaaatcaattatggaaccaccagtcactgaagaggaagatataatgggctgttcctatcttctgaatcttgtggatgcctttaatggggtagaaattatagaagaacagctcaaaatgagaaaagactatcaagaaatttgtagcatcatgagtgttgggatggcatacagcttgctacacaattctagaatagggactgatccttctcaacggaaggagctattgaagaggaggtttaaggaaaaacatgcatcacccagttctgatgatatagataaacttggcaaggtacagtcctcattttggagagagtggaaactgaagttagaggagcaaaagcgtctcactgagcattctagagcactagagaaaataattcctggggttgaaacagagcgctttttgtccagggattccatctatattgagaatgttgttatctctctcattgagtcagtaaagttagaaaaaaagcacattttgaaggacattttaaaattggctgacacttatgacttgaactgtactgagctcattggtgatgttgtgaaagctatattcttggctgtgctatggtttcacttgaaggtgttattgcgttacctaagcgctgtccttgtttctgatgtttggaccaatgatgatattacagctgaagttgcaggctataaaggagaaataattggtaatagtgtgaaaaccattgaaaccatctcaacaattgtataccctgcaattgatgggtgcaacaaaattcgccttgcttatgtgtatgggttgttatcggagtgctacttgcagctggaaactaccaaagatttgtcatcaatagtgcaggctgatcatgtgaatgccaatctaagcttagctcaatattacaaggtcattgagcaagaatgcaaaaacgtgtcctttatcaataacctgaacttcaaaaatattgctgggttacatggtttgaactttgagtgcattagtgatgaagtttatgcatgtattgaggaaagtagcttgtcagctttgtcaaaaatggtacagactcttgtcaatatgtatggtgattcattgcctattgatttcttgtcatggcaggatatctacaagtattacatcctaagtttgcttagagctttggagactaaagttactactgattctggcattagaactcctgaataccttcaaggctttataaataagcttgaacagagttatgatttgtgcagagtgtatattaggcttttgagccagtctgatgctttggggatcatgaagcagtacattgcagtaaccatgcctctctatagttcatatggactcctacctgacaattcaacgtggcaagagtgccttattgttcttctgaacttttggatgagattggcagatgatatgaaggaaattgcattggaggaaaattcagcagaaactagtagcttcaatccacaatgtttaatgagttgtctgaaggtttttatgaaattggtgatggaagatatcatctcccctaatcagggctggggcagcatatatggttatgtcaattgcggcttaaatggtgattcttctgcagaaactataaatttctgcaaagctatgattttttctggttgtgggtttggtgctgttgcagaggttttttctgttgcatcatcagaaactggttcagcttctgatcatggcacttgttgtcaggatcttcctcatttctatttagatattctagaagctgttttgacagaattgatcaatggatcccatgagagccagaacctgtatcatatactgtcttctttaagcaagctagaaggtgacttaaaagttatgcaatgtgttagacatgtaatttgggaaagaatggtccagttctctgacaatttgcagttgccaagttctgtcagagtttttgtgctagagcttatgcaatttatctcaggtaaaaatattaagggtttctctacagaaatactagccaatgttcaaccatgggaagaatggaatgaattgatttatgctagtagaaagagtgagactgatgttgacaagcagttgccagatcacaaagactcttctagtagagttacgaatactttggttgctcttaaatcatctcagcttgtggcgtcaatctctcctagcatagaaattacccttgatgatctattgaatgcagacacggctgtgtcttgctttatgaggttgtgtggagaagctactgaagatctccaccttgatgctctgctggctattttggaagagtgggatggacttttcactgcagggaaagatgaagaaaccactgttgaaacatctgatggaggaaatgactggaacaatgatgattgggacgagggatgggaaagccttgaggaagtagacaatcctgagaaagagaagatagaagaccct

SEQ ID NO: 111992 - DNA, 237 bp, Glycine max
  Peptide Sequence Number=SeqID_228770
atggagagggaaaacgaagcacattcatggagtttggagataaaaatcgaaaattttttagataaaaataatagctttaaaagaaacaatgaacatgctatgaaaaaaatcgacaaaaaaacacatagagagggaaaacgaagcataacctttgagtttttcgttcggcatctccgtcattttcgtccagcatttggagaacaacagcaccaagacatcgtcttcgaacgatggtag

SEQ ID NO: 111993 - DNA, 309 bp, Glycine max
  Peptide Sequence Number=SeqID_228771
atggcttcgcttagtacacttcgcgtttttgttgctgatttcgaagacgaggaagcagaacaccccatctacattcttgcagccgttgaacccctttccgctgccagcaaactcctcgttgtcgctggaagcactacgccatcctcctctacaccaccactaatattcgccaaccgcaagaggaatccattcattggcgaagttgctggatttcaacatcagaacactgggaggcgccaccccgaacacggtgccaacgaggttgatatgaacatgcacgtttctcacaaaaagcccaaaagcatgtga

SEQ ID NO: 111994 - DNA, 1305 bp, Glycine max
  Peptide Sequence Number=SeqID_228772
atgtggttgatgaagccacaagcccgcaattgcggtgacaaacatcccaaaagcgtcaaggctgaaatcacggcggagtttgatatgaagaatgtgtttcttcacataaagttgatggagcaagcttcagagagtgaccagccagcgattttaattcaagaggaatgtgatggtgagattcaggggtctgctttgaggctcacgtttgcttgcaactctccgatttcgtggcctgcaatgtcgggtgcgttggatagttcctccatttgctgcaagaggatgcagatctttgagaagaagggtttcaccttgggggttgtgcttcttgtggttctacctgggcatgataagttggtgaggaccagggttgaaaatgctttgaagtttgccatgaagaagcccaaaaccggtgccgtgaagcttccctttgggctctgtgggtgccaggaagagaattctaaaggaagagagcttgtggagattgaagaagaaaccggtgatggttaccgcggaaaggagtttgagaattcaagccaaaggattcagcttcaggtgcctttgccttcttcatcttttgttgtgtcagtggatgaatggcagaccataaagtcaggtgggaatgagattgagaaatggttgttgaattcagatagtgttgagtttgttgagcagattggtccgaattcatataggggagtgtatatggggaagagggttgggattgagaagctgaagggttgtgataaagggaattcttatgagtttgagctccacaaggatcttctggaactcatgacttgtggccatagaaacattctgcagttttgtggtatttgtgtggatgataatcatggattgtgtgtggtgaccaagttcatggaaggtggatctgttcatgacttgatgatgaagaacaaaaagcttcagactaaggatgttgtgaggattgctgttgatgttgctgaagggatcaagtttatgaatgaccatggtgtagcatatagagaccttaatacacgggggattctgttggataagcatgggaatgcttgcttgggagatatgggtatagtcactgcctgcaagagtgttggagaagcaatggagtatgaaactgatggttataggtggctagctccagagctgctgttccagaaaaatcttttgacattaattttagaactttaccaatttaccagcactgtagcacctggtattcaaacattggctcaagccattttctctaccccttcttaccctgaaaaagcagtttatgtcttgcagtcaactaatgaaatttcttaa

SEQ ID NO: 111995 - DNA, 153 bp, Glycine max
  Peptide Sequence Number=SeqID_228773
atggtgggggatgaaatattggctgccaataacatggaggtaaagggaaaatcagcatttgaagtatcatccttgttgcaaggccctaatggaacatctgtgactattcaggttttggattctatttccaagttagtttggcacctgctctag

SEQ ID NO: 111996 - DNA, 1008 bp, Glycine max
  Peptide Sequence Number=SeqID_228774
atgggtcctaggagtcagggtttcaagcgaattgagccatatcttgctgtgaagaagaagatcgagaaacatagggagagggtgctccgatgtgatagcctgctacagaaaaatcagtttgttaagccagtgccatcttctattctgaagaagtgttctaaaaaccgtaatgtggcctctaaatccaatttgaaagtggccaatcaagatggtgataaggatgattctgccatgtttgatctatgggatgataaaggcaaggatgacaagaaggtgaaaaaggtagcaaagcctactcttatcccagcagtagagattgatcccccaggctgctctttcaatccctcatatgaaagtcaccaggatacattggcttctgccgttgcagaagtaatgcaaaaaatctacaaaaatgaactgggccctgaacccgtgcctttaactgttcctggagaagctatcgccgaagaagatatgtattttcttgatgtggacaataggagtgacaacgatgaaagtactcctgaaaatgaggatgatgatgcattggagaaaaagcctattaaaactaagagagttactagagttgaattgaataagagagctaggcggaaagaacaacagagaaaagaagcagaagctaagaagataaaggaattgtctaaggaaattgatagcataccagaaattgttcaggaaattgagcatgaagacgaggaaaagaagaaaagacaccttaggcgtcaagttgctaaacaggagatgttaaagacacgcccaccacgcttaggaaaacacaagtttgaacctgcacctgttcaagttttattaagtgaagagataactggatccattcggaagctcaaggtaggcttgtgtttctcttgctatgattttggttggtgtctcttttacgaaacacgtaacggttgctgcacccttataaaggaccgatataaaagcatagaaaaaagaggattgattgttccagcaaaaaggaggaattag

SEQ ID NO: 111997 - DNA, 251 bp, Glycine max
  Peptide Sequence Number=SeqID_228775
atgggtgaccaagaggaagtacaggaacagatgaaagccgacatgtcggctttgaaagagcaaatggcttccataatgaatgccatgctaggaatgagacaactaatggagagtaacatggcaactgccgccgctgttagttcggctgccgaagcagacccaactctcccagctaccatgcaccaccctatcccgaacatggtgggacgagaaagaagcacactggggcacattaggcaaccccatccggg

SEQ ID NO: 111998 - DNA, 695 bp, Glycine max
  Peptide Sequence Number=SeqID_228776
atgaggctggttaaaaatataaaaaatgacaactggaccagtaattatacctattatgacagcaaaggaagagtggtaggaacttataccgttaatcatctgggaggatataccaaaacggaaactttactagactttgcaggtactccacagaaggcgattacaactcatatgagaaaaccgggtgaagcaagtgttaccatcaatgagcgttttgtttatgataatggaaacaggctaaaacaacattatcatcaggttgatagcaacccggaagaattattaacggacaatacctataatgaactttcccagttaagcaataaaaaagtaggaaacaatctccaaagtattgactacaattacaatatcaggggttggctgacagatattaataaaaaccagatgtctgtggctaatttaggcgggaaactttttgcttacagaatcaaatacaatcagaaagaaggaattacaaatccggacccagtcttattctccggaaaaaatgttgaggcaaaatacaatgggaatatcgcagaagtagattggagggcagtggaaacaatcggagccaatccttctcttactcctaagagatatggatatgtttatgataagctgaacagattaacagcaggatattatcaaaacccaaataattccaacagcaaagaaaatacagaatctttaac

SEQ ID NO: 111999 - DNA, 348 bp, Glycine max
  Peptide Sequence Number=SeqID_228777
atggcatacccaccaactataatagatatcccaacttcaaaaggtaaccaatttagagaagcttgtgatccttcgtggttccttcaaggagactttccactttccagagctgaaagtattacctttggagtcccttggaaagctggcttccaatggttcagagaattcttggaagtattcatctgttttagttcaataaatttggtaccatgcagtgtgtctttctccaatttgacatatttcgaagtagatagttgcaagaacatgctatatttgttcacatcctcaacagccataagtttgactcagcttaaaacaatgaaaggtaagatgctgcaattcaattga

SEQ ID NO: 112000 - DNA, 192 bp, Glycine max
  Peptide Sequence Number=SeqID_228778
atgtatgtatcttttcttgtcatccatgtgaaggacttggaaattgtagggtgggtagtgattcaaaaagtgatgcaatcctacactccaagggcattggatagaagactccaagaagattgggccagagatataagagaaggccctaggattctcatcagccttaaggtagattttgggcccatgggctaa

SEQ ID NO: 112001 - DNA, 339 bp, Glycine max
  Peptide Sequence Number=SeqID_228779
atgtccaattttggatataatatatcgagacgctcaaaattgaacattgaaagctctcgagaaattcaaatggtcataacttttaactcagatgtccgattcggggataaaatgtctgatttagggataaaatatatcgagatgctcgaaattgaacaacggaagccctcgacaaattcaaagcgtcataacttttcactcggatgtccgattcaggcgcataacatatctagacgctcaaaattgaacatcggaagctctcgagaaatacaaatggtcattacttttcactcagatgtccgatttaggcgcatcacatatcgagacgctgaaaattaa

SEQ ID NO: 112002 - DNA, 213 bp, Glycine max
  Peptide Sequence Number=SeqID_228780
atggcaatggggcgagacagagacgggtattatctccccaatccccgatcccgactccccaacatgtccccatacccatacccgattaccggcgggttaaaatttattatcccattctcatatctgtccgtcttcctcctccaatgtgtgcatcttgttaaagtgcctacaatgcctgccttaatatctggtccacatcgtcataagtgttag

SEQ ID NO: 112003 - DNA, 1113 bp, Glycine max
  Peptide Sequence Number=SeqID_228781
atggtccctccccctggtgtcaatggttcacatccatctcaatgttgcaaactccttaagtctttgtatggcctcaaacaagccaatcgagcatgtaattttgtcgatgagttgacacatattaagcaagttctacactttcattttcgcatcaaagatcttgacaccttaaaatacttcttgggtttagaagtagcatactcagttgctggaattctctgtcaacgaaaatattgcccagatttagtcactaatttcggagtattaggttcgaaaccaatctccacactcatggacaacactcttcgtcttcaccaagactctggtcctttgttacttgatccattaccttataaacgcttgattggccgccttatctacctcaccaacactcgtccacacattgccttcaccacacaacaacttagtcaattcatgtctctaccaccaactcagacacatctctgtgctgctactcgtgttctcaaatacctcaaaggatgtccaagaaaagggctctcttttagtagagaatctcccattcaaattcttggattcagtgatgccgattgggcaacatgtattgattcaagcaagtcaatcacatggtactgcttctttcttggtagttctctaatctcatggaaagctaagaaacaaaacactgtttcccgctcatcctcatcctctgaagctaagtatagagctctcacctccaccacatgcgaattacagtggcttacttaccttctaaaagatctccatctgccaatcaaagtaatatatcatggacaattggagattgattgccacattgttcgagagaagactcaacaaggattgatgcactgtttactccctgtttcctcctccaatcagttagcagacatcttcactaaagctctctcgcccaaacttttcagcagcaacttatccaagcttgggctatctgacatcttcctacctccagcttgtgtgtgtgtgtggctccgggggagggggggtatcagaaaaacagcaacccacacacaaacaccatgcccaccagacccaacatcagaattgaaccttctagaagtctccagaattttgcatttgcatagctgttggtga

SEQ ID NO: 112004 - DNA, 168 bp, Glycine max
  Peptide Sequence Number=SeqID_228782
atgagtcagcttgttcaccatggaatgatatttgttccggttggatacacgtttggagatgggatgtatgagatgaagaaggtgaaaggtgggtccccatatggcgcaggaactgttgtcggggatggctcaaggcaacctagcattgcaaagaagctcaagggataa

SEQ ID NO: 112005 - DNA, 294 bp, Glycine max
  Peptide Sequence Number=SeqID_228783
atggtggcgcaggaagcaattgaagatctgaaatccatcgtcaccgcgctcaggaagccattgtcaacggagaagaagagtgatgatgttcctattattaaaccccgtgagcttgctgatgctgatggttttctgtttggttttccgacaacatttggatccatggtttctcaatttaaagcatttttagaaggcactataagcctgtggcttacacaggcactagcaggaaaacctgtagggttcttctctagcactagttctcaaggaggtggacaagaagagaccccatga

SEQ ID NO: 112006 - DNA, 1296 bp, Glycine max
  Peptide Sequence Number=SeqID_228784
atgggcatagagattccttgtattgaaagtcttcccgttggtgagtccatgcacagaggacaagttgtgggtcctacaagtgttacagcgagactcacacttgaggagaagattgttggagttcaagtgtatggtgaagtctcgcatcatgagattttgagacagcattgccttcaatatcgtgtttgttgcatcagacagacaaagcaagaggcatttccaaaaatgatcagactcgttagactgtggcactgtcacaagcctttcacgttccccaaacctcaacctcgtatggtagtagaagcatcatcatcgtgtttctccacgcgcgtgggcacacacaacgggaccttccactgcgacgaggccctcgcctgcttcatgcttcgcctctccaaacgcttctccgctgctcacatcgtccgaaccagggaccccaaccttcttcaatccctccacgcactcgtcgacgttggaggcgcgtatgacccaacacgacaccgtttcgatcatcaccaaaaggactttcaccaagtcttcggacacggcttccacactaaactcagcagcgctggccttgtctacaagcattttggattagagataattgcaaatgtgctgaagcttcatgaagaccatcctcatgtacaccagttgtatccagttatatacagaaactttgtggaggcaattgatgctgtggataacggagtcaatctatatgaccttgatgtccctccaaaatatgaaattaacacgaccctggcctctagaataaaacgcttgaatttgaactggatggattcagaccagtcatctgatagagaaaacgaggcttttcatcgagcaatggcgctagcgggtgctgaatttctggagaatgtgaattattatgcaaagtcatggttaccagcacggtcaattgttatggacagtcttgctgcgagggaaagtgttgattcgagtggagaaatcgtaaagctcaaccgatcttgtccttggaaacttcacatacatgagcttgaggaggaaatgaaaatcagtccttctatcaagtatgttctttacccggatgataggagtgagaattggcgactgcaggcagtggcaatttcacctgctaaatttgagagcagaaaaccgttaccatatctttggaggggtttagaaaatgacaacctctctgaggttgccggaatcccaggttgtacttttgtgcacatgagtggttttattggaggaaatagaagttatggcggggctctagccatggcaagagcttctttaaaggcttag

SEQ ID NO: 112007 - DNA, 624 bp, Glycine max
  Peptide Sequence Number=SeqID_228785
atgaagttcaacacgctcgataagctcgttgtgtttgactttgacttctccgtcagcaagcgatctaggtcttcgatcacgatcagagacttcgccgtcgtctgcatcagcatcaccttccaatcggcgccatcggcgcgccgtagaggaggtagctccgcttccaaacgcggcctagccggtggtagtactgcttcgacttcaggaactgcgccactcgccggagtcggagttcacgtacagcttgacgtccttttttcttcgttgctcgatctcgtccgcgacggagagaatgtgctggaagacgagcgcgtcgccggaggcgttggtccaggagagcctggcgccgaggaaggtgtcatgaacggtgtggttagggtcgaggtggaggaagatgtcggagggattggggccggagaagaggttggtgtaatcggaatcttcaacggagggaagagaatcgaggtaagtgaggattttccggtagaggctattgtccagagagtgaagattatagcgagggattttgaaggactggtgaaggtggagacggttttcgaaggaaaggaaccattggttgaggatgtgaagtgcagaggttttgcggaagaagaaaacgattag

SEQ ID NO: 112008 - DNA, 201 bp, Glycine max
  Peptide Sequence Number=SeqID_228786
atggttttcaaggggtcaaatcgttacagcgatagtcatttgttaaaactcctggcggattcgtccagtgaagaacggagcacatcggtattgcaacaagctttgagtggctgggaagacttcagtaggttgcaagttgcaactatgcaacttcctgagcaaagtgattgcctatggttgtgtcaggaagaaattttgtag

SEQ ID NO: 112009 - DNA, 297 bp, Glycine max
  Peptide Sequence Number=SeqID_228787
atgaagtctcgagcaactgggaaattgccccattctatagggaaattcaatagtctgaatgatcttgatctgtcaagcaactcactctcagatcttataccaacatcaacaggaaacttatcaaatctacggtctctgaacttggaaggcaacatgttgaatgggaaaattctagaaagtattgttatactattccagttggaacatctacatctactccaaaacaactgggaagacacgatgacaagaactacaagtaaaaactcgaaaaagttcaagaacaaaaaatatagttaa

SEQ ID NO: 112010 - DNA, 216 bp, Glycine max
  Peptide Sequence Number=SeqID_228788
atgacttgcattggcccaatcccttttgtattcaaaaacaaagatattgtattcaaaacaagaagaacaaaaaaattgaaactcaacagaaataaccaaacacaaaagggagaggggagttgtggcaagaaagtaaagaggcaagaggaagcttacccttccaattcccactcccactctaaaacgcatggctttgttagctacagtgagcaatga

SEQ ID NO: 112011 - DNA, 1095 bp, Glycine max
  Peptide Sequence Number=SeqID_228789
atggctgataatgtagttacctccaccaattcttctacgccctcgctgaaccctactcggataatctgccactctcatagtctccgttgcactgaatccttcatgaaagaaaatgtagttcaggaacttcagcaaatgcagcctgatgaacaaactaaaaataagatgctggacatactgaaaagatttcactcagaagaggaaatggatgaggattattcaactttatctgaggagacaatggaaaaaattttgtctggacaagaaatcagctttgatgatttatcacttgaagaaaagaaacggtttcacagagcaattgcttatggggaactgagcaagatgatcaaaccatgggatccatggtggtcaaagccttctgccagaaacatctgtctcagtaaggaaggaactcagcttgttcaacctcttccagatcaggaattgctagatgatgatattggaagtgatgaactcagcgaagttcctcttgggcctgaaattccgcttcctcctctaagtaggcttagttccaaggagccatcaccccttttaacagttcacctagttgacattctgtatagctactgcttcactcttcgtctctacaatggagattggaagtcagatgccttagggtcagtcatggttgtattgagcgtgtccttggtgttgggtcaaggtgcacagccggagacagtactagaagcactttctcattgcttggagcaggtatgctgtccagtttacagacacatgggaggattgcaatttggtttgggtgtcattgatgatgtgatcagtctgcttggtttgggaactcctgcattggtgtgtgccctttgtgatatgcatcggttgattcaagaaggggaaaaggaggccaaatcagaaagaccgagaaagttgcggacagatgggactagaagtgctattaagctggcagaaaggaggatatatttcatcacgtgttgggttcatgagcagccagaggaagcatggttttctttagcggccattgtaagagcagaaaagacatcagccatggaatttcaacagagcaataaatctgaaaatttgaacaataaggcagag

SEQ ID NO: 112012 - DNA, 1359 bp, Glycine max
  Peptide Sequence Number=SeqID_228790
atgattgatcattcactcaggggcgaggatttgatgaatccaatgggtgctagtactgtaagcaacgaagaactcaaagagatcgagagtctcgggagagaggacattgaagaggctccaattgtgcccgaggatgtgagcagaatagcaccatggataagacagattacacttcggggactagtagctagcttcctgattgggataatttatagtgtgattgtgatgaagctgaacctcacaactgggttagttcccaatctcaatgtttcagctgctctccttggctttgtgttcattagagcttggactaaggttcttgcaaaggccaaaattgtttcgaccccattcactagacaggagaacaccataatccagacttgtgcagtcgcttgctatagcatctcggtaggaggtggtttcgggtcttatctcttgggtttgaataggaggacatatgagcaagcaggagttggtacagaggggaataatcctggtagtaccaaggagcctggaattggatggatgacagcctttctctttgtgaccagctttgttggattgttggcgttggttcccattagaaagattatgataatagactacaaattaacttatccaagtggaactgctactgctgttcttattaacgggttccatactcctaaaggagatgttatggccaagaagcaggttcatggtttcttgaaattcttctcagccagtttcctctgggctttctttcaatggttttattcgggtggtgataactgtggatttgttaagtttcccacttttggattgaaagcatggaaaaattcattttattttgatttcagcatgacttatgtgggagcaggaatgatttgttcccatcttgtaaatttatccttgcttcttggtgctgtgatttcatggggcattatgtggccattaatcaggggactaaaaggggaatggtttcctgcaagcatagcagagagtagcatgaagagtcttaatggttataaggtttttatttccattgctttgattcttggtgatgggctttacaattttgtcaaagtcctctatttcactgccacgaatattcatgccaccgtgaaaaggaagaaccccgaaactttttcagataaccagaaaccactccctcttgatgatcttagacggaatgaagtgtttgctagagaaagcattcctatatggctggcctgtactgggtacatattattctccatcgtttctatcattgtaatccctttgatgttcccccagttgaagtggtactacgtggtgtttgcctatctttttgcgccctctcttagcttctgcaaatgcttacggcgcaggcttaactga

SEQ ID NO: 112013 - DNA, 564 bp, Glycine max
  Peptide Sequence Number=SeqID_228791
atggtcatctgccccctttgtcgaagacttgaatgtctttcgaccgagactattacagtctccctttgccttttagagacaagcgagtccgttggcacacggagacaaattatggtcattcgccacctttgctatctagagacaagcgagtccgataacatgcagagacaaattatgcttatccttcacccttgccaaccagagacaagcgagtctgttggcacgtggagacaaattatggtcatccgacacccttgccaaccagagacaagcgagtctgttggcacgtggagacaaattatggtcatccgccacccttgccaactagagacaagcaagttcattggcacgcggagactattatggtcatccacactcctttgctatccagggacaagcgagtccgatagcatgcggagacaaatatggtcatctgccctctttgttgaagactcgaatgtctttcgaccaagactattacagtccccctttgccttccagagacaagcgagtccgatagcacgtggagacaaattatggtcatccgccacctttgctatctag

SEQ ID NO: 112014 - DNA, 932 bp, Glycine max
  Peptide Sequence Number=SeqID_228792
tcgggctttgggcagagttatcggaagagctttggagagaaaagataatcgtgattcagatgaagctctcaagaggcgaaggcccacagcattcacaccctcaagaagcagttgttgatgcccaaggttttctaggcgggtcgcatgacacctcagttctgactagctatgctgatcatgttgtagtcattgtttggaatggagaggaacatcctaaattgaagttatcttcccatggaaggaaggttcaaaaattcgggaggcctgctgcagagattaaagggttagttgttgtcacaggattaagttctctaatcgtatgttcattagacactagcaatcagggacttatatcggcttttgcggagagcgaggtgactatcaccctcaatgatgtggtctctttgcttaatctgtcaatcacaggcgccttccatagctgcggtctcttcatgttgacgaagagcaaatgtgatttcacatactggactgtagtagctcgagcttatctgttgcatttgctaggttacacactttttgctaacaagagtgcaacacatgtgtctgtgactattcctccacactctccaggttcaagattatgcttagaagatattgacgacagatggatgcacttctctgaataccttgcaccgctcgaggatccagtcaaacatctacctgtcgtgcaagatgacacatatgttgaaccagatattcttcagtacctggtggcggcaacagctatggaggaagcacctgcacatgcacattctcatgtggagcagcctcaacattcagtggaggcttgccaagaaataactgaaagtttagagcagttgctcaacctaaggataatgactaaagacacaaaaatatactatgtaatgaaagactgcataaggatcgctagaggtgtggctgcggattag

SEQ ID NO: 112015 - DNA, 1284 bp, Glycine max
  Peptide Sequence Number=SeqID_228793
atgcgcgccaccattacctcttcgaagcgttatctcctgaagcgactacctcaccacttaatcccaaccctctccttcgcgtcggaaacttggccggctccggcggcgtccgtcgacgatggattcccgtactccgacgtgccgaagcctaagcggagaaactcggagaggaagccgtacgtgacgccgatgaaggctctgatcgagcgggcgaaggcggagagagaagcgcgaaaggcgcagccatgtagggttttggaagagccaccggagaacgggttgttggtgccggaattggtggaagtagctcgtcgcgtttatcaagctcgcggctctctcctcttcgggctgagtcaactcgtccgagtcattcccgttttgcgctgccggctttgtaatgaggtccacattggttatatcggtcatgaaattcgaacatgtactggaccagagagtttttcacggaatgcaatgcatgtttggacaaggggaggtgttcaagatgtggttttcttccctaaatgctttcatctttatgatcgtgttggtaagccaagagttgggcatgatgaaaggttcagcgttcctcgtatacctgccattgttgaactctgtatacaagcaggtctggaccttgaaaaatatcctactaaaaggagaacaaagcctgtatattgtattgaaggaagaattgtagattttgaatcagttgtgaaagaggatgaaactgaaagacaacacttttttgaaaatgacaaaccttttgtgaattcatcctctatgttgacccagcctatagagaaggtccagattttattggagaataacataagccatctggatcagttaagtgatgaagaaaggaacaagttaagggatttaagtaaacatacactggactcatggattgagatgacatcaggtgcaaagaagatcatggagaagtatactgtgaatacttgtggctattgtcctgaggttcaggttggtcccaaagggcataagttgagaatgtgcaaggcttcaaagcatcagtctcgaaatggtttacatgcatggcaagaggcaacattagatgaccttgtcattcccaattatgtctggcatgtagaggatttgaatgggcctgctctgaataacaatctaaagagatattatgggaaggctccagctgtggtggaactctgtgtgcattctggaactcctgttcctgatcaatatagtagcatgatgagattagacgtggtttcccctgatcgagatgaagtcgatcttgtcgcctaa

SEQ ID NO: 112016 - DNA, 195 bp, Glycine max
  Peptide Sequence Number=SeqID_228794
atgggtgaagaacttcccaagagcatggtcagaaagattcagaacctctctgatgaagttagaagaagatggaaagaaacacaaggatgggttggagcaaattgtgcaaccgaacgtgaatgtcatcgtaataactatgcagaactagcatccatgccaaatgtcaatgagagaaatcagaaaaggactaactaa

SEQ ID NO: 112017 - DNA, 369 bp, Glycine max
  Peptide Sequence Number=SeqID_228795
atgtgggttgtggggttgtggctaaggcctccaaggaagcttagaaccaacccgttttgggcatcgactagtagtgatacaactaaaatagagtataataaaagaggaggcagggttcagctgcagtcaatgctgatgccattttcaaaatttgatcacgcagaaaagggtgatgcattatatggtttttatttttgtttcactatgcagttagcaaatgaaaacaatgacgttcaatttgttgactttctagaaagcgagtttttggttggtcaggtggaagacattaaaaagatctcagaatatgtggctcagttaagaagaatgggcagaggacatggtaatacgttaattacttgcgccttataa

SEQ ID NO: 112018 - DNA, 174 bp, Glycine max
  Peptide Sequence Number=SeqID_228796
atggtgggatcttccagttcaccaaagagaagatgcagtgagcagtttagtgcaagagttacaaaccccgtgtatggttgtgttggaatcatatcttacctagaaagtcaagtttctgagttacaaaagcagcttgcggtagctcaggcagagattcttagcatgcaaatgtag

SEQ ID NO: 112019 - DNA, 132 bp, Glycine max
  Peptide Sequence Number=SeqID_228797
atgcccagggcacagaattccacagcacaccatagagcctattttgggaaaagagctctggaggcagcaagaggagcagcttttgcagagatgcctaggtttttgcttaaattctgtatgttcttggtctga

SEQ ID NO: 112020 - DNA, 276 bp, Glycine max
  Peptide Sequence Number=SeqID_228798
atgtggaccaccacgggtacatataatgaattgaaaaagattggtttgagaaaattgggggagaagcttgccacccagctcgcccaggcgagcaaggttgcttcctctagaagcaacagccttttggaggaatcttctggagggcccaagtgggcctggttgctatctgcacccccatttttactaaatacaccccctgccttttttggtgattcttttttcgtaaagttacggaaacttacgaatttcgtaacgatacttgttttctttccgtaa

SEQ ID NO: 112021 - DNA, 1131 bp, Glycine max
  Peptide Sequence Number=SeqID_228799
atgtctggaacttacgatcaagacggcggctacggaggcgcagctagtgctggatatggtcatggtggtcgaggaggcggaggattcggtggtcgaggcggagatcgtggcggacgaagtggcggccgcggtggcggcagtggtagagacggagactggcgttgccctaacccaagttgtgggaatttgaactttgcgagaagggctgaatgtaacaaatgtggtgctccatctccttctggttctaatgaccgtggtggtggcggtggttataatagaggggggcatggtaacagtcgtgggggtagatctggtaattttgatggtggaagaggtaatggctataacggtggtagtaggggtaataacaatagtagtagaagtgggggaggcaatagaggtggttcattcagtggtagtcaaggttttgatgatggtgggtatggccaagttcctccgcctgcagcccaatcttatggcggtgctggtggaaactacccacctgcgtacggttcttatggtggaaattcaaattatgaaacggatgtggttcctccgcctgcaagctatacaggtggacctgcatctggtcctccatcatatgggagtaatgccgtaaccagcggcaacaatgtagctgatgcacgatatggtggtaggtccgggccaccagttggaaatgacagtggttatggtgctggtagtcaaggtggatttggtggagctcccgctgagccccctgctaaggtgaagcaatgtgatgagaattgtggggattcctgtgacaactctagaatctacatatcaaacttaccaccggatgtgactattgaagaattgagagaactttttggaggcattggacaagttggaagaataaaacagaagagggggtataaagaccagtggccttggaacataaagctatacactgatgagaaaggaaacaacaagggtgatggttgtcttgtctacgaagacccttctgcagctcattctgccggcagtttttacaataattatgatttgaggggttacaaaataggtgttgcaatggcagaaaaatctgctccaaaagctccacctgcatataaccatgggtattccattatttatcatttttcacattga

SEQ ID NO: 112022 - DNA, 732 bp, Glycine max
  Peptide Sequence Number=SeqID_228800
atgggatgcacttcgctgcttagaagccccaagaaagaagaacaagaagtgcccgatgccaattctaaccaaccttacacctatgaagatttcaatattttggacgaactcgaaggggtcttgagcaccaaggaagaacaagattcttcgttgccgcaacaaaaatcttctagtagtgaattccattgggatttcatggaatgggaggagtttcaaccccccaatattgaagaggaaggagaagatgaaaatgaagggaaagagaacaggaggagcaaatgcctctttgatgaggaggagcaagagatgaagattgaaaacaataataatattgttgggttttgggaaatggatgatgagaagatggtggctttgaatttgaacttgaactatcaagaggttttggatgcatggtctgaccgaggctctctatgggctgatgattgttctctttcattcgccaccaataatgcctactatatgggagaagtgccggtattggaagaagagagagcaagaagagaagcatgtgttcttaggtacaaagagaagcgccagaacaggttgttctcaaagaagataagataccaagttcggaaattaaacgctgataaaagaccaagaatcaagctttttccgatatttttgtttgtagggtcgctttgtgaagagactctgaagttgctcgagaaagatcccccaaaccaaaaaatatctcccacaaatatctag

SEQ ID NO: 112023 - DNA, 654 bp, Glycine max
  Peptide Sequence Number=SeqID_228801
atggaaaaaggaaggtggaagctgaattttgacagtgattttggggactacgcgaacacaattgtggtcgcattagcagcatttgtctcgcaattttttcgctatgttaaaaatgtgtctgatttatatctcattctgttttctttgatttctaatattgaaccctgtgatcagttcagttacttatcagcctatattcagtttcctgcatctagtcagatgatagggaaaaaaatcattcaatctgaaatatctactgatgcatataggaatgctattgagtttgagaagaagacacatgctagtaaccttgagcacagacggactatggataataatatgattattatggaccacgaggttgaaaagttacgtgctgagttggccaatgaagaaaaaagggctagggctgcgatggctgctgatacaaaaccaagtcctggatatcctgctaactatgacaatcctgagatgggatatggaggaaccacatgccctcctgattcttatagcacgcatcagatgcaagctgtggttgacacacattctccacatgaagctggagcaccattacatcatccgaatgacctgcaacatacacaagtgcctagaaacttattcaataatagggcatatagttttgctgatatatga

SEQ ID NO: 112024 - DNA, 321 bp, Glycine max
  Peptide Sequence Number=SeqID_228802
atgtctgagtcattgcacgagctgaatctgcagttagactcagagatttttgttctggatggcatgtcgttcgcaaccgatgttaaagaggcaacagttgacgacggaggaactcatcagattacccggcaagtcatgaactacatccatcatatttgcacatcttttgggaacactgtccaagaatacaccatggttcctggtagagagggaaattcttcattttctgtgcagatagccaagatgataaagttgttaaagagcattttggaagccaagtccagagactacgctgaccctgtattgggctatgttttatga

SEQ ID NO: 112025 - DNA, 1419 bp, Glycine max
  Peptide Sequence Number=SeqID_228803
atggacgattgcattcaagttctaccaatcaccgccagccacgtggtggcagtgccatacccaggacgaggccacgtcaaccccatgatgaacctctgcaagctgctcctctccaagaactccgacatcctcgtaagcttcgtggtcaccgaggaatggctcggcttcataggctccgagcccaaacccgacaacatcggattcgccactatccccaacgttattccctccgaacacggtcgagccagcgacttcgtcggcttctttgaatccgttatgaccaaaatggaagctccctttgaagagttactccatcgccttcagccgctcccaacgctaatcatatacgacacttacctcttctgggtggttcgcgttgccaatagtagaaacattcccgtggcgtcgttttggccaatgtctgcgtcggttttcgctgtcttcaaacactaccatcttctccagcaaaatggccactaccctgtaaatgcttatgttgttcaaatgtttgcaacagaagacggtgagaaacgtgtggattatattccggggaactcgtcaattcgtctggcagattttccccttaacgatgaaaactggcgcagccgaaaattgttggaattggccttgaatgttataccatgggtgcagaaggcgcaatatctgttatttccttccatatacgaacttgagcctcaagctattgatgctttgaaatcagaactctctatacccatttacactgttggccctgtaataccttatttcggcaatggccacattgatttctctaattttgctgaccatgaacttggctactttcaatggcttgagaaccaaccctctggctctgtgttatacatttctcaagggagctttctatcggtttccaatgaacaaattgatgaaattgcagctggtgttcgcgaaagtggcgttcggttcttgtgggtgcagcgcggagagaatgataggttgaaagatatttgtggagataagggactagttttgcaatggtgtgatcaattgagagtgttgcagcatcatgctattggagggttttggtctcattgtgggtggaattccaccagagaaggtgtttttagtggtgttccttttctgacctttccaatatttatggaccaaccccttaatggtaagttgatagtagaggaatggaaggtggggtggagggtgaggacaaaggttaaagaggacactttgataacaaaagatgaaattgctagtcttattagaaaattcatgcatctgggtagtgatgaagtgagagatatgaggaaaagaagcagagagctgaagcagttatgtcatggtgcaattgcaagtggtgggtcatcagaaactaatatcaatgattttctttcgcatgtattacagggtgccaaaccagagttatag

SEQ ID NO: 112026 - DNA, 1182 bp, Glycine max
  Peptide Sequence Number=SeqID_228804
atggcatcactgtgtctaaactcattaccagtcccaccatcttctcttcctcgcaaaccaactgaaacttctctttcttcttatccttctttgcttcttcataacaacaacaacaatcttagtgacttgaaacccattgttgtcagtggagaccccccaacttttgtttctgctccgggtcgcagaattcttgctgttggagacctacatggagatcttaagcaagctaggtctgcacttgaaatggctggtgtattgagctctgatggtcaagacttatggactggtggagaaactgtgttggttcaacttggagatatactagatcgaggagaagatgaaattgctatcttgtccttgctacgatcattggataaacaggcaaaagcaaaaggtggagctgtgtttcaggtaaatggaaatcatgagaccatgaatgtggaaggggatttcagatatgttgactctgggggatttgatgagtgtaatgatttcttagaatatatcaatggttccgaagacaactgggaagaaacttttactgcttgggttgatgtctctgaaaggtggaaagaagatcgaacaatgtcaaaaagttattggggaccatggaatttattggagaggcaaaagggagtcattgccagatcaatcctctttaggcccggtgggcttcttgcacgtgagcttgcaaggcatgctgttgtacttaaggtcaatgactgggtcttctgtcatggtggacttcttcctcaccatgttgcatatggcttagagaggatgaataaagaagtgtctgagtggatgagaggtcagcatgaggatgacaatattcacaaaaagcctttcattgccactcggggttatgatagcgttgtttggaatcgtttatactcaagagacacactagatttagtggactatcaagacaaacaggtatgttccattcttgatgagacactgcaagcagttggtgctaaggcaatggtggttgggcatactcctcaaactataggtgtaaattgtaaatacaattgtagtatctggcgtgtagatgttggaatgtccagtggagttctgaattcaagaccagaggttctagaaattatagacgataaagcaagagttataaggtgcaaaagggacagacacagtgaacttcaagctgctgcatatacttaa

SEQ ID NO: 112027 - DNA, 171 bp, Glycine max
  Peptide Sequence Number=SeqID_228805
atgggatcttcgtcagcgatgggatgttcatttcggtttgatacttgcgtttgtggttgttgtgaaggtggcgtaaagggatatgaaggatggttttctttgtcaaaggaggctatagttgttgttgtggacatgagagttgtggtgatgatggttgtgattgaggaataa

SEQ ID NO: 112028 - DNA, 1203 bp, Glycine max
  Peptide Sequence Number=SeqID_228806
atggggagggatggtttcataaaggtgttgagtggaaagttggggatgaggttgttggcaagatgtgagagtggtatgaagatgggtggagacgggaattggtgtggagaagagaatgctttgagtgggagagagaatccgcgggaggaggaggaaatattttctcttttgtggcgtatcaaagcaccgagaaaggctttgttcttcatttggagaagtggagtcggcacaacatctcttctcaacatgctatgtggtggcgactatttggaagatgtagtcttggaaaacggtggtgaacgtgtggattatattcctggaatttcctcaatgcggctcgtggattttcctctaaacgatgatagttgccgcagtaagcaattgctgcaaataagcctgaaaggtttcgagtgggtctccaaagcacagcatcttttaatcacttccatttatgagctcgaacctcaagccattgatgtcttaaaagcagagttgtcattgcccatatacactattggccctgccataccttattttagcctcgaaaaaaatccaactttgagcaccacaaatggcactagtcatagctacatggagtggttagatgcacaacccgatcgttctgttctttacatctcacaaggaagctatttctcggtttcaagagctcaagttgatgagattgcatttgctttgagggaaagtgacattcggttcttgtgggtggcccgtagtgaggcttcaaggttgaaagagatttgtggtagcaaagggttagttgtgacatggtgtgaccaattgagagtgttgtctcattcttctattggtggtttttggtctcattgtgggtggaattcaaccaaagaaggtgtgcttgctggggttccgtttttgaccttcccaataattatggaccaaccaattgatagtaagatgatagtagaggattggaaggttgggtggagggtgaatgaagatgttaacgtgaataatactttggtgaagaaagatgaaattgtaatgctggtacagaaatttttggatttgaacagtgagcatgcaagggaaatcagggaaagatccaaaactcttcggcagatatgtcgtcgtgcaattacaaatggcgggtcagctgtaactgatttgaatgcctttgttggggatttaatgcagacaaacattgattccatgaacaccttgtag

SEQ ID NO: 112029 - DNA, 375 bp, Glycine max
  Peptide Sequence Number=SeqID_228807
atggtaccctcccggaaagacaaagagagacatttggccagatttcttgacattttcaagaaattggaaatcactttgccttttggagaagctctccaacagatggcactctatgccaaaattttgaaggatatgctaaccaagaagaatcggtacatccatagtgactgtcgcaacctacccttttgcgggcgagcgaggcgaggctcacgggtcgacaagggtgtttcccttgctcctatgtattcctcaattgtgataaggaaatcagacctacgtagttctttcaaaaggggcgaatcaagtgattcttttttacttggaaggcggtcatttaaggcgttggaccttaaaatgatccattttacttggtga

SEQ ID NO: 112030 - DNA, 966 bp, Glycine max
  Peptide Sequence Number=SeqID_228808
cgccaggatcgtggtgaagttcacgaaggtcgccagcggttcggcaaagcgcgccaccagcaccagtaccgcgccgagagccgcgggagccaggctcccctgggtgacccacagcatgccgcagcccaggattgccagcatcccggattcgacgatggcggccaccatcaacgacggcttggcgccgcgccggtgatgctcgcgctgcaatcgttccacctgctcgaagccggcgcgcaggcgttcattggcggcgccggctcggcccgtcgccaggcacacgggcagcccttgcatgtactcgagcagttccgcgttcaaggcttcattggcgcggcccgtggccgcatgcccgcgatccagcgccggccggcgccagcggtagagcggcacgatcacgggaaacaccagcatcagcgccatgcccagtcgccagtcccaggccagcagcgccagcgcggtcgtggccggcgtaaccgcggcgcccaggatcaggttgatcaccgtcagcgcgtagttcatctgctcgtcgacgccgcccagcagcttggcggcgatgccgccggtgcggtgggcctgcagcgcctccagcggcatgcgccgcagttgctcgcccagcagcacgcgcagctcgtgcgtggcgcgcgccatgtggccgcgatagtcgaagccctgcgcgcgccagcgcaggatgatggcggcggctgccagcaaggtgaagcccgccagccaggccagcgcggcgcgccagggatcgccgcgggtcacgtggacgaacaggggcacgatgcaggccagcgacaggccctggcacacggcggcggccagcaacaggcacaggctggcgcgcaggcggccggcctggctgcctgcgctgcggagaaggcggcgataggtgtcgcgccagggagcgggaggtgtcgtcatgagggttgctcgcccaaggtccagcggcgggcgcgttga

SEQ ID NO: 112031 - DNA, 327 bp, Glycine max
  Peptide Sequence Number=SeqID_228809
atggggttgaaccaagcacatgtttttaagaaaaggttcatcgagtcgaggaaagaatgcactttacggtgcccttatcgaacgtgtgccaaagctagagtaatgagtgaaatagaggaggtgcaagagcaaatgaaggccgacatagaggccatgaaagaccaaatggccgccatgatggaggccatgttgagcatgaagaaaataatggaaagcaaagcagctgcagtcgccactacgagtgccgccactgaggtagacccgagtcacccatcaggagcttgtggaggatgcccaaagacaattgtgatagtagggtacatttga

SEQ ID NO: 112032 - DNA, 1212 bp, Glycine max
  Peptide Sequence Number=SeqID_228810
atggaggttgacatacctctaggttggaaaccgctcaacctggagcgctacgatgagaccaccgacccagatgagcacctggatgcattcctcacccaagctaacctctacactaatgacgatgcaatcctatgtctagtcttccctatgtcctttaaaggagcgacattgatgtgctatggaagactccctccttggcagatgacaagtcactttgcaaatttatggatagattcgggcggcccgagcccaaatcagaaatctcaatctcgaggtagcactacattccatgttgggtgccctacgacttgccaaggttatacactcttaacgacaaatcaagccaccatcctcgaagaagctttcaatgcaaaggggcacaatgaggaccaccaaaggagaaaagaaactgatagaaggggagatagaacaaaggatagggggagacagaggcatcacccacaaaggcatgaacacaaacaccaacaaaagcaagaagacaaacccgctcagcagattataggtatcatcaacactcttgcaggcagattttcctatggagggctatctagccagtcttggaagcatcatctccacgccatcaaagatgttgatttcaactattgtcaaaggcataacctacaaccatcgagaagtcttcctcccataaccttcaccgacagagatttcaaaggcatcaacctcatcaaccaggatgaccctatggttgtctctattgtcattaccaacttcatggtgtctaaagtccttatcgaccaaggaagcgagagagtggaatctagaggttatgcggacctaatgaccaccttcggtcagggaaagctcttgcagagtttcactataagatatttaattgttgatgaaaatacttattttgctttgattggaaggaaaacattgaatgagctagaagtcatagtctctacactgcaccttaaaatgaagttcgctaccttgatgggagaaattgtcactgtcaatgtagaccaaaagcaagcccaacaatgctatggtgagagcctgaagatgaccccttatcctaccattagagaatcaggcaagccctattcctcctctagtggtagcaacaatcaagtcatgagcattgtcggagaattcccattaaggaccttgaccatctacaagataactaagggaaatctcagagatacattcaacatagacccttag

SEQ ID NO: 112033 - DNA, 327 bp, Glycine max
  Peptide Sequence Number=SeqID_228811
atgtctcggaacttcacgtattgtgcaacaaagggtgctaagtacctcgaagcggtcaaacaaaggttacatgccatgaaacaatggtccccggatgaatataggatttttatataccaaattgaagtggtctggcggcaagcaacgacggcttgtggtggccaccattggtcatgggtggtgaaggagaaggtgttagggtttttgggtggaagtttagagagagggggtaaaatgcgtatttttacgctgttgaattgcgctaatcttgctaagcaaatcttcctctcgggttgggaattgtgcttagcgtgtttgtctcactaa

SEQ ID NO: 112034 - DNA, 291 bp, Glycine max
  Peptide Sequence Number=SeqID_228812
atggtgtttggagttggcggaggtcatcgttgtccaccatggcgatcgtcggaggggggttggaattttcttggggtgtctctctctaaagtcagtctgacatcaagattgatcgctgtcagaatgaacttcaatgatctccctggcggcggagtcgtaggtatcctctttttgaggaatgaagtgtacctacaaaagggacttcgacgctcaaatcaatatcttaatagcctgaccacttggctgctaggtgctcgggctgactttgtacgagaagcttccatgttctag

SEQ ID NO: 112035 - DNA, 600 bp, Glycine max
  Peptide Sequence Number=SeqID_228813
atgcctgaagatcctgcaaatcaacctaattaccctgactttttcaatcatttcgcaactaatgaggtttttgaaaatcaagacgatttgttgcgcagggttcgagatttgaggaagagtcttggatttgttcttgcaattcataggtcagaaaatggtaggaaaatctatgttgtagtggattgggaaaatggaggaacgtacaaacaatacaaggataaaagagtggacactcaagatgttgacaaagatataatatggtctcatccagattccatcaagctattaaattcattcccaacagtgttgatttgtgagactatttacaagacgaacaaatatcgtcttcccttgttggagattgttgcaaaatgcaagatacttgtgactaaggcagaagattgggaggagtatgtttattatacatggttgttgcatcataaaaggagatttgtacaagcatggaccgatcatgatatgtatcttggaaacacaacaactaatagggttgaaaatgcatatgcaagactaaagaggtggcttcgtgatagcatgggggatttgtgtacttgttgggatgcttctactactatatactaa

SEQ ID NO: 112036 - DNA, 210 bp, Glycine max
  Peptide Sequence Number=SeqID_228814
atggcgatacatttatacaaaacttctaccccaagcacacgcaatggagccgtagacagtcaagtaaaatccaatccacgaaatcatttgatctatggacagcatcgttgtggtaaaggccgtaatgccagaggaatcattaccgcagggcatagaggggcagaagttcctataaaaatgggaaatgccctacctttgagtgcggtttga

SEQ ID NO: 112037 - DNA, 309 bp, Glycine max
  Peptide Sequence Number=SeqID_228815
atggcttggagaagagataaggattctgcttctggggtccgacataaccatgcaagtaatattccagcaccaaaagaattgtcccttgcaaatatagaagcattaactttgcaagtaatactaccttggctgggtggttgccacgaagttgcaaggttgggcgaggtagttactgctggatgtgaagctttggagttcctacattattccaaatgcaccaaagggtggttgcaaagataccttgttgttgtggatttaaatggtttacagctgaaaaaaataagatcattcgtacaatctgcttgctaa

SEQ ID NO: 112038 - DNA, 405 bp, Glycine max
  Peptide Sequence Number=SeqID_228816
atgccaggttaccatctggtcggttcatgtaatgggttgcactgtggggttagcgaaataccagaaggataccgtgtttgtttttggaacaaggcgacaagggtgatatccagagaatcgccaacgctgtctttttccccgggcattggtcgtagaacaatgtttgggtttggctatgatccgtcaagtgacaaatacaaggttgtagcaattgcattgactatgctttcacttgacgtatctcaaaagactgagatgaaagtttatagcgcgggtgacagtagttggagaaaccttaaaggttttcctgttctttggactttacctaaagttggtggagtgtatctgagtggaacccttaattgggttgttattaagggaaaagaaaccattcattctgaaatc

SEQ ID NO: 112039 - DNA, 141 bp, Glycine max
  Peptide Sequence Number=SeqID_228817
atggcttcagatcggaaacttcacactttcgaggaggtggcaaagcacgaccagaccaaggattgctggctcatcatttctggcaagacaaatgcaattgtagccgccacaattgcggttgtggaactccataaactttga

SEQ ID NO: 112040 - DNA, 228 bp, Glycine max
  Peptide Sequence Number=SeqID_228818
atgagtgtgctcttgaggatcctcatgggcaccgttgggatgtccaggaggctgcccttcgagggtgagaggagtaacatgacctgtgtcatcatgtgtggtcggtgtcaagagaactgggtctgcttcggcggctgtgctggcggcgacagctgttgccgcattactctccattattcgtttcattcccagcatggcttccatcatagaagccatttggtattttaa

SEQ ID NO: 112041 - DNA, 321 bp, Glycine max
  Peptide Sequence Number=SeqID_228819
atgcagccaatacttctatccgtgggaggactgccttcgatagcggaaggaaaagaaaaactcgatctcattgaagagagattgagagccgtcgaaggattcagtgattatccttttatggacatgactgacctgtgcctggtgcctgacgtcatcattccctcgaagtttaaagtacttgatttcgatagggacgagaagctattaatgcacttctttcaagatagtttggctggggcagcggtcatctggtatactaaccttgaagcttcccgtatccacacttggaaggatctgattactgccttcattaggcagtga

SEQ ID NO: 112042 - DNA, 192 bp, Glycine max
  Peptide Sequence Number=SeqID_228820
atgaggtgggtcgttacaagcttgatatttgttggtggaaggaccatacctcaagttttgatgatctatccaaccaggattataagtgttgcagtgtacaatagatgccacacaacctttgttgattggctgccatcacattctgccgttgaccaatggctagctgtctcacaagggatgtcaattctataa

SEQ ID NO: 112043 - DNA, 414 bp, Glycine max
  Peptide Sequence Number=SeqID_228821
atggttctagagagtacacagggagaggaaaagccatcgacctcgtacctccccctccctctccctctccctctccctctccatcccatcacaaagaaaacaacaattcacattattagcagatcagactccgacgacgacgacgaccgcagccacgaagaaggaaagcatggattcgagtttgtttgggaaatggaggtacaaattctgggcgttagcggccatgtttcttctggcgttctggtgcatgttcaccggcatcgtctagctccgctggaaatggaggagaaggagaaggtggtgaggcacatgtgggatgtgtacacaaatagtcactgcaggcaaaatggagaagaagtgagtcaagaagaagctcacccacataggaagccatggataagaacttggaggtag

SEQ ID NO: 112044 - DNA, 270 bp, Glycine max
  Peptide Sequence Number=SeqID_228822
atgggggagggatattgtacgcaaccttacccttgcatatgcaaaaaggctgtttccggattcgaacccatgaccaacaggggtcgtcttaaatcaccatggtcacgcaggaaaagaaaacatgtccttacacctcagcaatggaaaagcgtgtttacccaggatgggagaatacgggatggtggaattaagttcttgaaaagagttcgcagtggaggtgttgatcctagtatcagagctgaagtttggccattcctacttggagtgtaa

SEQ ID NO: 112045 - DNA, 582 bp, Glycine max
  Peptide Sequence Number=SeqID_228823
atggagttcttgtccaatgtgaagttcagcactgacttcaataatatcacattttccaacaaatcaacgattcaaccaatcagaccgaaatgctgccgaacaaagagacccaaaacagaaacgcaacacacacaagctgatcaacctaagcggacactgacaccaacactggggatgcgcagaaagaatgagaaaggaagaactcaccgatcagaggacgaacaagaggctggtgaggaagaagtgacaacgaatagaaccgaccgcaaatggatccacgaagaggaggaagacgacgacgacgacgattgcgacgacgacgacgaaggagaggaattcgaagacgacgattgcgaattagaggtcttaggttttttacctactggcaccgcagaagacgacggagacgaaaacaaggccggcgagggccgtgaagagcagcgccggagtaaccaccgccgaagccatggagaacaacccggcaccgccggcgacgaagtgagggtcgttggtggtgttcgaaaatgccctttcaatgatccctggttggctcctcaattcgttgtttctgagaccagttag

SEQ ID NO: 112046 - DNA, 804 bp, Glycine max
  Peptide Sequence Number=SeqID_228824
atgggatgtatcaaaagggagaggcaggttctaaaactggttcatccgggtagacatgttgaggttcttaaagaaccaataacagcagctgaggttatgagaaggaaccctagacactgtatagctagaccagatgtttttgagttcccctctgttgtggttaaacctgagtcagttttgcttcctggaaatgtcttctttattgttcccaatcacacactctataacttgttaaaaaccaaaggccaaaccaacaacttaccttttatacaaaagcagtactctccaaatgatagactagttagctcttatgcttgggtgagttctaagttgcaaacatacaagcaacacattaagtgtctttttacaagaaaaggaaaagtagggcagagcagaaaagttaaagaaaagcttcatgtttttaataaggcgtttcttccattgttcttccattcccctttttcccaaagaggatccaattgtccaagttactcaaattctgcatatgtggaaagtttgtgcatatatgaaggggatggaaagtcagaaagccaactccaagttgaggatacatcttatgatgccatagaaaatcgaaagaacaatgagatgaaattgctcaagaaagacgtttttgggcctaatcaaaaagttaccatgctgaaatcttgtttaagaaaaccagatagtattcgcaagtcacttaatctaaaggtatcattcgacctaccaaacaagaaacaggagcagcaaatggaattgaatatttttcgatcaaaattttttggctacttaagttggtga

SEQ ID NO: 112047 - DNA, 261 bp, Glycine max
  Peptide Sequence Number=SeqID_228825
atggaaggagaaacatcatacacagtgggtccaccaccaatatttgatggtgaggagttcaagttttgggcagcaaggatgaccactcatcttgaagtgatggatctttgggaggcagtagaagaaaactatgatgttccaaaattgccgtcaaatatgacgagatttgggactatctcaaatcataatatcaaggctatgaaagaaccaaaggcatgcaagtgctcaagttggccaaagaatttgagattcagagcatga

SEQ ID NO: 112048 - DNA, 321 bp, Glycine max
  Peptide Sequence Number=SeqID_228826
atgggggctgtgggtgatggagaaagagattggaacgttggaaatggttttggaagaaagaaaggagaagaaatggcatttttcttaagctacttggactacaaggctcaaaacgcacaaatgagcaatgctctcgggaacggaaacgtcgcgcacactctagacatcttctcaaagatcccaatactgaaaaccaaatttcgagatgatccaacggttaacgaaggctgggcagcgtttttaccgagacaacttcatgtagcttccttgagaaacttcattaagaagcttcctcgagaagcttcctcatgtcttctttga

SEQ ID NO: 112049 - DNA, 249 bp, Glycine max
  Peptide Sequence Number=SeqID_228827
atgcagatattcgtgaaaaccctaaccgggaagaccatcacccttgaggtggagtcaagcgacaccattgacaatgtcaaagccaagattcaggacaaagaagggattcctccggatcagcagaggttgatcttcgccggtaaacagctggaagatggccgtaccctcgctgattataacatccaaaaaggtttggaatatctcaattttgaaaattgcgtaaatattttgaatgtggtaattgattga

SEQ ID NO: 112050 - DNA, 470 bp, Glycine max
  Peptide Sequence Number=SeqID_228828
agtcaacattgcatcttgttttaaggcttcgtggtggtattattgagccatctttgatggcactggcgaggaaatataaccaggataagatgatctgccgcaacaagattcctaattttggaactgcctgcaagttatggaaggcgtgtatgaatttactgatgtctagtatagaaaaagtacagccacaacagattgttgatttctctgaactgcatatttctgaaaagccctacaccaaggtgttatgcccgtttacatccccgtgctgtgaactgcaggaaaaagaagtgtggtcacagcaaccagttgaggccaaagaagaagatcaatgttacatgtatacctggtttggaaaatgttttggatcatcctgcgaggtgattcatttgctgcatcctccaactgaagcaactcgtctgaggagaggcgccaacgaagagcacccaaattttcctcagcttgtttaa

SEQ ID NO: 112051 - DNA, 309 bp, Glycine max
  Peptide Sequence Number=SeqID_228829
atggcgccttacaccagggcggtttgtgaatgcttgcagggtttagttaaagcagttggagtaagtaattacggaccaaagcagcttttaaagatgcatgattatctgaaagaccttggagtccccttgtgctcagcccagttgcaattttctctgttaagcacggggaaatatcaactaaagatcaagagcatatgtgacagtctgggtattcgtatgattgcatatagtcctctaggacttggaatgcttactgggaaatattcatcatccaaacttccgagtgggccaaggtttgttgatatttaa

SEQ ID NO: 112052 - DNA, 177 bp, Glycine max
  Peptide Sequence Number=SeqID_228830
atggcgaataccaacaacgagcacacacggattgatgaagacaaaccacggattgatgaagatcaacaaattgaagagaaaaatatgagagaatttgagaggagaaatgaaaaacgtgtaaaagaaatgatgttggatgcaggaagaaaatcccaggaggatgttaggatagggtga

SEQ ID NO: 112053 - DNA, 312 bp, Glycine max
  Peptide Sequence Number=SeqID_228831
gaagggtgtgaaaacggcgtcggcgtaggagggagggtcgatgtaagaagaggagtcgggggagccaggttttggggagaggaggggatcggagtcggcgggagtggcgaggatcggtggagagagagggtggtggtgagattcggagagcgtggacatggcgctgcgagagggtggtcctccatcattgtgattgtgagtgaggattgggaaattttagaatcggaagtgttgttgatggagcttgctgcttgcaagctcgaagatgatgatgatgatggaggagtgagggagggattagggagaggttga

SEQ ID NO: 112054 - DNA, 1290 bp, Glycine max
  Peptide Sequence Number=SeqID_228832
tatctaaagataaccgtttcgaaccctgtcaaggagcaagaaacatcgaattcgattgttcctggtagcaacagttacgtgacctacttggtcaccacgaagacgaacattccggaattcggcgcctccggcgccgatttcgcggtccggcggcggttccgtgacgtggtgacgctctctgatcggctcgcagaggcgtaccgcgggtttttcatcccgccgcggccggacaagagcgtggtggagagccaggtgatgcagaagcaggagttcgtggagcagaggagaatggcgctggagaagtacctgcggcggctggcgacgcatccggtgatcaggaagagcgacgagttcagggtgtttttgcaggtgcaggggaggctgccgctgccggcaaccaccgacgtggcgtcgagggtgctcgacggcgcatcgaagcttcccaagcagttgatgggggagagtgtgattgcgccgcacgaggttgtgcagcctgcgagaggagggatggatttgatgaggctgttcaaggagttgaggcagtctgtggccaatgattggggaggttccaggccttctgttgtggaggaggataaggagtttatggagaagaaggaaaagattaatgagcttgagcagcagatcaatggtgcatctcaacaggttttaaatcacggttgtggttgcagctttgttgcaatccttgacattgcgggcaaatgcggccaatgtggttgcagtgagctcaaaaaccctgacattgcagctgatgctgaatcacttgttaaagcacagcaagatatgggagaaacaatgggagaactaggtctggcatttattaaattgacaaaatttgagaatgaagaggctatcatgaactctcagagggtacgggctgctgacatgaaaggtgtagcaacagctgctgtgaaagctagcagattgtttcgagaattaaatgctcagactgtgaaacatttggacacgcttcatgagtatcttggattaatgttggctgttcatagtgcattctcggatcgttcaagtgcattattgacggtgcagactcttctgtcagaattgtcttctttggagtcaagagctgaaaaacttgaagtggcctcatctaaaatttttggggctgacaaatcaagggttcgtaagttggaggagctacaagaaactataagagccactgaagatgcaaagaatgttgcaattagagaatatgagcggatcaaggttcagattgttgcatttatagacctaagtgcgtttgtgaatttgtag

SEQ ID NO: 112055 - DNA, 1866 bp, Glycine max
  Peptide Sequence Number=SeqID_228833
atgttggcaaacacatgggagccctctttgacctcttcccggttgaaagctcattcagcctttttggttttgcttatgacttctgtatactcctttttcgttgataaagaattgcaagggaaaccagatgtatatagcctagtttcgtctgctgcatttgctatcgcgtctttgggattgtcaactctgactaccttaggattcgaggttgatctcttgtattttttcagcggtgttctaatagtacaactcatgaaaattaatttatggttggtcattgttggagggggtttcagttatttcctcatcattcttcggtctactttagaaaatgagtataatcaaatccaagacattgaaattggtctgcatcgaccatcacaaggaactaacgtttctcaagtgtcttcttcaccccaagctattggtaatgctcatccacaagctgatgctagtcaggtcacccaagttgctttaagttcacaacaaggcaataggcatagaggtcttatcagggcccggtatatgagtcatatagaggagcttaagaaggagaatgggaagctcatcgacacaatttccaagcatgtcggcgaataccttatggctaatgttgtgaacgaagacggtatttcagtgccggaaatgcaagcagatgacaacttggtggcggatgtgttgccacaaggaatcatcaacaaccttcgtgaaaccgggaggctgatgttacagaatgagtgctgcaatgtgtacagcagggtccggagggagtttctgaaagagtgcctatcaaaatttgggttgcaagttgaagagctaaacgtggaggacattgacaagatggagaagattgagagttggataaaagctttgaacataaccgtgaggatactctttcccaatgaaaggagactttgcgatcttgtcttctcgccatcttatgctgcagatatctctttcggggaggtttgcaaggaactgaatattagtctactgagattcgcgaataccttagcaactgagaatcattcgccgtttcatttgtgccatctcatccccaaagtgttcaagactttgagtgacctgattccaaatttcaattcactgttttatggtcagttgttcagtgaatcactcagaaatgacgcggtccttgttgggaagagattggggatttttgtggagttggagagtcttattcaccgtgagatgccaaaggagactgttccagacggcggaattcatccaactactcacaaagtaatggactacctcagagatgttttcatagataatcagagtttttcaattagaacgggagtatcttcattttctgaccaggtagccaggataatacaagtgttagacagcagtttggaagccaagtccaaaaactatacagaccctgcattgggccatgttttcatgataaataatctgatgcttttacaatatgagaaatatatatatagagtagtcatttttggtgaagattggtacaaatcaaagatcaaccaaaacattgaactctatcaaagaagctcattggataagatattggactttttaaatctagacagcaatgagttgttgctagcagagtcgatgaaaaagaagctcaaattgttcaaccagcacttcaacgagatatgcaaagctcagtctgaatggcttatctttgatgagcagctaaaggaacagatgataaaatccatagaaaacaaattgttgccggcgtatggaacctttcttggaaggattcatgatgttcttggtaaggatgcttatgacttcattaggtatggaatacagaacattcaagacctactgagcggtttgtttcttgtaatccaacatgaaggctga

SEQ ID NO: 112056 - DNA, 264 bp, Glycine max
  Peptide Sequence Number=SeqID_228834
atggtgtttaccttgagaaaaatgtttgtgcgcagtgttaaaggaaaagggttggacctgaatcacgaaggtgagaccttaacggattgtttggagtttaggccttgggggcaaagacacttgaaatgtaataattcactccctatgtgttgtttgtgtttggatcctgtgatgatcttgaactttgtgttcgtgagaacagatgactatgtggatgactttaaagaccctcgtgctagaagacattgtgacacaatactctga

SEQ ID NO: 112057 - DNA, 305 bp, Glycine max
  Peptide Sequence Number=SeqID_228835
atgggtgagaaggaagagaaaaaaaagaagaaaatcaagtcccatatgcttccgaagcaacccagctcgcttgggcaagctgggcggcaacctcctccaccttttcttatacaaaggcaaaaggtggatgttccaaggatccctgatccccctggctatgcatttcagctgtttttggtgaaaaaaaattatttccgtgaagaaaatccaagccgaggtgcttccataacgcttccgagacgtttttgtgagcaaatccgtgaaggttttctgtcgttcttcattcgttcttcgttcttcaacgg

SEQ ID NO: 112058 - DNA, 423 bp, Glycine max
  Peptide Sequence Number=SeqID_228836
gtcgactctagaggatcccacctccgcgtgacggcctcctctcgcggagacgaagacgtctcctcgcgaacggcacgactcgcacgcatcgcatcattcgcgcgttcgcatgattcgcgcattcgcgcgttcgcattattcacattattcacatcattcgcggtattcgcggtattcgcggtattcgcggttggggttacggcttggattgactttcgtcacacgacgcctcgtcgtccccatctcgtggtctctcccgcgcgcgcgctcgtgcgaacgacgcgaacggtctcggtcgacgtcttcgcggcgtctccgtcgcgcgacgtcgtctccatcgcgcgcgacgatcgaatcgatgtcccccgcgagcgtttcgggacgcgtcgacgcgatcgtcccattcgcgccaatctcgcgtga

SEQ ID NO: 112059 - DNA, 663 bp, Glycine max
  Peptide Sequence Number=SeqID_228837
atgtccgaatgggacgcgcgtcagacgcgcgcgcgcgcgaagcgagcgggcgcctcgatgtcggacgtgcccgcgaacgcgcccgaggcgtgtcccgggacgcgcgcgaagacggcggggacgagcgaggcgtgcgcgggatgtccgaatcgagcggcgtgcgcttcgggggcggtgaaagcggcgagcgaggagacggacgcggacgcggttcgagtcgcggagcggttgcgaggggtgcgtcggaagattttagtgctcagtgggaagggtggggtggggaagagcacgttcgcggcgcagttggcgttcgggttggcgagtcggggacgagacgtcgggttgctcgacgtcgatatctgtggaccgtcggtgccgttgatgtgcggtgaggtgggcgcggaggtgcataagagtaattccggttggtctccggtgtacgtagaggagaatctgggggtgatgtcgatcggattcttgttgccgaacccggacgacgcggtgatttggcgaggaccgaggaaaaacgggttgattaaacaattcttgggcgacacggagtggggtgaattggattacttgatcgtcgacgcgccgccgggaacgtcggacgagcatctgagcatcgtgcagtacatgaaggaggcgggtgggatcctctag

SEQ ID NO: 112060 - DNA, 762 bp, Glycine max
  Peptide Sequence Number=SeqID_228838
gtcgactctagaggatcccacgtgattgactctgccgacacttcgtctcctacgtcgcagccggcaaaggtgcttctggtcgtgcgccaaagtgatagcagtgcgtcagcagctacaaactcctcgtcagggcagtctgttcagtcgttcgagttttgggacggcgacaactcgacgagtctaagctttggcgagtttgccaaatttgtcgaagacacggctggctttccactcaaaggtcacgcgatcatatctcgcgctgtctggagttcgttggacgccgatggggacgacacgctgagcccgtctgagtatgccgacgcgaaagggaagatgcgctcgggtgatttggtggccgctccagtcttggtgtacgcgtcaatcaacgccaagtatctcaattcatttgagacgactcgaggcaacgcaaattcgtgcgagaactttgtccttgcgcgcacgaattcgacagccatgcccgcgaacacgactgcctggaatgcgttttatgaagaactgataccgtctggatcatcgtctttatcttcagcgatcacgccttgtgaagtgggtgtgcacattcccgctgtgtacgctggcgttgacgccaacatgacgaagttgatccctttgcgcgtctttgagtccactgcgccaaagactatttcgctcgcttcagaaagtgcgaagtcgacttccgaagacctcacgcagtttgatgacccagtggtcttgagtgccaccgagcagtatcacgacatt

SEQ ID NO: 112061 - DNA, 195 bp, Glycine max
  Peptide Sequence Number=SeqID_228839
atggcaatcgtcaagtacctcaccatggatgaattaaagcgcctaagcatcccttcaaaaatgcttaaattctttaaccactctagtttcccacactatgaacaggtgcctgatgttataaggacattctcttacttaacaatgctcatgtgttctatggtgtctcctgaaatgctaaaccccgatccctcatga

SEQ ID NO: 112062 - DNA, 336 bp, Glycine max
  Peptide Sequence Number=SeqID_228840
ttgcgtcgcgaggacgcggaggatggacgaccacgatacgtgtggcgcacggacgtgcgcgcgacggcgccgttttggagggcgtggtacgaaggtttatcgagaaaatttctcgccgttcgcgcggcgaaactgttgattctcgccggaaacgatcgattggacaccgaactcacggttgcgcagatgcaagggaagtttcaactcgcgttgcttccgaagacgggacacgccgtgcacgaagactcgcccgaggagacggcgacggcgattgaaaactttttcgcgcgatacgtcgtgaacgcgagaccgacgcctccgccgttcgtggtgtaa

SEQ ID NO: 112063 - DNA, 888 bp, Glycine max
  Peptide Sequence Number=SeqID_228841
atgatagatataccatgtacaatatgcgcaatttcacatactggagagctgaccaaaaagtgtctcctaacggtaatctccggtggctcgtgcagagcacacaccgtttctctgaatcatgtaatattcgagtacttgagtcaccattcaagaattcgattaaaaaatcacgatggcgaacacggacatcatgcgtcgtcctcgcgcttcagttcgtcgcgtggtgtggtgatgcgcgcgtgcgccgacgcgcgatcggtgagcgccgccccgcgatatcctcgtgttttgaggcgcggaaatactagaagagcgagggcgcgacgggcgggactcgcggtagatgctgaacacacgcctctagttgatttctacgaacttctcggcgtggacaccgacgccgatgtgaagacgataaaaaaagcatactacgggctcgctaaggagtgtcatcccgacgtttcggaggtcgaggaagaagggcacgacatgtgtgtgttgttgaacgaggcgtatgagattttgagagacccgatcgcgcgagcactgtacgacgccgagttggaacaacaaaagctggatgaggatttgttcactgggaacgcatactcgaaatggacgactaagaaggcgaaaccgggggaaacccgcgcggtgttcgtagacgagtttacttgcataggctgcaaacagtgcgtgtggcaagccccggccacatttcgtatgaacaacgactacggtcgcgctcgggtcttcgcgcagtggctgaacgatgaagaagatatacaatgcgcgattgactcttgtccggtggattgtatacattgggtcaaacgagaggagttgccgtacttggagcacgtgtgcgtgaatttcggaaaggtttcg

SEQ ID NO: 112064 - DNA, 309 bp, Glycine max
  Peptide Sequence Number=SeqID_228842
atgggaagagcgcctcaacgccttggtcgcgcgaatggaggccgtggagaatgtctgactgtttgtccatacgataatctaaaccctagcaaaaatcgagtttcagaaaagcgggcaccactcgacgtcgagcgggcgacggtgacgtcgtcatggagacgtcgtctcgcttcttcaacgcttccctacgtggccgctcaaatcgccgatttagagagcgcaaacgacgcgaaacaacgccgcatcgacggcctcgaagagcgtgtcaacgctctggtcgcgcgaatggaggctgtggagaatgtctaa

SEQ ID NO: 112065 - DNA, 2295 bp, Glycine max
  Peptide Sequence Number=SeqID_228843
atggcttccgcgttacataacactactggtggttcgccacctcctcctcctcctttacaacctctggtggtatcgtcttctttggcttcattctcgcactccatttccgagaagcttacgacttccaactatcttctatggtgcagtcaagtgcaaccagttgttaaagtatctcagctggaagaagcaagatcagcttcttctttcctgatctgttctccctcgtcttgtaggatgcactacgtggcatctatgggagaaacttcactcacatttccattcgattgctcgcgcgaggaacagcaagtggatatcattcttgaaggattaccgatggaatatgagtccatggtatcctatatctacaacaaatccaagcctatgtctgtggacgatgttgaattgctttgtcttgctcgtgaatcgcgacttggcaaacttagtaagaagtctctaggtgctatcagtgctggagttaattctgatcctcaatcacatccaactcaagtttctaatgatgctgctgacaattacaacaattctggtaacaattccggcaaaggtggtggccaaaatttattttgtggctgctgtggtggaggttgcggccatggtggggtcacggaaaatttgcagatgttcagtgtcaatttgcaaactggtatcctgattctggtgactaacgtgtcacaaaatattcagcaagctaccccctttgaaggtccagatcaaatcaccataagcaatggtcagggcttgaacattaatgcctcaggtctcacagattgccttcttctccttctcttactgtttactcttgttgggaaaagctcaagtcctacatctgctagagataagattacaagtatctcagagtctttggaagttcttgttttcctttactcagaccctataaccaacacaagtttcagcccagatctcaggaatgctaagtttccctacactcaactctttgctgagccagttacttcttcaacacaagcatcaaatagcaccctgtctgttctgccttctgttttgaatcatgtggttcctgctatgtctcagcctccagggactaattccacacatgcagtttcatcttcttcgggaactaattccacaaatgaagtttcatcttcatcaattagtcctgaaccagcagcaactagtcctgaaccagtagcaactctaccagctgatcacttaccatcgcctcaaccagaggtaacttccaatcctgtgatttctgctccagcactccctacttcagtgcactctactgcagaatcacctcctttgctagtcagacctgataatattcactcaatgtgtacaaggacaaaagctgctatgaaggcagaatatgatgttcttcttcataaaaacacttggaaacttgttgatctcccttcctcaaggtctcctattggttgcaaatgggtctttagggtcaaggaaaaccctgagggtacagtcagcaagtataaagataggcttgttgctaaaggctttcatcaaagacttggttatgattacaatgagaccttctcacctgtaatcaaaccagttacagtcagaattcttttgaaacttgctgttactaacaagtggaaacttcagcaactagatgtcaacaatgcttttctaaacggcattcttgaagaagaattctccatcaaagatttgggtgatcttgactactttctgggaattgaagtcagctctcaacctaatggatctcttctacttattcagtccaagtacattcaggatttattggtaaagactactatgaatgaggctaattctatctcttctcctatgtatgctacaataacaaggccagagattagtttttctgtcgacaaaatctgccagtttatgagtaaacctactgaacagcattggatggcagtgaagaggatacttaggtatctcaaagggactatcaattttggattagctatgcagcctaatttctctgtctctcactattctgttcatgcctattgtgatgctgactgggcatcagatcttgatgatagaagtactgaagctgaataccaaagtttagccctgaccacagctgaagtaacatggattcaatctcttttggctgagctcaaagtacctcatgctcctcctgttattgaaaaacaagttcaagtggttcgtgtccgtgctgccgatcaaagggcagacatcctcactaaagctctcataccctccaacttcactgcttacaggttcaagctcagagtggctgtaaagatttctaccaacccctcatga

SEQ ID NO: 112066 - DNA, 1500 bp, Glycine max
  Peptide Sequence Number=SeqID_228844
atggctaactattcccaccctcatatctgccaatgtctgagtcacttgctgaccctccggcaacattttccggtcataattgccggaaaccgccgcaagaccggccaagagttggtggaggaagtgttgtccttggcacaaggcctgctccaccttggactcacatctggccaagtggttgccatctctgctttcaatagtgataggtatctggagtggttattagccattgcatttgttggaggaatagctgctcctctgaactatcgctggagttttgaagaggcaagattagcaatggctgcagtgaagcctgtgttgttagtgattgatgagagcagttacacatggtactcaaaactccagcaaaatgatgttccatctctgaagtggcatattttgttggattccccttcctcagatttttctaagtggaacgtgttaactccagaaatgctcaagaggcatcctataaaacttctaccatttgactactcttgggcgcctgacggcgctgtcataatatgcttcacttcaggaactacgggaaagcctaagggagtcacccttagtcatggagctttgaccatacaatccctagccaagattgccatagttggctacaatgtggatgatgtctatcttcatactgctccattatgccatattggtggcttgtcatcagccatgaccatgcttatggttggaggttgccatgtcttgatgccaaaatttgatgcagaatcagctgttgatgccatagagcaacatgcagtgacatcttttatcacagttcctgcaataatggccacaagctctggttcatctatgcaaacagttcttctgtgtaaatgttttgctattaagaaccttaggcacaaagagacctggaaagggggagaaactgtcaagaaaattcttaatgggggtggaagcctctcacatgagctcatcaaggacaccagcatattcttccacaaagctaaacttatttcagcttatggatctaagctcattcaccagcaacaaggtgtttgtattggcaaggctgcaccccatatagaactgaagataagtgcagatgcttctggtcacactgggagaattttaactagaggaccacatataatgctcaggtattgggaccaaactctcacaaatccattaaatccgaataaaagagcctggcttgacacaggtgacattggatcaattgatcattatggtaatttgtggctccttggtcgaacaaatggtcgaatcaagagtggtggggagaacatttaccctgaagaggttgaggcaattctacagcaacatccagggattgcaagtgttgttgttgtgggaatcccagatgctcacctgacagagatggtagcagcatgccgaaagctccttcttgttatggctggtttggtcgaggtgcattatcgcaatggttcgttggcagctcgtagttgtcgtcgtggttggtgttacagtataacggcagaggag

SEQ ID NO: 112067 - DNA, 477 bp, Glycine max
  Peptide Sequence Number=SeqID_228845
atgtcgtcgctctcgggactcgccaccgcgatcgcgctactcctcgtcggaatctcctccgccggccgtgatctccgtccgtcggagcacggcctcgtcttccagacctcgccgccggccaattcctcgccggagatgaagtccttcttcagcaccagcaagggctcttcttcttcttcttcctccaacgccgacgccccactccggaacgcgacggagtccctgccgccgccgtggtggggagtcaccggcggcggcggcggcggcggaagaagccacgttggacgagcgctgatgacggcgagcctggtttgcggaatcacaggtggcgtcttgttagtggcttcggcgttgctttatctgtttaagcaccgaagaaatcctcaccaaaacgaaccgtttcgtgcacgtaatgatggcactgtcaataatagtgcgaacaagcttcaattagtgccagttgtgcctaatcgttga

SEQ ID NO: 112068 - DNA, 123 bp, Glycine max
  Peptide Sequence Number=SeqID_228846
atggctcatttggccctgtctcagatggctgtaactgttcctgttggcaacgatttgtctctcagaagatctgcagttaagatccaattgtctgaagaatctatagttatgctagatgtttag

SEQ ID NO: 112069 - DNA, 1358 bp, Glycine max
  Peptide Sequence Number=SeqID_228847
atgcatgcattccttcccatcgcgcattcattcgtcggcatgtccgcgcgagcggcgctcgagcgcgcggtggaggcggtgcgcgtcgagtgcccgaacgcgatcgggacgccgttggatttacgcgcgatcgcgtcgagcgcggcgacggagggggagatgacgtcggatgcggacgcggtgacgcgggtgacgcgcgcgtggacgcgcgcgacgagagatcctgggaacgggctcaccgagggcgagctcgcgagagtcatgcgcgcgtttcataaagtgtggatcgaacacggacgatcggggacgccgttggacgatgggacgtgggcgtttcgatgcgcgcgggtgaatcgacccgcggtgaaacagtgtctcacgagactggcgacgtggacgaggcggggcaggtgggcggggtgggcggaggcgtgcagagagatgcggagggaggtagcgatgaagagtggtggaccgtatgagacgtacgcgcaggtggtgcgagggttggatgggttgcgcgcgcgagcgacgacggcggtgcgcacggaggcgaaggaggacgcgatggcgttcgacgagagcgcgaggaagtggatcgaggcgtgttggagcgacgcgtcgattggatcgccgttaccgtcgttggatgagatgccgagggagaacgtgacgttttacgcgcgggggatggagcgggatggtgtggtctcggtgtcgaaacgggtgccgccgagagatcggtcgcagccggtgagtccggcggcgccgacgccgaagagggcgaaaaaggcggtgaaacccaagattgaggcgccgagttcggtgaatcgcgagagcggtgcgttgttaccgagttcttcgaagaaggacgccgcggaggtgtccgtagtcgtcgaggagggcgacgagagacgggcgccggttcgcatgatggagatgcacgccgttcgccagtcggtgggcatcaccgtcaaagtgcgatgccacggattagacgcggaaatggtcatcattccgccgttcggtctgccgaacggggtcaaaacgaacggtgagatggcggcgatggttttccaggagacgcaggcggcgaagcacgcgaacgcgccgcccgcggagccttcggcgcggtgcgtgcacaacgacggtaaagcgtggcgatgccccggtcgaagagtcgacgacacgccgttttgtgcgaaacacaagccggctaaatttgcaacgtccgttcgctggtcgccgacggcgtttgaaacgccgcacggattacgggtgacgtacgacggacctccttccgcgggtgtcattcgaagcgtggctggcacgccggtcgacgcgtcggatttgttgag

SEQ ID NO: 112070 - DNA, 411 bp, Glycine max
  Peptide Sequence Number=SeqID_228848
atgtacagaaataatgaagctgatgagcagcagcagtcggaaccacaaatgcagcatttatctgcaaatggaatttctcatgcaggtattggtactcagaatgttcagtatgcaacacctccgcagcttggaactgggcatgctgtgtggtttgcatccttagtgctctcattggagctggtaccacccacttacccatatccagatccatactacagaagtatctttgctccctatgatgcacaaacttatcccccacaaccttatggtggaaacccaatggtccaccttcagttaatgggaattcaacaagcaggtgttcctttgccaactgatacagttgaggagcctgtgtttgtcaatgcaaaacagtatcatggtatattaagacgcaggcagtccttgtgctaa

SEQ ID NO: 112071 - DNA, 975 bp, Glycine max
  Peptide Sequence Number=SeqID_228849
atgacttcagcaattgcaatcgaagatgtaaggagggaggtgaaaatgttgaaagccttatctggacataagaatttggtcaagttttatgatgcatttgaggatgtcaacaacgtttacattgttatggagttgtgtgagggtggagaattacttgacagaattctagatagaggtggaagatacccagaggatgacgctaaagctattcttgtacaaattctagatgtagttgcgttttgtcatctacaaggagtagttcaccgtgatctaaaaccagagaattttctttttgtctcgaaagaagaggatgctgtgatgaaagttattgattttgggctatctgattttgttaggccagcactgacttctactaaacatgcagatcaacgcctcaatgacattgttggcagtgcctactacgttgcacctgaagtgctccatagatcttacagtgttgaaggagacttatggagtattggggttatatcatacatattgttatgtggaagtagaccattttgggcacgcactgaatcaggaattttccggtctgtcttgagagcgaatcctaactttgatgattcaccttggccatccatatcacctgaagctaaagactttgtgaagagacttctgaacaaggaccacaggaaaaggatgactgctgctcaagctttagctcacccatggttgagaaacgaaaaaaatgctattcctttagatattttgatatacaagttagtaaagtcatatgtgcgtgcctcacctttgagacgtgcagcattgaaggctcttgcgaaagcattgaccgaagacgagctaatataccttagagcgcagtttaacctcttggagcctaaagatggctgcattttacttgagaattttagagttgctctcatgaaaaatgcaactgatgccatgaaggagtcaagggtccctgaaattttaaatttggtgagtaatctttga

SEQ ID NO: 112072 - DNA, 615 bp, Glycine max
  Peptide Sequence Number=SeqID_228850
atggggcattgctgcagcaaaaacatcgccgtcaacaacgagacgctccccgccgatcacgcccccaagccgccgcattacgcggcggcggtggcggcttctccgctgccgccgtcggggagctcggtctccgccgcaactcccgggaggaacacgccggcgcaatcgttttccatgagcccgttcccgagtcccctcccggcgggcatggcgccgtcgccggcgaggacgcctggaaggaagttccggtggccgctgccgccgccatcgccggcgaagccgatcatggcggcgttgcttcggcggcaggggaaggcgaagccgaaggaggggcccataccggaggagcagggggagggtggcggcggcgagggtgagaggtcgctcgataagagcttcggttatgggaagaattttggggcgaagttcgagttggggaaggaagtgggtcgagggcattttggtcatacgtgttgggccaaagggaagaagggtgacctcaagggacaatctgttgctgttaaaatcatatccaaagctaagttggagatggtgtacgttgactcttggtctcttcaggatcagtttctgactggaatttcatctagcgtgtga

SEQ ID NO: 112073 - DNA, 207 bp, Glycine max
  Peptide Sequence Number=SeqID_228851
atggaaaatgaagggaagaagccatacttgcatgaatctcgacatttgcatgcactaagaagagcaagaggatgtggaggtcggtttttgaattcaaagaaagatgagaatcaacaggatgaggtagcatcaactgacgaatcacagtccaatatcaatctcaattctgataaaaatgagcttgcaccatcagatagaacatcctaa

SEQ ID NO: 112074 - DNA, 195 bp, Glycine max
  Peptide Sequence Number=SeqID_228852
atggggtatgtgatgagagtgagattggcgtcgttcttcaccggggctgcagtggcgtcgtttctggggctctacaccctccacaaggattacaaggtcgcgcaccaatcctttactcaacagatgcgcatatttcgtcttttgattgatggagtgaggactgtgcagagggaggcagactgctgcatatcctga

SEQ ID NO: 112075 - DNA, 447 bp, Glycine max
  Peptide Sequence Number=SeqID_228853
atgcataattcaataaattccacccgtctaaattgcagaagtgaaaattttgtaactttacaagaaacaagtattcatgagggactagtaaaagccatcaacttggaaccccttgagcaggtcaacgtttcaaaccattcgaatggaagccttgaggttggcgtatctcctccttccctggtggttggtgttttcgacagcagaatcggcgtgcaaggagggctgtggagtggcactaggctcctactacttatggcggggctccaacctcacctacatctcctccatcatggcctccagccttctgacaactccggacgacatagtcaactacaacaaggacaccgtgcccagcaaggacatcatcatcgccgaccaaagggtcaacgtccccttcccctgcgactgcatcgacggccagtttcttggccacaccttccgctatga

SEQ ID NO: 112076 - DNA, 618 bp, Glycine max
  Peptide Sequence Number=SeqID_228854
atgagaagagccattttcactgcatggacaaggtttcatgcgctcaaggaccgtctatactttccttatcagaatccttgggtttcatggcaaatgagcttctacgaaaacaagacaaaactattcaacaatcttcatgtgcatcttggaactcaagtcaatgttgttgaacctccactaattgaagttacttcacaacttccaccaattgtggaagacgccttagccattgttagcacttctattactcctcgtgagataactcctttgaccacctttgctccaagtataagattcattgttgaacgcattgagaccaacatgctaatcaagaacactctggagtcttcgctcaaatccttcaacgattttgttccctataacatgaatctgctaatgcaacaaaggttgcctccatttgtccaacaccagtctacacccatacctcaaccacctccaccaacaccgaccactgttgtgcaacctcatcctgaggttcttgcacaaatgattcctgcatcagaggttgctatacctattgatcatgtgcttgtgcctctgccttcgccaccaaagtcaccacctcctatcactcaacctccatccactgaaggttga

SEQ ID NO: 112077 - DNA, 725 bp, Glycine max
  Peptide Sequence Number=SeqID_228855
cggaaggtgtggccaagaaactggccgtcgatgcagtcgcaggggaaggggacgttgaccctttggtcggcgatgatgatgtccttgctgggcacggtgtccttgttgtagttgactatgtcgtccggagttgtcagaaggctggaggccatgatggaggagatgtagtcaacctcgttcaagcaaacgggaaaagagaagagctcaatgacctaagcgtccagagggtgaacaatcctctattaaagatgatgttgttaacgacccctctccaactgatattcaacaagttcctcagtagacttcaactgttcaagagtttgaaagaagccttcgacaaattgagactatatgcctcaggaagaagaaatcaaactgagttcacattgatatggacaatgatgttcaaactgatgttcaatatggacaatgatcgctttcaacatcaaggccttcctaccatagatcccaatctttctgctgaagacattgcacggttgtgttttcctattgtctttctttttgagaatgcttacaacattcaaagacgaatggaagagaaattccaacctcagattgattggatgcagttccctcttgacattaaagaagaggaagttacatgtcctttgtccaagcaccaagaatctcatgttgcatccacaacttttaaacaggctcccccaacagggatcaaagttcttccttcaccaaagtggaaatga

SEQ ID NO: 112078 - DNA, 402 bp, Glycine max
  Peptide Sequence Number=SeqID_228856
atggacttcactatcatcgcaactctcatgaagaagctttacaacaatgtctatgacatctttagaagatttgcagacgatggaatttttgtcactccaatcaagcttcacactctgagctccaccattcagttcgacgactaccgcgagattttctgcaccgccaaagtgtcctcgctcgattcctttcttgaacgggttaggaatctagatgttgctatgatgccttttgaagagcttgttgttgatcctaggaagaaaggtttaccatcttctggtaatataggtgtggggatgaagaagtggagaaggcaagcttgggagacaaatggagatgatcacaaagtgtcaatggaaagtggaaaaaaggaagacaatggaagatcaaatggacatagatag

SEQ ID NO: 112079 - DNA, 774 bp, Glycine max
  Peptide Sequence Number=SeqID_228857
agcgcgatcacacgcccatgtagcggccggggcggtggttgaacatcagcaccaagctgagcaccaccgcgccgatggccgaatacagcaccttggaaggcgacagcacgaagaacgcggccaccatcaggcaggcgtcgtaggacatctgcaccttgcccgcgctccagccacgggtgcgctgcaggtacaccgccaggatgccgataccgccgaggctggcacggtgacggatgaagaacaggatgcccaggccggacaatgcgccaccgacgatcgccgaatacagcgggtggatgtgcgagaagtcgatccagcgcggcagcaggtcggtcagcacgccgcaggcggtgaccgcggcgaaggtcttcagggtgaattcccagcccatgcgccgcaccgccacccagtagaacggcagattgaccagcacgaacaccacgccgaagttccagtccagcgcgtaatgcagcaggaacgccatgccggccatgccgccgatcatcagcccactcttggcgaagatggccaggcccagcgaggccaccatcgtggccagcaccatgccctgcacatcctcggcgatcgagtggcgcagcgctttttcgtcggcggtggtgccggcgctatcgggcggcggggtcagcgggccggcggtgaccaggtggccgtcagcgtcgtcgcacggcgcggggccatgggagggaagggacatacgggtggggaacagcaggcagcacggccagcatgtcctctccgtcgtcgtccattccg

SEQ ID NO: 112080 - DNA, 471 bp, Glycine max
  Peptide Sequence Number=SeqID_228858
atggtagctttgtgcgtttgccgtctaggtcttactggtagagctattgcaggaatagctgtcggaattgtggcagctcttctgttattgggagtttgtatatatgttggatatttccgtaagaagatacagaaggatgaatttcttccacgagattccactgcactctttgctcaagatgggaaggatgaaacttctcgtagtagtgcaaatgaaacttcaggacctggtggacctgccatcatcacagacataacagtgaacaaatcagtggaattttcatatgaggaactggcaaccgccacggataacttcagtttggctaataaaataggtcaaggtggttttgggtcagtctattatgcagaactgaggggagagactaagttctattacatttatatcttgacaatacttgagcaagaagcaaaaagtacatctttacgacctgctgcagcaggctacaaatag

SEQ ID NO: 112081 - DNA, 610 bp, Glycine max
  Peptide Sequence Number=SeqID_228859
atggtgccaggtagtagagaacctctgccatgggctactcgggtgcagattgctttggattctgccagaggtcttgaatatattcacgagcacacagtgcctgttgctgattttggtttgaccaaactgacagaagttggaagctcatcgcttcccactggtcgtcttgttggaacatttggatacatgccaccggagtatgctcaatatggagatgtttctcccaaagtagacgtgtatgcttttggagttgttctttatgaacttatttcggctaaggaagcaattgtcaagacgaacgattctgttgccgactcaaagggcctctttgatggagttcttagtcagccagatcctacggaagagctctgcaaactagttgatccaaggcttggggataactacccaattgattcagttcgcaagatggcacaactagccaaagcatgtacacaagacaatccccaactccgtccaagtatgagatctattgtggttgctcttatgacactttcttcaactaccgacgattgggatgtgagcttcggtgaaggtgaagggatcgatgttcattgttgcagtggttggttcgtcgacggtggcatacgag

SEQ ID NO: 112082 - DNA, 483 bp, Glycine max
  Peptide Sequence Number=SeqID_228860
atgccgatctccccttgtggaagtatcaattggtctgtgtcgttccgacgtagggatcgtgcccaaaagacacccagtagacccggagaagtccaacagggccctggggtttccagctatggttatgggcctctgtcggtcctacagggtgcccgtcccccccagcaaggaatcgcgcccacaagacacccagtggacccggagaagtccaacagggccctagggggtagcgcccacaagacacccagtggacccgaaggagcccaacagggccctggggtttccagcatgggtctctgtcagtcctatagggcgcccatccccccaccaagttcatgccatcgtgacatagggatcgtgcccgtaagacacccagtggacccggagaagtccaacagggccctagggtttccagctctggttgcgggcctctatcagtcctacagggtgcctgttctccccagcaaggtcacgccatcatga

SEQ ID NO: 112083 - DNA, 225 bp, Glycine max
  Peptide Sequence Number=SeqID_228861
atgacagaaggtgaaggagatgatgctagtctctgcgcgttaacgggcttatctgcccctggtcgacgaaaggtgcggcaaaagaatgtttatacggataaccactcgggtatttccgcctgccccctaacttcacggctcgcttgcctctggttgacaaaaggtgcggataaccataaggtacccccgcatgtcatcggactcaccgtctctgggatgacaaag

SEQ ID NO: 112084 - DNA, 708 bp, Glycine max
  Peptide Sequence Number=SeqID_228862
gacttggaggttccgacgaagaagaatgaaggcatatacccttctcagattcgccgcaggcgcctcaccgctctcgtccaagctcttgaagagcaaatcatcgacgagagtctcatttgtctcatggaaaagggtagcgatgatcgatctgtcttcactggtcatgcgcgtttgaacaagtacttcacgggtatgcgtgcccgcccagaagaattgctccatcgaggcacgtgcacgtcatcctctcctacggttggcgcgcttcaggcttctcgagacatgcttctcagactttgggacctcgaagaaaaagccgacacggtgttgtgcgaagaagttcgcaagcgcgtcgaggcactcttctgcggcgacaacggtcgtatggtgatccacccatctggcactgacgccgagatggtgccgctactcgaagccattcttgcgtcccgcgccctcaagcgtgaagctggcttgagcgacgtcaagggcgacgtcatcaacgttgtctcctgtgccggagaggtcggcagtgggaccagacaagcctgtgaaggtgtcttcttttccagcaccgtgccgctcggcgggtacggcgtggtcaacggcgagcgcttacccgcaattcacaaactcgctgatatgcgggcgatcgagcttgtcgcgcgttgttctgaaaacgggaaactactcgatggctatgaccagatg

SEQ ID NO: 112085 - DNA, 117 bp, Glycine max
  Peptide Sequence Number=SeqID_228863
atggagatgggagaaagaatacaatgtatggttatgagtaacaattggctaaaaaccctaggacacgctgatggagcaagtgtagaaaagcttctccaaaatggggatatcgattaa

SEQ ID NO: 112086 - DNA, 228 bp, Glycine max
  Peptide Sequence Number=SeqID_228864
atgccgaacgattacgtggagactaggtttcagagtaacagacgcgcccccgacgccgatgcgaaacaacaaatttacgacgacgaagatcgcgtcttgaacatcgcgacgtctcaaaaggtcaccgcggccagtctcgttgtcgtcgccgcgctcttgtttctcttcatcgtcgtcataggtccaccgccgagcgacggtcggtgcacgctgccctggtgcgggtga

SEQ ID NO: 112087 - DNA, 399 bp, Glycine max
  Peptide Sequence Number=SeqID_228865
atggcttctaggaaatgtaagagtatcggttcaagacccacaacacaatatgatacaaggagatttcactccttagatgcttggaaccggtacacggataatgtcctagggagaaacatcttgcctgagaggaaggtggagctctaccacactaagttggatgattttaaaaatgaggtggagaggcgtaatttctataaacgcctcaccaatttggtcgatgggagcatagacttggctttggtgaaagagttctatgcaaacctatacagctttgagggcccttcaccaaagcaagccagagttaaaggccatctactgaagatcgatgttgatagcctcaatacattcctggagacacctgttgatgcaatcctaccccgcaagggcattggatag

SEQ ID NO: 112088 - DNA, 420 bp, Glycine max
  Peptide Sequence Number=SeqID_228866
atggcgtcgggagagcgcgcgagcgagcgaatggcggagtgtgacaaagcggccttaaagtcaagcgaaaagaatagtgttcgcatccgaatcttacatgtcttcggtgagttcgacgagttcatccatggagatggtttgctcgtcgccggcgaaatcgttatcgtccctgcgaatggcgtgaaaagaaacgcgtcgtcgtcctcgtcagtctcgtctcaaagcgaactcgtctcgcgcaaacgtacgtcaagaagagcatgcagtgacactcctttctctctctcatcggcacgcacggacagttccagaacccctgcgccacttccgcttccttatcgtcgtagtgcctgcacggacacaacggcgatccgagctcgtccttgtgttccgccaacccctgaatcacaacggcggtga

SEQ ID NO: 112089 - DNA, 716 bp, Glycine max
  Peptide Sequence Number=SeqID_228867
atgacgtcatccaatgcgtctcacctgaagcgttcattcgctctcacagacggtgatcacagcggcaagcacggtcgcacgccgctggtggccggtggatacgttcgagtcgatctcggcgactggagctccatcgactcggtgcagatatgcatgccgttacagtccatttcgttacgacagtacacaacgaatacgttgacggcgagtttcaaagtttcggcgaattctccagcggagtttgaatacatctcgccgccgagccttcaaaacgacgtcgtgcagattttgaaagcgtcagcagtcatgtctgtgccttcgaccacattcgtaaacgtcaaacccggagacatggtgattttcgagtgctggatcaaggcggcgtttatggacaaggcgaaatttaagccaatcttcgtcacgtcggcggcgagcgcggtgggcgcgtcggacacgttcgaggcgttgaccgacggatggacgttcgtgcgattggagaagacgttcacgaaggcggaacgagtgactgtcaaggtgcaaaacctcgatggaagtcaatccgtgtacttcacgagcgcctctctcagagtgaacacgatcaccgcacacatgcaaccgaagaacggcgtcgcgctcgtcgacgacgacgccatgaaagcacctccggggctcgaagatgtcgtcctcacgattggcaacgcgcgcactgtattgac

SEQ ID NO: 112090 - DNA, 689 bp, Glycine max
  Peptide Sequence Number=SeqID_228868
atggcgagggcgaacgcgctcgcgctcgcgttgcgagacgacgtctcgaagggcacgcgcgtgggactcgcggcgacggccggaccggagtattgcgcggcggcgtacgcgacgtgggcgcgcggaggagttttggtgccgattgcgagctcacactcggatgaagacgcggcgtacgtcgtgcggcactcggggatgtccgtcgtgctcgtgccgccggcgagcgacgggagggaggatacggagacgtatgagaagtacgcgcggttgatcgagcggtcgaatgtatcggtggagattcgacacgtcgctcgcgtggacgaggacaatgactcgacggtgtctggcggcgaggacgcgcgcgcggacgacgtcttcccggatgacggcgcgctcatcatttacaccagcggaacgaccggacgaccgaagggggcgttgcacacgcacagatctctgtacgcgcagtgctctggtttgattgaggcgtggcgatgggactcgagcgatagaatcgtgcacacgctgccgctgcaccacattcacggcatcgtcaacgcgtggttgtgcgcgcacgtcgccggcgccgcggttgaatttcagcgttcgttcaccccgcgcggggtctggacgcgcttacgcgacgacgcacaaccgccggtgacgattttcatgggtgtgccgacgat

SEQ ID NO: 112091 - DNA, 641 bp, Glycine max
  Peptide Sequence Number=SeqID_228869
gattaagtccactgatcgattgttcagttactactggcgatcctggactgatatccgcattcgtagagaggtggcacagtaagactagcaccttccaccttccgtttccatgctctttctacggaggaggccaaatttatgctgatagagttgctggaggtgtctgccgaggaggccagagcgtagacagcactcacacgtggggcatatctcgcgcttatctattgcaccttgtcggttgcactctttttgctaataagagtgcaacatacgtgcatgtggttcaccttgacgcttttcgggacctcgctcatagtggtggttacgcttggggagttgccgcactggttcatatgtatgaccagttagatgaggcttgtagggcccccacccgacagcttgcggggtacttgacgctacttcagcacttccctagtgtgcaccagtgcgtgactgacgatacataccaggagacgtccccacgtgcttcccagtggttgacgtcgaaggcgcacatgaagggcatcacaggagcaccctacagggcacattgtgatggtttgactgtcacagatgtgtcctggttgccgtacacggagcatcggggggttagggcgtttcaggagatttcatcgttctag

SEQ ID NO: 112092 - DNA, 1092 bp, Glycine max
  Peptide Sequence Number=SeqID_228870
atggccgataccctggcgaaataccgcgccaagcgcaatttcaatgtgacgtcggagccggccgaaggcggccaggccaacgaggcggcgcgcgccttcgtgatccagaagcactgggccagccgcctgcactacgacttccggctggaactggatggcgccatgaagagctgggccgtgcccaaggggcccagctacgacccgtcggtcaagcgcatggccgtgcaggtggaggaccacccgatcgcctacaaccgtttcgagggcgagatccccaagggccagtacggcgccggcaaggtgatcatctgggaccggggcacctgggcgccggtgggcgatcccgccgacggctaccggcgcggccatctcaagttcgacctgcatggcgtcaagatgcgcggacgctgggcgctgatccgcatgaagggccgcgagtcggaaaagcagccgccctggctgctggtcaaggaccgcgacgaacacgcccgcgccgaaagcgaattcagcgtggtggacgagcagcccgacagcgtggccacgccgccgcggacgggcgcgcgggccgtgcccgccgcggcgcccggggcgcggccggatgcggccgcatcgccgtcagcatcgccgtcatcgtccgcgtcatcgtcgtcggatgccggggcagcgggcctgccgggtgaggcggcgcccttgccggagctgctcaagccgcaattggccacgctggtggaaggcgtgccgcgccaggccggcgatgactggatctacgagatgaagttcgacggctaccgtctgctggcgcggctgcgggacggccaggtgcgcctgtacacgcgcaacggccacgactgggggccgaagctgccgcacctggcgcgggcgctgcagcgcctgccgctgcccgacgcctggatcgacggcgagatcgtgatgctggccgacaacggcgcgcccagcttccaggcgctgcagaatgccttcgacggcgaacgcaccgacggcatcctgttctacgcgttcgacctgccctacgtcaccggccgcgacctgcgccaggagccgctgcgcgtgcgtcgagcggtgctggcgcgg

SEQ ID NO: 112093 - DNA, 531 bp, Glycine max
  Peptide Sequence Number=SeqID_228871
atgcgcatagacgaattctgcgccctttatcattcaggaacaacaagttgggtgacgaattttgcgccctttatcattcaagagcagcaagctgagtggataaatgcgcatagacgaattctgcgccctttatcattcaggaacaacaagttgggtggtaaacgcgcagagatagattctgcgctctttatcattcaggagcagcgagtcgagtggaacaacaagttgggtggtaaacgcgcagagacagattctgcgccttttgtcattcggggacagttccgctggcagggaggttcaccagccgaatggtgttttgctcgaacgaaattagtgtcttatctttacttcccttttatctccaataaaagacaagtaaagaggggcaactgtcataccctaattttgtccgggaaccatccgttgttgggatgcgaccctcgtttgaccactttgagatatttggcacccatcgttaggcaatttgtgaagttccgagacatgccggaagccaaaagaaaagcgtcgtaa

SEQ ID NO: 112094 - DNA, 108 bp, Glycine max
  Peptide Sequence Number=SeqID_228872
gcattctctaaagaactcactaagcgcgcttaccgtgctaagcgagttcatcttttgaggatgaacactcattctcttgctgaactacatgtggctaagaaagcctga

SEQ ID NO: 112095 - DNA, 352 bp, Glycine max
  Peptide Sequence Number=SeqID_228873
gattcctgaacacaagggatgggttgtccctgtgtggttcagactttgtaaatggtttttttacaaagatagtggaaatcctaagagggttgcttggggactggacataagcacggaatttgccgaaccagccacaaggtccaacatagggaactctaattgtgagggtagtttcctacttctaccttcatctgtgatgcaatcctaccccgcaagggcattggatagaagactccaagtagattgggccagagatccaagggaaggccctagggttctcataagccttaggggggtgtgtagcgaagctctagcttctcatttcaaggaggtgagcttagctattagagag

SEQ ID NO: 112096 - DNA, 201 bp, Glycine max
  Peptide Sequence Number=SeqID_228874
atggcaaaaggatatactggaagtgatctaaagaacttatgcacaattgtttcttatcggcctgttagagagctaattcagcaagagaggctaaagagtctggatttaaaagaggccaaaaatcaggtaacacccactctaacaattttcacctggtatgacttaaagaattctaatatatatggagcgagggtgcaataa

SEQ ID NO: 112097 - DNA, 126 bp, Glycine max
  Peptide Sequence Number=SeqID_228875
atgggaagaagattggtacagaaagaatgtgtggagggtcccgacatcgccgaggatgatgtggtagctcttgacgaagtgcttgtaggcctacgggttgtcgaagcgccgcacgatggaaactag

SEQ ID NO: 112098 - DNA, 775 bp, Glycine max
  Peptide Sequence Number=SeqID_228876
aggatcccacagcgcgacggcgcgtggttgggaacgacgacggatgaggcgattttcgcgcgggcggaggcgcgagcggaggcgagagggacgaaggcggggatcggagggttattcgacgaggcgagtcgcgtcggcgcggacgagtcgggacgaggacgaccggcggagacggagtattacgattgtttagaggtggcgccgagcgcgaagagcggcgagattcgacgacagtattacgtgctcgcgcgtaagtgtcatccggataagaatttagacgatccggacgccaaggcaaagtttcaaaagattggcgaggcgtatcaaattctttcagacgaaaagcttcgagcgcaatacgacgcgcgcggcaaggagggcatggaggacgtgccggtggtgaatccggcggcgttcttcggcgtgttgttcgggtcggagcagatggagaatttcatcgggcgattgaaactcgcgacactcgccatggccgggacggatttgacgcgagaggaacaagatttactgcagagacgacgcgagacgcgtctcgcgatcaagttagcgtccatgttggacgtgtacgtcgattggcaaccgccgcgtgggtcggcgatcggcaagaaagagcgcgcgaacgcgttcgtggagatgatgaaacccatcgccgagacgctcgtcaacgcgtctttcggcaccgtcatgctgaaaaagattggttgggtgtacaagctcgaggcggagaaatatctccacgacccgctcgccggcaccg

SEQ ID NO: 112099 - DNA, 705 bp, Glycine max
  Peptide Sequence Number=SeqID_228877
gtattggacgcgttagcgagcggacttcgtcgatcgacgacgtactcgtcgacgacgcttcgagagttgtattacgtcgtgaacagtcgaggcggcggcggcggcggcggcgcgagcgaggcgggcatcgtgcgaacgttgcgacagatatccgacgcgctggacgaaccgagagcggcgctgggggtgtgcgcgtcggcgaagggacaagtggccggacgcgcgcacatcgagacggcggcgggggcgcgcatcgattgcaccgccgcgggcgtcggcggatggaccgtcgccggggacgtcttcgagctcgacgcgatgacgattcacagcgacgcggcgtacgtcatcgtcgtcgaaaaagacgccgtgttcaatagactcatcgccgagcgcgcgtacgagacgctcccatgcgtgctcgtcacagccaaggggtttccagacgcggcgacgaggaagtttcttcacctgctgaaacgcgcgctcgacgcgacgcgacccgagggggcgcgctttttcggtttgatggattggaatccctccggcgcgtggattctctccacgtactcggtcgctcgagacgacggcggcggcgttcgcgacgcactcgagtgcgtcgtgccgttgacgtggatcggtttgcgggaggaagatttatgcctcgtgcccgagcgcgcgttgctcgatctcaccgagcgcgac

SEQ ID NO: 112100 - DNA, 207 bp, Glycine max
  Peptide Sequence Number=SeqID_228878
atgcaatcttcgcctccatccaccgttcacgactctccgatgaccccctccggggacgacgcgcgccacgtggaaaggcgcaaccctccggcccgcacacgacgcgcgtctcgcgtctcgcgcgcgaatacgagcgcgtctcgcgtccgagcgatcgcgaacgcgggacgcgtaaattcatcgaatcgtcgcggtgggatcctctag

SEQ ID NO: 112101 - DNA, 348 bp, Glycine max
  Peptide Sequence Number=SeqID_228879
atgtacaccaatgatgatacgatcttgtgtcgtgtcttcccaaggtccctcaagggggcgacattgacctggtttggatgcgttgccgtccaaatccgcaatctcaacccagaggtagcattacactccatgctacttgctctatgttctggcatgtttggggacagtgctacatccagatggaagatatgtctagatttaggaacaaagtcaaacaaaccggacataagtgtgacaagtgagaaggaagcatcaagattgactcacacaagtcggacaagaggcacaagccagacaagcgccaacctttcccaaaagggcccaagtacgagcgttacacacccctaa

SEQ ID NO: 112102 - DNA, 387 bp, Glycine max
  Peptide Sequence Number=SeqID_228880
atggtcccatcataccgctctaggttaagtggtttccaacctaaggggttggacccgtcgaaaagggtctcacgcctgaggccaaatcgagtgctaaccattggtaagagagataacgagagactgcgaggtatattttatcgcatccccacagtgggcgccaaatgtacttaccaaaatctggagctggcacacatcaaggtggacgtggctaaggtggtctcctggacttcacacgttggactgagagtgacctttgttaggaggaaaggagggggaacctgcaaaacaaaggactttgatgctcaattgctaagggtcagatgttcatgctcttgtaccagagctgacatggaaggtggacacatgtctcagaatactaagtag

SEQ ID NO: 112103 - DNA, 596 bp, Glycine max
  Peptide Sequence Number=SeqID_228881
gcggcgcgagccggacgctcctcgaaccgacggtgggcgtgtctctcgacatcccggcgtcgacgtcgaagacggcctcgttggaggcgtgcctgcaagatttcaccgcgacggaggaaattcagagtcacgagacgcgggtgtgcgccgagtgttccgtcgcgtcggcgacgtacgaaaagcgcatgcgtttcgcgcgagcgccgcgcgtgctcaacgtgcacctgaaacgtttcgagggcgatttcgaatcgatgcgaaagaatgacgcgcacgttcgtttcccgctcgttctcgatctttcgccgtatgtgagcgacgcgtcgccgtcgtcgtcctattattatcgtctgtacgccgtcgtcgtacacagcggtgtgctcgagggagggcactacgtcgcgtacgtcaaaagacgaggcacgtggtacctgtgcgatgacgcctccgtcgaacccgtctcgcaggagcgcgtgctcgccgcgcaagcgttcatgttgttctatgacgagtttacagcaacgatgaaacccaacggcaacgcgcattacatactctgtgatatgttcccgccagtgtctcaagatagggtttag

SEQ ID NO: 112104 - DNA, 1386 bp, Glycine max
  Peptide Sequence Number=SeqID_228882
atgccaaaacaaactacgaaacccagaaccaaagtactatgctacaattgtgaaaaactaggtcacataagcaaatattgtaggttgaaaaagaaactaagaaaccttaacctagatccatccatagaagagcagattaataatttactcatcgaaacctcaaaagaagaaattggggaagtatcttcggaggaaaatctcaaccaaatcctacgggatgatcaagcatcatcctcaaaagaaaaagatatccaagaagaaaagaaggtcttcctgaataaacttaaaaaatctttggaagccaaacctaaaccaaaagaatttattactaacaacacatttgatgttagtaatattctcaaaagattagaaaatacttctgtcaaaccaaccactatccaatatctccaaacagagattaatagcattaaacaagaaattagagaactcagacaacaacaagaaattcatcaaattattctttctcatttcgaagaacatagtgatttagataatgaggacaagagagaagaagatgaaggtcaagatgatgaaatcttcatgggattaatcaacaagattaaaatccaaaagttctatattaatattagaattattatcaatgactttgtcctggatacaaaggccctttttgatataggtgctgactcaaactgcattccgaaaggtttaattcctacaaagttctttgagaaaacctcggagaaattgagtacaagtagtgggtcaaaattaaaaatcagttataagttgtctagagcaatcatagaaaaccaggttcttaggattgaaaccaactttcttttggtaaaaaaccttaagaatgaagttatcctaggaacaccattcatcaaatctctgttccctctccagatatccaagggaggaataaccacttggcacttgggaaagaaaatcacctttgatttctctaccaaactaattacaagaaacataaacttcatagaaaagaagattaaccaaatcaactttttgaaggatgaagtttcctttagtaatattcaaatccaactagagaaacctcaattgaaaggaaaaatccaggccctactaaaacacatccaatcaacaatttgttccgattttccatatacattttggaatcggaaaaaacatatagtcgatctcccttatgagaaagacttcagggaaaaacatattcccacaaaagccaaaccaatccaaatgaatgaagaatttcttcaatattgccaaaaggaaatcaaggatctccttgataaaggattaattaggaagagtaaaagcccttggtcttgtgctgctttctatgtcaacaagcaagcaaaacttgaacgcggaacacctcgtttagtcataaattaa

SEQ ID NO: 112105 - DNA, 788 bp, Glycine max
  Peptide Sequence Number=SeqID_228883
acgccgcgagacgcgaggcgagatcgctcgtcgacgctgggtacgcgtgtctcaaagtcaaggtggcgagaggcgcgggacgcgagggcgcgcgcgcggacgccgagcgactcgcggcgattcgtcgagaggtcggaccggacgtcgtcttgcgcgcggacgccaacagagggtgggatctcagcgaggcgcttgatttcggcgcgcgcgtgcaagagctcggcgtcggtttgcaatacgtcgaggagcccacgcgcgcggcgcgcgagagcgccgcgtttcacttcaccacgggcgtccccgtggcgttggacgaaaccatcgatgacatcttgcgagagtcgacggatttcgccgccgcgagcgccgccatcgcgcgcgtcgccgataggtcggcggggatcgtcgccgtcgtgctcaaaccgtccgtcgtcggcggcatcgaggagacggcgtccgtggcgagaatcgcggcgtcccgaggcgcgcgaccgacgctgtcgagcgcgttcgagagtggcgtgggattgagcgtcatcggacacctcgcggcgacgctcgatgacgcgttgagagaagacgtcgccgcggcgaaggaatttctcgtcgccaacgacgacaccgagcgaccgagagcgatggatgtgaaacctttaatcttagagttggacgacgagcccgcggcgcacgggttaggcacggcgacgtggttcgaagacgacgcgttggcgccgaatgttgctcccgtgcgggcgacgaaggacggtggcgcgtgcatggatttacgc

SEQ ID NO: 112106 - DNA, 933 bp, Glycine max
  Peptide Sequence Number=SeqID_228884
atgagccttgatcccttttccaacattctgcgattcgttcgcgctgaatcattgctgaccggcggttttaccgcaggcggacgttgggcgctgcgtttccctgcgcccgataaaattaaattcttcgccattatcaaaggcagttgctgggtcatactggagggcgaacctgaaccgtttcattttgccaccggcgacgtcggcttgctgagcgctaaacgcgccttcgtgctgaccagccatccggacgagccgccggttgacgccatgagcgtgttttatggcgcaggaaaaggccatgcgccgattggcagcggtgatgattttgtccatatcggtggccatgtactgcttgatcctgccagtggtcgtttactgacccacgtattacctccctggattcaggtgccggcagcgtcaccgcaggcggcgtcattccgctgggtgctggatcaactggtgcaggaaggccagcatgtccagccgggatcgcagctggcaacggcccagctggcacaactgctgttcatccagattctgcgggcgcatttgcaaaccagcagcgcactgcccgccagctggctgcgggcgctgaacgatgcgcgattggcaccggcgttacagcggctgcatggcgatccggcgcgcaactggcatctggacgagctggcgcgtgcctgtgccatgtcgcgcacccgttttgcccaatattttcgccaggtggtcggcatcacgccgatagcctatctgacggcgtggcgcatgcggctggcggagcgtgcgttgcaggaggaaaatgaggcggtggccgtggtagcgcagacgctgggttacgcctcagagagcgccttcagccatgcttttaagcgtgaaacgggtcagtcacccaatgcatttcgccgcgccgtgcggttacagcaggcgcagcgataa

SEQ ID NO: 112107 - DNA, 903 bp, Glycine max
  Peptide Sequence Number=SeqID_228885
atgatgtttgcctttacgtatgctggtattaagctagacaaatcaattaatgaaagtagaggacctcctacaattagaattcagggtcaaccatgccatcgaatagacagcttattaccaatgcctggaaagcaaccaaaattttcacaattgtatatctttgatacgcagaatgaagttgaaaatagaattaatacaatgagtcaacatgttggaattcaaccagagattgtttcaactttaagtcaaatgctggatgagtacaatgtccatgcaaaaagttttagaatggccagggacagattgacagatactcaagtcgataatgtaaaattgagattgatagctacacgtgagaaagatggtcgtacatacaatctcccaaatgtttctgaagttgctgctctaattgttggtgattttgatccagactcaagaagggatattatttttgaaacccaaaatggagaattacaaagaatccatgaattacactctagctatctaggactccaataccctttactcttcccttatggtgaagatggatatagacctgatatacttcaccgttgtacacctagcagcagaaaaagaaagagaaatcgtctaacgatgagagagtggtttgcttatagactacagtccagatcaaatgaagcacaaactttgttgcattttagaaaactattccaacaattcattgttgaagcatacacgataattgagtctgaaagacttagctacattaggaacattaaaaaaaaacttagagttgacaagtattgtagtttacaaacatcattagatgctggaagcagtaaaggctcttctaaagaaaaaagagtgattttgccgtcaacctttgttggcagtccacgctatatggaccaacttatttga

SEQ ID NO: 112108 - DNA, 627 bp, Glycine max
  Peptide Sequence Number=SeqID_228886
atgtggcgattcgcggtgggaatcgtcatcatgacgcgcgccgtcgcggacgggcgagtcgcgcgggatgacgcgcctcgaacgagcggacgcgcgtaccgcgtgctgtacgaagacgacgcgggcgagagagaggacaattacacggatccggagacgtttttggcgcggatgcgattgaatcgctccgtcaagactcgctcgtacgcgacgagcgcgctcgcggcgtggaccatctcgcagcagtgcgcggtggtggtcattcagagtgggtcgcacgcggccgtggcgagcggacgggtggacgtggggacggtgacgcgcgcggaaatcggcgcgttggcggcgggcttgacggcgtgggcgttgggaggcgtcggacggggcgacgatgacggtggacgacgatggacgatggcgcgcgtgattcgtcgagtgatgcggtcggtacgtttgggcgcgctcacgatcggtggactcgcggcgttgacgcctctgtgtcagacgatgaccgcggcggtgagcagcgatacggcggcgatgtgcgcgacgctcgcgctcgcgctctacgccatcacgtacgattacgccttcataaacctcgaaacgaaacgtgggatcctctag

SEQ ID NO: 112109 - DNA, 762 bp, Glycine max
  Peptide Sequence Number=SeqID_228887
atggtgaaaagaatcatgttaaacgcttcggcgtgtttgatgaacgcggacttggggaagaacgcgagtgagattgagtgggcgacgacgcaggcgctgcgcgcggacgccgcgagtgcggtggcgcactaccgtcgaggatgcgctcgagccacgatggtcgatgaacacgcgatggagaaagctttagacgattttagacgcgcggtcgcgctcgatccggacgaaaatcggtatgcacgcgcgttatcggagtgcgcaagacgagttgcggcggcgaaatctgcgagtcgggcaatgttcgggaagattttctcgagcgacaaggccatttacgacggcatcgacgagtctgaggacgcgcacgtgttgaccaaacgaaaatgcaacgcggaggatgaggtcgcgcgcgtgcttcgcgacgagtccctcaaatcgaaagctcgagagatgggctttgacgtcgacagcgaggcgtttcagagtgaattcgcggcgctcattcggaaagaaatcgactccaatattcaccgtgaaacgaggacattcggtctgaaatcgtgtgtcgagtggatatcgcgcgcgttcgggttcgccgatatcggtgaagccggtacgaggtccgagtcgagcgactttcgcgcatcgtcttcgcgactcgtcgtctacgcgtctgcggcgatactcgtggctcgcttgacgtacgtcgtctacgccctcttaacgaaacaatcactcgagagcgttcgagtgcgcgcgtga

SEQ ID NO: 112110 - DNA, 529 bp, Glycine max
  Peptide Sequence Number=SeqID_228888
cgtgtcgaggttttggcgcgaggtggagcgctcgtttcgaggtctcggggacgacgcgggccgagaggggcgtccgggacgcgcgtacgcgaacttgttcggacgatcgcacgcgacgcggtttcgcgtcacgcaggcgacggcgatcgcgttcgtgttcgcactcgcgctcgagtggatcgtcttggtgttttacttcgcgagacgacgagaacggcgaggcgggttcgcgacggcgtcgtcgacgacgtactcgggcgcgggcgcggcggcggcgatttgcgcgtgcgtcgcgcacgcgtccatcgtcgcgtacgtgcgcgcggacacgccgacacacgtgcctggattacgcaaagcgaatttcaccgcgtatctcggctggggatattggatgtttttgacgtgcgggtgcgcgcacctcgtgtccttcgtattctccctcgtcgagtgggatcgagcgtcaaaggcgagagcgcgtcgtcgtcgtcgcgaggcgctcggaaacgatctttcgagagacgcgtga

SEQ ID NO: 112111 - DNA, 950 bp, Glycine max
  Peptide Sequence Number=SeqID_228889
cgtacgacgaaatgctcaccaccctctttaccgccaccgacgacaccatcatcgaccacttcgttttacagaacatcgacaagacgtggcttctccacccctcgctcaccgtgcagggacacttggacatttcaaacgttttgcagcatcgcgtgcaagaattgttcgagaccaatctccagacgcagacgcctcgtccccgtccctcgtctcgcgtcatgacctccccgccgtcgcccgcgctccgcgtggcgacgtataacgtcctcgcccaagtctacgccaagagttcgtggttcccgtggaccgagcgacgcttgatgaagtcgaaaacgcgccgggacgccattcgcacctacattgaaaaactgaacgtcgacgtcttggcgctgcaagaggtggacgggtacgaggacgacgaggagaacgccaagagcggtggtgggtggaagacgtggctcgcttctcgcgggtacgaatcgacgtacgtgcgacgaacgaacgtgagtaacgcgaaaaaggatggttcgtgcgtggcgtggcgacgagacgtcttggaagaaatcgagcgtcgagagattgcgtacaacgacatagcgaacgagatgtatccgtcgacgtccgagacagcagatggggacgacgacgcggcgacggtggaggcgcgatcgaggtatctgcgagactgcgtcgggaacttgacgctcttgcgacgaagggcgacggatgaagaaatcgtcttcgcgtcgacgcatttatactgggacccggcgttcgccgacgtaaaactctcgcaggcgaagaaattgatcgaagaatgccgacgatttcgagcagatcgcgagcgagcgacgaacggggtgaacaaggttcgagtcgtcgtcggcggcgatttcaacagcgtggagacgagcgacgtgtatcgagagatgaacgcggcgttcccatct

SEQ ID NO: 112112 - DNA, 579 bp, Glycine max
  Peptide Sequence Number=SeqID_228890
ggcgcgatcgtcgtctcgtccccgagcgagctcccgaacgaaaacggaacgaaacgaccgatggtgacggtgacggacgaggaggtggcgaatttagaggcgtacttgcaaagtggattcgggctcgtgcacgatgacggacgagacggggatgggcgacgggtgttggtggtgaacgcgacgcgcgtgccgggatgggcgggaagcgcggatagagacgcggcgctgcggttgatcaccaaggcgttaacgcgagcgggcgcggaggggggtggtgccgagtcacaccctcgggtggcttcgagacatgcacgaggggttggagcgggagacgcggaaaaacgtgacgagaatcgtcttcgtcaacgcgtcgtggttcacgggcgcgctcatctcgtggaccatgacgtttacgagctccaagacgagggagaagtttgtgtgggtgaactctttgcacacgatggagaaggagagcgggttcttcgtgaaccccacgatgtgcggagaagcgtttttgcgatccgtccgctacgcgccgcaaacagaggcgtcttcgtgattcgattcgactacggg

SEQ ID NO: 112113 - DNA, 360 bp, Glycine max
  Peptide Sequence Number=SeqID_228891
atggcagaacaagctaaacatgtattttatgttcaagacccttgtgatgaaaggtggtcagtggttctacacagaaaaacaattgatgttaatgttgaagatgatgattcaattgttgatacttgctgtcgtgacctacccttcggtgggagggcgatgcggggctcatgggtgtgtcttccaagggaggaaggcgcgtggactcgccaccaacatttattcggggaaaacgtcagaaaaaccagaacgtgtggtctacgaactttaatcgtgaaaggttcgggagttatttttacgcacggggaaggggtggttgacaaaagcggggcttttgctcctgcctatcctcaattacgatga

SEQ ID NO: 112114 - DNA, 780 bp, Glycine max
  Peptide Sequence Number=SeqID_228892
aagcccgcgcgtctttggcagtggacgtgtacctgtccatcgacggcgaggcgttcgaggacgaacacgtgtgcgctggtgaacccagacgtcgatcgagagggggcgatcgaggccggtctggacgcggcgggattggatggtaccgaggaacgcgaggtggcgagacgcgcgctcgcgaagacgcgcgagggcggcgccaagccgtggtgcacgttgatcggatccgacttttccgccgggaatcacttcgtgcacttgccgttgatggcagaatatctcgacggtgccatcttagatccgtactccaaggcttatgcgcacgcgctcgtgtggcggtgggccgacgcgtgcaaacgcgtcggcgcgggcaaacacgaggtgacccttcgctgcgccccactcggcatcttcgtgccggaatcgaacgcgtgcacgtttaccggcaacgttgacgacgcgcgcgcgcgtccggaaggattcaaggcgttcctgaacgaactcagaaaagaatacgagacatcgccgaacgcgccgggcatgagcgcgacgttttcgctgacgcttcgcgacgaacactgcacgggcgataaagtggagcgccaggcgcaagaatgggcggtcgattggccgactgatgaaatcgcagagtgctacaccaccgcgttagagttggcaaacaccggcgcaccgggtaagatggccgccgagatggttccgggagcggtgtgctgccacgtcgtgttgccgtcgaccgaaggacagagcggcatcgccgag

SEQ ID NO: 112115 - DNA, 453 bp, Glycine max
  Peptide Sequence Number=SeqID_228893
atgtctgagcttttgtcagtttgccaagagcgtcatctttttatagcattgatgggaaagaagaaggtattcaaggttactggaagggtaacctccctcagtgtttgttctttaatatttcaagtgatccgagttatactttacattgttgtccaggtattgattgctatgaaaaatggtgctcaacttcttaaatatggtcgtaaaggaaagcccaagttttgtccatttagactttctcgtatttgcaaagataaagttgaggcagaagtgtggattgctggcctcaaagcattgatatcttctggtcaaggtggtcggtccaaaattgatggatggagtgatgggggtctcattcttaatgcaacatttgatatggatgctagaagggaatgggacaacatatgggtgttgttctatgtattatgcattctaaaatccgaatggtattag

SEQ ID NO: 112116 - DNA, 660 bp, Glycine max
  Peptide Sequence Number=SeqID_228894
gtcgactctagaggatcccacttcaacaccggcgacagagtcaaagagacagatggcgccgtcgagcacgcgaagcgcgcgttcaacctccaaggtgaagtcgacgtggcccggggtgtcgataatgttgatgcggtgatccttccacgcgcacgtcgtcgcggcggacgtaatcgtgataccacgctcttgttcttgttccatccaatccatggtggcggcgccttcgtgcacctcgccgattttgtgcgagcgacccgtgtagtacaagacgcgctccgtcgtcgtcgtcttaccggcgtcgatgtgcgccatgataccgatgttacggtacttttccaacgggattccacgctcttccgtctcttcacccttggcggcgcgaatcacgcgcgttcgcggcgcgcgtccggcggtcttctgcaaaaatgggaaaaccgcgcatcacacagggtcagtcagtcacgccgtccgtcgccgtccacgcatcacatgcactcattcgcccgcgaacgacgcgcgacgccgacgagtcgccgacgaagcgacgaaaaaggaaggactatttttttatccatccccctcccgcctcgcctctccccttcgcgtcctcgcgcgtccgtccttcgcgccccgaccgcgcgcgcgcgcaagggataa

SEQ ID NO: 112117 - DNA, 1016 bp, Glycine max
  Peptide Sequence Number=SeqID_228895
cgggagcggtgaagagcgcgttcgagagcgtgagtcatggacggaagtttgacatcttgggacgcaaggtgaagggggcgcgagggaacgtgctcaaggcgcgcaccgaggccgtcgaaaagagacggcggacgctcttgcgggaacacgaggcgagcggaaaggcgaacgcgttcgtggatcgacggttcggtgaatacgacgatggattgagcaaagaagagaagagcatcgggaggttggcgaaagcgcgtctgcgtcagttgaaaaagtcgaagaatttttccctcgccgaggagggcgacgacgacgacgacgagtacacaccgcctcgagatcatcgaaagattgggccgtcggcttgcccacgcacctcgccgaacaaatcggtggcattagatggaatttttgggcaaactcttgaggagaagaagctctcgtcgactgcgttgaacggcgcagtcgcgtgcctccgtcaattatcgcgtgccgccgtgaaaacgccatctgcgtcagaattactctcacccatccgtggatccatcgtgaaccttcgaaaagctctcaagaagacgaacaaggaattggctgagttgtgcgacgcgtttgttaaggaattggacgacgggctcgcgggtgccgtcaaatctcctcttgcctatcacaagaaggttgctgaggcgatcaagacgtacaatccgatgtacgaagaggacggataccagaaaggtcgtgactacgatccgaatcgcgaaagagccgaggcgagaaagctcaagaagcagcttaaacaagaaagcagaggcgccatgcgcgaattgcgcaaggacaatcggttcatggcggatgctcgatctaaagagcaagccgaagcggctgatgagcgcgacgcgcgccagaaagatctcttgtccttcttggagaaacaagaggctgatttcaagtctggtggtcaaggcggacagatcgtcaagaacaagcgacgcgtttcgaaaggatccagacgggcgttttag

SEQ ID NO: 112118 - DNA, 150 bp, Glycine max
  Peptide Sequence Number=SeqID_228896
atgggtgttcacgttttggttcgtacttccggaacctccttacccacttccattaccttaatggagcggtcatcaagttgtaaagtcatcctagtgggcatgatctacaactctcccaaccttatgcacatggagagtggcattaagtaa

SEQ ID NO: 112119 - DNA, 945 bp, Glycine max
  Peptide Sequence Number=SeqID_228897
atgagacgcgaatcatcggacgtcgtcgcgcgcgcggacggaggaggacgacgcgcgatgcgtctgatggtggtgacgatcgcgatcgcgtgcgtgtcacatctcgtcgatgcgacgcacgcggcgacgatgggcgcggcgctcgacgccggtgcgcgcgcggtatcgtccaacgccgtcggtgcgttcgcgcgcgcggtcgaactcgcgaaaagggtgacgacgggacggacgcggtgcggattgaatggattcttttgcgaggaggatttatgcgaacgcgcgagagcggcgacgacggaggaactcatgggccaacccacgggcgtggagctcgtcttagacgcgctgtgtgatcacgtggagacgccgagcgaacgattgcggaaaccgctggtgatgtcgatgcacgggagtccggggacggggaagtcgacgtttcatagaattttggcgcgcgcggcgtacaacgcgacgacgcgcggttccggagaggatgcggggcggtacgcgtgtccgggacgagggtgtccggggtataaggtgattttcggcacggattacgtcgttcgcgagcgcgaggcgcaggcgagaatgttgagagacgcggtgaccagacatgtggaacgctttccggaatccgtcttggtggtcgaagaatatgataaattgggttgtccagcgcgaggcatgttgaaacagatgctcgagcacggaagcgcgggcggcgaggggaacccgttcgatcgaaatgtgacgttcgcgagatcaatattcgttctcgaggccaacatgggattcatggacgtgcacgacgcgtcggcggcgaacggacgtcgcgtcggcggcgacgcccttgtggcgttgcaacgcaaactcaaagacgggttattcgagaaatggagaaaggacgggtgtgaggaccgcgaggacacgctgaaagtg

SEQ ID NO: 112120 - DNA, 297 bp, Glycine max
  Peptide Sequence Number=SeqID_228898
atggctcacatgctctctactattcctgataccggcataaaggatgttgctcgtaaatccttgcttcatgaacttataaatgttctgcagtcatccaagaacctggaggaaaagatcctggcttccctagccttgaaaactttcataaatgatcgaattgctcaacaaccacttagagcttatgctaaaagcatctacaaaatcataacgaagatcaacaaatattcaacagtagttgttcatattatgaaaaccttactaaacttaaactccgttgatgtggtcagtactgagtag

SEQ ID NO: 112121 - DNA, 216 bp, Glycine max
  Peptide Sequence Number=SeqID_228899
atgttgcgacagctcttaatccccgacgttgcgcttggcgccaccctcgcgcttagtgcgaaaccaacaccttcagatgataagccattagagaaaacctcgaagatagcattaacttcaacctacgcaaggaaacatgaccatgtgtacaaatgtgccatcataaggcaagaagcaaaggcatatatcatgccatttgttattgccgatgagtga

SEQ ID NO: 112122 - DNA, 827 bp, Glycine max
  Peptide Sequence Number=SeqID_228900
atgggggatcctgtggtaatcgatgaggttttcattgtgccgggtttcccgccgctgcgccattgcgggcgggatgtgttatcttacgcgccggaaataccttcaagagagcccgtcacggtggaaaaaaagaaaaccttcccgcagcagaaaagcggcctgcatccgcgcaaccgtcatcgttcacgctatgacttcccggcgctgatcgccagctgcccggcgttggcgccgttcgtaaaaccgaacgcctggggcgatgtgtcggtggacttcgccgatccggcggcggtgaaaatgctcaaccgtgcgttgctgcagcacttttacggcatcgaacactgggatattccggcggactacctgtgcccgccgatccccggccgcgccgattatctgcaccacctggcggatctgctggcgaccagcaacggcggcgagatcccgcgcggcaagggcgtggcgatcctcgacgtcggcgtcggcgccaactgcatttacccgatcgtcggcctgcgcgaatacggctggcgtttcaccgggtctgaaatcgattcggtgtcgctcaacgcggccaaaatgatcgtcgagatgaacccgacgctgcgcaacagcgtgcgtctgcggttgcaaaaacagcctgagctgatttttagcggcatcatcggcgcggccgagaaatttgacgccaccctgtgcaacccgccgttccacgcgtccgagcaggaagcgcgcgccagcacccgccgcaagctgcataaattgggcaaaggggaagtggccgacaagccggtgcaaaacttcggcggcaagaacaacgaactgtg

SEQ ID NO: 112123 - DNA, 241 bp, Glycine max
  Peptide Sequence Number=SeqID_228901
aggaaacactgggtccaacaaagataggagaaaatcactcaaagtgtatcaatctcacacagtgcgtggcgagaaagtcgctagcgcacaggattttgttggcaatcaaagggagaggaccactttaggtcgtggcaaggatcgacattctcaccctaggtcaaggtttatggtaagttgggattctggctcaaggcttgtagaacggctggtcatgatatatgtcagggtttggccagcg

SEQ ID NO: 112124 - DNA, 909 bp, Glycine max
  Peptide Sequence Number=SeqID_228902
agtcagctggcgcggtgcgaacagcagctcgccgtccgccggccggctgcgcacctcgcgctctcccggccgatcgatggcgcgaatgctcacctgatacaggcgcgcgctgcgggtgccgacattgattgcagcggcggtaaaggggaaggacaaacacagcaaccctatcagcataagtttcacgctctgccctcaattgatgttgcgccaggtggcttcgacatgaatttcaccggcggcgctgacgtcgccgtaccaaccgttgccgtcgacggttctcagcgagatcggattattcatcggaatgctaaaggtcacgcgggtcttgttcagcacccccacttcaccggaaatatcattccacggggtgctgctccagagcgcattggtcatgtcgtgccactggccatcgcagccggcggcgaagctctgctggccgttggtgctggtggtgatgccgagggtggcgggaaacggcacctgggtactgttatccgcggaagaaaagaggcaatagttcaccccgttgatcgcctgagtcggcccggtcgccatcaccctcacctgatcggcggcggttttgccgctggtagtcaccaggtagccgaactccagcgccggctccgccgggccgacataaccttcacgatgtgggctgttgtcgtaatcatcggaaataatgctgatgctgaaatcgcgcggcttgataatcagctgatcgcgggtgccgctgtcggaaatccccagcgcaaccatctgtttgaagaaattactggagaagaacacatagacggcgttgctgctcttcagctcgttaaaggtatagtagctgccggtgcccgacgtgtttttccaggtgttgccgttcagactgaactgcaggtcggcggcgttcaccgcggatga

SEQ ID NO: 112125 - DNA, 471 bp, Glycine max
  Peptide Sequence Number=SeqID_228903
atgggaaaggcacttcctgatttaggtgcaagtgttatcttaatgcctttatccttgatcaagaaaattggagatgttgaaatcaaaccatcaagaatggctttacagttagctgacagaactatcaagaatccatatggtattattgaagatgtgttggtgaaagttgacaaatttctattcccatccaattttgtagtgatggatatggatgaagataatgaagttacattgattcttggtaggcctttcgtgaagactactagagtggtgattgatgttgatgatgaaaagctctctgttagggtgcaagatgatgaagtacaatttaatgtatttaaggccatgaaacaccatatggataaaaaggagttttttaaaatagatattttggatgaagtgatttttgaatctaagaaaatgatttcaaggaaagattatctggagaaaccattgactgaagaagtttag

SEQ ID NO: 112126 - DNA, 204 bp, Glycine max
  Peptide Sequence Number=SeqID_228904
atggcagaaagagcaaaaagagaagccaatagaagaccaagaaggactcttggtgactatgctaatcaacaaggcccaaaacatttcagcaacatagtcattcctccttcaagtacaataggaacctatgttgaagatgttgaggttatctctctcagagtttttccattctccttgacagctaaggcaaagacatggctctaa

SEQ ID NO: 112127 - DNA, 363 bp, Glycine max
  Peptide Sequence Number=SeqID_228905
atgattcttgatgttgcagctagagttactatgatgtctaagatcttggaggaagcaattgtcatcattgtttctatagcagctagtgattatcaaggtcatcatgatagggctcatgttcacaggaaaggaataatggagttggatactccgaattcaattctagttcagaacatgctcataagtcaacaaattaaagccttaacaaagaaaaggaagtacactatatgcagaatcaaggatgaccacaacaacgtttcaaagggaattaccaaggttataaaggtggtcatggtccttcaaatagaggttcatcacaacaacaacaacctaatagaatgtcaaagatggaagagactttaa

SEQ ID NO: 112128 - DNA, 135 bp, Glycine max
  Peptide Sequence Number=SeqID_228906
atggctgccgagttagggcaactgacggtggagatatccactcttgtcacacccgtcgctcatgataactcattggttttgttagcagcgctaatgaatcgaaggacttatcatgagcgatgtcactgtatttaa

SEQ ID NO: 112129 - DNA, 573 bp, Glycine max
  Peptide Sequence Number=SeqID_228907
atggcagaagattcaaaaggtcaagttttattgagtagcaattcatattgttttggtgggtcagataatggtatgaaaggcaatgttctgaaaaatgaaacattgaagaatgtgagaccatcatcattttcccccaaagcctataagatggaaggctcttgcaactccaagattaacaataccaaaaacgacaacaacttgatgtccaattgttccaacaaagacatgttcctagacagctacaccactacattcgctaagcgcaacactcatgggctaagcacgaggaagactctggaagatgagctgtataggcttcttggttatggaaagctaaatcctctgttggatcttccctgtagggctaagttgtcgtactatcacgaggaattggggtgcgataatttagttgtgtatgtgtatctcaatgcggtcttggttgagtttagcccaacaagagaaatctacggacgatgcttgattaggattaggctaaactatcatgaggaattgagggagaggaaaggtattgcaaatctgtcaactgagtgggagaagaaaggtgtctcttga

SEQ ID NO: 112130 - DNA, 319 bp, Glycine max
  Peptide Sequence Number=SeqID_228908
atggaagaaaagcatgtagagaaaaatgtatgtgatagtgtcattgggacgttctttaacattcaaggcaagacgaaagatggtttgaatactcgtcatgatctagctgagatgggtatacgagcgcagttacattcaaagtctaatgttgagcgatgcatgaatatcttaaaagggtataccaagaatctacaccgtccgaaagcatctattgtggaaaggtacattgtagaagaagccattgaattttgtttagagtacattgaaaaagcaaaacatgttgggcttcccgagtctcgacatggcaaaagagtgggag

SEQ ID NO: 112131 - DNA, 469 bp, Glycine max
  Peptide Sequence Number=SeqID_228909
tgcagaacagcggggccaccttaagggttgaatctcaacacttcgcaagtgtgaatgacgtcaatccctgtgtagcttccatcccttattttgggttcattgatgatatttgggagcttaactatgtcaaatttaccgtatgtgttttcaaatgtaaatgggttgatagcaacattggtgtgcgcactgatgatataggatttacgctggtagacctaaagaaacttggttaccacaatgaccctttcatcatggcagaacaagctagacaagtattttacgtgcaagacccttgtgatgaaaggtggtgcgtggttctgcagggcaaaacaattggtgttaatgtagaagatgtgattcatacatggacacctatgtactcttccttattgctagcaggtagtggctcaatcatcttcttgttagctcgacacattgaccttgttgtccagactgcttttgcaatcag

SEQ ID NO: 112132 - DNA, 306 bp, Glycine max
  Peptide Sequence Number=SeqID_228910
atgtatgtgcatgtattagaaattccaagatgtgcacatgtgcaatttttggtaccccaaaatgctttgagtatgcatgtatgtaaatttagccaaggagatgtgtgtgatgaaatggccccgaggaagcttgcctcaaagaggtccaggaaggacaaggcagccgaaggaactagttccgctccggagtatgacagtcaccgctttaggagcgctgtacaccagcagcgcttcgaggccatcaagggatggtcgtttctccgggagcggcacgtccaactaaagacgttaaagaagcgctactag

SEQ ID NO: 112133 - DNA, 1265 bp, Glycine max
  Peptide Sequence Number=SeqID_228911
tccccgtcctcgccctcgtaccctatccctcgcatcgcctccgcgtacgcacccgcgcaccgaaaccgctccccgacgctctcgtcatcgctcggaaacgtctccgccagccttccccgccacgtctcgtccacccgcacgacgcacgcccgcacgacgcgcaccaactcccccgcgttctcttcgtacgcgcgcacgtcgtccagcgtctccgagattcccgccgctcgaagcgcgacgacgagcacctcatccgcgtccgcgcctcgcgcctccgccgtcatgcctcgttccacgcgcgcgcgcgcaccagagtgtcgacgacgcgcgccatcgcattcgcaccgagattccgcggtggtgaaaacgcgtcgcgtcgtcttcgtcgccgtcctcgtcgacggggacggtgaggcgatgacagaacgagagcgcgagacggtggaggagcgggaagaggatgttgacgacgcggatgacttggcggcgctcgtgccgaagatgctcacgagaggggagcccgtggaaacgggaaataacgacgatgagagcggagagagtttggtgtggaaggaggccgcgggattgcgtacggcgcaggcgagggaacacacggccgttttggcttggattgcactggatacgctctggtcgcaagagagcgagtgggtgttcgcgccgatggtgattgtgtgcgtgtactttactcacagcgcgtgggcctcgtggcgagaggatgcgaaggattttccacacgcgctggcggtgtttctgtggttggtcggtgcgaatacggtctgggtgtggatggatgtcctcggttcgtcgcacgccctgttgaaggcgtggtgcatagtttgtttcgcatggagcattctgatcgagaccgtgcagctctcatccctggtcgtagacatcagagacgtgagcgcgagagatttgtcggatgcatttgaatcgctcgtcattttatcgtgggctgcgcacgacttggtgaatttcgtgtattatagcttcagcggcacatcgcgattttacatcctcttcatgtggtggctgttctctgtcatcatcatcgtgcagtcgacgtactatctactcgtgcagattcgtatattttgcagtcgtccacgtagtcatagcgtggagtacgctctggcgttgtttgcgtggtccgtcggggtgatgctgtgggaatttggagatttttacgcccctgaagaccaagacccggagaacatatttgaagagcctacgaattctag

SEQ ID NO: 112134 - DNA, 234 bp, Glycine max
  Peptide Sequence Number=SeqID_228912
atgccggaagtcgaaagaaagcattgtcgcacaatccgtaaaggggtgcaaatagaaaccaggcccacttgggccttccaggaagttctccagaaggcggtgccttctggtggaagcaaactagctcgcctgggcgagctgagctcgcttgggagagctgggtggcaagacgtttccgtgggtgatttcgcgaagattttcaatcgttcttcgtcgttcttcggtcttcaaccg

SEQ ID NO: 112135 - DNA, 840 bp, Glycine max
  Peptide Sequence Number=SeqID_228913
atgtgcgtcttgtatgattcgcttcagctcgcgcacaagtgtattttgaattcattctacggctacgtcatgcgaaagggagctcggtggtattccatggagatggcgggcgtcgtgacgaacaccggtgccaaaatcattcaaatggcgaaacgtttagtggacgacatcggtaagccgctcgagttggacacggatgggatctggtgctgtttgcctggaactttcccggagacgtatagctttaaaatcaagggggaagacaagccgtatgaaatttcgtacccttgcgtcgtgctcaaccacatgacgaaggttcaaaacacgaacgatcagtaccaaactctcgtgagagatgaagacggtaaaccgttgcgttacgaaacgagctcggagatgagtattgagtttgaagtcgacgggccttataaggcgatgattttgccggcgtcgaaagaggagggcgtgctcatcaaaaagcgttacgcggtgttcgatgaggaggacaagctggtcgagctgaaaggtttcgagctcaaacgtcgcggtgaactcaagttgatcaaggttttccaaagtgaagtgttcgatttcttcttgaaaggaaaatctctcgacgaagtgtaccaagctgtcggagccatcggtaatcgttggttcgacatgctcaagacggagggagcgaactttgaagacgacgagcttttggagtacatttcggagtcgagcgtcatgagtaaagctgcgatcgagtacggcgatcgtaaatctacgtcgatcacgactgccaatcgtctggcgcagttcctcggcgccgatttgatcaaagacaagggtctc

SEQ ID NO: 112136 - DNA, 846 bp, Glycine max
  Peptide Sequence Number=SeqID_228914
atggtgcgattatccggcgcggacagcgtcgtcgtgcgcacgacggcggacgagggattcctgatgacgccggaaaagctgcgagcggccatcacggagcgatcgaggttgttgattttgtgctcgccgagcaacccgagcggggcggtgtatcccaaggagacgttggaggaattggcgaaaattgtcgtcgagcacccgagattgatggtgctgagcgatgaaatatacgagcacatcatctacgcgcccgcggagcatcactccatcgcggcgatggagggcatgtgggagcgcacgatggtggtaaatgggttttccaaatccttcgccatgaccggttggcgtctggggtatgttgcggcgccgaaacacttcgcgcgcgcgatgaacatgcttcaatcgcaaatcacgagcggtccgaactcgatctcgcaagaggctgcgctcgcggcgctagaactgggattcaagggtggtgaggacgtcgccgaaatggtcaaggcgttcagacagcgtcgcgactttgtctccgagcgcctgaacgccatcccgggcgtcaaacttccgagcgtcgacggtgcgttttacgtattccccgacgtgagcgccttcttcggcggcgacgcctcggctgaaggattcggtccagtgacggatgtcgacgaactgtgccgctacatcttagaaaaaggtcaagtcgcgctcgttccgggcagcgcgttcggcgttccggagtgcttgcgaatctcgtacgctgcctccgaagccaccctggaagacgcgttgacccgcatcgaggcgtgcctggatcccaaagtcttcactcaaaactcgagcgcgtga

SEQ ID NO: 112137 - DNA, 907 bp, Glycine max
  Peptide Sequence Number=SeqID_228915
atgtccatgtttaaacgtttcgaacgatgcggctatcccgtgcacgtgctcaagacgcaatacagaatgcaccccgcgattcgcgagttcccgtcgaaattcttttacgacgacgtgttgaaggatggaccaggtatgacgacgctcaacgcgcgtccttggcacgcgtactcggcgtttcgtccctttgtgttttacgacgtcaagggcaaggagcgctcgacgtcgggacactcgtgggcgaacgacgaagaggcggaattttgcgtgtgtttgattcaaagcctgctcaaacggtttcctaagctcggttctgatcgatcgatcggcgtcatctctccgtacaaggcacaggtgaacacgattcgcgcgaaactcggcgaaaagctcggcgtcgccaaggcgagagccatcgacgtcaacaccatcgatgggttccaaggacgagagaaggacgtgtgcgtcttttccgtcgtgcgcgcgccccaggatagcgctcgagcgcgcgcgagggggctcggattcgtcgcggacgaacgtcgcgtcaacgtgggattgacgcgcgcgcgctcgagcctcttcgtcgtcggctcggcggagagcattcgaggcgacgcgaattggggcggtgtagtcgcgcacgcgaccgagaaaaactgcgccgtgacgccgacgaaaccctacaccgccttcttcaccaaacacaccaaggaacccgacgccgacgccggcgccgacgccgaccgagagacgtccgacgcgtccctcgtcggcgagccggcgacgctcgcctctgccgccgcctctccgaaaaagaaacacatccacgatcctcactggagcggcgccgccgagttcattcgcaccaacgccctcaacgacaacgccaccggtttcgccaaggacg

SEQ ID NO: 112138 - DNA, 1054 bp, Glycine max
  Peptide Sequence Number=SeqID_228916
gttatcacgcgatcgcagaatcgtctcgcgtcgatggcgttttatcagtggagcggcttggtgatgtcgaaggcgcgtcacgcggcgctcgtgtcgaggttcgtcactcgaatgcgcgtccgtgaagtgagtgcggcgatcaacaagtggtatgacgtgatggaaaatgaaaagcgtaagcgcaccgtattcaccaaggtgttgcgcacgattacgcagaaacacttggcggcgacgttcaaccggtggcgagagtttgcggctgaatcgtacgacgtcaaggttcgcctgcgtaaagtcgtgagtcacatgcttcgattgcgtctgtcgcaagctttcacgctttggaacgaaagaaccgtcgagatgcgccgtcaacgcgccgtcgtcggtcgcttcgtcgctcgaatgcgcaaccgaaggctcgcgtcttcctttacccattggctcgacgtcgtcgaggagcgaaagcaaaccgatcagagagtggcgtaccgagagcgtctcgccgggaacatcatggctcgaatgaaccgctcaacgctccgcgccgcctttgacaagtggtactccgtcgtcgaagagcgagagatgcaccgagagatgcttcgaagaatgttgcgcaccaagcgcgtcgccatgaactttttcatgacgtggtactgggacgcctttgacggcgacattcaagacaccatggcggacatgttcggcgccacgcgcacctttatgaacgaagcgttcgagggttcgagcctcgatctcgccccgcgaccgacggcgctcgatttcatcgcgcaccgcgaaaacgacgtcaacgttttcgcctcggagcgctccttcgacgacggcgactttgacgacgcgtccaaatcggaacgtttcacctcctctccgcccgccccagagtggcgctccagctcgagcggtgattaccctggttacgacgacgggtcgcgctccgcgttccacgttccgcgcaacgacgcgcgagcgcgagacgacgtcggcgacgacgcccgcctcatccgcgtcacatccggcttttcgcccc

SEQ ID NO: 112139 - DNA, 1016 bp, Glycine max
  Peptide Sequence Number=SeqID_228917
atgaaaagacttttcttactcgtaagccttttagttttatcaaaattctcagctcagacctgggctactgaagaccaatacatccagaaatttgcacaatatgcagtagaagaaatggaaaaatataaaattcctgcttctattacgcttgctcaggggcttctggaaacagggggagggcaaagcagattggctctggaagggaaaaatcattttgggataaaatgcaaagaagactggacagggaaaacaatgaagcatacggatgatgctccgaacgaatgtttccgtgtgtatgaagatccaaggcagtcttatgaagatcattccatattcctttcaacaagaaagtactacaccaatcttttcaagctggatatgaaagattacagagcatgggcgtacggattaaaaaaagcaggatatgcaaccaatccgcgttatgcttccattcttattggtaaaattgaaagatataaactgtatgagtttgacaataccaattccaaagaggttctttatgccgtactaagcttatatccgaaccttaaggatgacagaactttcatggcacaattagtaccttctaaagtcgcaaaaaaagatcctgttacagtgaatgtaccttataaacagacttcttatgcacaacagcagaaaagggtagaaagaattaaaacaaaagctgaaatccttaattctatactgataaaaagccatcctaatgacggactgaaatatatcgttattccagaggatacagatgtaaaatacattgccaacaaatttaaggttagcgaaggcagattgatcaaatggaacgaattagaaggaactgctttaaagaaaaatgatatcgtatttcttgaatctaaaaattccacaggaaatacggccgtgtataaagccgagtctggtgaagatatgcacgacatcgcgcagaaattcgggatcaaactacacaagctatacgcaaaaaacagaatggatgaaggacaacaaccttcgcctggaca

SEQ ID NO: 112140 - DNA, 990 bp, Glycine max
  Peptide Sequence Number=SeqID_228918
atgtgtgtacacgtacacgcatcatcggcgcatggaatagtagtaaagcacacgaacaccgttccatctccgtctcatccggaagagagtctcttccgaagtctcgcgcgcgtcgtcgtcgacacccgagttcgcgtcccgcgccgtcgaggggacatgccgatcgatttcgccaccgtgcgcgcgagagcgcgagagcgcgcgagagagaccgtcgaccgcgatgcgatcggtgcgggcgacggtgcgggcgacgtcgacgcgcgcgcgacgggtgattatgattatgatgatttggatttgaatgaaaacgtcatcgatgacgacgtgttcgcgacgcacgcgacgaccgtgatccccggaatctctctgtgcgacgaattcatcgatgaagacaccgcgcgcgcgttggaggcgcgcgtgatgcgagaaccggcgtcgtcgtggacgatgaagacgagaggccgccgcgtgatgaattcgggcggcgcgtcgccgtcggcgccgtatcgagatgaggacgcgagaaaggtgccgatgtacgcgaagacgatgatgagatacgtgtttcgacgcggggccgcgatgaaggagccgaaccacgtgttggtgaacgaatacgaggcgaacgccggggtgacgccgcactcggacggggacgcgtacgaagaagacgcggcgattttaacgcttcgaggacgcgcgatgattgaattttggccgagcgagggcgcgagtgggggtgatgagggcgagggcgaaccggtggtgagttttgtgttggaaccgagatcgttgttgatgtatagaggcgacgcgtatcgattgcggcacggaattcgggaacgcggagaagacgtggtgacgcggacgacggcgaacgcgcgcgcgttgggactcgaggtcggggatgtgattaaaagaaatcctctcggtcgcctgtcggtggtgttcgtgcgtaagaaacgcgccgacagcgtcgaggattga

SEQ ID NO: 112141 - DNA, 501 bp, Glycine max
  Peptide Sequence Number=SeqID_228919
gcggcggcggatttgagagaggtgttgcacaatttttacaactcgaaatacacggcgtgcttttccaccttggacaacgtgcgaagcacactggcgctcgatattcatctcggtgctcacatcgacgcgctgtatgagtgcattcgcgatcgcgcgctgatccagtacgtcaagccgtacgtcacggtcgatttgacgagagcggcggattctttcagcgcgacgacggaggagattcaagacgaagtcacgcgtctcatcagggatggaaagattcgagcacgaatcgatggaaacgcaaaagcgttacgtatcatcgacgaaccttccgcgtctacacttttgaagcacatcgccgccgatggtgagaaattcgaggatgagacgcacgcggcgctcctgcgactctccctgttgcgaaacgacgtcatcgtgcgcgacgcgcgtcaacatcaacaagacgatcctcgccgtcgcgcgcaggcgctgacggactgttga

SEQ ID NO: 112142 - DNA, 708 bp, Glycine max
  Peptide Sequence Number=SeqID_228920
atgctaagtccattttttttttccattgcactgcagttgagattgcctgctatcagacaaccactgatattgcaatttaaagctgccttccattgtgacaaggacgccatagaaataccaggcttctatcagcgccaatggctaccaaattatcctgaaattgttgaatttaagtatgatggggaaacctacgaaattcaagtcagacaacacaaaggcaaactttactttgctgatggcctaacaagattgaggacagaactgcagatttatgaatctgtgaccataaatttcgtggcctgcgaccaccccttaaaatttgacctccacttcactccaccattagaccagcagaaatgcaaaaggcgccgtgcaacaagaaaacacatttggacatatgaaatcacccaatcaatgctaggcgcaccatatccactgcaacttccagcctctgtcacacaatacctaatccactgtggtaatcatatgacaattctcagaagatttgaacctccactgcaatggaatgtagttgtgctcgacaaaggcattggtgataagtatgtcactctcccttggtataaattccttcaagaagatgattttagccatggagacgagctctcattctactataggcgtgttgagaagatctgggaagttgtcatcaggcgtgcaattgattgggatgatagtgatatagattag

SEQ ID NO: 112143 - DNA, 216 bp, Glycine max
  Peptide Sequence Number=SeqID_228921
atgagaggagcgccatcggaaaagagtatcgcgcctttcattgcacgaggcttcagtgaccccaatgcaagaatgcttcaaagagtccaaaaagcatggaatgcggtgcaaagaaaggataaggagcttggaggaagcgacaatgggatcgtcggcggctatcacaagtggctgaaggctcggacgcaagagataacttggcacccaatgctaaag

SEQ ID NO: 112144 - DNA, 318 bp, Glycine max
  Peptide Sequence Number=SeqID_228922
atgcaccgcaggccgcagacgcaccgccaccacctcatcaggctgatccggctggatcatttggcatggagcggtatttatagcacttggttcgccagcaggcggccaaccacagggggcaggtacagatacatgagtgtctctaccagctcagcctcagtcagcagagccaaggtttcgctccttttgtgtgccctacttcagatcagttcagggctgaggttgcatggcccggagattggcctgaggcccaggcaggggaggcgcccgcagaggctcccagcgatgcagaggaggcccgcatggatgaggagctga

SEQ ID NO: 112145 - DNA, 168 bp, Glycine max
  Peptide Sequence Number=SeqID_228923
atggagaactcaccctggccacaacaacaagggcctagtctttatgacagaatgatgaagttggaagagactctttctcagttcatgcaagtatctatatccaatcaaaagagcacagagtcagccatcaagtgtgacatcctggaaatttctacccggaatttttga

SEQ ID NO: 112146 - DNA, 400 bp, Glycine max
  Peptide Sequence Number=SeqID_228924
gtcgactcctagaggatcccactatctccgcgtaaatgtgtgcagaatgaccaaacttggtctctgcttgccaacagacacgactgtgcctgaatggcaaaggggtgcggataaccgtaaggtatctccgcgtatcataatgaccaaacttggtctctgcttgccaacggacacgactgtgtctgaatggcaaaggggtgcggataaccgtaaggtatctccgcgtatcataatgaccaaacttggtctctgcttgccaacggacacgactgtgtctgaatggcaaaggggtgcggataaccgtaaggtatctccgcgtatcataatgaccaaacttggtctctgcttgccaacggacacgactgtgtctgaatggcaaaggggtgcggataaccgtaag

SEQ ID NO: 112147 - DNA, 411 bp, Glycine max
  Peptide Sequence Number=SeqID_228925
atgtctggagaagcagatcgaacgagcattgaggaagagatggacacaggaaaggagactgcagagaagaacctgaagctcaaagaccgaaaggtatcatgggcaaagctacgccgcgtagattctctcaatttagaagctggaagagtttctacggttgctcacaacccctaccagatgggttggaggacgacgctgatcttagcatttcaaagcataggggtggtatacggtgatattggtacatcaccactttatgtgtatgcaagcaccttcactaaaaaaattaacaacaatgatgacattcttggcgtcttgtctctcatcatctataccatcgtgctcatacctttgcttaaatatgtcttcatcgtattgtgggccaacgacaacggcaacggtacgttctaa

SEQ ID NO: 112148 - DNA, 231 bp, Glycine max
  Peptide Sequence Number=SeqID_228926
atggtagtggtgcacgctgctcgcttcattgtcttccggtgcctctctgaccgtgccagagacttggcattctcactattgagcatgggaaggccttcatctaccttgttgtcgttcatggagcatcctctgatagacagacaaacatggtgccattgttcccgggttgcgtcttccatgactggctcggcatcatccatgagtctagcggagaaggctccaccaagctag

SEQ ID NO: 112149 - DNA, 891 bp, Glycine max
  Peptide Sequence Number=SeqID_228927
atgtgtgggggcaaggaaatactactctactctaaaaggggaaagagtggtgagatacagagacagagattggaaagggagagagagccgttcctcagctggatgcaaaacaaaattggtggaaaacaagataacagaaaaccaaacacatatacaactactcatgatgcaaagcaagagcctcgtgaagaattcagcgattggcctgatggtttactagccattggtacatttggaaatagcaatgaagtaaaagaaaagacagagaagcacattctcagagaggatccatcctcgtcagaggaaatagcagacttcactcctgaagaaatcgggaaactacaaaaagagttaactaaactgttgagacaaaaacccaatgtggaaaaggaaattgctgagcttcctctggacagatttctcaattgtccatcaagcttggaggttgataggagaatcagtaatgtactttgcagtgattcagaagacaaagataaagatgaagaagaaagagaaaaagaagaagaagaagatattgaaaagacacttagtgtcatacttggtaaattcaaagagatttgtgcaaataacagcaagaaagcaattgggaagaaatcaatttcatttttgctgaagaagatgtttgtttgtagaagtggatttgctccagcaccgagccttaaagacacccttcagctccaagaatcaagaatggagaagcttttaaggataattcttcacaagaaaataaactcccaacattcttctcgggcattgtccctcaagaagcgcctcgaggacaggaagatgccaaaggaggatgaagctgaaaatgatgatggctgtaaatgggtcaagactgattctgaatatattgttttagagatttaa

SEQ ID NO: 112150 - DNA, 156 bp, Glycine max
  Peptide Sequence Number=SeqID_228928
ttgttgagggtgatgttcaagaatctgatgttgttcaggggaaggaaattagaggggaaactgctgctcaagtggttgacattggtaagttttttggaacccagaaggcaaggttgtacggttcgaaaggtttgagaaactggagaggtgaagctg

SEQ ID NO: 112151 - DNA, 243 bp, Glycine max
  Peptide Sequence Number=SeqID_228929
atgaaatataacattggaaaaaacctaactcttcttacatggtactctcatcctaaacttaagttaagcttaatcaaagaaaaagacatgcaagcttaccttggagaacacttgcaggccgcgacaactaaaaggcacgaggctgagctcacggtgctcagaaagtcagccacatgccacgcagagctagggggtgcgacttcctttgcggaggtgacggtgctgcgagagaaggaattttga

SEQ ID NO: 112152 - DNA, 573 bp, Glycine max
  Peptide Sequence Number=SeqID_228930
atggctggaacaacgaaagtaaacaaagactacatagtctttggacttcagtggcatgtgaggagtgtgtttgggcctaatgaccaaaggaagggccaatgggctatcaatacttgccccatcagcaatgactttgtccttaaagtcatgggaaggcaaaggttgctgcctgaagaagaagatcgttggggagctttggaggagaaggaggagggtcacgaacgaaatgcttgggcagagaagcgtggaacacaagatgaatccgggcatagctggggaggtccagaaacttctaagatcgagcaagagccacagaggtctggcaatagggtcggagcccaatctttgacgttgaagggtatggctgaccaaggtttgatcggtggaaccaataagatagtcagctttcatttggccgtcagtcttcggatgatgagctgtggaatatttcaattgagtgccctcgagacggaacagttcgtgccaaaacttactaaggaggatcctatcttgatctgtgacaatagaacggggcaacccatgaagtctataaatctcaacagagaagtgtga

SEQ ID NO: 112153 - DNA, 1353 bp, Glycine max
  Peptide Sequence Number=SeqID_228931
atgccagtaaaatgcatcgcagatgagattggaactcaaagagaaactcagaaccaggatacgtttaaacatgacagtaaaatgatgttgaagatgccacagcagtggacaaaaccagttaagaaaattgttagaatgaagaacaaggtcgaggacggctcaatggaaggcattacagacagatccagaggatggtactgttctaatactgtatggattgatggctgcctgaaatctgcctctatttacatattggttaatgggagccccacagctgagttcactcctcaaagagaactcaagcaaggggacccactagccccactcctattcaacattgttgcagaggggttaacaggcctgatgagaaaagcacaagagaataatctgtttgaaggtttcacagtaggaagaaataatgtggaaatcagcatattacagtatgcaaatgatattgttttctttgggacagcaacgatggcaaatgtaagagcaagcaaggtgatgttgaggaattttgaattggtatcagggttaaagataaactttgccaagagcagttttggggcgattggaatgcctgagcaatggatgaatagtgttgtcagttatttaaattgcagattgttttttgtaccatttccttatatggatatccctattggggcaaacccaagccgtagtgggacttgggatccaattgtcaataaatgtgagagaaaattgtcaaaggttccgaagaaggtggtggataagttggtgaggctgcagcgggatcagaagaagattgcatgggtaaattggggattagtctgtttaccgaaggagaaagggggtttgggaatcaaggattcagtgaaattcaattatgtctttctcggaaaatggcgttggaatttgtttcaccaccaaggagatttgtgggctcaagttttggactcaaaatatggaggatggaggaacttggatgagacaagaaggaacaacacagaatccctacggtgtgagacaaaatggaatgttgggtgtggatcaaaggtgatgttttgggaggacgggtggaaggatgatggtgtttcgctgatgaagtacccaagactctaccacacttctcaacagaagtaccaatatatccagcagctggggatgacatctaatggaggttgggaatggaaattgcaacggaggagattccttttggaagctgaaatagacatggctacaaaacttatggaggatatagaaggtctgattgtacaaactcagcgacaagacaattgggtttggcagggagattcaagtgggacatatacagtagggaatgcgtacatgttgcttgatagggattcgtag

SEQ ID NO: 112154 - DNA, 318 bp, Glycine max
  Peptide Sequence Number=SeqID_228932
atggggaacttggagcatactaggtattatgaacaactatcatggggtacttggagcatactaggtgcattgagggaacattttgttttgtttggagaaattgtgctggcacagaaggtaatgtatgaaaaatttggggatgattttctagttcattttgtatcgaaaggattttcttctgcacattgcccaccagatctggcagagcaatatcgtcaaaaattgcagggtggtgatttcaaggcactaaaatctttctatcagtcactagtggaaaatttgagactgcagcagaatggaagccttatattcagatag

SEQ ID NO: 112155 - DNA, 2193 bp, Glycine max
  Peptide Sequence Number=SeqID_228933
atggatgatctggagagagcgattcttgttatatttgatgaatccggaacccttgacgatgacttgaagaaacaggcagaactttactgtaatgatgttaaggagaagcctttaatttgtagattgtgcattgaaaaattatgcttttcaaatcttgttcaagtccagttttggtgcctacagaccttgcatgaagtcattcgaacacgatacttgacaatgaccccagatgagaggcacatgatcaggggctccgtcttttcaattgtgtgcctcgaagacaagaacctcacaagggttttggaaggccctgcatttataaagaacaagcttgcacaggttttgataactttgatttacttcgagtaccctttggtttggtcctccgtctttgttgatttttttccacatttgagcaaaggcaacgtggtcatagacatgttctgtagagttttgaatgccctggatgatgaactcattaatttggactaccctagaacccctgaggagttgacagttgcgggccgggttaaggacgcaatgagacagcagtgtgtgtgtcagatagttagagtttggtatgacattgtttctatgtaccggaattctgatcaggagctatgcactagtgtgttagattccatgaggagatatatttcttggatagacattgggttgatagtcaatgatgctttcatccctttgttgtttgatttgattttggttggtcctctgtctgttcagcttcgtggtgctgcagtcagatgcttgttagcagttgtttctaagcgaatggagccccaatcaaaactgtcattgttgcgaagccttcaaattagtcgggtacttaggttagtgaccgaggatggtgatgccgagctggtctctgatatagctgcattgctttctgggtatgctgtggaggctttggattgctttaaacacttaaattctgaggatgctaaaggaatttctatggagcttttgagtgaagtttttccctccattttctatgtaatgaagaattttgaggtagatgtcaatatcattcagtttctttcaggttatgttgccattttgaagagctttgctcctttgccggagaagcaactacttcacctgggacaaatattggaagttatccttgtgctaatccgttatgacccagcataccgcactaatcttgatttcatggacaaaattggtaaagaggaggaagataggatggtagagttcagaaaggatttatttgttctgcttcgcactgtgggtcgtgtagcgcctgatgtaactcagttgtttatcagaaattcgttggcaagtgctgtttcaagatcttcagatagcaatgtggaggaggtggaaggtgcactttctcttttatatgcacttggagaatccataagcgaggaaactataagaactgggagtgggttgttgagtgagctgttgcttatgcttctatcgacaaagtttccttgtcactctaataggcttgtcgcccttgtttatttggagacagtgacaagatatgttaagtttattcaggataatactcaatatattcccatggttctggctgcctttcttgatgaaagaggcatacatcattcaaacatcaatagcctgcaagatacagttgctcaattcactattacgaattatacgacagaagagctatcaggatcagaagatggtagccacatttttgaggcaattggtttattgattggaacagaagatgtcctgcctgaaaagcaatctgattatctatcttctttgctcagtcctctttgtcagcaggttgaggcactgctaaaaaatgccaagttattgaatgctgaggagactaatgctaaaattgctgtaacccagcaaattattatggcaattaattctctcagtaagggctttagcgagcgtcttgtaactgctagtcgccctgcaattggtctcatgtttaagcagacattggatgtacttcttcaagttcttgttatatttccaaaagtagaacctctgcgaaacaaggtcacatcttttatacaccggatggtggatacactaggagcatctgtttttccttaccttccaaaggcattggagcagttgcttgaagaaatagaaatgtttatgttttggggttgcaaggggcatttgaatgtgatggcattgagaatactattcctctaa

SEQ ID NO: 112156 - DNA, 1092 bp, Glycine max
  Peptide Sequence Number=SeqID_228934
atggttgctttctacatgaaacgtgacgctcttgaatggtaccagtggatgcacactaatcatcagctctctgattgggggcagccttttaagtggtgccaacatacctctgattctgattatcaacttcaatttgagaaactgtgtaaccaagtttatggtctcacacctgatgccattctcaattgtttcatttcagggttaaacccagacatccgccaagagctagctatattaaggcccacttccttttctaatgcaattgggcttgccaagttgattgaagataaggttaaaggtacttgttctcgcaccaatctgtgttccactcctacaagtgttcccactaccactccaaaggccaaacaatacttgctcctactcatggataaggacacctctgagtctactcctgatattctagcctcctcttcatctcacgaggacctagttcaggaaactcatgatacctcggttcatcttcagttatcactacaagctttggatggcacatcatcccttcaaagtcttcgcttccatggaaccatatggagaaacctgatgatggtattaatggacactggtagcttccacaacatcatgcaaccaagattggccaaacatttgcaacttcccatttcaccgattaaaactttccctgttatgattgtgaccacttttcacctattgaccattgcggacgaccctcctaacctttctagtcccactagtgaggttgtgttaactgattttcctccctttcatcaatacctaccagatcttcaggcccttttgcaaaattactctagagtatttgcaaatccctacaacttaccacccattagggcacatgaccatcacattcccttaattcctaatacccctctgttaaggctaaaccttataggcacccgcatgcctataaagaaaccatttttgcttgttaagaaaaaggatggcacttggagagtttgtgtggattattgggctttaaacgtagtaaccattaaagaccatgttcctatccctacaattgatgaattacttgatgagttagggaatgctactattttttccaagattgatttatga

SEQ ID NO: 112157 - DNA, 651 bp, Glycine max
  Peptide Sequence Number=SeqID_228935
atggattattcacaacaggtttctgctaatgctaggtcgttatacgaaatgtcaaatgagcaagggtcgctacattggcgcccggatgtagtgttaaatgagcaagggtccttacatttttctagacgaatgtgggtaaggaagctagttcagaagtgttcgataagatttgctactttgacacctaagtctatcgaggaggtggacaccatgattcagagaaggattaacattatgtgcctacaagagactaaatgggtaggagtaaaagccaaggagatggatattgcaggttttaagctttggtacacaggaaaagttagaggaaagaatggagtaggtattatggtggagaaggtttggaaagaaagtgtggtggatgtaaaaagaattcgagacagaatcttagccttaaaattattgatggcacaagagactatcaatatcattagtgcttatgcaccacaagtaggatcaaaggcacttgagaaggaaaaactttggcaagacttagaggggttggttcaaggcattctgcaacagaagattttcttaggtggggatctaaatggacatgttcatagtcagaaaaggcattttacaggtgcacatggtggttttggttttggagatctaaatgaggaaggatag

SEQ ID NO: 112158 - DNA, 609 bp, Glycine max
  Peptide Sequence Number=SeqID_228936
atggtgtacaaccctccaagcaataatccttgtggtgtaaattctcatggtgtattatggcataaatgttcacttctggtttctgtttcaaaagcacgtgcaataatagtccttgctgaagatgggaatgctgatcagagtgatgcccgtgctttgagaacagtcttaagtctgactggagtaaaagaaggattacgagggcacatagtggttgaattgagtgatttagacaatgaggtccttgttaaacttgtgggtggtgatcttgttgaaactgttgtagctcatgatgtcattggtcgcttgatgattcaatgtgctcgacagcctggacttgcacagatttgggaagatatacttggatttgaaaattgtgaattctacatcaaaagatggccacagttggaaggcatgcaatttgaggatgtactaatcagctttcctgctgcaattccttgtggaatcaaagttgcatcatatggcggtaaaattattttgaatccagatgactcctatgttctgcaagaaggtgacgagattctggttattgcagaggatgatgatacctatgccccagcatccttgcctacggtgctttgtctcacataa

SEQ ID NO: 112159 - DNA, 906 bp, Glycine max
  Peptide Sequence Number=SeqID_228937
atggctaacagtgataatttttacacactgagattagtttggagaggaagcttacccaaggactttgtttatccaaaatctccagagagaatacttttttgtggttggaggcgtgatatggaggatatgatcatggttttggatgcatctttagcacatgggtcagaactctggatgttcaatgatgttccagaaaaagaaagagaaaagaagctaactgatggtggccttgacataaatcgattggaaaatatatctctggttaatcgtgaggggaatgctgttatacgtcgccacttggaaagccttccattggaatcatttgattcaatattgattttggctgatgaatcagtagaggattcagcaattcaagctgactctagatctcttgccactctacttttaattcgtgacatacaagctaggcgtcttccttatgtatctatggccagtcaagctcacggaggaagcttctctaaaggctcatggattggggaaatgaagcaggcttcggataaaactgttataattagtgaaattttggatcctaggacaaaaaatcttatatctatgtcaaagattagtgattatgttttatcaaatgaacttgtcagcatggctttggccatggttgcagaagatcggcagataaatgatgtattggaggagctctttgcggaggagggaaatgagatgcatataaggaaagcagatctatacctttgtgaaggtgaggaattgaatttttatgaaataatgttacgagctcggcagagaagagagattgtgataggctaccgtttagcgaatgctgaaagggcagtcattaaccccccagtgaaaactgacagacggaagtggtcattgaaggatgtttttgtggtgattactgaaaaggaatga

SEQ ID NO: 112160 - DNA, 1104 bp, Glycine max
  Peptide Sequence Number=SeqID_228938
atgtccctggattcggagacgtcgggttccgccagagattggttcttcccgtcgccatccttcttgcggtcctcttcttcgcaatatggccgtcgattctattcaaactcaaagccgcactctcctccgagcagctccactcgcattcgtcatcgccgcagagttaaattcccccggactcctactaacgacaaatctcagctttccgacactgaaaatgttaagtcatcagcgactgcgaggaataatcttatctgcctttcgcaatttcgtttccagtttgccctcgtgggtgagattctcggccttaatcacagattacatgcgtgccacaagttggacaccttgtacgtaacaagttccatatctcaggacgtggatccttggtcacgtgaaaactttaaaagaaatctagctctttttttctcgttcacacttctttttatccctctcctcattttcaagtacataggctttgtatcaaaatcaagattttccgacaatatatcagaacaagtttctctaaacaagcaaatagcatatcgggttgatgtatttttatcggtttacccatatgctaaaccactcgtattgttagtggcaacgctcttgctaatttttcttggaggattggccctttttggggtaactaccgaggatttagcacattgcctctggttatcttggacctacgttgctgattctggcaatcatgccagctcccaaggtattggtccaaggttagttgcggtttccattagctttggtgggatgcttatatttgcaatgatgcttggacttgtgtccgatgcaatatctgagaaatttgactcactgaggaaaggaaaaagcgaggtggttgagcaaaatcatactttaattcttggttggagtgataaattgggttcattactaaatcagcttgccatagccaatgagagtctgggtggaggaactgttgcagtgatggctgagcgagacaaggaagaaatggagcttgacattgcaaaaatggagtttgatttcaaaggaacatctgtcatatgcagaagtggcagccctctgattctggctgatctgaaaaaggtgtacagtctactttaa

SEQ ID NO: 112161 - DNA, 453 bp, Glycine max
  Peptide Sequence Number=SeqID_228939
atggccagtatttgcttccagaaaagttcttggatgcggtgttttggacggttgacatggccaaggatatcagagctaataatatctagctttctttcaaaacttcctgactttcagaagatcattgtatgttcatctgaatttgaaaaatgcaatgggccatttggatggttgcagtgcttttccttgacttacagtcgggaaagtgattttgaggaaggaaaccacttctatagattctttgaccacgaaccgcttatctccaaatgctttaacttccgtggtaccactaatgatagtgaaccgaaggctgcggctgcagtatgtcacatacaatacactaagttgcttgtgaatgcaaaacattccgaggatttactctatatgcatgttgcaaggctgcatgacctttgtatccctgtgtaccacatccctggggtttgctcattctaa

SEQ ID NO: 112162 - DNA, 534 bp, Glycine max
  Peptide Sequence Number=SeqID_228940
atgaagtacatgtataaagagcaaaatcctggggatggtaaagtggagtattatttcagtgatttaaacttagctactaccgatcatttgatgaggttcgtcaacaaagatccagaaggttttgtgcctatatctgttgttgcatctttcaagaagattaaggccctcatagcgagtcattcccaacttgcaactgttttaaggaactcgtcaaagcttgtggttagtgaagatggaaagaaaatcaaacgccagtatcccctgactgagtctgatatagaagagatacaatctcgcattgttgtagctgaaaacctacctgaggatcattgccatcagaatcttatgaaggttttctcagcagttgggagtgtgaagaccatccgtacctgtccacctcaaacttccaatagtggggcttcttctgcttcaagattgggaaaagttgatgggatgcctttatctaacaagttttggtcacatgagcttggctgcacatcaataattaaattcaggcctgttttgctattttga

SEQ ID NO: 112163 - DNA, 204 bp, Glycine max
  Peptide Sequence Number=SeqID_228941
atgccatgccaattgggaggtgttgaagataagaagggcttggaagaggatgacacaaattctgatcacaatgagtcctctcaagaggtaaagcaaaggtggactcaaagaggaagcactcgcgcggcttcagaggatgcagagtcaaggaatggagtattggagcccgatgaggtcaccatggggattgctgttctcttgtag

SEQ ID NO: 112164 - DNA, 1320 bp, Glycine max
  Peptide Sequence Number=SeqID_228942
atggattgctctagattcgcttctggaaagagtcgtaggccattgttaccagactttgcttgtaaagtggcaattcccggtaaactaactttccaaatgtttttttcacaggagatggctccgaagaagctttccacgaagaggtccagaaaggaccccactggagaaagctccagcgctgcctcgggttttgaccggcaccgatttcagagtgctgagcatcaacagcgctttgaggccatcaagggatggtcattccatagagagagaagggtccagcttagggaggacgagtaccctgatttccaggaagaggtaactcgtaggcgctgggcaccacttgtgacccccatggctaaattcaacccagagatagtcatggaattctatgctaacgcctggcccaccgaggaaggggttcaggatatgcgcttgtgggtgaggggtcagtggatccccttcgatgcagacaccctcaaccaattcttagaccacccgctgatcttggaggaaggccaacagtgtgaatacggccaggcttctggctttgacgatgaggctattggtgtggatcatgcacaccagtatgaccaccctgactcagatatggatgacgttgctgctaagcaacatcctgcccagcgatcacaacttcgacctccccctaccgaagtgtcagctggtgtatgccatactggcacggatgagaacggcgcctatgaggcaccctttggacctggagaagtccaacagggccctggggttcccagctctgatcatgggcctccactagtcatcggccgcctatcaccagagccttcatcgagaagtactgcaccccaaggcaggcatagggtgaggcaccacatcaacttggagaggatcagcagcaggcaacagacgcaccgccaccaccttcggagtccacctcagcttacctgcagaggttggagcactatatacgacatgtggccagccaacaagcgtccaaccaccggggataggtgcggctgcatgagtattttcaccagtacaccctcagctagcagggctagggttccaccccttacatatgtcctacttcggagcagtttagggctacggtcgcatggcttggagactggcccgatactcagacaggggcaggacctgcagggacccccggagatgcggatggagcctaggaagatgaggatatggctaacttgctcgacttcctgggagggagcggagccacatgaccgagatcgccagacctgtgatttctcctcatctaacattactgctttcagttattttgttatttccattgtgacctaa

SEQ ID NO: 112165 - DNA, 1086 bp, Glycine max
  Peptide Sequence Number=SeqID_228943
atggagaaacagagcagttttcgagcatctacaatggaaaagcagaagagttttcgtgggtttatggaaaaacagaaaagttttcgcattgtgatggagaagcagctcagcttcataggaagtgaaaggaagaagaacaaggaatcacctgggaaacgtggtgacttaccaattcatttagcagcccgggcagggaacttgagtagagtgaaagagataattcaaaactattctaattatgagacaaaagatttgttggcaaagcagaacctagagggggagacccctctttatgttgcttcagagaatggacatgctttggttgttagtgagatactgaagtacttggacctgcaaactgcttctattgcagccaaaaatggctatgatccattccatattgctgcaaagcagggccatcttgaggtgctgagagaactactgcactcctttcccaacttggccatgaccacagatttgtccaactcaactgctttacacacagctgcgactcaaggtcatattgatgtggttaatcttcttctggaatcagattctaaccttgctaaaatagccaggaataatggtaaaactgtccttcactctgcggctagaatggggcatttggaagttgtgaaagctttactgaacaaggatcgaagcactggatttaggactgataagaaaggtcaaactgcactacacatggctgtgaaagggcaaaatgaagaaattttgctggaattggtaaaacctgacccagcagttttgagtctggaagataataaaggaaatacagcattgcacattgccacaaagaagggccgtactcagccattcagtgggttcaaccctctcttcttgggaaattctttcatgtgtgaacatgaatgccaccaagatgagttcaattctgaagatgcgccatcaacaactaataagaaccttgggagagccacaccacaaaagctagcttttgtagttggtgtcttggagagccctaggcctataaacctcacattagattcccatacttccaatgtgggactcaagtcccaaaccttggaagttggaattggatcctag

SEQ ID NO: 112166 - DNA, 1171 bp, Glycine max
  Peptide Sequence Number=SeqID_228944
atggcggatggagggcactggaggaaggcacaagaggaaatcatgattccacatggtgaaaagttaagattctgggaggatccttggacaaacaccagtatgccactaatggaaaaatacccaaggctgtatcacatctcatgccaacaaaagacaaccattatgcgaatggggagcaacaacaatactggatgggaatggaaactcacctggaggagggatctctttgactctgaagtagaaatgacggatacttttattgggaaaatatcacagcatcatgtacagccttacagggaagataactggatatggaagcatgatcaaagcgggaattactcaacgaaaagcgggtatgacctgatatggagagagctaatgggggcaaaccagaattcagactttgcggacctatggaagctaaaaatcccagccaaagcagctatgtttgcatggaggttaatcagggatagactaccaaaaaagatgaatcttagaagacgacagattgcaaagcgcttagaaaaatttcagacaacaatcttcactcaaatgaggttgcttgccatcaaacatggagccataaaccttggtcaaggctttcccaactttgatggtcccaaatttgtaaaggaagcagcgattcaggcaatcagggatggcaaaaatcagtatgcccagggttatggagttgcagacctgaacattgccattgctaacagatttaagaaagatactggacttgtggcacacgccttcctcactttcacaattgcccatccttttcagtgtgctgctgcagcagctctgagagcaccagactcttactatgtagagctgaagaggaattatatggcaaagagagctattttggttgaaggccgttggcttcaaggtcaccccttttactttaatccagaagagggaaagaatctaatcagatttactttctgcaaggatgacgaaactattaggtctgctattgagaggatgaaaacgaagcttcgatcaaccataacgattaatgtgggcgcggtgtttaagatagggagagggggcacaacagtggacgttggagctgcggctatagctagagtgtttggttcaggaggttcaattcggaaggtcgaagcctacgggcaagctgagaaacaaagacgggcttatggtg

SEQ ID NO: 112167 - DNA, 1764 bp, Glycine max
  Peptide Sequence Number=SeqID_228945
atggttaatgtttatggacaagtaaatgaatcattggctatttcaaatgttgtagagctatttaaacttgtttttttaagcacctcaacagatcctcaggcacccaaattactagatgacattcttcggcgatactcacagcatgatctatttgctgcttttaactatcttaaagagaaaaaagttatggttgtacatccttgtgtatttggaaaaatacctaatacctatttaagctatgaaattcacttcaaagtcattggtagccacacactcttggaacgtgagtttgagcctaactcaatcccaaaaactagctcatggggcgaggattgtcttccacttatatattctatcttggcactatctttagccgatgttgggggcactggcaatgaacgtttcgaactatcacaacagttcttgcagagtgtttccaagtcaccatttccatttaatactggaaagcaagctgttaaattttctgcatggttggaggaaagaggcaaagacctcacagaagtgggcactaatcttgctgaagatctacaatgtggggacatttttcatttgtttgctttagtctcttcaggtgaactttcaatttctccattcctaccagataatggtgttggagaggctgaggacttgagaagtgcaaagcgtaaatctgatactaccgagtcttcatatagtgataaagccaaaaagtcaaaatccttctttggagtagaaggtgaaattatttctcgtcgggaaaaaggttttcctggtatcatcatttctgcacaccgaacaacaatttcaagagctgatattttaaatttgttcaaggataatgataactatggccaaccttttgagggagatttccaattaaacattggccaaagcagtaattattcacttcctgaccatatcttggaaatcactaaatcttctgaccctgtacctctagaagaaaatcatagtgaatcaccctgggaagctatggcaggctatgcacgacatttgttgtctgaatattccaataaaaaacatgcatatgccatttgtgctgaggtcttcagggttgtttatgctgccatccaaaaggctggtgaccaaggattaagcatgggagaaatttcccaggttataaacttgccaggagcagaggtagatgtcttgattgttgatgctcttcaagcatttgggcaagccttaaaggtcaatgcttatgatactgtccgtgttgttgatgtcttataccgtcacaagtactttttgacacctatgtctgattttcatcttcgtgttgtacaaccttcctcaacaaaaaacatcgagaaaagtgatcatacatgtgagctttatgaatcggaggaaagggatactacttctgttgatacttcgagggaaagaaacaccgctattgatagcgtgcacaaattgacaattctcaatcttccacatggggatgtggatcctgaaaatcaagcttgtgataggaatgaaggctgtaagcaaaacagacttgggttatccagagtcaatcataagaaagaaactctcgaattttcttctggtgaatcatgtgtgccaatattgccatgggtcaatggagatgggaccatcaacagcattgtttacaggggactcagacgtcgtgttcttggaatagtgatgcaaaaccctgggatattggagatttctaacagaataataaaagaagataagaaggatattttgagagagagagggaacttgggaagcaagaagtga

SEQ ID NO: 112168 - DNA, 198 bp, Glycine max
  Peptide Sequence Number=SeqID_228946
atgacacccgtcgaccccagcaagttcatcaggcccctattaatcgggctttcatcaagaagtactgcgcccccaggcagacgcagggcgagacaccacagtagcattaggatggccggtttgagtattgcctacgacacatggccgaccaataggcaaccaagtccaaagccaaaggacgcacctagttgctcatga

SEQ ID NO: 112169 - DNA, 195 bp, Glycine max
  Peptide Sequence Number=SeqID_228947
atgagaagtgacttttcatcgaaagccatgagaagtgagtcttcaccaaggtttaagggatgtatatcattaaaaggtatatctttatttttgcagtggcgtctccaatcatcacaccttgaaaaaggtatgtatgtcttcaacaccccaatcccaaccaatagggaagatgagatcattgctaaagcccgttag

SEQ ID NO: 112170 - DNA, 325 bp, Glycine max
  Peptide Sequence Number=SeqID_228948
gagttgtgttgatccctcagggaacaatccagacacgggtgactcagacaaatgcgggttgtacatcgaagaaaattctccccacctggtttccctaggaagagtttatgagagatccacaactgttcacagcattcctttgttgcatgatcaagtgaaggtcggagttgaggaggttaaagatgtagatgctccaattcctatacccactaacgagggagctgtaggacctgcaaaacctggagataggccgatcataaggcatctgactgagacaagtatgcgagcagggaattccgatgtgtatggattcctcaagccatag

SEQ ID NO: 112171 - DNA, 198 bp, Glycine max
  Peptide Sequence Number=SeqID_228949
atggctgagtataaggcgtgcacccttgggatccaagcaacaattgacttcaaggtcaagttgctcaagaagaagagcaagatggtaaaccttggtactttgatatcaaacgatacatcgaggacaatgaatacccatgggaggcctctaacgatgacaagagaacgttgcgaaggttggcagtcgactttttcctaa

SEQ ID NO: 112172 - DNA, 477 bp, Glycine max
  Peptide Sequence Number=SeqID_228950
atgacagatcttgtgagcgcggaagatgacggcgcagaagacgacgttagtctctgcgtgctatcaggctttttgtcttacagacaacaaaaactttatacggataaccactcgggtatttccgccagtcagcgtgactcaaaagtcagtatgacagatcttgtgagcgcggaagatgaccaaaaagtttatacggataaccactcgggtatttccgcccgtcagcgtgactcaaaagtcagtatgacagatcttgtgagcgcggaagatgatggcgcagaagacgacgttagtctctgcgtgctatcaggcttttcatcttacagacagcaaaaagtttatacggataaccactcgggtattttcgcccgtcaccgtgactcaaaagtcagtatgacagatcttgtgagcgcggaagatgacccaaaagtttatacggataaccactcgggtatttccggccgtcagcgtgactaa

SEQ ID NO: 112173 - DNA, 216 bp, Glycine max
  Peptide Sequence Number=SeqID_228951
atggtagcatcccacataacctggagaggcttcaaatacagttgcgggatggtcaatgttgtcagctattgtaggtcttcaggaggcatggaggaagaactgcaggatgttcgtggagccaatctgaagtattgctttatggtgacactggctccagcagcacggacacgactagggtgctctggtcgcccaatggcagcagtcaggacatcctga

SEQ ID NO: 112174 - DNA, 315 bp, Glycine max
  Peptide Sequence Number=SeqID_228952
atgtcgccgcatgttctctatctttacgcgttttctagatttctcccggggacagtcggtacgttgtatctcgtggggcaggatcactttgggctaccctctggagtgaagacaaaacatgaatggcagaaacccagtcaaggtagggtacttaaggatgaacgcaagcgggatggggtcacgaccgaccgatcgttgctcttctctgtgcgaaacaagcagggaatgtcgctgcaaggcagccccgtatcctttgttagctcgcctgggcgagctgggctcgcctgggcgagccacccctgcaccaaaatataa

SEQ ID NO: 112175 - DNA, 675 bp, Glycine max
  Peptide Sequence Number=SeqID_228953
atgacgactgccatcatgctggtgatgcttgcagtgaccagtttgttgttgctggtgatgcatgcgcgtgctcaagctggcctgcaagccattgcgacgctggatggcctgaccggcgtgttgaaccgcagaggtttgcaagaggcggcggcgcgtatgcaggcggtttcgcaacggctccggttgcccatggggatgctgatggtagacctggattatttcaaaaaagtgaatgatgtgtatgggcatctggtcggagatgcggtgctcaagtcttgcgcaggcaccatacgtgccgctttacggggtggtgatgtgattgggcgctatggcggggaggagttttgtgtcctgatgccgaatactggcgaacaagaggcgatgatattggcggagcgtatccgccgtattattgaggtgaccccggtcagtattgctggcgtagaaagtatgcgtagcgagacacaagccatcaagtgtacggtcagtgtcggtgcggtgagttcagaaaccgttggctacccgctggagagcctgttctcggctgccgatcaaaacctgtataaagccaaacagaatggccgtaaccgtattgtcagcaatgttggccagtcacagcctaacccgacggaagaggggaagcctgcaaaacggcatgccagcttactggcctag

SEQ ID NO: 112176 - DNA, 351 bp, Glycine max
  Peptide Sequence Number=SeqID_228954
atgacagaaaccgtttgtacggataaccgcttgggtatctccgcacgtcacctaacttcactggtcaggatgacagaaaccgtttgtacggataaccgcttgggtatctttgtacgtcacctgacgtcatgggtcaggatgacagaaaccgtttgtacggataaccgcttgggtatctctgtacgtcacctgacttcacgggttaggatgacagaaagcgcggaagacgatgtcatgatagcagaaggtggggtggttgacaaaagcgagacttttgctcctacgtatcctccatttttgatgaagaactcagagctatgtagttctttcttttgtgttgtgctaggctaa

SEQ ID NO: 112177 - DNA, 864 bp, Glycine max
  Peptide Sequence Number=SeqID_228955
atgagtgaccccggccggggaaagaaagtttctacgggatttcccgtagcggtgaatggcgatgcgcgtgcctccggccgcggcgggccgccggcacgcgcacaaggcgccaggcgggcgctgcccgcggcaggaaggaggcgggcggcctcagggcttgcgcggcgcgggcttgaggcgcgagggcacttcgtccaggtcgctgcacacggccagcacctcggccggtttcttgctcagcgacaggtagacatggccgatgccgctgtcgaaataggcggattccagccggttcagcaccacgctgtcgccgttctcgaactggatgcgcaccttgcccgacagcaccagcgcgaactcctgcccgggatggcggatgtagtcctcgaactcgacgacctcgcgcgcgtcgatcagggccagcatgggcatcatcttcttgcccgggtattcgcccatcagcagccggtagtgatagttctcggtggcgtagtcgcgcgcgtcgctgagcttgttcttgacgtaggtgggagccacctcggcctgggccgcgtcgcccagcatgaacatgcgcgtcatgtcgatgcccagcgcccgcgccagcgcggcgaacttctcgtagctcagggcgatctggcccagctcggccttggacagggtcgagaccgcgatgccgctggcctgcgacaggtcttgcagggtcattttccgggccttgcgctcggcgcgcaggcgcgcgcccatcacttccttgcccacgatgtcgggtggggccgtattgcgagcggagggaggggccatgtagcggtttgcgtccagggttgggagggggcggcacgccgccccgttcacgccggattgtaa

SEQ ID NO: 112178 - DNA, 441 bp, Glycine max
  Peptide Sequence Number=SeqID_228956
gcaaagtttgatatcgcagaagctacgaaggtgaagacgaaggttatgtcaacagtagcgacgagatggcgacaatttaagtccacattgactagcaaatttgtgtttgctaagagtgaaggtcaacaaacacaggatgttgtgacaaaatatggactagatcctgaagcatggaaacaatttgaagaaaaccggctcacacctaactgggagaaattgttagaccagaaacgaaaaaggatacaagaggaagcattgttgagtgaaaatgcagcaagccttgatgaacccccatctccaataaaaagacatgttaagtggaaggttgctcggaccagggctgttggcaatatgacatctgagtccgcacaggaaattgcagataaaatagtaggttcaccaatatgttgcaatgttcatatgtttaagtattttgagtag

SEQ ID NO: 112179 - DNA, 108 bp, Glycine max
  Peptide Sequence Number=SeqID_228957
atgccttatacagattacatgaagcctgataccgagacatacaattgggttattcaagcttatactagagttgaatcttatgccagatttcatgaagccagctcatga

SEQ ID NO: 112180 - DNA, 294 bp, Glycine max
  Peptide Sequence Number=SeqID_228958
ggccctgttggacttttccgggtccactgggtgtcttgtggggggagattggcgttgcggtcgctgggcagaatgttgctaagtagcaatgtcatctatatctgtgtaagagtggtcatgttggtgcgcatgatccgcactcgtctctttgcaacggcacgggtgaaatcttgccccggtatgcatagtagctgtgtaatagcctccctctctggttgtgctcgcacagttggccctcctccaatatcagggggtggcccaggaaccgttaaaaggaaactactggccccttaa

SEQ ID NO: 112181 - DNA, 207 bp, Glycine max
  Peptide Sequence Number=SeqID_228959
atgaaaggaagggcagaaagaacactggacaaggaagaggatgaagagcacgtgatggaagaagcaagggaattaaggagaggggcccggcccaaaataccaaattccaaattaaaggatttctattggcataaggaacaacacacgcatgaaggagcttacaggggatgtcaaaaggatcctgaagatgatggaaaaccgcaataa

SEQ ID NO: 112182 - DNA, 918 bp, Glycine max
  Peptide Sequence Number=SeqID_228960
atgaaattcattgacatgggcaataaccaactttctgacgcaataccagattggatgtgggaaatgcaatatctaatggttcttcgtctaagatccaacaatttcaatggcagcattactcaaaagatttgtcaactttcttcccttatagtgctggatcttggcaataacagcctgtcaggatccattccaaattgtttgaaagacatgaagacaatggctggtgaagatgacttctttgccaaccctttaagttattcatatagctctgacttcagttataaccactacaaggaaactcttgtcttagttcccaaaggagatgagttagagtacagagacaatctgatattggtgagaatgattgatctttcaagtaataagctgtctggagcaattccatctgaaatttccaagctatctgctttgcggtttttgaacttgtctagaaatcatctgtctggagggataccaaatgacatgggaaaaatgaaattgttagaatcccttgatctctcactaaacaacatttcaggtcaaatccctcaaagcttatctgatttgtccttcctcagtgtcctgaatctatcatacaacaacttatcaggcagaattcccacgagcacccaacttcagagctttgaagaacttagctacactggaaatcctgagctttgtggtcctcctgtaacaaaaaattgcacagacaaggaagagttgacagagagtgcttctgttggacacggtgatggtaatttctttggaacatcagagttttatatcggtatgggagttggatttgcagcaggattttggggtttttgcagtgttgttttcttcaacagaacttggaggcgtgcttattttcattatcttgaccacttgagagatctgatttatgtgataatagttttgaag

SEQ ID NO: 112183 - DNA, 360 bp, Glycine max
  Peptide Sequence Number=SeqID_228961
atggcagaatcgtcaaagaaacgtaagggttcatccacctccgcttcggcttcaagagctcatcgttccgaagccactagcgcatccacagcaccaattccaccctcattatcctcttccacattgttttcttctgaagaacagcagaaacggtattcaaatcttttctcatctcgttccattatcgaccctaagtttattgatatggaattcttttctgctgaaacttttgattgcattcaagcctttcagaacctaggtcttatacctttaatgtcattacaattgcctgtttatcctgaattggttaaagccttttattgtaatcttgaaattcaggacagcactttaaatttctga

SEQ ID NO: 112184 - DNA, 375 bp, Glycine max
  Peptide Sequence Number=SeqID_228962
atggtgggttacacaccttcaagctttgctaatttagttttcgctgatgaaaggatcgaagtgggtctgaaaagaggcaaatttaatcatcgtgcttggacgaatgagaaaactggggcaaatgaagagggtgagaatgagggagaaacccatgctgtgactgtcattcctatacggccaagtttcccaccaacccaacaatgtcattactcagccaataacaacccttctccttacccaccacccagttatccacaaaggccatccctaaatcaaccacaaaacccgcctaccacacaaccaatgctaaacaccacctttagcacgaacacaaacaccaaccaaggaaggaattttgcagcaaaaagcctatag

SEQ ID NO: 112185 - DNA, 242 bp, Glycine max
  Peptide Sequence Number=SeqID_228963
gtgcggataaccatgaggtatatccacgtgctactggacccttgagtctaacggatagcaaaatgagactttttcgcaatctcgaccagaagacgctaacatctccggaaaagtctcggccggaagacgctgacatctccgggaagtctcgaccggaagtcgctgacatctccggggaaggtgcagatgacgattctcggccggaagacgctgacatctccggggaaggtgcagatgacgat

SEQ ID NO: 112186 - DNA, 300 bp, Glycine max
  Peptide Sequence Number=SeqID_228964
atggagttatttgccacaatttgtgacaataataactcacaaaacaaccaacatgactcaacctccaatgttgaggacctattatatgaatatgagaattgttgggtcaaagaccatggtagtgatagtgactcatctttcgggccgaaaggatgcaacatgtctccttcccatgaaccaatatgcaaaagaagttggcagcagggtaaaatcacagtcaaaattgacaacactttgcaatttacccaagtctctgaaaaagcaatacatgtttcaccaacaaaactaacattgaattga

SEQ ID NO: 112187 - DNA, 216 bp, Glycine max
  Peptide Sequence Number=SeqID_228965
atgaaaaatggaaaccatgaagaggaaatccaaacgggagagaattcagaggtcacaatggaaatggaaatcggaaaaatgcaaaggcatgaacactgcagagccaaggccaactcgaaaagacaaaacaataagtgtagcgttggtggaaacaaaaaaatgagggaggccagtgcacgtacacacaaaatgacagaaacaacaaatgcagtgtga

SEQ ID NO: 112188 - DNA, 159 bp, Glycine max
  Peptide Sequence Number=SeqID_228966
atgcatatgacacagatgcaatttacgaatacgggagcccgagaaactgtctccttcttagatacaacgtctaggggtagcaaagtgccccaacaggggatcaacccagcacccatgtgcgatgcatatgcgaaaggcgcaacacgggaatgtacatag

SEQ ID NO: 112189 - DNA, 309 bp, Glycine max
  Peptide Sequence Number=SeqID_228967
atggatcaagaaaaggttcaagcagtcctgaattggccatatcctataaatctgaagcaattgagaggcttcctcggtctggctggatactacaggaaatttatcaaaggttatgtgtcaatcgcaactcctttatccaatctgttgaagaaggaaaactttcattggaatgaccacacttccatggcttttgacaatttgaaagctgcaattaccaaggcaccagtactggcattgcctgatttttccaaagcctttacattggaaactgatgcctctgttataggcattagggctgtattgagttag

SEQ ID NO: 112190 - DNA, 225 bp, Glycine max
  Peptide Sequence Number=SeqID_228968
atggaaaagaaactgagccagttctctaagaacaaggaaatgaatccttgtagcaagacaagacttgaagccataagaatattcttagcctatgtagcacacaaagatatcaaactatatcaaatggatgccaagagtgtctttctgaaaggattcacaaatgaagagatgacatcatctttgatgccacctcagaaaggatgtgcaacaagttttttgagctaa

SEQ ID NO: 112191 - DNA, 1827 bp, Glycine max
  Peptide Sequence Number=SeqID_228969
atgggtgaattatttggcgttgggaaaagaagggacatcatcagcaacaacaacagtgctagtagtagcgttcttgggttggatgtgaaggtgcagagccctgaagtattattccataataggatgaccatgatggggcatcataatcatcacctccatccattgtcatccccctttgataataataacgatatttcctgtgctgctggtgatggcgatggtgatggtcccacgacttacatgtctctcactaatcatataaaccttgttagtggtgcttctgttcttggtcctgctattgatggtggctgtggtgctgctcctgctgcacctgtaagaactttgcagccttttcaaatttcttcttatacttctcccaccaccactaccacagccttcgaacccttttcaggtgtgatggcggcttcattggggtttcccttcacaagtgcacaatggagggagcttgaaaggcaggctatgatatacaagtacatgatggcttcagttcctgttccacctgatctcctcattcctacttcactcacatcctcttctcgctcttcctgcatggatggtggtttcaatctgaggttggcaaatagcactgaccctgagccaggtaggtgcagaagaacagatggaaaaaaatggagatgttcaagagacgtggctcctaaccacaagtactgcgagcgccatatgcatagaggccgtccccgttcaagaaagcctgtggaagttaacaccaacaccactcccactagcatcaacaacaacaataacaaccaccaaatcaaaagggctcgccatgagtgtaataatccctttgctacacctgatgttgctgtggctatttccaatcccacttccagaaaaggtgaatcttcatcccattttcttgggtctactaccactcagccataccttaaatctcccctctgtcttgctaacttcggtctcaaagctgcgagttttgactccgtggcttctgtttctgcaaataaggaacccaggggtttggagtggatgctgaatggagatcctatttccctggatgcttctaactcccaatggcagtctctgatgcataataaagttggaatgagcagtgttagttcctgtaataccaccgagtctcagtatctgaattcatttgcactatatagctctggactggaacaacagaacagacgccatcctttgttcctgaatcctcttcttgttcccatgaaaaatctccaaccagagaaaccaaggggtttcattgatgcttggtctaatgcagaaacagctcaaagcaatgccaacaccaacaacaagaactctgctgcatcaattggtaaattatccctctcttctcttgatctatcaatggggggtggtgctgtgagtgaagatgttgataatgttaacatgggtttgggactaatggagacttatggaaaaacacacactgatactaaaatctctctctcaaattggcacaacccggcaccttgggtggcttcaagttcaacacttgggggtcctctagctgaagttctaaggtcaagcacagtcactgccacgaccaatgaagcaacctccaacgcaacctcatcaccagccaccactacacatgctgaatctaacagccctctgggaacaatggtgtcatctccatccggggtgttgcagaaaacccttatttcattgtctgatagcagtaacaatagcagccctacggttgcatcatcaagggccaattctgagatggccttcctcaggcccctatggcctattgttgaggacgctttaaattctagcttcatggaaacgtcatga

SEQ ID NO: 112192 - DNA, 810 bp, Glycine max
  Peptide Sequence Number=SeqID_228970
atgtcaagctttaaaaaatgttcgacaccgaaacctagtgaaggttatcacttctgctccagccttgattataagggagaggaattcaaggcccttgttatggaattcatgcccaatggtaacttggacgtgagtctataccccgaagatgttgagtcaggatcctctctaaccttgttgcaaagattgaacattgccattgatgttgcctctgctatggactacttgcaccatgactgtaatccaccggtagtgcattgtgatatgaaacctgccaatgtccttctagatgaaaatatggtagcacatgttgcagattttggattggcaaggtttctatctcaaagtacatcagagatgcagagtagcactctaggactgaaaggatcaataggctatattgcccctgaatatggtctaggagccaaggcttcaactcggggcgatgtgtatagttttgggatcctactgctagagatgttcacagccaaaagaccaactgatgaaatcttcaaagaaggattaagcctaagcaaatttgtctcagccatggatgagaatgaagtactaaaggttgccgatcgaagtcttattgttgattatgaatattcaactcaaagctctatcaccggtgatcaaagcagtggcattggcagcaacacacattggattcgtaaagctgaggagtgcatagctggtgtgataagagttgggttgtgttgcacagctcaagaacctaaagatcgatggagcatgagagaggccataacaaaattgcaagcaattaagcactctatgttggccttgtga

SEQ ID NO: 112193 - DNA, 504 bp, Glycine max
  Peptide Sequence Number=SeqID_228971
atggtggaagtgcttgaagatttcaatgaagaggaaggtttattggtctcaccacttgttaaagttgatgcttttaggacagtgtttcacaggcacagccatgatcagggaagaaagattcctaaagtggagatatttcgattctctcatcaggttcctaattacttgcttaccgggcaagaagctcataatgctccaaagggctgtcgagagttggatccagcagctactcctttagaccttcagacaacaactgaagaggtgttgaataatgtcggaaaatcgaaggaagacacgttccccgggtcacctgaaaaccatgatgctggtaaagggaagaatgcttctaaacataatatagaagctatattagacgaggatgacaacgaaggcgagatccctgcaaccaccacaatgatgacattgaatgaagccaatgaagacatgcggcaaaggcgaaaccactgcaacggtggagacaatggctctacttctctttgttag

SEQ ID NO: 112194 - DNA, 1951 bp, Glycine max
  Peptide Sequence Number=SeqID_228972
atgatctacaatattcgacatattttgctcctatttttcttacttcataattttcatgacatactatgcaacaatgacacagacaaagatgtccttctttcattcaaatcccaagtgagtgaccccaaaaatgttctgtctgggtggtcttcagattccaatcactgcacctggtatggtgtcacatgctccaaagttggcaagagggtccaatctctcactctaccaggacttgccctctctggcaaacttcccgctcgtctttccaacctcacttacctacactcccttgacctttccaacaactattttcatggccaaatacccctagaattcggccatctcctacttctcaatgtcattgaattaccttacaacaatctcagtggtacacttccaccacagctgggtaatcttcaccgtctacaaattttagacttttcagtcaataatctcacaggtaaaattcctccatcatttggcaatctctcttctcttaaaaaattttccttggcaaggaacggtttggggggtgagattccaactgaacttggtaatctccacaatctttccactcttcaactctctgagaacaatttctctggcgagtttccctcttctatcttcaacatctcttccttggtcttcttatccgtgacaagcaacaatttatcaggcaagttaacacaaaattttggaactgatcttccaaatatagaaaatctatttctggctagcaatagattcgaaggggtaattcctaattccatatccaatgcctcacatcttcaatacattgaccttgctcacaataaatttcacggttccatacctctattccacaacttgaaaaaccttaccaaactcattcttggtaataactttttcacttccacgacctcactgaattctaagttctttgaatcccttagaaactccaccatgttgcaaattctgatgatcaatgataaccatttgactgggggccttccaagctctgttgctaatctgtctggcaatcttcaacaattctgtgttgctaacaatttgctagctggtacccttcctcaaggaatggagaaatttaaaaatcttatatccttgtcttttgaaaacaattctttcactggagagttaccatcagaaataggagcactacataatctagagcgacttgcaatatacagcaacagattgtcaggggaaattccagacatttttggcaatttcacaaatatgtttttccttgcaatgggaaataatcagttctcgggtagaatttacccaagtattggacaatgcaagagattaacttttcttgacttgggaatgaatcggctaggtgggtccataccagaggagatttttcagctttctggtttaacagccttgtatttagaaggaaactctctgcatggttcgcttcctcatgaggtcaaaatcatgacacagcttgagaccatggtcctctctggcaaccagttgtcagggaatatttctaaggaaatagagggtttgtctagcttgaagtggcttctgatggcaggaaacaaattcaatggttcaatcccaaccaatctagggaatttagcatcccttgagactttggatttatcatcaaacaatctcaccggtcctattcctcaaagtttagaaaagctccagtatatacagacattaaatttgtctttcaaccatttggaaggggaggttccaatgaaaggtgtttttatgaaccttaccaagtttgatcttcgaggtaacaaccaactgtgcagccttaacaaggaaatagtgcagaatttgggagttctcctgtgcgttgttggcaaaaagaaaagaaatagcttactccacatcatccttccagttgttggtgctactgctttgttcatttcaatgctcgttgtgttttgcacaatcaagaagaaaagaaaggagacgaaaatca

SEQ ID NO: 112195 - DNA, 911 bp, Glycine max
  Peptide Sequence Number=SeqID_228973
atgttggtaagaagggctcaattgaagaaagaccttgatgaggaggctgcagatcccctcaagttcagattcgtattcattatacacaatgttccttattgtgctcaaaaggagttatatagttttgaagggagcgtaggttacagaataagcagtaacatcagtcttagcaagttctatccgatcataggttttagtctaattgagcctggcgggatatttttaggtaccgatgacaaaggtgctccaattgctatcaatccttacttgtcggtcaacgggcgccagaacccacattgggccatcactggtacaaccggtgcaggtaaaacaacaactggcgctgttctcattgatagactgagaaaagctcacgacgatgtttacgtaatagtcatagaccctatgagtaactataacagattctttgaaaatgaagcagatcttaacatcgttttcggagataatgattatttaggattggatcctgttagtttagctaacgaaggagtagtaagctctggtgacattgctgatttcttaatagaatcatatggaattccagctgagcttcgaggcattttagtaagccagttcgagcaaaataaatcgttaaatgagatcatggacaatttagaagacttagcaagcaagaaatttgctactgaatacagaaaattagagaacttcctattgaatatgacaacgggttgtgataagtatgtctttcaaggatctccgcctagtctaaagaataagaaatttgtcattttgggattgaaaactgaggacactaggaagaagcgtttggcagcaactatgctaatgatttatgcatattcactaattaataaactccccaaggatgtcgagaaattaatcctcatcgacgaagcccacctcctcgaaaa

SEQ ID NO: 112196 - DNA, 381 bp, Glycine max
  Peptide Sequence Number=SeqID_228974
atgccatccccaccaaccaacacccagaatgcgaatgtgacgcacatccttcctggcaccggttgtgcttctgtttggtggccttttacgagaacacgaccaaaagcgatgcgacaagaacgcagcgggatcacgcacgccctccacactgatagcaacataaggctttccaacaacacacctagatgcagggcaatacgtgatgaagaccatagcatgaggcaaagaccacgacgcacaatagaggtcacgaccattcgcaaagtcccaagaccgaatccatcaacatatggcttgaaagcatatctctgttgggtacaacctctccagcgccatcacgaccaccatgctgacatttggaaaggctctagtccccactga

SEQ ID NO: 112197 - DNA, 567 bp, Glycine max
  Peptide Sequence Number=SeqID_228975
atggtcttcatcacgtattgccctgcatctaggtgtgttgttggaaagccttatgttgctatcagtgtggagggcgtgctatatcagcacatatatattgctcagaagttgttgattgctttatttgcaaggtctaggatgatgtttttggatgatggtggaaggccaccaaacagaagcacaaccggtgccaggaaggatgtgcgtcacattcgcattctgggtgttggttggtggggatggcattgcgttttggtcgcatggaaaacctctgtgttcttacaagtggccaccgaaggaagcgcaaccagcatcaagaatggtgtgcgttgcggcaacaaggagagaggaatggggtatggtttgtggtgtatggtggaaggaatttggaaggaagaatttatagaggttaaggatgaggcttgcaagtttttcaaagatagattttatgaagaacactgggagaggccaaacctaggcaaagttagctttaagaagatatcaagtgatgataatgatatcttgattggtagttttggggaggaggagatcaagagtgccatttag

SEQ ID NO: 112198 - DNA, 1864 bp, Glycine max
  Peptide Sequence Number=SeqID_228976
tcagcctctagatgttgggtctagttttgatgtcctcatcatctacaatgatctcagaggtaaattacctccatcatttagcaatctcttatctcttaagaatcttgccttggcaaggaacggttttgtgggtgagattccagctcaacttggtaatctccactatctttcctatcttcaactctcagaactcttccagctcaacttggtaatctcaacaatctcttccaacttcaatcttcaacatctcttccttggtcttcttatccggttaattcctaacttcatatccaatgcctcacatcttcaatacattgaccttgctcacaataattttcacggccccatacctatgatcaacaacttgaaaaaccttacccacctgattcttggtaataattttttctcttcgacgacttcgttcaatttccagttctttgattcccttagaaactccaccaagttgcaaattctcatggtcaatgataaccatttggctggggagcttccaagttctgttgccaatctgtctggcaatattcaacaattctgtgttgctaacaatttgctaactgaaggaaactctctgcatggttcgcttcctcatgaggtcaaaatcatgacacagcttgagaccatggtcctctctggcaaccagttgtcagggaatattcctaaggaaatagagggtttgtctagcttcaagtggcttctgatggcaggaaacaaattcaatggttcaatcccaaccaatctagggaatttagcatcccttgagactttggatttatcatcaaacaatctcaccggtcctattcctcaaagtttagaaaagctccagtatatacagacattaaatttgtctttcaaccatttggaagggaaggttccaatgaaaggtgtttttatgaaccttaccaagtttcatcttcgaggtaacaaccaactatgcagccttaacaaggaaatagtgcagaatttgggagttctcctgtgccttgttggcaaaaagaaaagaaatagcttactccatatcatccttccagttgttggtgctactgctttgttcatttcaatgctcgttgtgttttgcacaatcaagaagaaaagaaaggagacgaaaatcagtgtgtcattgacccctctcagaggcactggtgaaaccgccacccttgctgtcaaagtcctggacctgcaacaaagcaaagcttctcagagtttcagttctgaatgtcaagctttaaaaaatgttcgacaccgaaacctagtgaaggttatcacttcttgctccagccttgattataagggagaggaattcaaggcccttgttatgcaactcatgcccaatgtcaggatcctctctaccttgttgcaaagattgaacattttcattgatgttgcctctgctatggactacttgcaccatgactgtaatccacccgtagtgcattgtgatatgaaacctgtcaatgtccttctagatgaaaatatggtagcccatgttgcatattttggattggcaaggtttctatctcaaagtacatcagagatgcagagtagcactctgggactgaaaggatcaataggctatattgcccctgaatatggcctaggaggcaaggcatcaactcatggtgatgtttacagttttgggatcctactgttagagatgttcacagcgaaaagaccaactgttgaaatcttcaaagaaggattaagcttaagcaaatttgtctcagccgtgtggatgagaatgaatggcattggtagcaacacacattcgattcgtaaagctgaggagtgcatagctggtgtgataagagttgggttgtgttgcacagctcatcaacccaaagatcgatga

SEQ ID NO: 112199 - DNA, 213 bp, Glycine max
  Peptide Sequence Number=SeqID_228977
atggccatcctcctacgtgcctccaaattgatgtcatttgctgttcttttagcaatacttttactgcttatgtcctccacgctgggaagtgctgcccaaccactcgggcgaaaacttttccaatatcctagtggcagaggatatggatatgctgaaggtggatcaatatataaaaaatatcctggtggtggaggatatcgaaaaagaccatga

SEQ ID NO: 112200 - DNA, 786 bp, Glycine max
  Peptide Sequence Number=SeqID_228978
atgaacttggagtccatagcccaagtctcaagctatgtcagagaaggaagcacttatcatgacagttgggaagttacttatgaaaagcatgttccaagagctttttacaaggagaaaagtgttgagtatgttggtacaaagaagatagtgtatcacaccatgtgtgaaagggttaagatttgggcaaacatcaccaacaagagttttctgcataagcagttgctcttcgaccttccacacattgtcttcatcaacatcctcaagaacttgaggacactaggtggaatggacgacatatactacgcaactttggtcaacaagctgttttgggaacaaggtgtttaccatgttttaaaaaagattgacaaggattccaagcaccaagtcactgtgaaaggttcattcattgctaagcaacaacagtttagcaagcgtccaccaccatcacaaatcaaccttgcaaagttcaagaaactagcaaggctatcatcatggagaccttgggtgcttctcaccaaggatatgcaagaacctgtccaatgccaattcatcattatgtcacctacaccatggacgaggtgtgattatgttcataagccctctgctatcgacaaggcacttccatcatatgctattgtgtcttctaaaaccccatcatggagacaatcgggtagacaagagctcagaaagaagccaatcgggaatgatgatccattttcaaaagcacctaaggaatgtcatcttctagttaggatggatccatcacaggaaaacctaactccttag

SEQ ID NO: 112201 - DNA, 195 bp, Glycine max
  Peptide Sequence Number=SeqID_228979
atggccatcctacgtgcctccaaattgatgtcatttgctgctcttttagcaatactcttactactcatgtcctttgagctcggaagtgctgcccagcctagttttaaactcgggcgaaaacttttccaaactggagagttgccaccaacttatggttcatatcctggtggtggaggatataccccaaatccatga

SEQ ID NO: 112202 - DNA, 168 bp, Glycine max
  Peptide Sequence Number=SeqID_228980
atgtcaatgtatcatcgttctcaagggaagccaaatgaactttttatccaccgagtcgacacatcttataaagcttctgctattaaaattcttgaagatcagcaaactagctttcttggcaaaatcccaagatgttggaccccacttaaacaaaagttgacccgttaa

SEQ ID NO: 112203 - DNA, 177 bp, Glycine max
  Peptide Sequence Number=SeqID_228981
atgaatgggattggtaacgacggaggaggaggattgagcaacgtggagatggagtacataagaagacaccacaggcacgagcctggtgagaatcagtgtggctctgcgctcgttaagcatataagagcaccggttcctcaggttttgtgttgggagcataagtgggaggtgatctag

SEQ ID NO: 112204 - DNA, 752 bp, Glycine max
  Peptide Sequence Number=SeqID_228982
atgggcataagagtggaattagctcaaataagatcttaccccggagatgtgtatagaaattataagaaacatttagagatcatagagaccagtactgcagattgtgtaatctttccagaactctccttaactggttacattataaaagatttgacatatgagatatataaggatgcagaggaggctacacgtaaaatagcagagaaagttaacaagtgtgccgtatttggaacaataaaggaagttaggaaaggaatattaagaaacgcagcggcagttataattaatgggaaaatggattacatatataagttttatcttccaacatatggattatttgaggagagaagatacttccaaagaggagacccacttaaagatttgaaaattttcgagtatagagacttaaaatttggtgtagtaatttgtgaagatgcgtggcatccagagccaatagaggcactatcgcttatgggagctgacgcaatttttataccatcagcatcaccaatgcgaaaactaagagaaaacttggcaatagaggagagttgggattcacttttgaaggctcactcattaatgaatactgtttggactgttttcacaaacgttgtaggtagtcaagaagaggaatacttttggggaggatctagagtggtttctccattaggtgatgtaaaacttaaactaaatctattttatgaagataggggagttgtggagatcactgagaatgagttgcttagggctag

SEQ ID NO: 112205 - DNA, 252 bp, Glycine max
  Peptide Sequence Number=SeqID_228983
atgactcgtggagatggaatgatagagaatgctatgggattttctgaggcatcagcattcaaggctatcgtatcgtcataccaaattgcacaaaataatcaactttttcctcagatgaaggttttttggaaatcagatgttccgtccaaggttctatttttttcttggagattatttcatgatcgcttagctacgagggagcagctgcagaatcgtggtgtcttgaatcttcaacaatctggaaataaataa

SEQ ID NO: 112206 - DNA, 1419 bp, Glycine max
  Peptide Sequence Number=SeqID_228984
atgttctgtccaggtggtcttcaaattccaatcactgcatctggtatggtgtcacatgctccaaagttggcaacagggtccaatctagcccctcaaccttccaacctcacatgcctacactcacttgacctttccaacaactattttcatggccaaatacccctagaattcggtcatctctcacttctcaatgtcattgaattaccttctaacaatctcagagtgattccaactgaacttggcaatctccacaatctttcctctcttcaactctctgagaacaatttctctggcgagtttctcacttctatcttcaatatctcttccttagtcttcttatccgtgacaagcaacaatttatcaggcaagttaacccaaaattctggacatgatcttccaaatataaaaaatctatttctggctagcaatagattcgaaggggctggggaccttccaagctctgttgctaatctgtctggcaatctccaacaattctgtgttgctaataatttgctaactggtaccattcctcaaggaatgaaaaaatttcaaaatctcatatccttgtcttatgaaaacaattctttcactggagagttaccatcagaaataggagcacaacataatcaacagcaacttgtgatatacagcaatatgttgtccggggaaatttcatacatttttggcaatttcacaaatctgtatatccttgcagttggagataaccagttctcggagatttttcagctttcttgtttaacaaccttgtatttagctgaaaactctctgcatggttcgctccctcatgaggtcaacatcatgacacagcttgagaccatggtcctttctggcaaccagttgtcagggaacattcctaaggaaatagaggaaggagatgttcctacgaaaggtgtttttatgaaccttacgaagttcgatcttcaaggtaacaacaaccaactgtgtagccttaacaaggaaattgtgcagaatttgggagttccactgtgtgatgatgtgttcagcttcagcaccggtgaaactatcacccttgctgtcaaagtcctggacctgcaacaaagcaaagcttttcagagtttcaatgctgaatgtcaagctttaaaaaatggagaggaattcaaggcccttgttatgcaattcatgcccaaaggtaactttgacgtgagtttatacccagaagatgttgagtcgggatcctctctaaccttgttgcaaagattgaacattcccattgatgttgcttcagcaatgaactacttgcaccatgactgtgatccatcagtagtgcattgtgatctgaaacctgccaatgtccttctagatgaaattatgattgcagatgttgcagattttggattggcaagtgatgcaatcctactccgcaagggcattggatag

SEQ ID NO: 112207 - DNA, 747 bp, Glycine max
  Peptide Sequence Number=SeqID_228985
atgatgagtccaaaccttgcaaaacaagttggtgacgcaacctataccaagatttttgttggaggactggcttgggggactaagagagacactctaaaacgctattttgatcagtttggggagatcttagaggccgttgtcatcactgacaaaatcactggaagatcaaaaggatatggctttgtaacacccacttctctattctttaggcacttggtctttcacttcttggtgaccttcagggacccaaattctgcaataagagcttgtcataatccctatcctgtgatcgatgggaggagagctaactgtaatcttgcagctcttggtgcccagaaatttgatccatctataacaggaaggcaaaaactcagtagcccgtcatggaatatggcaccaattccattgcaaggcacttccacttattataaccagcacataccccactatccatttccgtatccagcctacaggtatcctggttatcctcacccacaagacttgtatgaaatgaactacaataatgcatatggtggacagcagcttccactccgttggttgccagcatattgccaacccttttatggccttggtagacagtttattccaacagcatatgtgaaaaaggcacaaacccccaacatgtcacctcaggagttcacagtcgttggcttctcagaacctatttcagcttctccctcaatttccagcactggttcagcatctaaactccaaacaatgctataa

SEQ ID NO: 112208 - DNA, 319 bp, Glycine max
  Peptide Sequence Number=SeqID_228986
ccctgcttttgtcaaccaccccaccttttgttatcgtgacccaagagtccggtggcatgcggagacacccgacggtaacccgcacacaccctttgctatccagcaacccgagagtccgatagcatgcggagacaccttacggttatctgcaccttgtcatttggagaccccaagtctgattgacaagcagagaccaatgtggtcatctgcaccctttccgaagatgtcagcatcttccggtagagactattttagtctcacaccgctttcgcaagaactacgttggtctgaattcctcatcgcgattgaggatacgtag

SEQ ID NO: 112209 - DNA, 222 bp, Glycine max
  Peptide Sequence Number=SeqID_228987
atgcctattttgggaaaagagctctggaggcagcaagaggagcagcttttgcagagatacctaggttttaacttgaatgcagcagaattgaaacttagtcttataagagggatctgcagattaagttttggctttagatatgttgttacaatattgttgtttggtcttagtctactccaacaagagggatctgagaacaaagctcaggctaaattagtctaa

SEQ ID NO: 112210 - DNA, 117 bp, Glycine max
  Peptide Sequence Number=SeqID_228988
atggaggagcaacagtttgttggtggaaaatccactccattgatatggcctgcattggacatagctagtgctctaagtggggataaccttggtccacgaaagggtagtggcccttaa

SEQ ID NO: 112211 - DNA, 399 bp, Glycine max
  Peptide Sequence Number=SeqID_228989
atggtgtccaggcttgaccccaactttcactccacaaattattctgcaactggttcttacttaaatggtacagtgcactcttctgaggtggctattttgtcacctgcatcttcctattcaataactgtgcacactccttcggagaaagaagtgggtaattttcgagttgattttctaatgggtggaatagttccaattgaacgagtaaaaaatcaggataaaatgatgaaaagtggttggttgtctgagccatacaagagaattggtgattgttttgctctaaccatgaaggatgagggtgtgatttctctttggagaggcaatactgctaatgttatcagatactttctcactcaggctctgaacttggcttttaaaaaggacaaagatgcctactga

SEQ ID NO: 112212 - DNA, 617 bp, Glycine max
  Peptide Sequence Number=SeqID_228990
attgtgctttggaagatcgcgtaatggacactgttggggttatttgtatagataatgaggggcatgtagcatcaggagcctccagtggtggtattgctttaaaggttagtggacgcattgggttggcagcaatgtatggttcaggttgttgggcatcatcaaaaggtccctttggggctccattcatggctggttgttgcgtatcgggggcaggagaacacctaatgaaaggatttgcggctagggagtgctgcgtttcattgtcactcaaaagtagggaatatattatagatgagtaccagagctcgcagtctggtgctgcctctgcttgcacgaaaattctacgctctgttgttgaggatggcaggcaatgtggtactgatagcagtgcagggatcttggttgtgcagtcagatgcatctttgacagatcaaggaaaatcatcaaggctgaaagctgtagagattgctgctgcatacacttccttgtcttttggagtagggtattttggaagctctatggaacggcccaaggtttcaattcttaggagtacaaaacaacaaagcaagacagcaatagatcaatttggagcacgaatagatctttcaaatggatag

SEQ ID NO: 112213 - DNA, 720 bp, Glycine max
  Peptide Sequence Number=SeqID_228991
atggagggaaagaggtatttcgtggcggttcacgtcggcgccggttaccactctccgtcgaacgacaaagccctcaggtccgccatgaaccgcgcttgcctcgccgccgcgtccgttctctctaacggttcgggaacgcgcttagacgccgtcgtagccgccatccaagtgctggaggacgatccctgcacaaacgccggcagaggctccaatctgaccgaagacggtggcgtggagtgcgatgccagtgttatagacggaaaatctggtgcttttggcgctgttggagcagttgcggtttattatgctaggggcacacttgctaaggcgaatgcattgtttctaccacttcttttattatcaggtgtccgaaatgctatacaaattgctgctttattggccaaagagcaaatgatgggatctccattgttgggtcgaattcctccaatcttcttggtgggtgaaggggcttgcaaatgggccaagtctaaggacattgcattgccaccaagtatagaggaggccaatgagtggctggtcacagaaagggcaaaagcacaatggataaaatacaaatccatggttgaatctgctagatctaagacagagaacactcctgagggcgattcttctgtctatcaaaatgccacagtaccaggtatttttaatggcacacttccacaagatcttaccctacttttctgctttccaaaactgtga

SEQ ID NO: 112214 - DNA, 483 bp, Glycine max
  Peptide Sequence Number=SeqID_228992
atgtattttttcctcctactaggtccagagcatgaagtaaaccactatgattttcatattgtctacagtgcttcatatagagttccagtcttgtacttccgttcgtaccgtagtgatgtggatactagaaatgctagttacataaataatcctgcgcagtttatagcttatgatgggcaacttttgccgtttaatgaaattgaaaaggaccttcctggtcactctgcaaagttacggtcagaatccaaatggacatttataactcacgaggaacatccatatttgaacaggccatggtacaaattacatccatgtgggacaagtgactggatgaagcttctctttcatagtgactcatctttgaacaaaaatggttttgttattgaacagtatttgatttcctggttctcggtcattggacaagttgttggtcttaaaattcctttggaaatgctggatactgtagtttctaatgattcttag

SEQ ID NO: 112215 - DNA, 1035 bp, Glycine max
  Peptide Sequence Number=SeqID_228993
atggctttacaatttctgaaacaccccttaaccatctcacgaggtttgcagaacgagacaaccttaacttttctttctcggctacgaaatccgaagctcccattgtcgggattccttcttaataataataataataataatgatgatgatgatgatgatgatgaaaaatgtggtggtggtgcactgatattcttactgttgttttttcatgaattaactctagtgagatgcgaagacaatgttcagattccaacttctttccggagctatgctactgcaaaatcagaaaaggttttgcaagtgaagaagaaaaagcggctggatgaaatatgtgttgaaaaatatcagcaatatagtagatccatcatccagtcatggattttgcaaggaaaagtatatgtggatgggaaggtgataaataaagctggtacccctgtgcctgacaaagctgttgtggagataatagctgatattcccaaatatgtatgtagagctggacacaagttagaagctgccattgaacagcttggtgttgatgttactggtaaagtagctcttgattctgggctgtcaactggaggatttactgactgcttacttcagtatggtgcatcacatgtttacggagttgacgtaggttatggacagaaatacattttcgtcattttatgggtaaggggaagaattgttgctgtatgtttgctgctgaaccaatatggtcttatgggtaaaactcacaaggtagctgacaaaattcgaagagatgagcgtgtatcagtgatagaacggacaaatttaagatatcttgctgaactcccacaaaatgttgatttggtgactttagacctctcattcatctctattctcttggtcatgcctgccgtggtcaatgtcatgaaggaaaatgcagctttagtgactttggttaaaccacaatttgaagctcgtagatctcaaaccacacctcatgctatttataatatgaaaaaggaaatcaatattgattacaatcaattactgattaataggaaatag

SEQ ID NO: 112216 - DNA, 213 bp, Glycine max
  Peptide Sequence Number=SeqID_228994
atgattggaacctcctcgaagcaaggaatggtggagatgaagcggtggaagaagaaaagtgaagaaggtgggaacggaaacaacatgcagagccatgaaaagcttgaaggatggctcgaacaaagcaagcctcatgcgttgtcggacatgatcattttcatgagggcccctcacatgaaggggacaatgttgcagagagacatcaaaggctaa

SEQ ID NO: 112217 - DNA, 216 bp, Glycine max
  Peptide Sequence Number=SeqID_228995
atgaccaatgtagtcaaaatcaagatcctaactaggattggaaaggtaggccccttagctatcaaacagctaagagggaaagattctccttacatggagaaagacagttttagtaaggaggagttattactagaaaagcatttactgacacaagtatacccacaagaatctcaagagtgtaccttttgctatcaaacacctaagacggaaggttaa

SEQ ID NO: 112218 - DNA, 763 bp, Glycine max
  Peptide Sequence Number=SeqID_228996
accacgtcttttccggtttttccgacgttttcctcaaataaacgttggtggcgactccgcgcgtattcctttcttggaagacgcacccgcgagtctcgcgtcgccctcccgccgaaggaaagggctcaccaagggtaaaccttgggtttttcaagccttggagtggggacgtgtttgccctaggtattttcctgactgtggagttgtaaggatcaccaagtgtggagcttgggactcaccgagggtggaccttgggttttgtgagccctttggagtatcaactaggaaatttttgacttgggttttgggcgtcgtgctcatgaatgcatgtcagtcgccgtgggtggcacttattggagacatagcgcgtgctcttgcgtgcatgtcactcgtcgtgggtggcatgtactggagacgtagtaatgtgctcatgcgcacatgccactcgctatgggtggacttaccaagggtggaccttgggtttttcgatccctttggagtatcaaccaggaaattgtctgacctaggttttaggcaccgtgttcttgtatgcatgccgctcatcgtgggtggcacgtcaattgaagtagaacttcaggctggctgtggccctgaatggaccttcccagttaaggtcaagctttctcactcggggttcttttatggcttaaccttggactcgccatacgagggctctcaagatgactctattagttgtctctacccaaccgttagtttgaggatgttcaacaaaggtgactag

SEQ ID NO: 112219 - DNA, 366 bp, Glycine max
  Peptide Sequence Number=SeqID_228997
atgcctcctcatactcctcgacttccgttcctcgagcacctcaccaacgaccaacatttcttggtcccatccattgcctcctcaaagcagcctgtgcttctattggtaacggccaccacaatgcaaaaacaggttgagcaagagatagaagctgtgatgaagctgagcttagcacatcagtgggctaaacgtgcatccaccgctaagcgtagcttcagcgcacttagcacgatagaagagtctgtcagggcatcaatatcaaggtcacacgctaagcgagagattagtgcactaagcgcaacaggtgtctttagccaagctcagcgcatgactggcgctaagctcaaacccacttacttgcgttaa

SEQ ID NO: 112220 - DNA, 297 bp, Glycine max
  Peptide Sequence Number=SeqID_228998
atgtatattattctcaagtttaactctagcaacttggtcaaaaatacacatgctcaaacaaaaagtgaaagaacggaaatactggtgtctaagaagctgaaagcatcgcatactaaagaagcaatgcccttgggacagcaaatacacaactcaaagaagcatttaaacagagggataagccatggaaaggttaaggtgatggatgaagttaagctgataaagtatatgcatggaagtccaaagtccatgacagatgtctcaatggcatctacaaggttgcaacaattgacaatttaa

SEQ ID NO: 112221 - DNA, 843 bp, Glycine max
  Peptide Sequence Number=SeqID_228999
atggagcttgtggagcacggctcacctcaaggattgctctcttgttgtgttgcaattatatcctcactacagtatggccgtataatggatattgaattgaaggttcctccccgccctccatgttattgctttgttgagtttgataatgctcgagatgccgaagatgcaattcggggtcgagatggatacaactttgatggttgtcggttaagagtggagcttgctcatggtggtagagggccatcatcaagtgatcgacgtggatatggaggaggaggtggtaatggtggagcaggcgggggtcgttttggcatctcacgccattctgaatttcgagttattgttcgtggactcccatcttctgcatcttggcaagatttgaaggatcatatgcgaaaagctggggacgtgtgttttgctgaggtttcccgtgatagtgaagaaaaactgtattctggaaataatgacgtgtcagtgcctcttgcgtcatcagatgggacttttggcattgttgattacactaattatgatgacatgaagtatgccattcggaaattggatgacactgagtttagaaatccctgggcgagagcttatattcgggtgaggaagtatgagagtagtcgttctaggagccgcagcaggagccccagcaggagccccagcaggagcagaagtccaaaaagagttagaagtagatctctggagcgttctgtgtctaggtcacgatctagatctcaatcagcatcaccaatcaaatcttctaggccaagatcacgatcccgatcacgatcacgatctggatctggatctcctcatcaggtcctgtcaggtagtggttga

SEQ ID NO: 112222 - DNA, 696 bp, Glycine max
  Peptide Sequence Number=SeqID_229000
atggtaaaggcaaattttgatccggtgttgttgatggtcaccacaagtactaagattgataccttttcatcttggtacttggacactggttgttccactcacatgacagtcagaagagactggtttataagtcttgatgaatcaacaaagaacaaagttagatttgttgatgacaacacactaaaggtagaagaagttggtaaagtgttgatcaaaagaaatgatggtaaacaatctttcatttctaatgtgctatttatgctaggaatgaagagtaatcttctaagcctttgtcaattgctagagaaaggatttgtgatgaaaatgaaggataatgtgctaaaagtgtatgatagcaagaaaggactagtcctaatggcttatttgtccaagaataaaacccttaaggtaggaattgatgttataaaacataaatgtctagccacaatagtgagcaaaagtgagtggctttggcactataggtttaggcatctcactttcagggatctaaacctattaaatagggataatatgatgcataggttatcacacattcaagtgccaagtgaagtatgtgaggaatgcttcgagtgcaagaatcccgctctaataagttatcacctattaataaaattttcctcaggaaatggaaagttagatgaggccatatctattattgaagtttttaaactttag

SEQ ID NO: 112223 - DNA, 742 bp, Glycine max
  Peptide Sequence Number=SeqID_229001
atggattccggtgtccaaggttgcatcttagccactttaattctccacgacgaggaaatcccagtcaccgctgagaagatcaacgctctgttgaaggcttctaatgtctccgccgagtcttactggcccagcctcttcgccaagctcgcccagaataagaacatcgaagacctcattttgaacgccggcggtggtggggccgccgttgcagttgccgctcccgccggcggtggtggtggtgccgctgctgcagccgcacccgccgccgaggaaaagaaggtggaagcgggagtggcaggagtggaggaggagcacggcggagatcacggcgcaatgatggcgaagtctttcccgcagagcttgcagaagtgcatgtgcctctgcaaggattttcacatcgttaagctccacgattttgctgttgtcatcgaagtcctctacgtcatcatcatcttcgagaggcgtagttgcctctttttattgatgacggcgggttctggattcagcttctttgaatgggacagtggatccgtcactttatctctggcatctatcatcattcatctatctttgacaaagttgtggactgttaacatagtgcagtataaagcactacctagtcttcctgaagaatttggatctgtgttgggtagacaggttataaagaataagaagctatggggttccattgagtctttggaaacattgcagcctaatgccaacactagaagcaattattctg

SEQ ID NO: 112224 - DNA, 294 bp, Glycine max
  Peptide Sequence Number=SeqID_229002
atggattcaaagcagtgtaacccatccaactccggcgcaaacctgggcctcaaacggggcgggttttgtttggatccagcggttgatgatggattcggatcttttctggcggcggaggaagaagtggcttccattttgggctttgaattaactccttttacgggccccgtgcccaaggaaaacctccaattctgggcttgcgcgatctccaagtggctgaagatagacatcatggcgtcgttgtggatatttgtaggcatattggttattgatcatctaacagacttcgattaa

SEQ ID NO: 112225 - DNA, 441 bp, Glycine max
  Peptide Sequence Number=SeqID_229003
atggaattcaggcaaggagaggaagaacaactcttcataggagacactggaaacttagaaggcgaagaagccgaggagggtgaggcaaaatctaaggatttggcgagggtagtcgccaattttttttcccccaacctcgcccatttcggtttccacaaccatccaacgatgacaccaaagaaaaatgttacccacaggggactaaaaagcattccaataactgtgcacagacccaatattgcaggaagaagaagaagaagaagaagaagaaaggaacccccagaatctgttcagctccccgaaaagttaagggggggagaaggagctgcagaatattatttgaggcgaacaaaaatcagggagagggcagaaaaagaagacaaatttggcgaaaaatcagagggagagaaggacaaaaacgataaggggggtgtggattga

SEQ ID NO: 112226 - DNA, 657 bp, Glycine max
  Peptide Sequence Number=SeqID_229004
atggaacgtgagaagcagatgaataatcatctgcttccgcaagaaatcgaagaatttcttgggaatcctgcaagagctactcgttcttttttctctgacagatggtcagaacttcatctgagttcgaatcctactgagaggtctactagagatcagaaattgttgaagaaagaacaaaagaaacatcttgttctttccaggcgatcggaaaataaagaaatagtgaatttattcaagataattatgtacttacaaaataccgtctcaattcatcctatttcatcatatccgggatgtgatatggttccaaagggtgaactggacagttccaataagatttcattcttgaacaaaaatccattttggggtttatttcatctattccatgaccggaacagtgggagatacacgttacaccacgattttgaatcagaagagatatttcaagaaatggcagatctattcactctatcaataaccgagccggatctggtgtatcataagggatttgctttttctattgattcctccggattgggtcaaaaacatttcttgaatgagttattcaactccagggatgaatcgaaaaatcactctttattggttctacctcctcttttttatgaagagaatgatctttttatcgaaggatcataa

SEQ ID NO: 112227 - DNA, 1473 bp, Glycine max
  Peptide Sequence Number=SeqID_229005
atggtgttggcacttgctttgtccgcaaaccgttcatgtttgtgttcttctaccacctttcatccacacccactattaaatccttcaccctccctccatttttcaccttcaaccttccatcctcaacccctatgctccctcatcaaacaacacatcataccacaaccgtcgcacaaggcctccattcaccgccgccgctgcagtaactccctcgccactgccgacgcccaattcgatattggaatcggctttgaagagacccaagtcctcttgtgcaacaaccatgacctagcctctgtgccaattgactcattgcacgttcgctttctctctctgcgctctcttggcttcgaccctctcactctctgcaaattagtcacaaagcgcccaaccatattaacagccaacgaaattgaccctttgttaacctttctgagagacaatttgcaaggaaaactcgagaaacagcaactcaatcgcctcttatcttctacggagcaagaattcttggagagttttcctcagaaggttcaattcctagttgaccgaggaatccccgttgaccaggttgtgcacgtgctaaacaaagtgaatttgtcaaaggtcttgtgtcgcaggtcgcttgaagaaatcgacagaaccatatctttcttagaaccttttggtggcattgctttgattctgaaacgtcctcaaattttgaaccatgatttggatactcaaattgttcctagagtcaaatttctgatggagcttagtgatggagatgaagatagtgttgggaaagtgctgcttaggtttcccatattcttgaattacagtgtggcacatgtggaggaacacgtagggtttctgagttcttttgccgagtttgattacaaacagatatttaggataatacaagtttacccggctattgttactactagcagagagaggaaactgcgtcctagaatacagtttctcaaggaatgtgggttggattctgatgagatcttcaagttcttgattaaagggcccacgtttctgagcatttcattcaatgagaacatcgcttataagctggtgttgctggtgaagattggctataggtataggtcaaaggacttggcaatggcgattaggtctgctactaggacaaactgtgggaacatgcagaaggtcattagtttgttcttgaattatgggttttcgtgtgaagacattgttgctatgagcaagaagcagccacagatactgcagtataatcacacctctttggagaagaagatggagtacttgatagaggagatggggcgggacattgaggagttgctgctttttcctgcatttcttgggtacaagcttgatgataggattaagcataggtttgaagtcaagaagcttgttagaggcaggggaatgtctatcaataagcttttaactgtttctgaggagacatttgctggcaaacgaaaaaaggtcatgccgtag

SEQ ID NO: 112228 - DNA, 456 bp, Glycine max
  Peptide Sequence Number=SeqID_229006
atgcccatgagcaccatcctcgctgagctcttctgcatgggcgccaccctctccaaaaccaacaaaaaatgcccccggaaacagacaaaccctaaaatcttcctcgcttcctccgccaccaccaccaccacaaactccaaaccctccgtccccgccgccttgcctgccgctcccagcggcgacccggcggtgccggaagtggaagaggaggccgccgcggaccgcggtgaggacgaggaagaggggaacgaattgaaggggttcacgaagagcgaagtgacggtgatcgacacgagtagccctgggtggaaggtggacaagttcgtgttcaggaagaacaacgtttggaaagtcagagagaagaaaaccaagaacaagtttctcgccaagaggaaaagtaactccactctcgcgcctcgtgacgttcatgtcaatgcaattgagaactccaagtaa

SEQ ID NO: 112229 - DNA, 867 bp, Glycine max
  Peptide Sequence Number=SeqID_229007
gggtcatcctccaccgccgctgctactgcccatcgccgccacggaccatccgaagcacccacagcacctatccattcttccttgtcatctccaagatcatccactctgttttcttccgatgatcagcgtctatggtacctttctcaattttcttctaggatcattttagaccctaagtacctagacatagatttcttcaatgatgagacatttgattgttatcaagtgtttcaaaattctggcttggttgatttcatgtctttaaaattgccttataatcctgaacttgtcaaagtcttttactgcaatttaaaaattcaggatgacattctttcttctgaggtgcatggtattcccatgatcattgatcaatcattgttcttttctttgactaaactacccaatcaaggtgcaccttttgagggcaccattgttgatgactggaaatttgattattcttgtcatgatgctcgccgtatggcattacgggccaatgcacctctcccttaccctcaattggtcactctatttctccgtcattttcaaattccacttgatgatgaaccatttgttcaagtcaagcgttcctttgctattggtgctggtgcagtgacttcttttggataccgtaaggatcggaatggtcaatggctgaagaaagatgcacttcctcctcagcgagatgattctgccctcatgactgaagttcttttcgagttacggggtcttcgtacttatgttggcgaacattttgattctctggatactcgctttgccggcatggatatccgtctcacacagcttgaagaagatgtgggttatattcatcagagcctcgaccttccaccaccacctccaccttcttag

SEQ ID NO: 112230 - DNA, 264 bp, Glycine max
  Peptide Sequence Number=SeqID_229008
atgacacttcattgcacacgtcagccctccttgttagctctggcacaggagcatgaacgtctctcccttagcagccagactcccaaactagcaggttccccttcttgtcctcataacaaaggataccttctgttcgacatgcgagatcttggagcctaccttggtcacgcccaccttgacgtgggacaactccagattttgaaaagaataattacctgcaagagccgcaatagtacaagtaatggaagcaaagaatgtgcctaa

SEQ ID NO: 112231 - DNA, 444 bp, Glycine max
  Peptide Sequence Number=SeqID_229009
atggcgatagtggaatcatggacatggggatcccttgaattaaaagtctttctagttgatgattccatgcatggaggcctagtggtgtgtcacgtgactatgaagtggtggaggccatcatgtgagatgaaaaaaaaggcttcctcttggattaaaaaaaggcttcctcttgagggggaggccatcatgtggaagaggctcataattgaaggggagattgttggagtacaattggtggtgtatctatggacatggggatttgttgtatcgaaagtcttcttggcagatccttggacttggggatcccttgaatcgaaagtcttcttggcgtatgagttcatgcatggagttcaaatagtggctcgtgaccatgaagtggtgaagagtgaggcaatgcaagatactagagcttgttggcaacaatggctggctaagcaggagtaa

SEQ ID NO: 112232 - DNA, 201 bp, Glycine max
  Peptide Sequence Number=SeqID_229010
atggatgaccagtatgaaatcttgatgtccttgccagtttgtaagccacaactgaagattgagaacccaagcaaggctttgatagagagcatacgcctcaacttcttctggaagaggaagaccaggaaggaaaatagagcgagctctgaagaacatgctgcttcatcacggagacaaatgctgatgctaaacagatgttga

SEQ ID NO: 112233 - DNA, 120 bp, Glycine max
  Peptide Sequence Number=SeqID_229011
atggccgttttaagttttgctaaaaacaagttcccaaaatttttgtctctctcaaagactgccacacgaagtgctcctgcaaaacacaaagctgaaacagtcgctaaaaacaatcgctaa

SEQ ID NO: 112234 - DNA, 167 bp, Glycine max
  Peptide Sequence Number=SeqID_229012
atgcccccgactgtccctgttaatcattactccgatcccgaaggccaacacaataggatcagaatcctgcacgacccggccagtgaggggggcaggagcgcatcgccggcaaagggacgagccgaccggtgcacaccggagggcggaccgatcgacccaacccaagg

SEQ ID NO: 112235 - DNA, 987 bp, Glycine max
  Peptide Sequence Number=SeqID_229013
atggctccgaagaagctttttgctaaaagggctaggaaagccaccacaggggagggatatggtgcagccccgcaagcggaaattgagtttaacgggcaccattttcgaagtgaggagcatcaacgccatttcgagatgattaaggattggtctttcctcaaagaaagacgggtccaactagcagagggaaagtatgcaaaattccaggcagaggttgccagaaggcattggacccagccgacggagcccatggctaagtataaccctgagatagtcatggagttctacgcaaatgcctggcccactaaagaaggagttatggataagcgttcctgggtgcagggccaatggatcccatatgatgaagatgctatcaaccaattcttggggcatccgttgatcttagaagagggacaacattgcgaatacgctaaaagaagaagccaagtctcaggttttgatgaagaagccataggccagttactgtgctccccgggacatgattttgcacgaagcgtagcaaggaggcgggtacggctcatgcgcactagcatgaccgctttgactgaaatctggatgacgcttctgctcagcaacatccttcccgatgaccataattctgatctcccgctgcctaaatgccagttggtctatgctatcctgatccagattagtgttcatgtagcacaacttatctcgaatgtcatctatcagtttgtaggtattgcactagagaagtccaacagggcactgggatttccagcattgatcataggcctctgctatttctacagggtaccggtcatgcccacaaagctcatccagcccccattaacaggcacaacaaccggggcaagaccagtagcagtagctagcagcagatgcaccaccatcgcctccacatcagccaccatccctagagtccatttcagctcacatgcaaaggatggagctccagatgcatgcatacatgcagcatttggctga

SEQ ID NO: 112236 - DNA, 252 bp, Glycine max
  Peptide Sequence Number=SeqID_229014
atggagtcaaagcttattcttaagcttgaatgtggagtttggaagatggttcccgaatgtgacatgtcggagtatgtgccaaggccaccttatgtcggggaggactctcctcagtatatgttagggccacactatgtcgagatcgaggaggacccagagatgttagagaaggaacagtcagaggtgacagaagagcctcttaatcatgcaatggaggatggcatggcaatagtagacgaggagcttccctag

SEQ ID NO: 112237 - DNA, 669 bp, Glycine max
  Peptide Sequence Number=SeqID_229015
atggtgaaattagtgagagtacagtttcacaagatgtggaaattaaagaatagtaagttgattgctccttcaattattgttccaaacaacaatgaagaagaacaacacaataatgagcccatgatacataatgaacctattgtggaagaaccacaagaagtaacattaaggaggtctcaaagagaaaggagatcagctatttcaaatgactatatggtatacctacatgaaccagaaacagacttaagcattaatgataatgatcaaattttgttttcacaagttgtaagctatgataatttagatgccatgaaagaagagctaaactccatggaacataatagtgttcgggacctcgtacatttcccaaagggttgtaagaaagttggttgtaagtgggtcttcaagactaaacatgactctcatggaaaccttgaacgttacaaggctagacttgttgctaagagatttactcataaagatgagattgtttataaagagacattttcaccgatctcacgaaagaattctttcaagattatcatgacattgaagtactttgtagtgaaggtagaagttcaaaaacaaaaagtgtcaatagaacacattagcaaaaaccttatgatagttaaccctctgacaaagggagacatttatagagcatgttga

SEQ ID NO: 112238 - DNA, 1803 bp, Glycine max
  Peptide Sequence Number=SeqID_229016
atgttgagccgcggggcgcatggcgaagtggttggttctggtgagagtggtgaggatgagctgtatgagcagcagtggaaggcatgcgcgggaccactggtggatgttcctcgtgttggccagagagtcttctatttcccacaaggccacatggagcaattagaggcttcaacaaaccaggaactgaatcagaggattcctttgctgaagcttcccacgaagatcctatgtcgagttgtgaatgttcatttactggctgagcaagaaacggacgaggtttatgcgcaaattactttggtgccggaatctagtcaagacgagcctacaaatgctgatccgtgcactgctgaacctccaagagcaccagttcactcgttcagcaaggtcttgactgcttcagataccagcacccatggaggcttctccgttctcaggaaacatgccacggaatgccttcctgtgttggtaatgcgatctgttccggacatgtcccaaccaacaccaactcaggaattggttgcaaaggatcttcatggttatgaatggcgctttaagcatatatttagaggtcaaccacgcagacacttgctcacgactggctggagtacttttgtgacctccaagagattagttgctggagatacctttgtgttcttgagaggggacaatggggaattacgcgtgggcgtaagacgtctagctcgtcaagcaagtagcatgccttcatcagtgatttctagtcaaagcatgcacctgggggttcttgcaaccgcctctcatgctgttgcaactcagactctttttgtagtatattataagccaaggacgagccaattcatcataggcgtgaacaagtatttagaggctatggacaaaaagttcagtgtcggcatgaggtttaagatgagattcgagggggatgattctgctgagactgacaaaagattttcgggtaccatagttggagtggaagatatttctcctcattgggtaaattcaaaatggcgatcactcaaggttcaatgggatgaacctgcagctgttcccagacctgatagggtctcaccatgggagatagaaccctttgttgcttctgcttctacaccctcagttcaacctactatggtaaagactaaaaggccccggccacccagcgaaactccagatgttgacacaacatctgttgcttctgttttctgggatgctggtctgcaacaggctgacatggcacaaaaaaatgttttggcggaaagcaaatggaatgacaatactggtacgtggcatcatatgcaaactgacatgaatagtaaaagcaacagtggcaacactatgttaaggaatcagacagaaggaagttggctatcttctccgcattctagttgtccctctcatttgtttcaggacgtaacagatgatagcaagattgtctcagcttggccggtttcaaagcctcactcatccaaattgaacaatgatcatgtgctcgaccaagttgacaaggagagcaaagttgagactgctacaagttatcggttgtttggaattgaccttattgatccttctaggaactctccttctgtagagaaggcatctgcacaagcagtaaatgtacccaaagttactactgaaggctgtaccagcaccttgtcccgaaccgatgctggccataagtcagatgtatcaatggcttcttccatggagaggaaacaagaacagctgcaagtatcaccaaaggatactcagagcaagcaaatttgtagaagtcgaaccaaggttttgaacatagattgtttgtttagataa

SEQ ID NO: 112239 - DNA, 1008 bp, Glycine max
  Peptide Sequence Number=SeqID_229017
atgcccatgaccgaaccggacatgtctgattccaatgtgaaaggctgcccaaaatcaggggaggccaaaattggtgcttccgtcatagcttgcttcagtttgtcaaagaatcatgtcaagcccaggaacccttggagttccgtcgtggatgctggagaaggccaattcctcatggcactaatctttttcgggtcttatgctatgctagcgacaaacacgatgtgttcgagatactggagagtagttttggcaaataaacacttcaattttcataagaggaattgctctatggacaaagtggtgaagatagcctccaaatggggtcacgtgggagtccaagaacatactataaatgagaatttcatcgatttttggcatagggaacccgtccttcacaaggagtgcattcagggtgcgatagtcaacacaacatctccaactttcgtccttcttcttgaccaacagcatcgaagaggaaaaagggttgtgattgacctagatgaggctcgcatccaacatagtagaaatttgtttctcaagctcaattttctggaagtgaaggtaacgctatggtctaacgttcacgggcttggaattgggaagaaggtgaatgtgaagggtaatggcgcactagggtgggtgacgaaaaggaaaaggtgtggacagggttgggtaagggagaaatgtggaaaagaactgagacgctttgtgtatgatgatggtggcaccgttcagggtcaaggtgtacaaattgggagtaaaggtgtgaccctgaatcacgagtggcacctgggagcaaacactggtgcaatagagtatcccatcatagccaaccacgacgcgaaaggtgggtatcagagtggtaggaaggtcaaggaatttggcaaccctattttgcacaaaattgtgggtactatcgccatcgaccaaaatcgtaacgcgatggtggttgatacggtcataaaagcaaaaggtcacgagagtgggcattcccaacatggcatttag

SEQ ID NO: 112240 - DNA, 1353 bp, Glycine max
  Peptide Sequence Number=SeqID_229018
atgggagaggtggtcatcatgagtggagagaagaagtcagttagagtggagggggtggagaaggaagatagtggtggaagtgggagcaaggctggtgaatttaaggggttgatgaggtgggagaagttcttgcccaagatggttttgagggtgctgttggttgaagcagatgattccacaagacaaattattgccgcgcttctcagaaaatgcagctacaaagcattaacttcttttctggggtctgtatcattaagggtattcaccagactcaatgaaaaagggggggtaaaagcaggaactgaagaagctatcagtaaatccaagatttctgagtcccaatttgagaaaggactgacatatatgatctttgatattataaagggtgccatggttgctgttcctgatggcttgaaggcatgggaattactcaagggaagaccgcacaatgttgatctaattctgacagaagtggatttgccatccatatctggctatgcacttctcacattaattatggagcacgagatttgcaaaaacatccctgttataatgatgtcttcccaagattcaattagcacagtatacaaatgcatgttgagaggtgctgctgattatcttgttaagcctattagaaaaaatgaactgaggaacttgtggcaacatgtttggagaagacaatcatcaaccactggtattaatggcctccaagatgagagtgttgcacaacagaaggttgaagccactgcagaaaataatgctgctagtaatcgttcaagtggtgatgctgcttgcattcagagaaatatagaactaattgagaagggaagtgatgcacagagctcttgtaccaagcctgactgtgaagctgagagtgaccctgtcggtaacatgcaggaattttctctgctgaaatgtggggaagcatatccaagtggaacagagacacaacaggttgaaacaagctttcgcttaggccagacattaatgatgcatgactgtcatgctggaggattaaatgtgagtatccgcaaaaatggtgaggcaagcacgactaatgacaaggatactgatacagagcattttgggaatgctagcatcagtggtgaggctcatgacaatccctatgttcaaattaactcttccaaggaagctatggacttgattggagcatttcatactcatccaaactgttccctgaaaaattccacagttaattgcacaggcaactttgaccattctcctcaattggatctttctttgagaagatcttgtcccggaagctttgagaataaactcactgaagaaaggcacaccctgatgcattctaatgcttcagctttcaagcggtaa

SEQ ID NO: 112241 - DNA, 276 bp, Glycine max
  Peptide Sequence Number=SeqID_229019
atggagtttttgatagttacatcattcgcggtatgggtacgctacggatacggacgtggtacgggtacaagtttgtggtacgcgactttacgaataattgacctgcaaacttttcatttcctggcgaaaacgaattgtgaaatgagtttttttcttctctgtcggctttgtatatgggtttggtacttggcagcccttgtactgtcttataagaaagtttctttggctcataaaaagaaaaaattctttggagagtgtttggatggaaaaatttaa

SEQ ID NO: 112242 - DNA, 939 bp, Glycine max
  Peptide Sequence Number=SeqID_229020
atgtcatcgatttcaaaattcgcagctctgaatccgccgccaatagcggacccgagctcctccataatccctctgacggcggcggattcggggtcctcgttgggcttcatcttctccgacaggggcctcccgcgcttcctgacgttgccgtccgacaactcctggtgcgattctacaaggatcttgccgtgttttccggtgacgcgaacgaggacgacgtggacggttcgtaccggaggggtggagtcagcgagggaggtttccccctgggagagctcgagccagaggttgtgcacgttcttggtgcccggcttcacgccccacgaggcgaacgactcggaagggagccgcggcttcagccactccgagagcgactgcggggacgcgaagctgtggcggcgcggagggaggagggtgttgttgagattgttgtttttcgaggatttcgacgttgttgtgtttgtgagggacatggcggggattttgaggaagcgacgcgggaaggggcagcgggtggagccgccgatgtggggcttcgaggacgagactaggaagcagacggagagggccgtgaggagtagatccggcagggaggggagggtcgtctgcggcggcggcgggaacatctcaaccggcggagcgatgatgatgcagcgtgtaaggggtgcgtgtgttgatggaaaggtccatgcttggaaaaacaaatacgaggtcggggatgggtttgtaaattgtgttttgggattagatattcatattctactctcctctgctgcgcttttatattctttttctttttacccctcctctccgctttggcctttcttcataactaatacgtggcttcattcactctgtctcatctctgtggttctcaattcctgtggtcccactttttgctttacttggactggactgcatctttcagaggcccaataa

SEQ ID NO: 112243 - DNA, 223 bp, Glycine max
  Peptide Sequence Number=SeqID_229021
atgtggctccgcatgccaccggtctcttgggacacggtaacaaaaagtggggtggtcgacaaaagcaaggcttttgctcctacatatcctcaatttgtgatgaggaactcagacctacgtagttcttgccaactcatttcatttctaaacgaccatttagaggaaacactgggtccaacaaagataggagaaaatcactcaaagtgtatcaatctcacaccag

SEQ ID NO: 112244 - DNA, 162 bp, Glycine max
  Peptide Sequence Number=SeqID_229022
atgatgaggattcttttgataggccaaggtgtcggtctcaagccgaactcccatattactccacaaggcacgcgtgacaatgatgatttgaaaacaacgtgcaaaattagtcatggctacagccagggtgggcactcaagcatcccgtttatggcattgtga

SEQ ID NO: 112245 - DNA, 243 bp, Glycine max
  Peptide Sequence Number=SeqID_229023
atgaagtataggcaccccattcctaggcttgatgatatgcttgataagtttcatggtgcaaacatattttccaaaattgatcttagaagtggttatcaccaaataaggatgagaaaaggtgatgagtggaaaaccactttcaagaccaagttttggttgtatgagtggctagtgatgccttttcggctcactaatgaccttcatgaggctaatgaatcatgtgctaagggagttcataggtag

SEQ ID NO: 112246 - DNA, 228 bp, Glycine max
  Peptide Sequence Number=SeqID_229024
atgactgttaaaaagaggctaagtcatgaagtgctaaaagtgatagttgagttcagctcatcagttgggctaagcgcacatccatcgctaagcacagcttcagggagagacagagacacacggagagaagacaacttttgcagagaattccagagcacaccacagtgcctatttcgggaaaagagctctagaggcagcaagaggagcagcttttgtagagagacctag

SEQ ID NO: 112247 - DNA, 363 bp, Glycine max
  Peptide Sequence Number=SeqID_229025
atgggttgttacagagttcagcttgtggcaataatctcgttcatgcttttgctttcaaatacccacggttggggagatgatgggcatgccattgtttgtaagatagctcaggctcgcctcagcactgcagctgcaaaggctgtgaagaaattgttgcccaaatctgccaataatgacttggcgagcaagtgctcttgggcagatagtctgagggttgtcttcccttggtcttctgctttgcactttgctaatactcctgactccgtttgcaattacaaggacacaagtaactttctttctcattcttcttctctcaactcacccttcgcttgtacttgttttaaattgagtccagatagctag

SEQ ID NO: 112248 - DNA, 402 bp, Glycine max
  Peptide Sequence Number=SeqID_229026
atgttgatcattcagtggagtatgtctgatgttttggggaagttcatacctttagttagcaaagattggacacaatctgaagtggcaaggcttttctatgctattaagccttatggtaatcaattacacaagttgtctgaagcttgcagagttgtgtctcatatcggtttaatcgattacagccttctcgtaattgattacacagttgtttctgagacaacgattgatttattcaagagtctctactttaatcgattaccatgtgatataatcgattacttctttttcttgagtagtttagaagtgaacaagaacactttaatcgattactttgagtatataatcaattatattgttcttgagctgttttcaggttttgggaagaacactttaatcgattaa

SEQ ID NO: 112249 - DNA, 330 bp, Glycine max
  Peptide Sequence Number=SeqID_229027
atgtaccctatcacatataaccaagatctggtgagcctagctctacttgctagatggaaagaactcaaagagttctacgaactcactggaaatcatcatgtgaccttgacccactatggacaaagatgtgtcgagtaccatgtactcatttatgaaaacttgacaaaatcgttggtacacgatggatgtaaggggaagaagcgagtgacaaatcgtatgtacacaatgaatgtaatcggaagaatcgaggtaaagaatttggatcctgagggacaagctttgctgttgtgtgagagttttttgagacatgagaaggggtctaaaggttga

SEQ ID NO: 112250 - DNA, 231 bp, Glycine max
  Peptide Sequence Number=SeqID_229028
atggaccctatcagattccagagtgtattggaaggtttgtctccagatgatacttctagggaagactgggaccagctgaaagctagttatcacctagaggacaaggtggttttcgaagccatgggggataatatgaagcaagaaccacggatgcagtccaccttaagggaaaggtccacgagaaaggtcaccacacctgggtaccttagggactatgtcgaacggttttag

SEQ ID NO: 112251 - DNA, 402 bp, Glycine max
  Peptide Sequence Number=SeqID_229029
atgcctaacccagactcgcctaaccactcccccttatcttcctctgccaatccatcttctacttcacttttccatgctcattgcatgaagcttgaggttcaatggttcgatagcgtggatcctcttggttggatctttaagatcacccagttttttagcaatgaccaagttacttcatggtctgtcttccttctagcccttcaaactcgcttcgctacttcgcaatatgaagacccctctagagctctatataaattaactcaacgtagcactgtgaacgcttacctctctgagttcaagaacctggcgaatcgaactataggccttcctcccccttttcgtttaagttgctttatttccatcttggccccgaagatgcgtcatgaggttcaagccttatag

SEQ ID NO: 112252 - DNA, 480 bp, Glycine max
  Peptide Sequence Number=SeqID_229030
atggcaatacatggaagtcaacggagaaaacaacatcctgaatatgcaccgtcatgtcctcacaaagaagatgacagtggagctgatggccattgcccaccatcacacgaagtggtgttgtggcccgagttagaaggcccaaattgtggaccaagtgctcctggacaaagttatgggcacaagggctcaggggccagatggcccgaaagagtgtgcaggctaatttgtgtcgggtacaagatccggtttcgaggtgatatgttgaaggccatcatcgttatcctcaatcaagaggaaaaccttggaggcatatttgtggccatgatgaaatttataatcgcaattgaaatagaggccgccctcgcgttgcgaggccaactcctccaggaaaagtcttttgaccggcaacgaaggaaaaggtttgagaggtgtgggcaacaacagaggagggggcgaaggagtggaagtggaaatagatga

SEQ ID NO: 112253 - DNA, 807 bp, Glycine max
  Peptide Sequence Number=SeqID_229031
atgaagtacccctttgagtggtcatctaaggcgcaacaagttttcactggattgaaggatgtgctttctatagcccctactttactcttgccggacttcattatccctttttccttggaaacaaacgtgtttggtgtcgacatgggtgcagtcttatcgcagaaaggccaccctattgccttctttagtaagccttttactccaaagcttcttcacgcatccacttatgcctgggagctatttgctatcaccactgcaataaagaaatggcgccaatacttgttgggccatcactttatcattctcacaaaccatcggagcctcaaggagttgatgacccaggtggtgcagaagttggagcaacaaatgtacctcgctaaacttatgggctttgattacgagatccactatcgttccaataaggcgaacgtggttacagatgccttgtctaggattccaaaagccaccttgagctctctattgctatttttagttccatgttttccatttttgggagaacttaaacaacatcttatgaatgaccccgtatttctcaagttgcgtcaagctatctctaatgaccctgcgacatattctgactattctattgcccaggatttgattctaaaagggggtgggcacatgggagttgccaagactctagcacacctcagtgagaacttcacttggcgtggaatccaaaaggacgtggaatgctttatcgcagcttgtgttgactgccaacacatgaagtacgaaacccaaaaagcagttaggttactttgtcccctcccggtccccttctag

SEQ ID NO: 112254 - DNA, 272 bp, Glycine max
  Peptide Sequence Number=SeqID_229032
atggatacctcaaagccttacactggggcaatgaggggcatcatgcatgagcctcaagtgaatataggggcagatcaaaagttctcacccgtcgatgttcttttaaacagaaaaaaaaaaagaaagaagaggatgaaccctggaatttcaatgggattgattaaacgtcaaacggctccattgccgtcactccaaaatggtcaagtgactaaatcaaatagaacatacactctgagggagttcccggagagattagcaaaagataggataag

SEQ ID NO: 112255 - DNA, 894 bp, Glycine max
  Peptide Sequence Number=SeqID_229033
atgagtaatgacaaagttctggttaccggcggcagcgggtttattgcgcagtactgcattattgcgctgctgcagcagggctatcaggtgcgaaccaccttacgtgatgccaatcgtgaagctgaagtcagggcgcatctgttgcaggccggggtggccgcaggcgaggcgctgcaatttgtcgttgccgatttaacggcagacgccggctgggaagacgcggtggcaggctgtcgcttcgtgctgcatggcgcttcacccaccccgaccggtagccaggtaagcgaagctgactgggtgaatccggcgattgaaggaaatctgcgcgtattgcgcgccgcgcgcgatgcaggcgttaaacgtgtggtactgacctcggcgtttggcgcggtcggtatcggacatccagcggactatccgcgcccctttaccgagcgcgactggagcgatgtcagcggcgatgtgtggccctatcagaaatcgaaaaccctggcggaacgcgctgcctggcagtttatcgctgagcagggtaacggtctggaactggccacggtgaaccccgtgtcggtgctggggccggtgctgggtgctgactattcacattcgattcgcattgtgaaggagcttctggaggggcagccaggctgtcctgacatcaactcatgttttgttgatgtgcgtgacgtggccagtctgcacgtgctggcgatgacccacgccgccgcgcaggggcagcgcttcctcgccagttcggggcacagcctgccgcttattgaggtggcgcgcacgctcaaaacccatctggcagcagaagcagagaaagtttcgctgcagccaatgagtgacgccatggtgcgggcggcggcagcgcaaaatccgctgatgacgggaatg

SEQ ID NO: 112256 - DNA, 423 bp, Glycine max
  Peptide Sequence Number=SeqID_229034
atgtgctcagagcttcaaaattccatttcgagcaactcgatatattgcgggactcaatcggacatccgagtaaaaagttattgtcgtttgaatttgctcagagcttcgataatcaatttcgagcgtctcgatatattacgggactcaatccgacatcggagtaaaaagttattgtcgtttgaatttgctcagaccttcggaattccatttcgagcaactcgatatattacgggactcaatcggacatccgaagcttcggaattccatttcgagcaactcgatatattacgggactcaatcagacatccgagtaaaaagttattgtcgttcgaattttctcagagcttcgataatcaatttcgagcgtctcgatatattacgggactcagtcagacaacggagtcaaaagtcgttgtcgtttga

SEQ ID NO: 112257 - DNA, 222 bp, Glycine max
  Peptide Sequence Number=SeqID_229035
atggaggattgccttgagggtctgcacttaggcaatcatgaaacacagctccaacctcgaaggtggaggacgcatgaacgaaaacgcaattcatggagctccgaaaaagggttggcaggtggggtgggatatcgccagttgagaacgaccttgaatggcaatctgaagggaagtgacaccaaaaatgggttttcctttgccggcagtcccttaccttgctga

SEQ ID NO: 112258 - DNA, 568 bp, Glycine max
  Peptide Sequence Number=SeqID_229036
caaaatacgggatgagcttgccacccagctcgcccaggcatgctcagctcgcccaggcgagaatttcacggattgcgtaacaacgcttccttttgatttccggcacgtctcgggactcacatattgtgcaacaaagggtgtcaagtaccttgaagcgggtatgacacacgtcctcaccttcagagggctgcacgccctcgccttcaaagggcgactcgtcctgaacttcagagggctacacgccttcgccttcagaggactggacgtcatcaccttcagagggctacacgccctcaccttcagaggactatacatcctccccttgagagggatacacgccctcacctttagaggactgcacgtcctcaccttcagagggctacacgtcctcgtcttcagagggctgctcgccctcgccttcaaaggactacacatcctcgccatcaaacggcgacacgtcctcaacttcagagggctgcatgccctcgcctttagaggcctatgcgtcctcactttcagtgggctccatatccacaccttaagagaatttaaggtcctctgcccttaa

SEQ ID NO: 112259 - DNA, 1764 bp, Glycine max
  Peptide Sequence Number=SeqID_229037
atgaagcaaatcgacgacggcgatgacgagcagcgatccctctcccctctgccggaacaggtcctggagaacgtcctggaaagcgtgctccacttcctcacctcccgtcgcgaccgcaacgccgcctcactggtctgcaagtcctggtaccgcgccgaggccctcacccgccccgacctcttcatcggcaactgctacgccgtttccccccggcgcgccaccgcccgcttcccccgcgtccggtccctgaccatcaagggcaagccccgcttcgccgacttcgacctcatgcccctgaactggggggcccacttcaccccctgggccaccgcactctcccaatcttacccttcctccctcaacaaactccacctcaaacgcatgtccctcaccgaccacgacctcatcctcctctcccactccttcccctccttccaagacctcgttctcacgtgctgcgaaggcttcggcaccaccggcctcgccgccctcacctccaactgcagattgctgagagtgcttgaactagtggaatgcgtggttgaggttggcgacgaggaaatggattggatatcgtgttttccggagagtgatgctcagacacatttggaatctcttgtttttgactgcgtggagtgtcccgttaatttcgatgctttggagaggctggtggcgcggtctcccttgttgaggaagctgaggctgaatcgttatgtttcgatgtctcagctgcaccggttgatgcatcgagcgccgcagctgacgcatctgggaactggatccttcagtgcttcggagctggatcaggaactggattttgcgtctgccttcgcctcttgtaaatcgttggtttgtttgtctgggtttagggagttttgggcggattatctccctgctatttatccagcttgtgccaatctcatatccttgaatttcagttttgctgatatcagtgcggatcagctcaaatcggttatacggcactgtcataagctacagaccttttgggtcctagataccatatgcgatgaagggcttcaagcggtggctgagacttgcaaggatttgcgtgagcttcgggttttccctgtcaataccagggaggagatagaaggtcccgtgtctgaggtgggatttgaggcgatttctcgaggttgtaggaaactgcagtcgattctgtttttctgccagaggatgacgaatgctgctgtggtggccatgtcaaacaactgcccggatcttgtggtgtttcggttgtgtataattgggcagtatcggccggaccctgtgacactagaacccatggatgagggttttggtgccattgttatgaactgcaagaagctcactcggcttgctgtgtctggtttgctgactgaccgggcttttagttacattgggacgtatgggaagttgattaggacgctgtcagttgcctttgctggagacactgaccttggactccaatatgttctacaaggatgtcctaatctgcagaagcttgaaatcagggacagtccatttggggatggagctttgcattctggcttgcatcacttttacaacatgaggttcctctggatgtcctcatgtaagttgacgcgccaagcttgccaagaagttgcgcagacattgccccatctggtgttggaagtcattaatagtgaagaggacaaagctgatggtatagagattctgtacatgtatcggtctctggacgggccacgggatgatgctccaaaagttgttaccatcctttgctga

SEQ ID NO: 112260 - DNA, 1524 bp, Glycine max
  Peptide Sequence Number=SeqID_229038
atggtggttggtgaagttaatagcggggagggagatgcagaagcgcaactaccattggtgccgaagggaagcagcagcataagcatgacatgtctatgccttacccattcaatcactcaaactcataaccataaccataaccttccacacgctactactaccttctcttcttctctccataaccgtaaccccctctttcaattattctccgtaagtaaccaattccctcttctatctcgcgctttgtttcagagtattattctccgacctcgaattcgaccattttccaccaacttaactgcttcttattcttcttctgccttcgcccaaatcatggcgaatttcgacgctgattccgtcacttaccttacgcagcgagatgccgcggagatcgacgagacactcatgggtccacttggcttcagcgttgaccagctcatggaattggatgttttgagcgtcgccacttccatttctgaggtttacaaaccatgtgagcatagtcgtgttcttactatttgtggtcctggtaacaatggcggtgatggtctcgtagctgctcggcacctgcatcactttggttataagccctttgtctgttacccaaagcgtacccctaagcctctctatgctgggttagtcactcagcttgaagcactgtcgatcccattcttgtcagtggaagaactaccatcagatctttcaaatgactttgacgttgtcatagatgcaatgtttggattctcatttcatggttctccaaggcctccttttgatgatttgatccagagactagtctcgttacataataataataatcaaattggccaaaaaagatcagttatagtctctgtagatattccctctgggtggcatgttgaagagggagatgttgatggtacaggcattaaacctgatatgttgaagttttgtggtcctcaccactttctaggaggtagatttgtcccacctgctattgcagaaaaatataagcttatacttccaccatatccaggaacatccatgtgtgttcaaattggaaagcctccacaaattgatatctcagctctaagagagaactatatctctccagaatttcttgaagagcaggtcgaggttgaccctattaatcagtttcacaaatggtttgatgatgcattggctgctggtttgaaggaaccaaatgctatggccttgtcaactgtagggaaggatggaaaaccaactgctgaggcaatgctatttggcaaatgcttatttgtgttcgcctgctactattgctttgcgctggtacgggtggaagggcctgttcagaaagtctctgatgaggaatcagaacagtatttccatagccgtcctagaggaaagtcagattggagcaatagtcagcaagcagagtactgtagtgcatgttctttatcaggagtacaaagagctggaagaaaaatacctgatggaagtttgatccctaaacctaagaactggggaggatatagactaacaccacaacttttcgagttttga

SEQ ID NO: 112261 - DNA, 366 bp, Glycine max
  Peptide Sequence Number=SeqID_229039
atgaagcacattattgacatcattgcagaactgaggaaccagattgcaattttcaatagagaactcaaggagggacgtctgagaatcccagtgttccaagatgatgcgtgcagatggctgattcaaatccaacagcactttgacatgaagaaggaagggaagctgcagttggttgtgaaagtactagaaggacatgcttatgattggtataaacagtggggggtcagtaatcctaaggtatcatgggaagagcttcagatgtcagtgctcaagaaattccaggccaggtatgatctgaatttgccagttagggtccaagggaagggaaatcttgggagcaagacaaaagggaaaatgaagggttga

SEQ ID NO: 112262 - DNA, 227 bp, Glycine max
  Peptide Sequence Number=SeqID_229040
cttgtgttcgttaagcttcggtctatttttgaagttgtgactgccaagaaaccagttaaggacaagccaactgtggatagtggaagcaagtctaagggaagtggcaagaaattgtctacatctgcaactccattgaacccattacctgccattgcacgtgctacaccaattgccatgaatatgggtcttccttctggtcctagtgcagttcctgcaattggcccctg

SEQ ID NO: 112263 - DNA, 315 bp, Glycine max
  Peptide Sequence Number=SeqID_229041
atggttccaaagaagcttctatgtaagagggcaaggaaagacaccgctggagaaggatccagttcggccccacaagtggatatggaatttgacagacattggttccgaagcaaggaacaccaacgccattttgaagcaatcaagggttggtctttcctcaaggagagacgggtccagttaagggagggagaatatgctgagtttcaagaggaaatttccaggaggcagtgtactcaacttacagggcccatggctaagtatgatccagaaatagtcatcgagctctatgccaatgcatggcacacaaaggaggga

SEQ ID NO: 112264 - DNA, 423 bp, Glycine max
  Peptide Sequence Number=SeqID_229042
atggttcgatgttttggaaatctcaattttggcaggtatctcaagaatcaaataccggacaaggaaaagcctagatttcatttttttaatagtttcttctttagaaagctggctgatatggacaaaaatccatctagtgcttctgatggaaaagcagcatttctgcgcgttcgtaaatggacgagaaaagtaaatttgtttgcaaaggattatatattcattcctgtgaacttcaatcttcactggagtttaatagtcatatgccatcctggtgaattggttaattttaatggtgaggtctcagcttatgatcgttcttgtgaaaataaggagctggacaattcacttaaggtaccctgtatattgcatatggattccataaaaggaagtcatagtggtctgaaaaacctggtgcaaaggtag

SEQ ID NO: 112265 - DNA, 1218 bp, Glycine max
  Peptide Sequence Number=SeqID_229043
atgcctattttagtattacatctcccaattttacctaacataactagtaatttccagctcaatgtggactggtttctgcctgccgaagcttttctcaagcgaacactgatccagaagttaatctttgaacttttggaaaatcatggttcacatgaaatctcttcctctgactgtagtgatgacgatgagtgcttacaaaataatgataatagaactgggattgatcaccctgaagtcaataaggagtcaacaacttcccatgctggacagggaatagaaatcactctattgtctggttcatcgtctttggatcctcaatcctttaacaattcaggattggttcttaaagagctttttgatccaggagctactgcaggagcaatgttgggacagtgtcaatcttttgaccagcgttcatctgattatcgtttcagtggttcaatattttcaattgaggaagacacggatcttgggaaccagtttatgtacttgcctacagatcccaacttccagcaagtgactggaattacacctccaacatgttctttgccatatcttcctagggattgtggagatgagacatgtcatagaccacaaatctctccgctagtggatcgtgatgtggtgcagccatctttagatacatcaaatggtgtcttagatgattcagaagatgtaacagtcaccaaaagttgccttgttttgaatgtgcctgggtcatctaatgaacctgaacaaggtgagaaaacttgttcagccatggaaaacgctgagcatgttatagatatttccaactcggttgtgggaaattctctagactcaattacgaagtgtgatgataacaagaatggagatctccactatactggtcaagaaactctgacaattccagtgcagcaggtttctgatgcagtagatgatgaggaaactccaataccattgcaacaagtttctgatgcagtacatgatgaggaaactccaataccagtgcaagtttctgatgctgtaaataatgaggaaactccaacagtatcattgcaacaagtttctgatgcagtagacgatgaggaagctcccacaacaccatcacaagtttctgatgaggctggatgtgatgatggtcagatgatagatgacatggaacctgataattgtgaggaacaagctgcaaagaggaggcggctaatgcctctacagtgcagaagtgaggcattgtga

SEQ ID NO: 112266 - DNA, 432 bp, Glycine max
  Peptide Sequence Number=SeqID_229044
atggaagtcgttcttcatcctgattatgtcatataccaggataattattatctggggccaaagttaaccttttcaccttgttttgtcaagatcaatgtttcaactgcatgtataaagcaagaagcttttgatcttgaatgggcagttgatgatctcattgacattaattgtcagttgtttcaaagtagtggaactgtcattataaagcttcgagtaatatcacataatgcaagccaatcaaatcatgtaagcgatgcttcaggcattgaggaattggaaattgcggttgctgattacaattggtccctcagacatagacaaatcacatctcttaatctgaaatacttggcttcttggaacatggctcttcgtgtggatgtagaaggcaatggaactgattcacgtgggtcaagatgctacttccctaagtaa

SEQ ID NO: 112267 - DNA, 159 bp, Glycine max
  Peptide Sequence Number=SeqID_229045
atgatgcggtggatgacggcggcgagatgctccggcgcggcgacgaggaaggacggaacagaggaagctgagttgaaacaggaattgggtttctttttctctttctttctgtctgttagttttggagttggcttcagagaaagaaatggtcagagataa

SEQ ID NO: 112268 - DNA, 555 bp, Glycine max
  Peptide Sequence Number=SeqID_229046
atgaatgacatagttacaaagtacagtacgcattcccatggcatcaacaaattggataagccatcactagaactgcagagcttataccgcctgaacttcttggtgaccaaactagaagctagcaatagcgccaaattgagtaaggaaattgcagatagaacccaagaattaagttggttgaaaggcgacgatcttcaaggactaggtctaaatgagttgcagcaactggagaaaacacttgaaataggactcgatcgcgtgactgacataaaggaaaatcagataatgagccagatttctgaacttcagaaaaagggaatcctgttagaagaggagaacaagcatttaacgaaaaagctagcggagaaggagaaggaggctatgctgtgtaaggcaaaaattcctttcatggtggactcagataagggaataatgcaggaagaaggtgtctcgttagattctacaaataacattagtagttgcatcagtgatcctcctctcgaggatggttcctcggacatatctcttacgttagggctacccttctctaactga

SEQ ID NO: 112269 - DNA, 441 bp, Glycine max
  Peptide Sequence Number=SeqID_229047
atgatgggtttgtctcttctacttctttccgttcaatccaattctttgcctctaccattgtcagttcctagcgggcttcctctcatgggatatatgacacctctgcaaggagttgtatccatggatgggactcctgtgaaatctacaacaatatcgcctccccatcttctttttaaccagccttggccaaaaaggtgtgcaacccactgttatattgctcgcaatatattgtgtcaccaacaaattgcgaggatgaattcattttggccaacaacagcaggttctgcatcactatatgggggtaagcccaacaatcttaatgttgtaccctccacagagttgcatgagaatgttcccggcagggctgcaaactcttctcaagacaaagggcatggtattgtcaagttttcagaacatattgggaaggacaaagcctattag

SEQ ID NO: 112270 - DNA, 213 bp, Glycine max
  Peptide Sequence Number=SeqID_229048
atggaggttgaaacaaagagttctcctagagtttctattctagagaagactaatgagaaaggtaagggaattggtcatgttgacgtgtcttattgggctaagctacttgatagtgcagtgtcattttctgcttttgatggtagatgttatggtaatctggacaaggaaatttcgcctactcctatctctcaagtagacgaagaaaagatttaa

SEQ ID NO: 112271 - DNA, 453 bp, Glycine max
  Peptide Sequence Number=SeqID_229049
cctgctgtggatgcccttgactttctagagggtgatgaggatccacttcttgaggtggattctcccgaggaagtcatgtcggcatctgaggcagactctacggaggatagtggcccgagggagatggcgatcagcggaggctcttcatcctacgcccccgtggagtttgacagtcaccgggagaggcgtgtccagctaagggaggacgagtaccctgacttccaggaagagatagctcgcaggcgttgggcacgaatggtgacccctatggctaaattcgacccagagatagtcatagaattgtatgccaacgcctggcccattgaggagggggttcaagacatgcgctcgtgggtgaggggtcactggatccccttcgatgcgaatgccctcagccagttcttgagcgacccgctgattttggaggagaaccagcagtgtgagttcagctag

SEQ ID NO: 112272 - DNA, 426 bp, Glycine max
  Peptide Sequence Number=SeqID_229050
atgcagcatctaggaagtgatcctagatcgtctcccaacgagcaatggtcaaccaaatggcatgatccgcacctgcctcctcctcgtagcggtccgggaaaaatcctgccccggtatgcacaacaactgggcgatggcctcctcatcgaagccgtttgcctggttcctcctctagctgaactcacactgctggttctcctccaaaatcagcgggtcgctcaagaactggctgagggcattcgcatcgaaggggatccagtgacccctcacccacgagcgcatctggacacgcctctccctgtggaacgactatcccttgatggcctcatagcgctcctggtgttcggcactccggaaccggtgactgtcaaactccacgggggcgctggagccttccccatgggcattgtggcgtccctaaattaa

SEQ ID NO: 112273 - DNA, 1260 bp, Glycine max
  Peptide Sequence Number=SeqID_229051
atgagaattgattttactgggaaagctgtatatactgcaatatgggttgctgctgtgtcattgttcatggagttgctgggtttctctacacagaagtggttgactgctggtggtttgggcacagtattgatttcccttgcaggtcgcgagagtttttatggattgtcctgtatattcgatttctcaaattttgttagagtaactcttcaaggcatagccatagccattatcaatcagatatttacaaacttcctttcgagtataatgattcatgcaactcggccatttgttgtgaatgagcggattcaaacaaagattaaaggatatgaggttactggtaaagttgagcatgtaggctggtggtcaccaacaatagttagaggttctgattgtgaagcagttcatattcctaatcacaatttgagtgtaaatgttgtgaggaatcttagtaagaaatctcattggcgcatcaagactcaccttgctatcagtcacttggatgttaacaagattaatagtattatagctgatatgcgcaaggttttggcaaaaaatcctcaagtagagcagaaaaaattgcacagaagggaagcaatcctcttggatcttctcagagttatcagtcatcatcgagctcggctagccacacccatccgcacagttcagaagatgtgcagtgatactgatttagatgttgatccatttgatgacaccattcccactcgttccagatcaaagaataaccgtcctttcccactgataaatccaccttataaagttaagccttcaactactacaaatgaggacaaagatactaagattgatgaaaccttgccatctgacttcaaagtagaacgtgacaaatttgctgcgacatcgagttcagtccagaagacctccaaatcccaaaagctcaaaaaggaaagagtaggaagttcagaaaagggaacaacatccaaaaatttgtcaaaatccaacgagtttggttctggagagactacttcaccatcaaaactagatgaagagaaatctgttatgtcatcatcatcagctagtcactccttggaagagaatattgttcttgatgctgccctgctgggctcaaagagaactcttgcaattgatgaagaattgattcaatctatccctgcagaaccacaggaagttgcagtccatcaggatgggagtgaacctcctatttccaaggataagaaggatggtgagatgtcttcatttcctactcctaaacaaaaggattag

SEQ ID NO: 112274 - DNA, 702 bp, Glycine max
  Peptide Sequence Number=SeqID_229052
atgcaggatatggcagctcattcagcctgtgattttggtgggggtaaagctgagaaacttgctctagcgaagtaccggcaggtgctttggcagggaagggtattgaactctcaattcactgatgaagagttgagaaatcaggggcgttgcccactgactcctgaagagattggattgctcctggcagctttgagtttcaacaatagaacacggctttatcttgcttcccacaaggggcatagggcactttgtgctttgacttgggacttatctggattgctttcatgctttcaggtttatggtggagaagctaggctagcaactttaagcaagttatttcctcttatggaagataagaagagcctagtctccacagaggaaatggccaaggttaaaggaaaggcatcactgttagctgctgttgattattacgtgagcatgcagagtgacatcttcatttctgcttctccaggcaatatgcacaatgctctagaggcgcatcgtgcttatatgaatctgaagactatcagaccaaacatgagactgttggggcagctatttcagaataaaagcataggctggtcagaatttcagcttgcagttcttgatggacataagaacagacaagggcagataagattaaggaaggagaatcaatcaatttatacgtatcctgctcctgattgcatgtgtagagcttaa

SEQ ID NO: 112275 - DNA, 213 bp, Glycine max
  Peptide Sequence Number=SeqID_229053
atgcagagttcaaaatgcgatgtctatcttggggcctacctgaatggtgctttaaaaggtcttgatgatgctccacagtctaaatcaaaggctcctgctaggtggattgtcgtcaagtattttaacgatcctagaccattagagccagagagattaaaggtgcttcggatccagtgggcacagtattatctccgagttagggctcagagctag

SEQ ID NO: 112276 - DNA, 993 bp, Glycine max
  Peptide Sequence Number=SeqID_229054
atgtctcctggtgcaagaaattctaggatttttgcccttcaaaacatgctttcgacttcttctgcaactctagtgtctatgttatcccagttgtcagaggcagaagagcagaaacgggttttcagtggtaaagagcgttggaaccaagtccggtcccttgctgatgccaagaatgtgatgaattatttgttcaatattgtatcttcgtccagagagaaggacatggaaataagagatctaaaagaaaaatttgtggggctaagctactcacttcgacagttggacatgataaaagctgaacttagtcacaagttgaagttgcagagtgatgctttgaaaagatactcagaatatgtgggagattcagaatattctgacttgaatgttggaggccacaagtattacttgtgcaagccggaataccgctggtctacccatctattggaggacatggatatatctgagacagagtcagatgatctgacagatgacgggtgggaagaatcaggaaagttaaaggtttggaaaaggaaatctaaaacaagacgctcagacattgaaaataatcaatccaacatcaacaatttagaagatttcaaagaaaattcaggagatatacttgtagatacccctggggaaactgcatcagatatttgctgctcttgtagcagaacctcattgtgcaagacagcaaaatgcaagtgcaaagctatgggcaatagttgtgggagttcttgcggttgcctagcaaccaagtgtgtcaacagagcatcaatatcaagtgaatcacaggagccaacacaatctgcaagtattgaagaaacaggccttcttgttactcaaggtgcagggttacttcagggagcactggttgataggcttgacgagacaaacagtggccgagggcacagaaaacctctctctgacataggaaatacacaggtgcgtgtcaatcatcatcctctaaaacgtcaaagacgttttcttgattaa

SEQ ID NO: 112277 - DNA, 437 bp, Glycine max
  Peptide Sequence Number=SeqID_229055
aggttgaagctcaaaagaaaagccctgtaaaagagcatgagtcaagagaaaaagatgaggagaaagatgaggaacaagcacaacaacaatgggagaagtactcaatagtagaaaaccaacaagaaaatattctccaaagcaataaccttcctcatcaactgattgacaagaaaggaaggcaaggagagcatgaggaaaccttaagtgtcattctttctttaataactaacacctttcttgaaattatttggaatgtccttccagattatatgaagttcatgaaatttctagctaaaagtcctttcactaagcgcaagcctcgcgctaagcgcatctctgttcatgcgctaagctgcaagtctcacgcacttagcgtccaacccttgcatctgaggctgatttggtccgctaagctggccaaggttgagctaagctaa

SEQ ID NO: 112278 - DNA, 365 bp, Glycine max
  Peptide Sequence Number=SeqID_229056
gatgtgcaaaagaaggcacagatgagaggaaaaagaaacaactggaggaagctgctcaatccagaagcactaacaccacgattgatccttcatctcccatcagacgacacgtgaagtggaagatgacccgcaccaagaaaactgagcaaatgacatctgaggcagcaaaggaaattgctaacaagattgcaagttcctttgtcgcccatggacatcaggatgtattgactgttgccattgggcgacaagaacaccctggtcgtgtgcatgctgttggagttggtgtcacaatcaaacaatactttggaccggctccaaggacctcccgcacttcttcgtccatggctcccgaagacctggagtag

SEQ ID NO: 112279 - DNA, 726 bp, Glycine max
  Peptide Sequence Number=SeqID_229057
gtcaatgtattcccattgaagaaaaacactcaagaagtttactatatgggaaatcaacagagacaaggatatactcaaggaggattctcatgcttccagaagggtccttataaccaacaaggacagtggagatcacaccctggcaatcaattcaacaaggaccagggtggaccttccaacaggccaattcaacaagggtctaccatctttcagaggactactaagttggaggagactttgactcagtttatgcaggtaacaatgtcaaatcatagaagcactgagtcaacactgaaaaaccttgaggtccaggatgagtatagtgttgtatccaagaagaaagctgctgaaaagaaatgtactgatgaaaagaaagatgatgtgagagctagagagaagaaaagagaaaaagctgtgaatgaaggttcggaagtaccatatcccgtggtaccttccaagaaggagaagaagcgtcatttggcgagattcttagatattttcaacaaactggaaataaccatgcccttcgaagaagctttacaacaaatgccactttactccaatcactatggaaaggcacttattgatctgggagctagtattaccataatgccactctccatgtgcagaaggttgggagagttggagatcatgcccactaggatgactttacaacttgttgaccgctctattaccagaccatatggagtaactgaagatgtgctg

SEQ ID NO: 112280 - DNA, 207 bp, Glycine max
  Peptide Sequence Number=SeqID_229058
atggctcccgaagacctggagcagctgatacaaaaaattaaggaccatttggaggagtcaatcatagaaaaaatgcactcacaaggactcgcaatgcctcttaagcctgaggttggtctttcagctactcctgtcaacacaaaggagagttgtgttgatccctcaaggaataacccagacacgggtgatttagagaaatgcaagtag

SEQ ID NO: 112281 - DNA, 1239 bp, Glycine max
  Peptide Sequence Number=SeqID_229059
ggtgtggagaactcacatttgatattcgagtttatgatcgtgaagctgatgccatagagtctttaatcagtcgtgggctgaaggatgagtatggaaattatgttggcaagcttcaagccagacaacttttgaatgagtctaacggtatcggtgtgtatcgtaatggattcagaatccgaccactcggggatgctgattttgactggctaaaattgaacgaacaacgtgtacaaaatccatcgctacgtatcggtagtaaccaagcaatcggttatgtgcttattcaatctgaagagcaatccagtttgattgaaaaaagtgctcgtgatggtcttcgtgaaaactcagcgtatgagcaacttaaagaaataaccagagaagtaattgctaaattggaggagcgccgcttcagttaccgtcgcaaggcaggtctgagcaaaccagccttgaaagttgaaagggagctagaaagactcttttcttttgacagcctgaaaaaggaaatccggaaaaagttgattggtggtggcatggctgaaagtgcagccggtgaagttattgccctgattacccacgaggaagaagaaaaagccaagactgcagaagatattcgccaagctgttgctacttatcaaggacaggctactctcgggaaaattattaatgtagttcttcatgaaggccgtcgacctttgaattacttccggaatgaagttccccgcatatccagattcgggaagaaattttccgaaactggagacaaaaaaaacattgaagaaatactgagcattacaaaaggtgtcgaatccaattccaccattttgtcagatttattcaaaaggctagatcctctcgccactggaaaaagagctgctcgcaaaaaattaaatataaagagtgaaatcctaaacagctttgcaatattccggcacgaaatggaagagaataatataaaattcgaagtcaatggcgatggagatataatattttcagcatggagccaagatatttacgccatttttgccaatctgattgataatagtattttttggatgaaagaaaaatcatcagtcagaaagattactgtagatattgctgaggaaaatggacaattagcgtacattaactttagagatacagggccaggcatagaaccttccctcattagcgacagcgttatttttgaaccccaattcagtactaagccatctggaagcggtatcggattagcaattgccg

SEQ ID NO: 112282 - DNA, 666 bp, Glycine max
  Peptide Sequence Number=SeqID_229060
atggctattggaagaccggagcatcctggtcgtgtacgtggggctgggataggggttacaattatgcagtactttggtccagcatcgcgtcggtctaccacttcatcaaacatcactgtagaacagttggctgatataattggtaacctaaaagaagaatggcaaagacaggttgaacaagaaaacattaaaagagaggaggtgtggatgaggagggtagaagaggaaaaacagcgcactatggacacatttaaaggacaaatacaagaagctatcaagttggagttgtcacaaattgcatcacaacattcagccccacttcagccaaatgatatacaagtattagcagcaagggtaagcacgaagggaagctgtgcagcaacagagacaaatgcattagctaaaaaaccctctaagttgaatggtgacaacgtcgggctgcatgtaactgccgagaactccaacaaattagtggcagtgggcaaacagtgcgacagttttggcaccatccacaatgtgccctatgctgatgatgttgttcccgtgagtatggtggaagttatttttggtgatgcggaggttccaatccctacatcagaaataaagtttgtcaaagaagctttaggaagcagagaaggatgtgagctcaccattgaagactgttga

SEQ ID NO: 112283 - DNA, 234 bp, Glycine max
  Peptide Sequence Number=SeqID_229061
atgagaaccttaaggtcttctcttgcatctttgactcaatcttctaggagccttctatccaatgctcttggaagggccttcaccgatgcaataagaaatgcagttggctggcctcgaccagacttcttttggcattgcatgaggatactgcctcatgatcaaaacactggagccttcttcattgttgtagtacaaaaagtttctcctctgtcagatagtttttcttatgactaa

SEQ ID NO: 112284 - DNA, 345 bp, Glycine max
  Peptide Sequence Number=SeqID_229062
atggctttcattagtactcgttcggattatggatatactccacctaagctgaaggggatgatagggagcaacaagaaggcccaacagagagaccaaaaaggaagattattccccctaagcatttcagtgattacgtataacagaagcaattacaagagagctgagctgtcatcttatttgccaagaagagaatatgatggcaagacccagaagacccaagaaacttcagaaaaacacttcagcgaattcttagtgtccactattctattccagactatgtacgtaccagtaaagagtgtaggaacacagggatgggacatggccttcacagcctacaagttttaa

SEQ ID NO: 112285 - DNA, 2733 bp, Glycine max
  Peptide Sequence Number=SeqID_229063
atggtttctccccactgttttgctgctctatctctctcttgtcttctccttgctatgcttctatgtgcagttggggctacttcttcttccaaaaatgccaccaaaattggccaaggctaccgtcttgtctccattgaagagacccctgacggtggccttatagggatccttcaggttaagcagaaaaccaaaacctatggccctgatattccccttcttaggttttatgtcaagcacgaggcagagaaccgtttgagagtacacataaccgatgcacaaaagcaaaggtgggaggttccctataaccttttgccaagggaacaaccaccacctttgagtcaaagcattgggaagtccaggaagaaccctattacagtctctcagtattctggttctgagtttctgttcagctacacttcagacccttttagctttgcagtgaaaaggaagtccaatggtgagaccctttttgacaccacttctggtgattctgacccttttagttcccttgtttttaaggatcagtaccttgagatttccaccaaattgcccaaagatgcctctttgtatggtttgggagagaacacacagccacatgggatcaagttgtaccctagtgatccttacaccttgtacaccactgacatttcagccattaatctcaatgctgatctgtatggatcacaccctgtgtacatggatctcagaaatgcaggtggcaaggcttctgcacatgctgttctgttgctcaatagcaatggaatggatgttttctacacaggaacttctcttacatacaagattattgggggtgttttcgacttttacttcttttctgggcctagtcctctgaatgttgttgatcagtatacttccttaattggcagaccagctccaatgccatactgggcttttgatgttgtggagaattacaagaaggctcaaatcccacttgatgtgatttggaatgatgatgatcacatggaagggaaaaaggacttcacactcaacccagtaaactaccctcgcccaaaacttctaaagttcttggacaagatacacaactttggcatgaaatatattgtcattattgaccctggaattgctgttaacaccagttatggtgtatatcaaaggggtatagctaatgatgtttttatcaagtatgacggcgaacccttcttggctcaagtttggcctggggcagtcaactttcctgattttctcaatccaaagacggtttcatggtgggttgatgagatccgccgtttccatgaacttgttcctgttgatggcctatggattgacatgaatgaagtttcaaatttctgttctggaaagtgcaaaattcccgagggacagtgcccgactggaacaggacctggatggatatgctgcttggattgcaagaacatcaccaaaacacggtgggatgatcctccatacaaaattaatgcctcaggaataaaagctcctattggcttcaaaacaatagccactagtgcataccactataacggcgtcttggagtatgatgctcacagtctttatggcttctctcaatccgttgcaactcacaagggccttcaagggcttcaaggcaaaagaccctttattttgtcccgctccacttatgtcggttcaggcaaatatgccgcacattggactggtgacaatcagggcacatgggagaacttgaggtactcaatatccacaatgctcaattttggcatatttggggtgccaatggtgggttcagatatatgtggcttctatccacagcccactgaagagctatgcaatagatggattgaagtaggggctttctaccccttttcaagggaccatgcaaactactactcccctagacaggagctttaccaatggcagtcagtagccgagtctgcgagaaatgctttgggtataaggtataagctactcccattcctttacaccctgaactatgaagctcatgtcagtggagccccaattgccagacctcttttcttctcatttccaacttacaccgaatgctatggccttagcacccagttcttgctaggaggcagtctcatggtttctccagtgcttgagcagggaaaaacacaagtgaaatcactctttcctcctggtagctggtacagtttgcttgattggacacacaccattacgtcaaaggatggagtctatgtcaccctcgacgctcctcttcatgtcgtcaatgtgcatttgtatcagaatgccattcttcctatgcagcagggtggaatggtctctaaggaggctagaatgacacccttcaccctcatcgtaaccttcccatcgggcgccacccaaggagaggctaaggggaacattttcgttgacgatgatgagttgccagacatgaaccttggaaatggctattcaacctatgttgatctccatgcaactgtggaccaaggagctgtgaaagtttggtcagaagtccaagagggcaagtttgccttggataagggttggattattgattctatatctgtgttgggattagaaggaagtggagcagtgtcttcactcgagatagatggaaagcctctaatgggtggtggctcaaatgtgaatgttactacatcagcacatgagcacttgaacaatgagggagaaggagaaaagaagactgtgatggttgctttgaggggcttgaacatcgttgtgggtaaaaactttgccatgacatggaaaatggggtga

SEQ ID NO: 112286 - DNA, 315 bp, Glycine max
  Peptide Sequence Number=SeqID_229064
atggtaatccacacacctgttcagcatccagagacgatcgagtccgaaggcacgcagagacaaattatggtcattcggcaacttttgtcatccagaggcggcgagcccgatgacatgtggagacaaattatggtcatccgcacaccttttcgccatccagaggcgatcgagtccggagggacgcagagacaaattatggtcattttgcaccttttgtcatccagaggcggcgagcccgatgacatgcggaaacaaattatggaaatccgcacaccttttctcaatccggagacgatcgagtccaatggcacgtag

SEQ ID NO: 112287 - DNA, 327 bp, Glycine max
  Peptide Sequence Number=SeqID_229065
atggcgaaagggtgtgcggatgaccataatttgtctctgcctgtcatcgggctcgccgcctctgcatcacaaaaggtgcacaaggaccataatttatctctgcgtgacatcggactcgattgtctctggatggccaaaaggtgtgcggatgacaataatttgtctccgcatgtcatcgggctcgcagcctctggattacaaaaagtgcagagtgaccataattggtctttgcgtggcactggactcgagcgtctcaggatggcgaaaaggtttgcggatgacaataatttatctccgcatgtcatcgggctcaccgccttgggatga

SEQ ID NO: 112288 - DNA, 592 bp, Glycine max
  Peptide Sequence Number=SeqID_229066
accgtccattacgcggtttcacaatctctgctttgtcttcctcttcactcttgattccatcaacgcttctctcgtcaccatttctaagaggctcaacaagactcgcgattggatcgtcgccatcaaagccttcttgctgattcacaggctcttgcttgacgcccaccctgccttccaggacaagatcatgcactccacgcgcctcgacacctcgaggattctcaacatgtccaacttcaaagacgatgcacattccaactcatcggatcaagtgggtttcgttcgggtttactcgctgtatcacgatgcgaaggttgattttgtggcttataggagaaaattaagcaacggtgttgttgaatctgtggagtttagggatgagtttggttttgttgagagagagagagagaggaatgaagttactcctgtgagggaaatgggagatgagagagttttgaagaggttgaaccgtttgctgtggatgcttgatcgtgtcttgggttgtaggcccagtcgtgctgccaagaacaatagcttggtgctggttgcgctttaccaggttgtgagggatagttttaagctttatgcagag

SEQ ID NO: 112289 - DNA, 453 bp, Glycine max
  Peptide Sequence Number=SeqID_229067
atgtctctttttacaacgagattccttccgtcaaattttcgggtggaagaggatagagtaaaccctcttcctccgtttcaagctgttctcgataagaaaagaaaaattagaaggaaaattgaagcagttgggatcccttatacctttgtctctgcaaattgttttggtgcatactttgttaattatttgcttcgttcttatgagaaaaagaacaatattactgtctatggcaacagtgataccaaagctgtgctaaattatgaagaagatatcgccatgtacactattaaagtagcaaatgatccaagaacatgcaatcgtgttgttacttacccaccatcgaagaatatcatatcacaaaatgagttgatatcattgtgggagcaaaaaggtggtcagaattttcgcaaggaatttgttgctgaggaagagattgtcaatctatcagagtaa

SEQ ID NO: 112290 - DNA, 471 bp, Glycine max
  Peptide Sequence Number=SeqID_229068
atggtcaaatcaaatgccaagaacgataatcccaaaaagaaaacagccaccgtaattattgttccaaatccgccaccttcttcgcaggcagagaattctgaagtccccatccccatccacaacctcaagttcagcttcaggaaagaaaagttcaacttcaggaaagaaaataataacaacacgaatgaaacaagtgtagctgtgaataaaccaagacataaaaggtccaaatccagacctgaaaacgctgcctcagccccaagggcagagggtaatttcgtggacccagatgcacccttgaaaatgccaagggctgttcgaagggaagcatcatccaatagtagtggcgttccattttgggacaggaatgctgctgctggtaataagtcagatgaacctgaagtttttgaaacaaggaatccactacggcacaaaagatcactagacgaaaaagagaacaacagacgctga

SEQ ID NO: 112291 - DNA, 1446 bp, Glycine max
  Peptide Sequence Number=SeqID_229069
atgcggtggcttggaattccaaagatcaatatttggagctattctggctggaaacttttacattcaattgacacaggacatacagcaaatatattctgtactaagtttataccagaaacttctgatgagcttgtagcctctggagctggagatgctgaagtccggttattcaatttgtctcgcttaaatgggagtggatttagtgacaatgccatcattgctccatctgcatattatcaatgccacactcgaagagtcaagaaattggctgttgaaaatggaaaccccaatgtagtatggagtgctagtgaagatgggactctaaggcaacatgattttcgggaaggcacctcttgtcctccagctggatcttcacaccaagagtgtcgaaatattcttcttgacttaagaagtggatctaaaaggtcgcttgctgatcctcctaaacaagtccttgctttaaaatcttgtgatattagttcaactaaaccacatttgcttcttgttggtgggagacatttgttcaatccgttaagtgttgaaaatgttacaagtccttttttggggggtataaataatattgttgataagctatgtgttggtggttgcctggttggtatatcaaatattggaagtttactttcaatgatattgagttgggaaatctattccattctagaggggtctctggagatggtggcaatcatggctatagtcatgtctagtgaaagaaatgacagctgtggctgtggtggtggcagtggtttcttgggacatccaagcttgcacttaactcatgttacattcagtcctgatgggcacgaggttctcctcagctatagtggagagcacgtttacttgatgaatgtaaatcatgctggagtgaaggagatgcaatatacttcaggagatgaatcaaagctgatgacatactctccgacaattaatgggtcagagatgcagccttgtgtatctaatgtcttcccaaatagatttcctattaaaaagaacattgctgcaaagcttgacaagtgcaggaaacaaataaaatatgctaagaaatcgttggacaatgggataccctattatggaattgatgcatgtaatgaggttttgaatggctatagccatattattgggcctgcactgaaacatgaatgcttgtgtactcgtgctgcactattggtcaagaggaagtggaaaaacgatgctcatatggctataagagactgctatgctgctaggataattgataattcctcttacaaagcactatactatatgtcagaagcattgtcacagatgtactgtagtagtgagaatggaagagtgaatagaattgaagtagaagcactagtgaatgatattgattcttattactgtcttgtatatgcaagttattttagggtgttagggtgggaacgggatatagaacttggacattga

SEQ ID NO: 112292 - DNA, 285 bp, Glycine max
  Peptide Sequence Number=SeqID_229070
atggaaagttcaggtgcaaaggcgttgttggagggtgggcggaatgggaacaacaggttgatcagccagtggtgcatgactgacaacggtctcagagaagaatggagtagactcaaagaaagtgacatcagcaaaaaccagataccgttgaagttgtggacagtagcaatgatatcctttctgtatacaagagtaatcgagaaaaacacacttaagagacttagcaacgagtttatctttacctgggaaaagatcatagacaaaacatatacaaccaagacatga

SEQ ID NO: 112293 - DNA, 798 bp, Glycine max
  Peptide Sequence Number=SeqID_229071
atggctgctattcgccattggccgcttcaccagttcgatattaaaaatgccttcctacatggtgagttggtagggaagaggtttacatggatcaaccccccaggttttactgcttctaaaggatctcatctttttgatatgacctgctgtgaagctgaccactctgttttccttcattctttatctgacatgtgcatttatttggtggtctatgttgataatattgtcattactggtgatgactttgatggatcttggtccgctaaaacatttcttgggcatcgaagttgctcaatccacttcggtattgtcatttcccaaaggaattatgctctagacattctcaccaagattgatatgcttgactgtcatccatgtgacctatggatcctcaagcttcttccagtcattggcatgctgtcaagcatccttcgatatattaagaatgcaccgggccacgcactattatatgaagaaagaggcaattctaaaattgtttgttactctgatgctgattgggcaagatcaccattggacagaagatctacttctagctattgtgttcttgttggagctgaaagtgaaattacatggctacgacaacttctccagcagctccaatttggagacacccagggcactaagcttatttgtgataatcaaggagctcttcacattgcatccaatccagttttccatgaatggactaaacacataaagatagattgtcatctccagtctcacattgattatatttgtaacaagcttggtgcatatgacatatatgctccagcttga

SEQ ID NO: 112294 - DNA, 141 bp, Glycine max
  Peptide Sequence Number=SeqID_229072
atgtccttagtaggcaacatggatggttaccaacttgattatggtcctcagttattaataggagaagaacaacagaagaagggaagagcccttgagaacaatgcatttaatacacatgtttcatacttcatttgttcatga

SEQ ID NO: 112295 - DNA, 462 bp, Glycine max
  Peptide Sequence Number=SeqID_229073
atgtcagtgtcaatggccatacttcttagattgccacattttaatggcaggtccattcagagaatactaaaatatccaccaacaaggactttgagtggagatgagaggcagctcttgtggaaattccgcttctctttgatgtctgaaaagagggctcttacaaagttcctgcgttgtgttgaatggagtgatgttcaggaagccaaacaagcattagaattgatgggcaagtgggaaatgattgatgtttgtgatgcactggaacttttgtcgcctgtttttgaaagtgaagaggtccgtgcttatgcagttagtgttcttgaaagagctgatgatgaagagcttcagtgttatttgcttcaattggttcaggctcttcggtttgagcgttctgccaaatctcgcctttctcatttccttatccagtgtggtatgtgcatgagagttgaagagctatttcag

SEQ ID NO: 112296 - DNA, 660 bp, Glycine max
  Peptide Sequence Number=SeqID_229074
atggtaggtcagggaggggaggtgttaggcagcacggttggtccacacatggtgcataataggaatgctttcccatatggcctgccccccaactatacaccacccaacgccatgcacatgtccaacgagaatgctaaccacgtcgttcccgtttcctttgaaggccagcaaccccagttggggaatacacctttcgctcagcctatgggggacgcctgtgaagagcctcgggattatgctcagggtgactttgaaccataccccatgttcaccgctgagggttcaatgtgtgatggtatgcctcaacccaatgccgcagggccccctcaacagtgcccgctgcaacctctacacttctccatagggaggctgccttcgaccgcggaaggaagggagaaattggatctcattaaggagaggctaagggccatcgaagggattggtgattacctgttcaccaacatggcggagttatgtttagtgcctgacatcgtcatcctcccgaagttcaaggtgccggatttcgataggtacaaggggactacttgccccaagaaccacctaaaaatgtactgtcgaaagatgggggcatactctagagacgagaagctcttaatgcatttcttccaagaaagcttggccaaggcggcgctcacctag

SEQ ID NO: 112297 - DNA, 461 bp, Glycine max
  Peptide Sequence Number=SeqID_229075
gtctagttaaggaagggtttaattggccaaattcggaaaaggacgttgatgagttagtgttggattctgctaacaagttagaagattatgggattaaggcagaagaggtctccatacctcttcatagaatgggattggatatatggactcccattggcattgagggtgctacagccactatgatattgggaagtgggctaggatggggaaggaagggtttatttgagacccaaattgccgatttgtttgggaactccttaaaatccaaagctagagatcttcctaatactgtaaagggcgtattaatgctaggttatttcatgataaggaaatataataataggtattatgctaaggctagaaatctatcaataatgttaaaggaagcttatgatgaagcattaaggaaatatgatgccctcataatgccaacaactcctatgaaagcccatgaggtatag

SEQ ID NO: 112298 - DNA, 165 bp, Glycine max
  Peptide Sequence Number=SeqID_229076
atgactcagatgtctgattcaggccaatactgtatcgagatgcttgaaattgaacacaaaagctctcgtcaaattcaaacagccataacttttgactctgtgcataatatatcgagaagctcggaattgaacaggaaaactctcgacaaagtcaaacagccataa

SEQ ID NO: 112299 - DNA, 744 bp, Glycine max
  Peptide Sequence Number=SeqID_229077
atggttagaatgagagaattgcatcggactttaggtagaattttaggaagaaccttaggtagacaacttgttaatgatgaggaagaagcccttcagtatcgaaggccgacaacatctgcacgtagacaacgagcaactgcagttgttactgaagatgttgagcatatgaattatgctgctgatgagattcataaagagtcatatgagttagttacggatcatgtaggtgctgatacagaggattttccaggtgccttccatacctttgatgctattgatgtagaggaagttattgacttcttagttgagttgcttgaagtcagtagaaaaggagctaaagatgagactgagcaatgcagaggggcatatgttcgcttagcatggttgcgagacaattaccatatcaaatgtgacgtaagacagtggactgtagcagcttgcgcatatttattgcatctagtagagtcttcaatctacgagcattcccctacaattgtgtctattattgttgatgaggattaccatgaaaggaaatcacgtgtttgtcgttggaagtttgggaagacattaccagtgatgacctatcgtaagcgcttggataagttgatgctagatgttgtgtgttggggttcatctagtgttagacgccaaccagagagggtagtgcaacaatttgtagttctctttgttaatgagctgcagactacatggagtgattctataggatatctcacccattcatga

SEQ ID NO: 112300 - DNA, 1185 bp, Glycine max
  Peptide Sequence Number=SeqID_229078
atggcagctggtgttaatggagaggaagatgggtttaaacagtggcagagcttggtacgccagacagaattgactgctcagttgtgttcaatcactagagaagtaagtaatgttcgtggtaatacacagaagaagattgaaaagcttagacaactactttctggtcttcttagtgaacttacctattttgatgagccaatacgatcacctttggcaccaggtgtcctcattactggaattgtaccttcagagtcatcaatatttaaaagtgcattgcatcctttgcgccttacttttagagcagcaaatggtggaacttgtaaaatcatatttaaaaagggcgacgatattcggcaggaccagttggttgttcaaatggtatcactaatggatcgattgcttaagttagaaaatcttgatctacacctaacaccatacaaggtgctagcaactggacaagatgaaggcatgttggaatttattccatcccgctcattggcacaaattttatccgagaatcgtagcatcataagctatttgcaaaagtttcatcctgatgaccatggaccttttggaattacagccacctgccttgaaacatttataaaaagctgtgctggctactctgttataacatatatacttggtatcggagacagagactgggttcaccagaaactgccacatgctggccagaaaacacagagctggaaaacacagatcaggagactggattacacgcacttagacaatctcctccttagaaatgacggaggtcttttccatgttgattttggttttattcttgggcgagatcctaagccatttccaccaccaatgaagctttgcaaggaaatggttgaggctatgggtggagctgaaaggtacagttctcattggatgattcactttagattcaagagtggttgtgcgatctgtagcttaaattgtgaaatagtggttgatttctttgtccctatgcagccaatattatacaaggtgaaaactgttcatttgttcttataccaaggcattgtggctgtgcagcttcaggaaaagtttcggttggacttggatgatgaagccagtatacatttcttccaggatcttatcaatgagagtgtgagtgcattattccctcagatggttgagactatccatcgttgggctcaatattggcggtaa

SEQ ID NO: 112301 - DNA, 615 bp, Glycine max
  Peptide Sequence Number=SeqID_229079
atgaaggtaatggaagaaataagagaaaagataagaaaggcaatcaaagaaggagttagcctaagggaaatagaggagataatcttgcaagaggccatgatggaagagagggaagcctacctagaagttgaggacgaccacaagaacgggacctacttcagatatctgggaaccggagacggagtattaagactcagagtaccgagaaccagaaagggtggcttcagacctaagatccttccggagaagtacgagaggaccagcccagattacgaggacttcctccagcagctcgttctatcaggcatgactccaagtcaagtcaaggccgtgttagcagccaagggaataccgtatagtgagatcgtaatgaatcgggttgccgagagaatatccaacaaactcaaggaatacaagagccgcgaactacctcacgatctcctagccctttacatcgatgtgaagatcgtaaaggtcagaatcagcgagtcgatcatggagagagccatttacattgccataggagttgacttagaagggaataagttcgtcttggactacgaagttagggatagggaggacttggacggttggaagtccttcttgagcggactc

SEQ ID NO: 112302 - DNA, 132 bp, Glycine max
  Peptide Sequence Number=SeqID_229080
atggattccagagatgcactggatgcattgggactggttcggtattgttgtaggcgcatgcttatgacccacgttgatctcattgagaagttgctcaattacaatactttggacaagtctgatctcaattaa

SEQ ID NO: 112303 - DNA, 410 bp, Glycine max
  Peptide Sequence Number=SeqID_229081
atgaggtacgccacacaagggcccgatggaaggaaggatgcgtccgtcatacacactaaagttgatctatcctttgccaaggacccgaagggaaaggcaaaggcgggcgtggaagagagcatcaaggcgagcccgattctagataaagaagtcccagccgaaaggtttgccaaggaagaagatgacttcaacaaaaaaaggatatctgctgaagaagcaaccaagggcataatcaacaatatcatgaccaacaattacctcaaattcgctaatgaagagatactcgtggagggatggggacacaatagagccttgcacgtatccgtcaaatgtttggaccatattgtggccaaagtacttattgacaatgactcttctcacaatgtcatgcctaaggctactttgaacaa

SEQ ID NO: 112304 - DNA, 1095 bp, Glycine max
  Peptide Sequence Number=SeqID_229082
atgaacattgttggagtagactttggctttgctccaaacctcataacacatgtcaaatgcctggtacgaaggtcggagattagagcaatagagaaccaaagaacactgcacaaagaggcgtcgattttccgccaactagctcgatgcttttcgggaatgtctgtagccttagtgatggtcttgccagcgagtcggtgtcgcgtgccggcaaaggaggatgcgcgcgaacttcatgcactagagaagaagcacatgggaacgcgtgtggcggcacagcgatggaggttttggtcaccggggaggggtgacagtggttggaggtcgtgcgctggagaaggggccactggttgctgccaaacagtggctgaaggtgcgggcactattcaccgcgaagctgcgcaccaagcggaattgggtagacatgaagatgctttggagtttgctgttgcttcccattctttggccccatccaaatctgaagttgcagaaagagtagcgaatgtgaagagggacattgctttagctgaagctgaaaaaaatagtcagaccaatgatggggcatcaaggtttgatagtaggggtggaagaatattatcattaagcgacatactctattgtcctgagtctaatagtgatgatccacatgatggttcaagatcagagagggatgattctgattacgatgacgaattggagttggactttgaaacatcaatatctggtgatgagggacatgatcttgaatcaaatattcttcatggaaatttaaatcttagaattcatgggagaggtgactccagagacaatgctgatgcaagtggctcatgtgaatcaccttcatcatcgtcacagaacagtagaacttcttatcagcctgaaccagctgttgatatgaaacagagatttgttggccactgcaatattgggactgacataaaacaagccagttttcttggtcaaagaggtgaatatgttgctagtggaagtgatgatggcagatggtttatttgggaaaagtgtacgggcagactaataaaaatgctgagtggtgatgaatctggtaatcattggtttcctcaaggttttcgggtttag

SEQ ID NO: 112305 - DNA, 528 bp, Glycine max
  Peptide Sequence Number=SeqID_229083
atggctttgccacctagctcgcctcctcctcctcctcctcattcagacgcatcaacttcatcaacacctggtgctaagagaccagtggtccacgttgatcatgctaccggcaaggacaacggtccccacaggaagaaattaagaacatatttgagggttatgatgcgtgataaggtgggcgtcacgtatgagaactggaaggagttccatattgctcagaaggacttgatttgggaggatattcaggcttctgacagtaggatgaaaaagaagttacttaagactgtcagcgagagatggaggcagtttaaatcagacctcacgaggaaatgggcccttgcagccgataatggcggtgtggacgacactgtttgggagaaatacggcataagccagtttttccagactcgcagagacccttcttgggagaagctcctggctgagaagaccaagaataagctggaggaagctgcacagttaggaagcgtggatggcatcatcgaccctccatcccccctacgacgccag

SEQ ID NO: 112306 - DNA, 320 bp, Glycine max
  Peptide Sequence Number=SeqID_229084
gccgcaaccggtgcatttggaggcgtggttcttcgaggtggtgccggcgagttttgttgtttgacggcggcgaggagcttgccgccgtcgagggtagctctgtagaccctgccgtgacttcctctacccaagaaggtgtcggcggagaagccgttggcagcggcggcgatgtcggcgtagtggaagtgtcggattggtgttgcggcgaggggcttgtgtttcttgaagtggggatcgcaggtggcgattgcggactcggcattgcaagagagaattgcattggaatctattttgcaaggccttcaggctataagagatga

SEQ ID NO: 112307 - DNA, 663 bp, Glycine max
  Peptide Sequence Number=SeqID_229085
atgttaactttagtcccgccgtctgtggtggactgggcggtgccgttgattaagctcggcgacttcgccggaatctgcgaccggagaatcggaccgcagccggaccccgccgtgctgcggcagctcgcggtgctggctgccagatgcgtgaggtcgacggcggagaagcgtccgtcaatggcggaggtggtggagtgccttaatctggcgaggaagaggaatcgcgcgtcgccgatttggaacaatttgcggaggcgcgtggcgagcgtggagagcgcgcttccggtgtgggaggaggagtgtgatagtgataggagtgagaaatttgagaggatggtgaagaaaggtgggaaagggaaagtatcgagtgtgtcgcgtgtagggtatgggaatgggagtgaggcctccaataataatgataaagtgatgaggtcaaagtccattggttctggttctggttcgttgagagggagttgggttaaaatgcaacagcaacaacaccaaacggacaacggctttggaagaaggaaggtgaggctaaaaaagtcaaagtccatgggggttttgcaaggttctctgctgttacattatggcatccagaataacaataatgatgttcgggaatggccaagttggaaaagaaaatgctggaaaaaccgttag

SEQ ID NO: 112308 - DNA, 153 bp, Glycine max
  Peptide Sequence Number=SeqID_229086
atgtcgtctcttgtgttgttggatgtgaaaggtggtttccagccagctgacatgagagtgacacaaatcaatagaagggaaacactagctaatagctatgccttaggaaaaacacccaagggcatcaactatcaacttagacctaatagctag

SEQ ID NO: 112309 - DNA, 291 bp, Glycine max
  Peptide Sequence Number=SeqID_229087
atgctccacaggccgcaggcgcgccaccaccacctcatcaggctggccaggctgggtcatttgacatggaccagtatttacgatgagcctcagcatgcagagccagggcttcgttctttttcatgccctactccagaccagttcagggcagaggtcgcgtggcccggagattggcccgaggcccaagcaggagaggcgcccccagaagctcccggcgatggcgaggaggcccacgaggacgaggagatgaccaatttgcttgacttcttgggagggagtggagctacatga

SEQ ID NO: 112310 - DNA, 375 bp, Glycine max
  Peptide Sequence Number=SeqID_229088
atggcattccaaaagtcctttatcattcttgattgggtttgcaacccaaacaacccattgaacccaaacacctttaaatttttttcaaatgccccattgcacagttcgggaaaggaaggggcgggaaactcacctttgtcgtcagtgtcgcacgaaagggaaaagggatgctttgagaattgggggagacattgtgttatgagggaaatgccaacatcgcatgaaggggaagggggtctcaatttgcgtcggggaaggggggggggggtcctacggttagggtttgaggttgactatggcgtaactacggtggtgccgccaaggaagtcaggaagaagggtgttgtgggttggggcaacatggagaacaaattag

SEQ ID NO: 112311 - DNA, 129 bp, Glycine max
  Peptide Sequence Number=SeqID_229089
atggcatgtacaaaaagagtcaattttgatggtgacgatcatggtgataaacgcataagacctacaatgtcaaatccatatggaaaaggatgcaacagttctcgtgttggaggagttacttggagttaa

SEQ ID NO: 112312 - DNA, 264 bp, Glycine max
  Peptide Sequence Number=SeqID_229090
atgttctctggtccttcatctaaaaaggtcacagaggaagattactacttggctgagtggaactcaaaggagaaggagaaaggctcccatcatgcaagcttgaaatttgctgataatagcagaagtgaaagaggcagaaagctgaatgcttcaaccgagcttaccgaggaaatcacacccccacatctttccttgggaagtgaaatggttccaagactgtttaaattttctgctttgatatctcgttattattccctactctag

SEQ ID NO: 112313 - DNA, 387 bp, Glycine max
  Peptide Sequence Number=SeqID_229091
atggcatattcgagactagctggactgtactccataggaaaatttgcccacaatggtgttgattacacctctgatctgttgagcgggttcttgttcttgtggaggttgtcgctcacgccactattgttggtgtctctgtctaccttggtcttccgctttatctattcttctgtctactttgtggttcctatgttgctcatcttggtgccctttgagtcttgctcctgcttcgtgggcaaggagcatggaatgcaacactaccatacggtgagatccgttggttgcataatgcgcactaaagcattcgacaggggtgttgaagttgtctatggatctaggtgggagtccaccatactaggtcaatgcctccccctcgagggacgttag

SEQ ID NO: 112314 - DNA, 3093 bp, Glycine max
  Peptide Sequence Number=SeqID_229092
atgacttcacacgtcagtccattgaaaacccaaccgttaagggttggacgtctgtgctcctggaccaaggctgacatggaaggtaatagccttgtcaagtataagggtgacgagtcagtcgagcccctaagcatggacaagtgttgtccgatatcgagagtggtagcctcaacaagagtgaaagttgcagccaagggctgcatcgtggtgcaaaaaattagggcaccacttcagctcccgctagttaacgaagagtctgactcctctttaaatgcagtggatgatacttgtcatggtgcctctaacaacgaatcctcttcctcggagaggttgagggtttcatgtcgtgctggtggaggcacctctcacctccatgggagggtgcaaccttccactgcttccctggtcagggaacctgtcccagtcactgtgattctcaccccttctgcttctatgggagcaagcataagtgttggggatgttaagtataaatcctctatcacctctgtggcgagcattgctcctctgcaatgccaagtgaaactggaaagccctgaggactcctacaagatagtcttcagtctcattctccccttgacctctttccagtgtgctcttcttgagtacttgaatgtggccccttcccaactccacccaaatagttgggccatgatgaagctgactagcaagattggttgggtcttagctattgatgtcatggctgatggtttgccaccgatgttcaataaggacggggagcctcgcttctcgttctattggcagaataaccccacatggttcaagtcatttgatgaggatttgttgacccttgaggaaagggtcgacaaggctatcttggagcagttaccgacctcgctggatgcgcagaccattttgtcgctttcctcagcgagcgatcccctcactgccttggacgataaatgttttaccttgtcttcctcttttgtcaaacctgttggtgggactatgcccctattcgatgttgctcttgtatctagagaagggggacaacctgctgttgaggttggcgctattgctagtgatgctgaagttgcccacgaagcttcttcctttgtgttgactaagaggaagcgggatgacggtgttggaatgttgggccacaagaagtcgagggctctttttagcctttgtgccctgaggcaagctacagggttaacacctagttcgggttgcccttcaagtttacaagatgtgcctctggctccactgaccgtcgaggctcctacttctgttgttgttgttgttattgttactcctatccctcgacctcctcttgttgtgtttgttcaggaggcctcttttgctgctgaagttagtgcgccaactacttcggctagttttgttgtggctcctttgtccaccgttgttgtacccttgttgagtgtcgatgtggcaaccacgactgctcttgtgatgttgtctcctcctttttcagctctaccggttccttcgtccactgtgttggcgttggtgtccacctcttttcacctccatgtttccttggaccacatttacacttccagcgatgttgattccctgtggggcatggggtacaagcctgaacaaaagaccttgataggctttgtgtcagccttagataaaaatctgattcaatcagatggggtcaagcatgccacaaattctaccaagagcgccactactcaaaatgtttcgagagtgaagtgtcccaaggtggtcaacgccagtgttgcctttgctaaggaaaagaaaaaggacatggttggacaagtggagggcattatagcggagaaggatgagcttgtcaaggagtctgagctgtgggcagctagggagaaggaggtctacaaagagcttgaagatgagctaataatgtacaagaaaaaggttatggagcagcatgaaaaagttttcaacaaggccgttgggcaggtcaggttcttctccaaggaccttgacttgggtctttttgaccctttcaaggacatgaaggatggtgttctgcttgacgagaaagatattgctactgaggaggaggccgaggaggagcaggatgctgatgatgccgataatggagtctttgaccttggtgatgtaggaagcaaggccttgggggtgttaagtaaagtaaagaagtacatgaaatcatctccagcttctcccttgatggttatgaggagttggtatgactttcgagtaattgaaggtcttgctgaccattttggtgactcaccaagggaaaaccttgggtttgacgagcctttggagaatagatcaaggacgcgaatgtcctggattttggcaagactcaccaagggtggaccttgggaaattgtccgtcttgggttttggagagactcaccaagggagaagaaccatgggtttgacaagcttagagactcaccaaggacagaccttgagttttgcgaaccctttgaagaaacaacctatgagactcaccaagggtggaccttgggtttgacaagcctttggagaatcgaccagggaattatccgtcctgggttttggagagactcaccaagggcggaccttaggtttgacgaacttgcttgttatgaccttgaattagccttcccagttgagaacaagctttctccctcggggatattttctggctttgcctcgaactcgccacacgaggtcgtcgggttgaaaggctcgtggttgaacctttgtattgtatcttcttactgctcgaagcttggtagcttcttccctgatcctggtcatttcttggacttcatttgttgtctcgagttctactctcattgccctgaggatgactatgttggctgcctctgtctgaccattggtctgagaatgtttgacagaggtaataagaagaacatacttgcatatgaggtgtttccaggtgaatttctccaccttgttggccataatttctcgcagtgtggtcctagtatgtctattccctacatggcaaagggccaaggggagctcaaattatggagatttctaggagggatagcaaatctcttcatggagttctctcatgacataatctgtctgttggtcattcaagaactttaa

SEQ ID NO: 112315 - DNA, 954 bp, Glycine max
  Peptide Sequence Number=SeqID_229093
atggtcaaaaagtccaacggcaaacgatggatgcgcaccgactacattgatctggacagggcgtgtcccaaggatgcataccctctacccagcattgacaggctagttgatggcgtccagggaataaaagtcaaccccgaaaaatgcatagccatattggagaggcatagtcctactaacatccaggaagtccagaagctaaatggtagtctagcatccttgtccaagttcctccccaagctcatcgaaaaagcaaagtcgtttcacaaactgctcaagaaaactaagtcatttttatgggacaaaacctacgaacaagccttcttaggcttcaagaagatcattgctatatctggtagtcaagatgaattaccccatcaaataggttttgtgaaagccaaagctggtagtgaggatggtggcatggtccatggaacttttagagttcgatctttagtacgaaccctaagccccatgaagaaacaattcatggtagacttcctaacaaaattcgttggaaacaaccaaaccaacctagattggtggagcctttatgttgacaatgtgtccaacgtgaaggtaagcggggcaggaatcaccctcgaaggccctgacaatgtcattctagagcaagcccttaagctcaacttcaaagccttaaacgatcaggttgagtacgaggcatttattgcaggtttaaaaccaacaagagaagttggggcaaagaagctacgatactacacaaactcgcaacttgtccaggggcaggttgccaacagataccagaccaaggaaaacgtcttgctcaaggaaagcaacaccagagcatacctactctccaagctggccaacaccaaaaagactgagcactttaagattatcattcaggagatgctccaaactaccaccataggcactgaagaagttatgaccggagaagaagaaccagactag

SEQ ID NO: 112316 - DNA, 1614 bp, Glycine max
  Peptide Sequence Number=SeqID_229094
atgacgttggtgagccaggtggaatacctaacttctctgatgaagttggtcatgaagagcttgcccacttcttctctaactgctttgtgtcattcttgtcccatcttcctcttattctgtgataatgacattagctatgcatctgtgctcaaggatggtgaggtccgtgttgagctgtatacactggccaaacactttgtccatgctcatgacttgagtggtaccatccactatggggtgaggtttcgcaggctccctggtgggaggataagtggggaacttaatcttcaaatgcagtatggatatgatggctccgagcttgttgagtgttttcctgccaatcaaagaaaagtaaaagagttggccttgaccgaaggtggccataaggttgacataacctctggtctatactcattttcttgtgaagccaaggagtggactggcatgagactggatggtgaccttggacaccatgaagttgacatttatgatgaaggcaaccatgggttgatgtcgatgtctcaaatagttgaaagtgacgcttacgagactggctggactacccttcgtaggagaatccacccgcaatggtcagagataacttatttgttggggagcccaactgctaagggtcaggcgttcgcgctcctgtgggctcctgttcttgtggaggttgtcgatcgtgtctcaactagagatgtcttttccttcctcagtcttccactttgtctcttcttttgtccacgtcatgattcctatgttgatcctcttggtgtcctccgactcttgcttctgcctagtggttgtccagcctctaagcaaactaggctagggccaagcaatctcttgtgttatgaccgatactctgatggggtgtgtaacgctcgtacttgggcccttttgggagaagatggcgcttgttcggcttgtgcctcttgtctgacttgtgtgattcagtcttgtacgagtgttgagctaacaacttcttcagctactaagaaatatagaagtaggggtactcctggcctgggtcggctcaaaattggcggtgtggctatggtcttcttgaaagccaagaaagattttttgcaagtctcatcctataaggaagcttgttcgcaagtcgctatgaatcttcaatatggtactgcatttgtcggggtgcatgtcatatttacagagttccccgaagacttattccaggtctgccatgtgttgggttatgctttgagacttgacgaccatgtcatccacagtaagcatccaggaagcttaacacttggaatctttggggaacgccttgttcatatcagtgtagttagtacacatttgtcatttgtcgttggctttttttaccatgacaacgctggcgagccaagggtagatggaaaacttgtggcaaataatgcagctatggattcccgtcatgtcagatggttgctaagcaaacaaatctgcatttttgtgttgcatgtcagcgatgtgctggtgctcatggttggtgaggttcctactgagctgcgtatacaacccaagtttaggttcgagctgcaacttgatgagctctttgatgagttttgggcatctattaaaggtgttgtctcatggatctaa

SEQ ID NO: 112317 - DNA, 162 bp, Glycine max
  Peptide Sequence Number=SeqID_229095
atggcaaacttcatggtgtctaagagactcaaggtcttccctgacactgcccatcctcaagctggtccactccttggttttgcaggcaagagagtagagaccagaggctacatggacttgaccactttcggtcaagtaaactttccaggagtttcaccataa

SEQ ID NO: 112318 - DNA, 1154 bp, Glycine max
  Peptide Sequence Number=SeqID_229096
atggatatagaactccctgctgcaactgccaatgaatcacaacaacaaaagtttgctctacctgtggattctgaaaacaaggccactgtgttcagattattttccttagccaatccccacatgagagcttttcacctatcatgggtctctttctttgcatgcttcgtgtctagctttgctgcaccaccccttctccccataatccgcgacaacctcaacctcacagccactgacattggaaacgccggcgtggcgtcggtctcaggcgccgtcttggcaagaattgcgatgggaacagcctgtgacttggtcggaccgcgcctggcctctgcatcattaattctcctcacagcaccgtttgtgtacttcacatccatcatcaactcttccacctcttaccttctagttcggttcttcaccggcttctcgctggccacatttgtatctacccagttctggatgagctccatgttctctgctccggtggttggttcagccaacggattctctggtggatggggaaaccttggaggaggggctacccagctcatcatgcctctagtattctccctcatccgcgacattggcgcttccaaattcactgcgtggaggatcgcattctttgtccctgccatgttccaaatgctaacagcattctccatcctcttatttggtcaggacatgcccgatgggaacttccaccgcttgaagaagtcaggggaaaaagccaaagatgatttctctagagttttgtttcatggtgttactaactataggggatggattctagggttgacttatggatactgctttggggtggagttgaccatagacaacatcattgctgagtacttctatgataggtttaatctcaaactccacactgctggaatcattgctgcaagctttggcttggctaactttttttctaggcctggtgggggttatatatctgatgtaatggctaagaggtttggcatgaggggaagattgtgggctttatggatatgccaaaccttggctggtgttttctgcataattcttggcctggtgggatctttaagtgtatccattgttgttatgatcatattctctgtgttcgtccaagccgcgtgtggaatgacctttgggattgttccttttgtctcaagaag

SEQ ID NO: 112319 - DNA, 239 bp, Glycine max
  Peptide Sequence Number=SeqID_229097
gtgtgacttctacaagtggagatgctatttcaccatctcaaaaaatcgcaaggctcatggtggagatgattaaacatggtgatcaaatgagaaaaagcgaagaagagaggacaaatcatctaattcttttcatggagaagtcaaggggtatgaagagggttagggaggaagaaggaatgaaagttatagggagagaagaaatcataaaagatatagagataggcaaagagaggaagtga

SEQ ID NO: 112320 - DNA, 423 bp, Glycine max
  Peptide Sequence Number=SeqID_229098
atgtgtcctcttccaagacatttaaagcactttatagagctagttttctcttgcatactagccttaggggcttgcttttctattgccttccccttatcatctttgggcttagaagaaagcagacgaacctctgttgatgttttccttaaggctgctgggtatttggattgtgcagtcaaacatgttcttccacagttgcctgtggaactcaggagaaatttgcccgtagacctagcagaaggagttcttcgagcactctgtctacaagcattaggacaggtgtcgcaacctacccttcggcgggaaggcgaagcgaggctcaggggtgcatcttccaagaaaggaaaatgcgcgaagttgccaccaacgtttattcgaggaaaacgtcggaaaaacggaaaagacatggtctacgaactttaa

SEQ ID NO: 112321 - DNA, 1341 bp, Glycine max
  Peptide Sequence Number=SeqID_229099
atggggtttgactacaccattcaataccgttctgacaatcataatcaagtagctaacgccttgtcacgattaccagagcaggaccaggcttccctcatgatcttgtcagtgccctgtttgacattcatggaggaacttcacagacaacttggtactcatccagaccgtatctggttaccctgtggattttcattgattcccacattgattactgaatatcacgccaccccaaccggaggtcatactggagtagctaaaatcgtagcacgggtgttagaaaatttctattggcaagggctccgggagaacgttgctcagttcgtagccaagtgtgtagactgccaagtaacaaagtatgaggctaaacagctggcaggattactgtgccctctcccagttccttctcgaccctgggaggacctgtcattggacttcatagctggcttgccctcttaccatggtaacaccatgattcttgttgtggtggataggttttccaagggcattcacttgggaatgttgctggcaaatcatactacttctggggtggcctcactctttatcgacattgtgaccaaaattcacggcattcctcgtagtcttgtctccgatagggactcattgttcattagtagattctggcaagacctttttcgatcaagcggaactcaattgccaggtgcttggggaaagcttttgccttgggttgagtggtcccataatacagcttggaatgcaagcaccagcaccactccatttgagataatgttcggtaagaaaccattcaatttgccagattatatcacaggaactgcaaaggtggatgctgtggatgatattctggcgggaagggaagctacctttcaagcaattcgaaagaagctcttaaaggctcaagcatgtatgaagacatatgctgataagaagcggcacgaggtcaattatgaatgtggtgactgggttttagtcaagctccgaccataccgcgaaacatcggcaaaaggaactccggctagtatgggcaaattagcaaagaggtattacgggccatttcagatcatagagagaataggtcccatggcgtaccgcttgcaactaccaaaaggagcacgaattcaccctattttccattgttccacactcaaaccattccacggtttgccaatgacgtcgaagccagcagagctacccccaaattgcattgacaatcaacccctcatttttcccttggccatactagattatcatcgtcactcttccgatcctaacgctccttgggaagctttggtgttttggcatggcctgtccccagatgagacatcttgggaggattggtcgtag

SEQ ID NO: 112322 - DNA, 546 bp, Glycine max
  Peptide Sequence Number=SeqID_229100
atgccgccggcatcgtcttcttcaccgatgtcgaaaaatccggctttgtcgcacacaagatctcgcagacgctcgtctctctcgccagtggatgctttccacggtgacattggaatcctcaccaatcgcgatgtgcttatcctcctcagcaagtcctatgccactgaggagctcctccgccttgtgctgtgtgcgggggccaaaggcgcgctcctcatcgcgctcacctctgtcgaaggcaacgcgctcaccacggcgtgcgacatgtccgtgcatttgccgctccggagagagctctgtccaatcaacctcgcaccagtgacatccactgctattcaaatggtgttcggcgacaccatcgccatcgcactcatggaggcgaggaatctcaccaaggaggagtacgccgcgaaccatcccgccggcaagatcgggaagagccttttcttgaaggtgaaggatgtgatgaagaaacaggacgagcttccaatttgcagagaatcgaatttctttgattctgttccaatttttaattgtgaagactag

SEQ ID NO: 112323 - DNA, 834 bp, Glycine max
  Peptide Sequence Number=SeqID_229101
atgtttcgcaaggaaaacatgatctctgaattgcataccaagaaaggaacttggaagatagcagtacaaatcactgatatgtggcacgttaacaagcacaatggtaaacaagcaatagaaatggtgttcatggaccaaataggtgcaaagattggtgtcactctttggcaagaactgtttcctgaatttgaggtaaagttgaattgtggttctacacatgtgattcagaacattaaggttgttgaaaatcattctgaatacaaagtgagtaggattccatttttggtttacttggtgaaaactacttctgtgagggaggtcgaacgtcctgagattcctactaatgtccatgttattactccatttgctaatattattgatggagtagtaccacgtgacactttagttgatgttgttggtgttgtggtcgaagtcattgagcgtaaaacagttaatcctacatatagagttacaatcaagttgagggataacaattatagtgatagggatatgatcttgacttgctgggaggaatatgctcttccacttgatgatgctatagagaaaaatcattttgataggaagccattggtggttatgttaacacttgctaagatcaaagatcctaaaggtataccattctatgctcgcagactatcagatcaaggaagtgtttctcaatcacaatatagtcaatattcccaacgaagctctatggacaagttcttgcataatgctcaaatggtgatgttaggtgaaataagcaggctgagacaagactgttactgtttgaccgttggtacggtggatgaagtaatgattgatacaccctag

SEQ ID NO: 112324 - DNA, 276 bp, Glycine max
  Peptide Sequence Number=SeqID_229102
atgggtgttaagtacctcgaagcggtcaagcgagggtcgcatgctatcaaacaaaggtccccggacgaaattaggtgtcttttgtctacttgttcgtcaatggctaaagtaaaactaatgcttatgaatctatctcaattgtatgcttatggtgacttagctttgccaggtagtgacataagcacgtgggttatgggcccctatggttacgcagcccctgaagacatggctacaggcttcactaaattttcatccagcccaactaacctcctataa

SEQ ID NO: 112325 - DNA, 1768 bp, Glycine max
  Peptide Sequence Number=SeqID_229103
atgtcatatgttgcagccccattatcacaagaaacattcactcaaaattcatctcaaactcagagacacattagagtgaaaagtgatccagcttggggacattgtaaagttgctgaggagaatgaaaaaactattctgttgtgtctctattgtaataaaatttttaggggcggtggcattaataggttcaagaatcacttggctggagaaaaagggcaatgtgagcaatgtaagaacgtgcctgcagatgttcgatttcaaatgaagcaaaatcttgatgaacgtaaaaacaagagaagaaaagtccgagaagaatatgtggatagtaatgaatttggtgaagatcaaatgagaatagttgtggatgaagtgcaagagccaataagagtatgtaatctcaatccacctcaaaaggggaagaacatcaatcgcataggtcagtatttcatgcctaaaacaacccctagagctcaacctaccttaaagagtgggttgcaaagtaaggaagtcatagaaaaatgtgaccttgccattgcaaagtggatgattgatgcttctgtgccatttaatgcaattaattcagcatattatcaacctatgattgatgctattagtagcatgggtccaagttataaaggtccaaattttcatagagttcgtggttgtttattaaataaatgggttgatgatgtgaggaagcttgtggatggttatcgaattgtttggaagcaaactggatgcactcttatggctgatgggtggaatgatggttgtaggagaactttcattaattttctagtttattgtcctaaaggaactgttttcttaaggtctgttgatgtttctcatgcttctaaatctgctgaaatgttgcataagctttttagggagatggtgttatttgttgggcctgagaatgttgttcacatagtgacaagtaatgctgaaaattatgttgctgctggaagattattggaagctgagtttcctaagttatattggtctccatgtgctacacagtgcattaatttgatgttggatgacattatgaaattagaggaagtaagtgagattgtgtcacttgcttcaaaaattaccaagtatatttacaatcattgttattctttatatttgatgagaaaatatacaggtggaaaagatatacttggtccagctccaactcagtctgccactaatttcattgccttgcaaagtatattggctcataaagatgcactaagagccatggtaacatctagagattggacaagctcagcttatgccaaagaatctaaggcaaaaaaaattgtggaacaaatcttagactccaggttttggaaaaaatgtgctgatattgtgaagctcacagagccattggttcacgtcttacaaattgttgacagtaaagataaacctgccatgggttttctttaccaagctatgtataaagccaaagaggagatgattaggaggtttcagaaaaataagaaggtagagccttacttgaatatcttggataggcattgggattctctttgtaaaagtatacatgctgctggttattggttaaatccagcttgtcatttcaatgaagaatttgctaagcataagtccacaacatctggccttttggatgtcattgaaaggtatgctcatggagatcctgatttgcaatttaatttggcaagtgaaatgagaatatttaaaaatgccgagttagattttgggaggctagttgctacacgtgaacggaatacggtgatgccag

SEQ ID NO: 112326 - DNA, 474 bp, Glycine max
  Peptide Sequence Number=SeqID_229104
atggacagagtgaggttggtatatggactggtcatgaagatggacatggacgtgggatcgatcatctctagacagatttctcagatggcccagtccaactcctctaggcttggtttccctgccctgatcacagctctatgcatcatcagaggatttgtccctgattccttaacctttgagtccctgagcccgaccattaacttggcctacatcagaaagaactgttggaacctgaatgatcctaccatcacatttctcgggtcccgcaaggccagggctcggggaccctcaaatgcttccacttatgcccttgctcctaccccagctctcactccagcaccaacaccaacacctgctccaactccagcacccacagcacccctccggcccctccactttgagcacaaatgcgatcatgctgatgttgcagaacctccacaatggcttatgcctagtgatgcaaagtatccatga

SEQ ID NO: 112327 - DNA, 324 bp, Glycine max
  Peptide Sequence Number=SeqID_229105
atgcacatcgctcaactgatttctgatttcatctattgtttgcaaggatcgcgcctgcaagacacccagtggacccgaagaagtccaacagggtcttggagttgtcaagctctaattacgggtctctgtcagttctacggaatgcctgtcacctccagcaaggtcatcaagccccctactaagcgagctttcatcaagaagtactgtgtccccaggcaagtgcagggcgaaacaccacagcagcttggggatggccggcagcgggcaacagacgcaccgccatcacctctagagttcacctcagctgatccacaaaaaggttag

SEQ ID NO: 112328 - DNA, 1059 bp, Glycine max
  Peptide Sequence Number=SeqID_229106
atgccaaggctagtttttgctgcatgtatcttctcacttgcatcaattgctttggcagctctgcctgtgacatatatctttggtgactccttgacagatgttggaaacaataattttctacaatattctttagccaaatctaactatccctggtatgggattgactacagtggtggccaggctactggaagattcaccaatggaaggactattggtgatttcatatctgcaaagcttggaatcacatcaccaccagcttatctgtcagcgactcagaacgttgataccttactcaaaggtgtaaactatgcatctggtggggcaggaattctcaatgatactggactttactttattgagagattatcttttgacgatcaaataaacaatttcaagaaaaccaaagaagtaatttcggcaaacataggagaggcagctgccaacaagcattgcaatgaagccacgtatttcattgggattggcagcaatgactatgtcaacaatttcttgcagccgttcttggcagatggccagcaatacactcatgatgagttcatagagctcttaatatcaaccttagatcaacaacttcagagtctttatcagctgggagcacgaaaaatcgtcttccatggacttggtccactcggttgcattccatcacagagggttaaatccaaacgaggacaatgtctaaagcgagtcaatgaatggatcctacaattcaactccaatgtacagaagctaatcaacacactaaaccatcgtcttccaaatgcaaaattcatatttgcagacacttacccgttagttcttgacttgatcaacaatccatctacttatggttttaaggtttcaaatacatcttgttgcaatgtagacacaagtattggaggtttatgcttgccaaactcaaaggtgtgcagaaaccgccatgaatttgtattttgggatgctttccatccatcagatgcagcaaatgctgttcttgcagaaaagtttttctctcttttctcatcagctccttctcctgcatcagcaccaacaccttctccctaa

SEQ ID NO: 112329 - DNA, 1593 bp, Glycine max
  Peptide Sequence Number=SeqID_229107
atggctctgcattttcttctcctcctgctttttgcagtgtcttttgttgctgctgatgaagttctcagttctcctatgactccttgctgttttcttgaggagtttttggagtttgctttgtggggaatagaacttaaccatgctttgtcatatcaagaaccatttataggagtgaatattggaacagatctctctgatatgccacaccctactcaagtagtagctctacttaaagcccaacaaattcgtcatgttcgtttgtatgatgcagaccaagctatgctccttgcacttgcaaagacaggcattcaggttgttgtgactgtcccaaatgaagagatcctggcaattggtcaatcgaattccacggctgccaattgggtttcccgcaacgtggtagcacattatccagccaccaatatcacagccatttgtgttggttctgaggttttaactaccctcccgaatgcggcaaaagtacttgtcagtgcgattaaatacatccattcagcccttgtggcatccaatcttgatcgccaagttaaagtttcaacacccctttcctcatccatcattcttgattcatttccaccttctcaggctttctttaaccgctcactcaatccagttttagtcccactacttgatttcttgcaatccactggctcttatctgatgctaaacatatacccttactatgactacatgcaatcaaatggagtgattccattagattatgcacttttcaaatctctccctccaaacaaagaagctgttgattccaataccctcctccactacaccaatgtctttgatgccatggttgatgctgcatactttgccatagcttttctaaattacaccaacattcctgttgtggtgactgagtcagggtggccctcaaaaggtggctccaacgaacctgatgcaacggtggacaatgcaaatacttacaacagcaatttgatcaaacatgtgtttaacaaaaccggaactcccaaacatcctggaattgctgttagtacttacatctatgagctctacaacgaggatatgaagcctgggccattgtcagagaagaactggggactgtttgatgcaaatggaacacctatttacattctacacttgacagagtcaggggcagtcttagcaaatgataccagcaacaatactttctgcattgcaaaggacggtgctgacccgaagatgctgcaggctgcactagattgggcatgtggaccgggcaaggtcgaatgctctccattgctgcaggggcaaccatgctatgaaccggacaatgtgattgcacatgcaaattatgcatttgacacttactatcataagatgggaaagactcctgatgcatgtgacttcaatggagtggctactatctccacctcagatccaagtcatggttcttgtttatttcctggaagtgttggcaaaaatggaaccttaggtaacttcacagctccatccatgaattctacaaattcagattcctcagcctacaaattcagctctgacttgagaattagaagccttttaatggtagcaggatttctattatggggagtggttttgctataa

SEQ ID NO: 112330 - DNA, 676 bp, Glycine max
  Peptide Sequence Number=SeqID_229108
atggcttctgcaaacaacaattcttctccgccaccacatccgtctcctcctctgccgctggttcaacctgtaatcatcgggcatggtcttcttgattacattcttgctccgcagattccgcagaaatttctcactgttgaagatcacaacaacaacatcgttagcgctgcctatcatttctgggagcaacaagatcaattgatcctctcttggcttcaatcgactatttcagaagcagttcttctttgcatcatcaatcgcgtaacctcatggcatctgtgggatcgattgcatgagcactttcaatcctttgcgtgtgcgaagaagaagcaattgcatagtgagctttgttcttcttctcttgagaatcgttcaataactgcttatatgttacacattcaatcccgaattgattcacatgcatcaattggagactcaattttaactagcgctcacatcgacgtgattcttaatggtttgcttgatgattatcgcacaatttgtactattctaaacaattcgagtgatcctctaagtttggacgatgtcacttctatgctactggttgaggaatctagcattgaaaagtctcgcaagaagaatttgggctcattgaatcttgctgagggtttgaattccaattctgcttctgaagctcaggttcatctaactcaag

SEQ ID NO: 112331 - DNA, 396 bp, Glycine max
  Peptide Sequence Number=SeqID_229109
atggaagccatgaaagagcaaatggctacaatgatggaagccataatgagcatgaagaagataatggaagccaatgcagttacagttgccactaccagcactgttgctaaggtgaacccgatgcccccatctgatcttaaccaaatgaatcatccaacctcaaatatggaaggcaaagagttgggaagtagggacgacccccatgatgtgcaaattcaaaacaagcacgccttcccgccatatgtcttgcctcctaactgtaaaccacccaatgtggcgtacactcctagtgagaatgtcaataactccactcctatacccattgagagccaacaaatcatgcacatgtcttttaaatcgtgggggagacacatgaaattccccaccacaagctaa

SEQ ID NO: 112332 - DNA, 204 bp, Glycine max
  Peptide Sequence Number=SeqID_229110
atggtgcacaaattcggtgatagatctgtgctggccatgggggtgcctctcccagataaggcaaatacattgaatctaccacgagacaaatcccaggatgaaggaactccaagttcacaaacgcgcttccgaatgaagaccaaaatgtggcggagaccaagattaaggataacgcgttcgtccctatgcggaaccatgcattaa

SEQ ID NO: 112333 - DNA, 270 bp, Glycine max
  Peptide Sequence Number=SeqID_229111
atggacagagccaggttggtttatgacttagtcacagacatggacatggacatcggagccctgatctcagccttgatcactgccctatgcagagctagaggagttacctctaatagtttgacctatgagagcctaagcctggccattaactcagcctacattaagaaaaactgttggaataaggattatctgacagttcaaatccttcctaagaatcttcccaggatggccctcagtgttcaagatgaaccctcggcctggtatgcataa

SEQ ID NO: 112334 - DNA, 2994 bp, Glycine max
  Peptide Sequence Number=SeqID_229112
aacattacgatctcggcaacgatctgtttaccctgatgctcgatccttacatgcaatattcctgcggctactggaaagacgccaccacgctggaggaggcacaggaagccaagctgcggatgatctgcgagaaactgcagctgcaaccgggcatgcgcttgctggacatcggctgcggctggggcggcctctccgcctatgcggcgaaaaattacggcgtatcggtggtcggcgtgaccatctccgcagaacagcagaagctggctcaggcgcgctgcgccgggctggatgtgcagatcctgctgcaggattaccgcgatctgcatcagcagttcgatcgcatcgtctcggtcggcatgttcgagcacgtcgggccgaaaaactaccgcacctatttcaatgtggtagaacgcaatctggcgccgcacggtctcttcctgctgcacactatcggctccaacaaaaccgacatgaacgtcgatccgtggatcaacaagtacattttcccgaacggctgcctgccttcagtgagccatatcgccgaagccagcgaaggccatttcgtgatggaagactggcacaacatcggcgccgactacgatcgcacgctgatggcctggttcgagcgcttcaaacaggcgtggccgcagcttgcaccgcgctattccgaacgcttcgagcggatgttcagctattacctgaacgcctgcgccggcgcgttccgggcgcgcgatctgcagctgtggcaggcgttgaaggcggcatccgcgtcgcccgctaagcgcttgcccgacaaaaaaggccccggcagcaatatcgccggggcctttttttgctcgttcgacgcgtacggcttagccgcagtagacgcggatgattttatcgtcgctgtcgccaaggaagttcaggcggcgcaggttgaaatccatggtgacggcagagttgtacggaatggcgcgcaccttggcgtcgatccgcacgccttccagcgaggtcatcggtttgccgacgaagttttgatactgcgaagcgccgcaggtatcatccgcatcggccatttgcgcgctcgcgccctgctcaggcgaactgctgcaggcgctcagcgccagcaacgcgtctttgtgcgccggcgccatcgccgccgccagcgccgcttcccgattggccagcacgcgctcgacggtgtccaccaccgcctgcgtttgcggatcgatctcgatgttcaccttgtcacccaggcgtttcttacccagcgtggtgcgatccagcgtttccgggatcaggtgcacgcagaaacggttattcaccacttcgccgatggtcaggctaatgccgtcgatgccgatgaagcctttgtgcagcacatatttcatcaattcggcattcggcatgcgcagccatacctgccggttattttccgaggtataaatcttggccacttccgccgtgcagataatatggccggacatcaaatggccgccaatttcgtcattgaacttcgccgcgcgctcgatattgacgatgtcgcccagcgccagatcgccgaggttggtcaggcgcagcgtttccttaatcaaatcgaagctgacgcggttgccttccaccgcggtgacggtcaggcagcagccgttatgggccaccgacgcgcccagctccagccccggcagcagctcggcaggcatttcgatcacgtgggtgcggaaattggtttctcatcaatggcgaccagcggcgcggtgccttgtacgataccgtttgccccagttggcgctgaaaaccaaatccgcgacggcaaaaaacgaatggctgcgcatttaataactatttatctgcggcgtttgcttaacgacgccgagcagaagtacttaattgaagcgcgtagtttattggctctcgctatcccggtcatcatcgcgcaaatatcgcaaaccgccatgggcgtggtggataccatcatggccggcgcttacagcgccaccgacatggcggcggttgcggtcggcacttcaatctggctgccggccatcctgttcggccacggcctgctgctggcgctgaccccggttatcgcccagctcaacggcgccgggcgtcgcgatcgcatcgctcaccaggtgcgccagggtttttggctggcttccggcgtgtccgtgctgctgatcgtcgtgctgtataactgcaagttcgtcatcgacatgatgcacaacatcgatccgcagctggcggataaagccgtcggttatctgcacgccatcatgtggggggcgccgggttacctgttcttccaggtgatgcgcaaccagtgcgaggggctgtccaaaaccaagcccggcatggtgatcggcttcctcggcctgctggtgaatatcccgatcaactacatcttcatctacggcaaattcggcatgccggagctgggcggcgtcggctgcggcgtcgccaccggcagcgtctactggatcatgttcctgatgatacgcggctacgtgaagcgcgcgccgtcgcagcgcgacatcaaacgccaaaccggcgatctcggcggcccagactgggcggcgctgaagcgcctgatcggcatcggcatgccggtagcgcaggcgctgttcttcgaagtcactctgttcgccgtggtggcgctgttggtgtcgccacaggggatcgtcgcggtcgccggccaccagatcgcgcttaacttcagcgcgctgatgttcgtactgccgctgtcgctgggcgtcggcgccaccatccgcgtcggttatcgtatgggggaaggctcggtcgaaggcgcgcgcgtcgccgcttactccgccatcggcgtcggcatcaccaaggccgtctgcaccgcgctgtttaccgccgccttccgcgaaccgatcgccctgctgtacaacgacagcccggcggtggtggcgaaggcctcgcagctgatgctgctggcggcgctgtaccagatctcggattctgtccaggtgatcggcagcggcgtgctgcgtg

SEQ ID NO: 112335 - DNA, 213 bp, Glycine max
  Peptide Sequence Number=SeqID_229113
atgaagattggggagtttttcccagagctaaaaagaatggtcggacaagaagaccgagaaatgaagccataccaagaagagatgaaaattgtaaacttgggtttcggcgaggaaaagaaagagtcgctcgatacccagaatgggtttccaacattgtaccagtccccaaggaagatgggaaagtgcgaatgtgcatggactatcgggatttaa

SEQ ID NO: 112336 - DNA, 315 bp, Glycine max
  Peptide Sequence Number=SeqID_229114
atgggggcatgctctagggatgagaaattgcttatgcttttcttccaagaaagcttgtctggggcggcagtcatctggtataccattttggaagcttctcgcatccgctcacggaaagacttgattactaccttcattagcttcatagatttagtatttgcaggtgagaggattgaagtaggcctaaaaagagggaagttcaattatgttgctctggctagtacgagcaatagaagatttagagcaactggggaaaagaagaaggaatgggatgcccacgctgtgacttcaactcctactaggccaaaaccctag

SEQ ID NO: 112337 - DNA, 333 bp, Glycine max
  Peptide Sequence Number=SeqID_229115
atgggatcgaatcaagcacccttgcttaagaaaagaaatggggtggtcggaataccaaggaagcgcttggaggagaaagcaaaggttttggaaggtcaaggtgaatgggtttcgttcattgatgtcttggtgctattggtatttgaaatcgtcctttttccaaatatggatgggctagtggatttagcaacgatcgacgccttccttgcttatcaccatagcaaagaaagcccggtcattgctattttggtcgatgcctatgacacatttgaccaaagatgcgagaagagcgacataaggattgcctgttgcacacccactcttttgtcatga

SEQ ID NO: 112338 - DNA, 333 bp, Glycine max
  Peptide Sequence Number=SeqID_229116
atggatggaataggaacaagtgtgtcgtccaaagcatctaggggcatagggatcaaggatataagtaactttaataaggctttgttgggtaagtggaggtggaggatcatagttgaaccaaacaacatgtgggcaagggtcattagagctaagtatggagagtttggtcttaggatgagatactttgtaatgtggaaattggaagtcgatggtgtattctcagttaaaagtgccttcaatcttcttaacaaccatagtagtgtggaactgttatgtactctgaacttagagctgtggttcctggaattcgaggaccaggaagaacctccttaa

SEQ ID NO: 112339 - DNA, 213 bp, Glycine max
  Peptide Sequence Number=SeqID_229117
atgttgtgcaagtcaatgtacgtgggaggaggctatgtcgtcacacttgactgtagagagagagggtttggttgtgaaggactcagcagtgctgcaaactctcagtggaagcgtggaattatgatttatggaaataagttcagcacatgtggaaaggagcaaaaggaaagggaacaattcacctgcggaagaatgggactacagtttgggtga

SEQ ID NO: 112340 - DNA, 282 bp, Glycine max
  Peptide Sequence Number=SeqID_229118
atgaggtcaattcctttgggaatctcagtatctctaactcctataaacacctcaaagttatcacctttcagtgttaattttaagaagccaaccacctttccatctcggggttcaactcttcctcgtgaattctctctctcccaatcagtactacggattttgatttcacttaatgcagaaccatactcgtttttgcctgatttatttaaggaagccaactatgagtgggggactagtaatcaaggagtggatacatggggtgatggaatattttccatttaa

SEQ ID NO: 112341 - DNA, 708 bp, Glycine max
  Peptide Sequence Number=SeqID_229119
atggggactgacgcgagttttggtgccttagactggaagggcaaaggcgtccatgatgatagccttgatcagatggcatccaaacgaatcaacaaggaattgaaggacctgcagaaagatcctcctacgtcatgcagtgctggcccagtggctgatgacatgttccattggcaagctacaattatgggtcctgcagatagtccatttgctggaggtgtatttcttgtgtcaattcactttcctcctgattatcctttcaaaccacccaaggtttcattctgcacaaaggtttttcaccctaacatcaacagtaatggaagtatctgccttgacatcctcaaagagcaatggagccctgccctcacaatatctaaggtcctcctgtctatatgctctctgctgacagatcccaacccagatgatcctctggtgcccgagattgctcacatgtataagactgacagagccaagactacggctgaaaccattgggaaaccttatgattgcatttatgttggtctgcaggagcaagcccgtaaagagaaagaagatcctgaaaggatgcttgaggagaaccgaaggaaggttgaagaagctcagagaacggaagctttagagaaaaaagaaggaaggaagaaagatatgaagagatgcaaagacagaagcaagaagccatgcgaaggaagaaataggaggaggagcaagaac

SEQ ID NO: 112342 - DNA, 660 bp, Glycine max
  Peptide Sequence Number=SeqID_229120
gcccgactctcacagattgaggaaaagcatcctcagtttcaagatggcatcctggctctagcagatcaacttgccaatcaggataaggctcaacaattatggcatctcggagaaaacttaggcatggagacagttacagataacctacatttccttcacagttttgcttctatggagtgtagagacagaaaagaagctaaggagaatttggttgggaagcataagatagatcttctttgtttgcaagaaacaaagagggattccattgacaaggcactttgtcaggctctgtggggtcactcagactttgattggaaatggtttcctgcagtcaatacagctggagggcttctctgtgtcaggaataacaataacttccaggggacttcaactgcattaaacacccagctgaaagaatgggaagcactctttgtaattgcagacactaatcttatagctgaatttagtgagtggctcgctgaaatggaggtagatgatattccttgcttgggcaagccctttacttgggttaggcctaatggttcttgtaagagcaagttaaacagagtgctggtctttgatgattgggtatccaagtggcctgatgttccctacacaaccttgaaaggaactactcacatcattgccctatcattttga

SEQ ID NO: 112343 - DNA, 1568 bp, Glycine max
  Peptide Sequence Number=SeqID_229121
atggaccagctttctgggaagttcaaccttgatggaaatattgagttgcaggttgctgttagttcttcagaaccaggagctgcaagacaagtagatattaaggtttcatataatagcgactctctgtttttacattggggagttgtgcgtgatcagccagggaagtgggttcttccttctcatcacccagatggaactaaaaattataagaacagagctcttagaactccttttgtgaaatctgactcaggatccttccttaaaatagaaattgacgatcctgctgcacaagccattgagttcctcatacttgatgaggctaaaaataagtggtttaagaataaaggtgagaactttcacatcaagttaccagttaaaagtaagctatctcaagaagtttcagttcctgaagaccttgtacagattcaagcgtatcttaggtgggaacgaaagggtaagcagatgtacactccagagcaagagaaggaggaatatgaagcagctcggaatgaactatttgaggaagtagctaggggtacttctgtacaagatctccgtgcaaagttaactaagaaaactaaagctgccgaagtaaaggagccttctgtttctgaaacaaagaccatccctgatgaacttgtacagattcaagcttttatacggtgggaaaaagctgggaagcctaactactctcaggaacaacaactcatggaatttgaggaagcaagaaaagaattgttagcagagcttgagaagggggcttctctggatgagatacggaagaagattaccaaaggagagatacaaactaaagttgccaagcaattgaaaaccaaaaaatactttcgtgctgaaagaatacagaggaaaaagagagatttggtgcagcttatcaaccgaaatgtcgctgaaaatatagttgaacaagttatagatgctccaaaagccttgacagtaattgaacattatgccaacgcaagggaagaatatgaaagtggtcctgttttgaataagacaatatacaagcttggtgataatgatcttctggtcctcgttaccaaggatgctggtaagattaaggttcacctagctacagactcgaaaaaaccttttacacttcactgggccttatctagaacatctgaagagtggttggtaccacctgcaactgctctgccccctggatctgttactatgaatgaggccgctgaaacacctttcaaagctggctcttcgtctcatccttcttatgaggtccagtccttggatatagaggttgatgatgatacttttaaaggaataccttttgtcattttgtcggatggagaatggataaagaacaatggatcaaatttttatattgaatttggtgggaagaagcagatacaaaaggattttggcgatggcaaaggtacagccaagttcttgttgaataaaatagcggaaatggaaagtgaggcacaaaagtccttcatgcatcgcccagggtctgccacagatagttatagtcttaaaggcaaaccgagcttcctgtgccacccgctaccaatggcggatctacattatgg

SEQ ID NO: 112344 - DNA, 1084 bp, Glycine max
  Peptide Sequence Number=SeqID_229122
atttaacattgcatcggatttgatagatgaagctaaaaatgctggtcaacaaggtcttgcggggattttggtgtggatgagattcatggctactaggcagctcatatggaacaaaaattacaatgtgaagccacgtgagataagtaaagcacaggataggcttacagacttgctccaggatgtttatgcaagttacccacagtatagggaaattgtgaggatgatcttgtcgactgttggtcgtggaggtgaaggagatgtcggacagaggattcgggatgaaatccttgttatccagagaaataatgattgtaaaggtggaatgatggaggaatggcaccagaaattacacaataatactagtcctgatgatgttgtaatctgtcaggcactaattgattatataaatagtgactttgatattggtgtttactggaaaacattgaatgcgaatggaataacaaaagaacgacttctgagctatgaccgtgccatccattctgaaccaaattttaggagagatcagaaggaaggtcttctgcgagatctgggaaactacatgaggaccttaaaggcagttcattctggtgcagatcttgaatctgctatttcaaattgtatgggctacaaatctgagggtcagggcttcatggtaggggtgcagataaatccagtgccgggtttgcctaatggttttcctgaattacttgagtttgtcgccgaacacgttgaagagaaaaatgttgaaccacttcttgaggggttgcttgaggctcgtcaggaactccaaccatcactcagtaaatcccaaagtcgtctgaaagatcttatatttttggatgttgcccttgattctacagttagaacagctgtggaaagaagttatgaggaattaaacaatgctggacctgagaaaataatgtacttcattagcttggtccttgaaaatcttgcactgtcatcggatgacaatgaagatcttatctactgtttgaagactcaggcttataaagcctatatatgtgacatgtcatctgaaaatgttttctctaacaacaaagacttgggttgttcacaactttaa

SEQ ID NO: 112345 - DNA, 1214 bp, Glycine max
  Peptide Sequence Number=SeqID_229123
tgtgtgcatcccaagtgagcgtgagacacttttgaagtttaagaataatctcatagatccttccaataggctttggtcttggaatcataataataccaactgttgccactggtatggagtcctctgccacaacgtcacttcccatcttcttcagcttcacctccacacttcaccttctgctttctatcatgactatgattaccagtatctcttcgatgaggaagcttataggagatggagctttggtggagagataagtccttgtttggctgatttaaagcatttgaattacttggacttgagcggcaatagatttcttggagaaggtatgtcaattccttctttccttgggacaatgtcctccttgactcacctagacctctcttatactggattctatgggaagattcctcctcagattgggaatctctcaaatttggtgtatcttgacctgagttcagatgttgccaacggaacagtaccctctcagattgggaatctctctaagcttcgatatcttgacttgagcgccaattatttacttggaggaggtatgtcaattccttctttcctcgggacaatgacttccttgactcacctcgacctctctggtactggattcatggggaagattccatctcagatttggaatctctccaatttggtgtatcttggccttggaggtgattctgatgtcgaacctctgtttgctgaaaatgtagaatggctatcaagtatgtggaagcttgaatatcttcatttgagttatgcaaacctatccaaagcatttcattggctacacactctccaatctcttccttctttgacccacctatatttgtcattctgcacactccctcactataatgaaccatccttgctcaacttctcatctctgcaaactctccatctttccgatactagttattcccctgccatttcttttgtccccaagtggatattcaaattgaagaaacttgtttctcttcaattatcatataatgaaatcaacgatccgattcctggtggtattcgaaacctcacacttcttcaaaatcttgacttgtctttcaattcattctcatcttctatacctgattgcttatacggtcttcatcgtctcaagtctttggacctaagttcctgcgacttgcatgggactatttctgatgccttgggaaatttgacttctcttgttgaacttgatttatcag

SEQ ID NO: 112346 - DNA, 1830 bp, Glycine max
  Peptide Sequence Number=SeqID_229124
atgggatgggatgttgccttaagcatgtgcaagagtaaagatactcattgggcattgtacgcaaaatcagtccttgacagaacccgccttgcactcacaaacaaggctcatttataccaggaaattctgcaaccatcggcagaatatcttggatcactgcttggtgtggacagatgggctgtggaaatatttactgaagaaattatccgtgctggatctgctgcttctttgtctactcttctaaatcgactggatcctgtgctccgaaagacagctcatcttggaagctggcaggttattagcccagtggaaactgttggatatgttgaggtcatagatgagttgcttgctgttcaaaacaaatcatatgagcgacctacaattttgatagccaagagtgtgagaggagaggaagaaattccagatggtacagttgctgtcctgacacctgatatgcccgatgtcctatcccatgtatctgtacgagcaagaaatagcaagctgattaagaatttgattatcattaaagtcagcatccaatctgtgaagttctgtgaatttgttagagttgataatgtgtgttttgctacatgctttgatcccaatatcctggctaacctccaagaaaataaaggaaagcttttgcgcttaaagccaacatctgctgatgtagtttatagtgaggtcaaggaaggtgagttaattgatgacaaatcaactcaactcaaagatgttggttctgtgtcacccatatctctggcccgaaagaagtttagtggtagatatgctgtctcatctgaagaattcactggtgaaatggttaggtttcaaaattcactgttaacttgggcatttatagttgtttatccttatgtatgtgtctttccacccaccaaaatgcaccaggttggagctaaatctcgtaatatctcttatttaaaagggaaagtagcttcttggattggaattcctacctcggttgccataccatttggagttttcgaacatgttctttctgataaaccaaaccaggcagtggctgagagggtcaataatttgaaaaagaagttaattgagggagacttcagtgttctcaaggagattcgtgaaacagttctacaattgaatgcaccatcccatttggtagaggagttgaaaactaaaatgaagagttctggaatgccgtggccgggtgatgaaggtgaacaacgatgggagcaagcttggatagctataaaaaaggtgtggggctctaagtggaatgaaagagcatacttcagcacaagaaaagtgaaactcgaccacgaatatctttccatggcagtccttgttcaagaagtgataaatgctgactatgcttttgtcatccacacaactaaccctgcctctggagattcatcggaaatatatgctgaggtggtaaagggacttggagaaacactggttggagcttatccaggtcgtgctttgagttttatctgcaagaaacgtgatttgaactctcctcaggtcttaggttatcctagcaaacctgtcggcctatttataagacggtcaattatttttcgatctgattccaatggtgaagatctagaaggttatgctggtgcaggtctttatgacagtgtgccaatggatgaagccgagaaggtggtgcttgattattcttcagacaaactgatccttgatggcagttttcgccagtcaatcttgtccagcattgcccgtgcaggaaatgaaattgaagagttgtatggcactcctcaggacattgaaggtgtcatcaaggatggaaaagtctatgttgtccagaccagaccacaaatgtag

SEQ ID NO: 112347 - DNA, 429 bp, Glycine max
  Peptide Sequence Number=SeqID_229125
atggcatttctaggagaaactagcagtcagacgattgtcaactcaaggttggctttcatttatccaaatggatcgattattcacaatgatactggggtttacttccaaacttcaactctggtgcccattcgagtaccaaattggtgtgattttgcaagcctaaaaaccagaatacacaatacccttcagctatccgacaaacaatttttggatgaaattcactaccggaagccattcaccgatacagctcggtttgagtattcagatacggttataaaatatgaaataaatgagctgatcaccaacgaagaactgctgaaggtgttagtacaatctaactactggaaaaaatatggaccaatagaaattttagctgtctttactaaatatgttgaagacgaggtcagtgggacgtcgctaaacaactga

SEQ ID NO: 112348 - DNA, 246 bp, Glycine max
  Peptide Sequence Number=SeqID_229126
atgtcttgcctagcaatcataactctgatctccctctgcctaagtgccagttggtgtatgccacccactaggcaccctatggacccggataagtctaacagggccctagggtttccggcgttggtgatcagaccgccgatcacccgagcattcatcgagaagtactgcacgcctaggcaggcgcagggtgatgcacatcaggccgcggacgcaccgccaccacctcatcaggccaatcctgcttga

SEQ ID NO: 112349 - DNA, 732 bp, Glycine max
  Peptide Sequence Number=SeqID_229127
atggacatactcatatcacgtccatttaggtggagttactacctcatgttgtctacggatgggttccatgtgtggccatcagactatctcattctcaaggcagtgggtctccagcttctactccatatggatccaagtactgaaaacttggatgtgttgattggagaaaaaggcttcttggtcatgatgggtggtggactagatgattgtggagtgggagttggtgttgcctcattgttagacaaactaaagtcattagaggatgggatcttgatgggttccattggtttcagggacttgcatccaactcttatcttccttttctttggaaacaatgaggggatgataggcttgcttcttggtttggaccttgccctactgctctctaaggatcctttgaacctttttagcgagtccaaaggcaacaaaggttcctttgttgtcgatggagtgcttggagtcctcatccagtctttcgaagacatggaatacctggtgttcccagaggagtttgttgatgagggcgacatagtggatgtcatccaatcctcccagggtcttcatgttcctgagtatgttgatgtagaccatgtgtggaaggctaagaccttccagcatgttgatgtcaaagtagtgttcaacgtgaatagtaggttctccatcagtgtgaatgggggtggtgtcagtggtgataatggtggtggcaggagaaatgttttcactagagtttga

SEQ ID NO: 112350 - DNA, 248 bp, Glycine max
  Peptide Sequence Number=SeqID_229128
atgcctagcactgttcatgtgtcctctgttatcaagcgcggagcctctgaaaaaaaaaaagaaggagtagagacaagagtcgtcgtcacagaaagggcaggacggacgaaatcaatgtcttatctttgctttccttttatctccgatgagagatacttggatccctttgttgcacaatatgtgaagtcccgagacgtgccgaaaatcaaaaggaagcaggcttacgcgatccgtgaaaattccgtaat

SEQ ID NO: 112351 - DNA, 273 bp, Glycine max
  Peptide Sequence Number=SeqID_229129
atgaaccggaagctgggttacggtgcccaactgcgcgctaacctagaccccacaaagggtgttggtcgattaagacagcaggacggtggtcatggaagtcgaaatccgctaaggaggcgcggcggtcgctgcaaaacccagggcgcgagcccgggcggagcggtcgtcggtgcagatcttggtgggacgggggaagcccgtctgatagcgctctgtgcgcgtactccgaaagggaatcgggttaaaattcctgaaccgggacgtggcggctga

SEQ ID NO: 112352 - DNA, 820 bp, Glycine max
  Peptide Sequence Number=SeqID_229130
atctgcaccgacgaccgctccgcccgggctcgcgccctgggttttgcagcgaccgccgcgccctcctactcatcggggcttggtccttgccccgacggccggaactcgcccgcgggctccagctatcctgagggaaacttcggagggaaccagctactagacggttcgattagtctttcgcccctatacccaagtcagacgaacgatttgcacgtcaagtatcgctgcgggcctccaccagagtttcctctggcttcgccccgctcaggcatagttcaccatctttcgggtcccgacagggtcggtcggcggtgcaacccacagggggatcccaccaatcagcttccttgcgccttacgggtttactcgcccgttgactcgcacacatgtcagactccttggtccgtgtttcaagacgggccgaatggggagcccacaggccgacgccaggagcgcgcaggtgccgaggcacgccaagggcgcgcgctgccatccacaatcgcgatgatgacgtctccacgagcatatcaacagcccgggcttgggccaccatcgcaatccgcgtcggtcaatgtcccgagtcgatcggcggaccggctctcaccgttccacatccgaccgggacacatcgccggcccccatccgcttccctcccgacaatttcaagcactctttgactctcttttcaaagtccttttcatctttccctcgcggtacttgttcgctatcggtctctcgccagtatttagccttggacggaatttaccgcccgattggggctgcattcccaaacaacccgactcgccgacagcgcctcgtg

SEQ ID NO: 112353 - DNA, 222 bp, Glycine max
  Peptide Sequence Number=SeqID_229131
atggaagaagatggacgcgctgagcgtgagaagagacaacgtcctcgctgggcgagcacatctctggcttatcctcttctagggtttcccaatctgctaagcgagatgtatggcctcgctaagtggatgccactcgctgagtggatctgtctcactgagcgagtcatcaactacttgaacattctcttctttggcttgaaactgatttggattcaatattaa

SEQ ID NO: 112354 - DNA, 337 bp, Glycine max
  Peptide Sequence Number=SeqID_229132
atgactgggggcaatccaggtgatttacaaccctttgatcctgaaatagatagaacctttcatagattagctaggcatagtgtgcatcctagtcatgctgtgcattttgagcattctgttgctggtgattctgaatattctgattttgagcattcaagtactaattttcatactgagaacatggcccaacctccacctcgtgagaggactcttagggagatggctacacctgatttcacttatgaaagcttgtgcattcaatatcctgatgagggtgttccatatgttctcaagactggactaatacatttgctgcccaagtttcatggtcttgcag

SEQ ID NO: 112355 - DNA, 971 bp, Glycine max
  Peptide Sequence Number=SeqID_229133
agcgctacacgccctcatcttgagaggactacacgacctcaccttcacagggctacacgccctcgccttgagagggctacacaccctccccttcacagggctacatgccctcgccttcagagaactacacatcctcaccttcagaggaccacacgtcctcaccttcagaggactacatgtccatgccttgagaggactacacatcctcgcattcagagggctacacgccctcgccttcagaggactacacgtcctaacctttagaggactagacgtcttccactttagaggaccacacatccttcccttcagaggattacatgtcctcaccatcagagggctacacgtcgtcgccttcataggtctacatgtacaccccttaagaggactacaagtccttaccttcagaggaatacacgtcctcgccttcataaggctacaagtcctgcccttaagaggactttacgccctcaccttcagaggactacatgttctcgccctcagaaggctacatgtcctccgtttcagaggactgcatgtcctcgccttcagaggactccacgtcctcccattcagaggactccacgtcctcaccttcagaggactaccggtcctcgccttgagaggactacttgtcctcccctttagaggattacacgccctcgccttcgaaggactacacgccttcacattcagaggagttcacgtcctccccttgggagggctacacgccctcgccttcatagggctacactcccacaccttcagaggagtacacgttgtcaccatcacagggcaacatgtcctcgccttcaaagggctaaacgtcttccccttcagaggactacactccctcgcctttagaggactacgcggtcctcactttcagaggactacgcgtcctcaccttcagaggactacacgtcctcaccttcataggacttcatgtccatgccttcagaggcctacac

SEQ ID NO: 112356 - DNA, 234 bp, Glycine max
  Peptide Sequence Number=SeqID_229134
atggctggaagtctatcaaaaatcattccggatatgtcgaaaatagaacctctagacggctcaaattataggagatggtctcaaaaactgttgattttgtttgaagccttagaggttgattatgtgctatttgaagatcctcccgctgatgtcaacgcttctgaatcatctactcctgaaactcctgccacccctgtcgtcacaccgctttcctgcagaaaccaagaaagctga

SEQ ID NO: 112357 - DNA, 522 bp, Glycine max
  Peptide Sequence Number=SeqID_229135
atggccccgaggaagcttgcctcaaagaggtccaggaaggataaggcggccgaaggaactagttccgctcttgagtatgacagtcaccgctttaggagcgctatacaccagcagcgcttcgaggccatcaaaggatggtcgtttctccgggagcgacgcgtccagctcagggacgacgagtatacggatttccagaaggagataagtcgtcggcggtgggcatcactagttacccccatggccaagttcgatccagaaatagtcctcgaattttatgccaatgcttggccaacagaggagggcgtgcgtgacatgaggtcctgggtaaggggtcagtggatcccgtttgatgccgatgctattggccagctcctgggatatccgttagtgctggaagagggccaggagtgcgagtatggccagaggaggaaccggtctgatgggttcgatgaggaggccatcgcccagttgctatatatggatgactttgctactcagcaacatcctgcccaccgaccataa

SEQ ID NO: 112358 - DNA, 855 bp, Glycine max
  Peptide Sequence Number=SeqID_229136
atgaagatgtgtgagatattgcaggctaatgtgcttctagaaaaatttccaccttcgtggagtgactaccgcaaccaactgaaacacaagaagagggacttgtcacttcaagaattaataaatcatatgaagacagaggaggccaaccgacttaaagataagcatgttttacattctgtaaattcagttaatgctaatgttgttgagtttgctgatcaacacaggtcaaaaggaaaagaaaaacgatttcagaaaaaaggacaaaagaaaacacacactaatatcaacaaaggtgataacaagattcagaaaagaaagggtgagtgctatgtttgtggcaaaacaggtcataaagcttatgagtgcaaactgaggaagggacaacaatctaacaactcgaaacctgctgcaccacatgctcctcaagcacatctagcagaaaatgaagaagtgatagttgttgtggtagtggaggcaatcatggtcgacaacaaggtggactggattctagataccggtgcttctaaacacttatgcgccaacaaagagccttttcaccagattgaggatgctgatgacggagaatgtgttttcatgggaaattcagctacagctggagtgcttggtaaaggaaagattctccttaaacttacttctggaaaaacattatctttgagtgatgttttgtatgttccctctctgcgtaggaacctaatttctggtagttgtctaaatagagctggattaaaattggtttttgaagctgacaaagtagtaataactagaaatgatgaacgctatgttattaagttctgtgcctttacatttgcatacttcttcctctgtaacaaatga

SEQ ID NO: 112359 - DNA, 957 bp, Glycine max
  Peptide Sequence Number=SeqID_229137
atggtgaggctcactgctgacttgatctggaaaagccctcatttcttcaacgcgattaaagagcgtgagttagatcttcgaggcaacaagatagctgtaattgagaacttgggtgctactgaggaccaattcgacacaatagacttatctgacaatgagattgtcaaacttgaaaatgtaccatatcttaaccggttgggtacaatgctcattaacaacaacaggattactagaattaatcccaacattggagagttcttgccaaatttacacactctagttctcacaaacaacagaattgtaaacttggtagaaattgatcctttagcatcccttccaaagctgcacttccttagtctgctggacaacaatattacaaagaaaccaaattacaggctttatgttattaacaagctgaaatccctacgggtgttagatttcaagaaagtgaaaaataaggaacggttggaagccaaaaatttgttttcttcaaaagaagttatagaagaaattcaaaggacacccacaaaaagtgaaactcctaatgtttctgaagtgattgaggaacaacagatgcccaaagtcgttgctcctacacctgagcaaattattgctattaaggctgccattgtgaattctcagactcttgaagaggttgctagacttgaaaaggcattgaagtcaggccagcttcctgcagatttattgttggataatgttgatgaaaaacatgaggacatgattcatgacgatagaggtcaagctgatggagaatctaatgatacacaagagcagagaaatactgattctgcttcaatggaacagagtctatggacttcctcgtttcagattcttgtttcccattatttctctttgtttggcctggctcacttgtccagccacatgacaactgacattgcatctctggccagtgctcaccattgccagcaaccatga

SEQ ID NO: 112360 - DNA, 450 bp, Glycine max
  Peptide Sequence Number=SeqID_229138
atgttaaagcggcgaaggctgacagcatctgcacgtaggcatcgggcagttgcacctgttgttgaggatgttgagcatgtgaatcatgtagctaatgaggaatgtcctgagttgaagttgtcctcccatggaaggaaggttaagaaatttggcaggcctgctccagagattgaaggcttagtggctgccacaggattaagtcatctaattgcatgttccttagaactggagacaggggacttatatttgcttttgtggagaggttgcacggtctttactaacaagagtatcacacgtgtacatgtggtattcttggatgcatttcgtgacctcagccaaacaggaagctacgcatggggagctactgcactcgttcatatgtatgagaatttgaatgatgcgttaaagagaagcgctcgacaacttgcaggatatatcacacttttacag

SEQ ID NO: 112361 - DNA, 1075 bp, Glycine max
  Peptide Sequence Number=SeqID_229139
cctctttgcatatgcaaaggctgagtacaatgaccctctctcatgccttcaagtagcgaggatccttctgccaccgagtcctgatggagatataatagactgtgttgtgtctcatatgcaacatgcttttgatcatcctctactaaaaggacaaaaaccattggatcctccagaaagaccaagagggcataaccaaatggatgatggtgatttgagtgagaattttcagttatggagtttctctggagagtcatgtcctgaaggaacgattccaattagaagaacaacggaacaagacatgttgagagcaacctctgttcgcagatttggaaggaaaaaaataataaaccgtgtcagaagggacaccagcggcaatggacatgagcatgcaattgggtatgtgacaggagatcagtactacggatcaaaggctagcataaacgtgtgggcaccccttgtggaaaacccatatgaattcagcttgtctcaaatgtgggtcagcccggagctatatggggacagctaccctagattctttacttattggacgactgatgcatatcaagcaactgggtgttacaatttactatgctcaggctttgttcaaacaaacagtaaaattgcaattggagcagcaatctctccaacttcttcatatagtggtggacaatttgatattagcttactcatttggaaggatccaaagcatggtaattggtggcttgaatttggatcagggatcctagttggatactggccatccttcttgttcacccacttaggggatcatgcaagcatgattcaatttggtggagaaatagtgaattcagggtcatcagggtctcacacttccacccaaatgggtagtggacattttgctgaagagggttttgcaaaagcttcatattttaggaacatgcaagttgtggattgggataacaacttgattcccttgtcaaatttaaaggttctagctgatcaccccaattgctatgacatacaaggaggggttaataatgcgtgggggaattatttttactatggtggacccggcagaaatgtaaagtgtccctaa

SEQ ID NO: 112362 - DNA, 1041 bp, Glycine max
  Peptide Sequence Number=SeqID_229140
atggagattgatctcttttttgtcagagagaaggttctcagcaacaagcttgctgtagttcacatacctgctcaggatcagtgggcggatcttctcacaaagcccccctcatccaccagatttcagtttatcagggacaaactcaagactattggtgctgcaattttcccattggctgagagtttaaagaaattggactggccacatgcatatgcattcagggaggagattttagtggtgctattgccaataagttcaactacttggctcattttagattctacttttacagttgatagtggtttggatttaggaactcttggtatgcctgagtgtaaacttggattaaatgatagagtattattagaggcacaaggtagaacaaccaagggaaaatcaattgacttggaagacatcaaatttcatcagtgtgtgcgtttggcccgatttgagaatgatcgaacgatttcatttatccctcctgatggatcatttgatttaatgacatataggctcagtacacaggttaagcctttagtttgggtggaagcacaagttgaaaaacattcaaaaagccggatcgagattatggtaaaagctaggagtcaatttaaggaacgcagaccactctatatgtatttacttctccaaactactcaagagaatttattttacagtactgccacaaatgttgagattgagttgcctgttcctgctgatgcaaccaatccaaatgttcggacttcaatgggatctgcatcatatgcacctgaaaaagatgcattaatctggaaaataagatcatttcctggaggaaaggagtacatgttaagggcagagtttcatcttcccagtatagtagatgaggaagcaactcctgagagaaaagctcctatacgtgtaaaatttgagataccatattttactgtgtctgggatacaggtaagatatttgaagattattgagaaaagtggttatcaggctcttccatgggtgagatacataacaatggctggagagtatgaactgaggctcatttga

SEQ ID NO: 112363 - DNA, 1131 bp, Glycine max
  Peptide Sequence Number=SeqID_229141
atggctaagaggaacatgatcaagaccgtcagtgaccatgcgatacatcttgaccttcttgcaaaggctcgaggaattactgctgctgaaaattattttgttagtctcccagaaccttctaagaatcatctttgttatggtgcccttctgaattgttactgcaaggaattaatgactgaaaagtcggaaggtcttatggaaaagatgaaggagcttagccttcctttaagttccatgccatacaacagtcttatgacgctttatacaaaagtagggcaacctgaaaagattccatccctcatccaagaaatgaaggctagtaatgtcatgctggattcatatacatacaatgtctggatgagagctcttgctgctgttaatgatatctctggtgttgaaagggtccatgatgagatgaagaggggtggtcaagcagaagtggcgctcaaggaattggagaagagaaatgctttcaaagatcttactgcttaccagtttctaattacattgtatgggcgaacgggtaacttatacgaggtttatagggtgtggcgttcacttaggctggcatttcctaaaactgcaaacataagctacctgaacatgattcagaaaaaatgtttccgggagtgggaatgtggctgccccacttatgatattcgagttgcgaatgttttgatacgggcatatgtaaaattagatatgctggagaaggctgaagagctcaaggagcgcgctcggaggaggggtgccaagcctaatgccaaaaccttggaaatctttatggattactatttgctgaaaggagactttaagttggcagtggattatctaaacgaagcaatatcaatgggtagagggaatggtgagaagtgggttccatcgtcaaggatcatcagtatcatgatgaggcattttgagcaagagaaggatgttgatggtgcagaagaatttctagagatcttgaagaaatctgtggaatctccaggggtggaggtgtttgaatccttgatcagaacttatgcagctgctggtaggatcagttcggctatgcaacggcgattgaagatggagaatgtggaggtgagtgaaggcacccagaagttgcttgaggcaatttctgtggagtga

SEQ ID NO: 112364 - DNA, 273 bp, Glycine max
  Peptide Sequence Number=SeqID_229142
atggtggggtacgcaccttcaagctttacggatttggtcttcaccggtgaaaggatcaaagtgggtctggaaagagcgaaaaagcctgtagaattcaccccaattttggtgtcctatgctgacttgctcccatatctacttgataattcaatggtagccataaccccaaccaaggttctcaacctccatttttctgaggatacgactcaaatgcaacatgtgcttatcatggaggagccccggggcattccattgagcattgtagggccctga

SEQ ID NO: 112365 - DNA, 357 bp, Glycine max
  Peptide Sequence Number=SeqID_229143
atgtgctggaaaaaacagcttggactgaggctgcaagtggaggcttggaaactagctcctgaatctgggaaccaagtactattagttgtaggacatgaagttaatgagctcttgcttgagttagcttctgaaagtgatcatgaatcttttcccagacttgaaaggagtgaacagatcctagaatacacgatagaatcgagctggagagaattgattgtagccatgtcaggagcatctggtcttgtatttcccacgcagtgtacaccggattcacagtgccaaagttctgatcagcttcatttgcataccgaagaggaatcgtacacaccaagtaacggtgtagttgatgcgctttga

SEQ ID NO: 112366 - DNA, 762 bp, Glycine max
  Peptide Sequence Number=SeqID_229144
atggctggggcagcctctgctctgttcctccttgacatcaaaggccgcgtcctcatctggcgcgactaccgcggtgacgtcaccgccgtcgaagctgaacgcttcttcaccaaactcatcgaaaaagagggggatccgcagtctcaagatccggttgtgtatgataatggtgtgacctacttgtttatacagcatagcaatgttttcctcatgatggctaccagacaaaactgcaatgctgctagcctccttttcttcctacaccgtatcgttgacgtgtttaagcattattttgaagaattggaagaggagtctcttagggataactttgttgttgtgtatgaattacttgatgaaataatggactttggctacccgcaatacactgaggcaaagattcttagtgagtttatcaagacggatgcctatagaatggaagttacacagagacctcccatggctgtgacaaatgctgtatcctggcgcagtgaagggataaactacaagaaaaatgaggttttcttggatgtggtggagagtgttaacatacttgtcaatagcaatggacaaataattaggtctgatgttgttggggcattgaagatgagaacatatctgagggaagactattggtttaaaagaagattcaatggtgctgaagtttccagtggcaagctttctggtagcttttatggcaatctcttcaagcaagttgtcaccactggcaaactctccagtgacttttatggcaatttcttttag

SEQ ID NO: 112367 - DNA, 183 bp, Glycine max
  Peptide Sequence Number=SeqID_229145
atggagccatctactaacagtaaagtcatcctagtaggcattatctccaagtctccaagtctccagcacatggaaagcggcatcaaaataatactggctcccaaattaataagagttttgccaatagaaacttcacctatagaacaaggaagtgatcctaggtcatctcccagtgagcaatga

SEQ ID NO: 112368 - DNA, 450 bp, Glycine max
  Peptide Sequence Number=SeqID_229146
atggaggccatgaaagaagagatggccacaatgatggaggccatgatgagcatgaagaagataatggaggtcaatgcgactgcagttgccgctattagcgttgtttctggggtggacccgactcccccatcttgcctcaacctaataaatcatccaaccgcagatacgggagacccccattttgtgcaagcccagaacaagcaggttttcccgccatatggtttgcctccaaactatacttcacccaatgagaatgtcaataacttcacttctatacccattgagagccaacaacctcaatctgatcatgcacatgtctctcaacccatgggtgagacacatgaaatgcgccaccataatctagccgacttccagccttgcttcagatatgccactgaagggcaagcagttggtggtatacccctgcaaaacactttggaaggcccttag

SEQ ID NO: 112369 - DNA, 216 bp, Glycine max
  Peptide Sequence Number=SeqID_229147
atggatgccaagcaccccacaaggaccaaagaatggtcgcacgtcatcgagcaaaggttcccggacgaaattagggttgagctgaatgaattattgattgattgcacactgagcctatacagtgttatctcctgctaccttgacttaggtcatagaagagcatcatccacaggaagcgcggttcaaagtaaatttgtcccaaatttgggggagtaa

SEQ ID NO: 112370 - DNA, 324 bp, Glycine max
  Peptide Sequence Number=SeqID_229148
atgtttggaggcctaggagagaaactagcaaaaaaatgtcatgtgaaatgcgagaaggcccatttaatagctgggtccagggccccaaactttgaaagtttgaaagagggaattggaaacggtggtagcagcacagtgaggtttagggtttctccttccattcttcagtgtttacagagagagaaagaatataaacctgaggttggtgacattgttatagggcgtgttgttgaggttgctcagaagtgttggcgattggagataaattacaaccaggatgcagttttgctgctttcttctatgaacatgcgtgatggtgtttag

SEQ ID NO: 112371 - DNA, 387 bp, Glycine max
  Peptide Sequence Number=SeqID_229149
atgggaataggggtagttgttatttacacgtgtatatgggcaaatatgactatttttttcaaatgtggatatagacacaatgctttttgtgttttcgacaatgctataacacaatacctaacacctccccattatgattccaagtcaaagatgttctattctcaaagcacgggaaagggtaggtacaagaacaagaatatagtggaaacaagtgtgaacaatgtgattgaagagacaagtaagaagccaaggctgaatttgggtgaaggacttgctatgtttgagaaaaagaaaactaagggtgatggtgtaagtgttgctactccagcttttggtgcattcagttccttctcagatactttttacatagaaaaaggaatgaagtaa

SEQ ID NO: 112372 - DNA, 1428 bp, Glycine max
  Peptide Sequence Number=SeqID_229150
atgattgccaagctaccaaaacttagagaactgagtttaattcattgtaccctttccgatcagtttatccttccattgaggccctctaaattcaatttttctagttccctttccgtccttgatctttccatcaacagcttcacgtcatcaatgatactccagtggctgtccaacgtcacttccaaccttgttgagcttgaccttagtgataacctcttggagggttccacatcaaaccattttggccgtgtaatgaattctcttgagcacctcgacctctcatataatatattcaaggctgacgatttcaaatccttcgcgaatatatgcaccttacattctttatacatgccagcaaaccatttgactgaagaccttccatcaatccttcataatttgtctagtggttgtgttaaacactcattacaagatttggatttgtcagataatcaaatcactggctctttacccgacctttcagtattctcatctctaaaatcattgtttcttgatcaaaatcaattaaggggaaagatacctgaaggcatccgcttaccgtttcatttggaatctctgtcaatccaatcaaactctttagaaggtggaattcccaaatcatttgggaactcatgtgctttgagatcactggatatgtctggtaacaatttgaataaagagctttcggtgataattcatcaattgtctgggtgtgccagattctcgctgcaagaattgaacataggaggaaatcaaatcaatggtacgctttctgacctttcaatattctctgccttgaaaacattggatctttcacgaaatcaattaaatggaaaaattccagagagtaccaaattgccatctctgttggagtctttgtcaattggatcaaactctttagaaggtggaattcccaaatcatttgggaatgcatgtgctttgcgctcattggacatgtctaataatagcttgagtgaagagtttccaatgataatccatcacttgtctggatgtgctagatattcattggaaaaattagatctaggcatgaatcaaatcaatggcacactaccagacctctcaatattctcatctttaaaaaaattatatcttgacggaaacaagttaaatggagagattcctaaagattataaatttccacctcaactggagcaactagatatgcaatcaaattccttaaagggtgtgctcactgactatcatttcgctaatatgtcaaagttaaactacttggagttatctgacaactctttagtgaccttggcatttagccaaaattgggtcccaccatttcagttgacgtacataggattgcgatcgtgcaagctaggtccagtatttcccaaatggttggagacacaaaatcaatttgagtatattgacatttcaaatgctggaatagcagatatg

SEQ ID NO: 112373 - DNA, 528 bp, Glycine max
  Peptide Sequence Number=SeqID_229151
atgtctacacttaggaagcttgtcctatgtgggacgttaacaaggttgccaaattggatttcacagttcccaaatcttgtgcaactgtatttgggcggctccaggttgactaatgatgcattgaaatcactaaaaaatatgccaaggttaatgtacctctgtttcgctcacaatgcttatgaaggtgaaactttgcattttcaatgtggagggtttcagaaactaaagctactgttccttgcatatttggataagttgaagtgcatccttatcgacagaggagcactgtgttctgtggaaaaaatttctttagcagacctctcccaactcaaaaccgttccctctggaattcaacacttggagaaacttaaagatctcataatccactccatgccaactgaattggagcagcgcattgctcccgatggaggagaagaccactggatcatccaagatgtgccccatgtacttatttggagcagggatgctgaagaaccttcgcatatattcggcagaagtcatcactaa

SEQ ID NO: 112374 - DNA, 255 bp, Glycine max
  Peptide Sequence Number=SeqID_229152
atgcaatcaaacacttcatcatcaacgaaagctaagtctacgaacttagggtctataatggaacgagaagagaaaagagaattgtaccgggtcaaagcaaacaagatcaagaaaaagataaggcatcaaacaatctcattggttgatcaagcttttgcctcaaaacacattgtttccaacatccaaggctctggtaatcgattaccaggcaacgtaatcgattaccagaagacaattttgaagcaatgggtttaa

SEQ ID NO: 112375 - DNA, 1629 bp, Glycine max
  Peptide Sequence Number=SeqID_229153
atgcatggcatcaaacaagactacctcatcagggtaccttgttcatgcaaaaacacaagtggccttagcggatacttttatgacacaacctacaaagtgaggccaaatgacacttttgcaaatatttcaaacctgattttcagtggccaagcttggccggttaatcatacattgcaaccaaatgagactttagcaatacacattccatgtggatgttcagaaagtaagtctcaagtagttgttacctacacggtccagccgaacgatacaccgatgatgattgctaatctgctaaattctacactggctgacatgcagaacatgaacaaggttctggctccgaacatcgaattcatcgatgttggttgggtgctatttgtccctaaggaatccaaagggctactactactacctagtgctactagtactaatattgaagaaaagaaacataataagtggacaacaataatcattggcatcttagggggcatgacattgctttcaattgttacaacgatcattctcattctcaggagaaataaagtcgacaaaatcagcatagaagattcacgccttatttctggaagatcaattgccaataaaactatttcctcaaagtatagtcttcataaggaatttgtggaagaaagaccattgatatataaccttgaggacattgaagaggctacaaataactttgatgaaagtcgtaaaataggaagtggtggatatggaagtgtttattttggaatcttagggaacaaggaggttgctgtgaagaagatgaggtctaataaatctaaagagttctatgctgaactcaaggtcttgtgtaaaatccaccatatcaacattgtggagctgttgggatatgccaacggagaagattatctctatttagtgtatgagtatgttccaaatggatctctcagtgatcatcttcataatccattactgaaagggaaccagcctctttcttggagtgctagggttcaaattgcactggatgctgcaaaaggtcttgaatatatacatgattatacaaaagcacgatatgtgcaccgtgatataaagactagcaatattctacttgataacaagttcagagcaaaggtgggagattttggacttgcaaagctggtagatagaacagatgatgaaaattttatagcaactaggcttgtaggaacaccaggctaccttccaccagaatctctgaaggagcttcaagtgaccccgaaaaccgatgtgtttgcatttggagtggtgctttcagagctgttaacaggaaaacgtgcactttttcgagaaagccacgaagacatcaaaatgaaatcacttattactgttgtaagtgttgagaaagttaatgaaatattccaagatgatgacccagagactgctttagaagatgccatagataagaatcttgaagctagctatccgatggaagatgtctacaagatgacagaaatagctgagtggtgcttgcaagaagatccaatggaaaggcctgaaatgagggatatcattggggcattgtcacagattgtgatgtcctcgacagagtgggaagcatccctatgtggaaacagccaggtctttagtgggttatttagtggaagatga

SEQ ID NO: 112376 - DNA, 441 bp, Glycine max
  Peptide Sequence Number=SeqID_229154
atggcgggaaatatggcagttattgagcactccaacaacaagaacccggcgaggctgcatagagagcagtgggagatatgctttggctcgcttcatcccttgttcttcatcctcagaggagcactacgtcaccaagctgcatttcacgtggcctcaggtgtcttgcgtctctggataccctcccaggggcatcagaactgtgctttgttgattcttgcttttctaattgtaacgtcttgtggtgatggttgggttggtaggattcaaaagtttgctatgcggtttccatcaatctatgaagcagagtcatttatcaatgctttgaaggagattctgaaaggtgacaaggatccagaacctttgaataccgactttggttctgaaattttgtcgcagtcagagttcatgtcaacaattggaggaatgggaggatacaactaa

SEQ ID NO: 112377 - DNA, 510 bp, Glycine max
  Peptide Sequence Number=SeqID_229155
atacatatctcctgtgaatctacttggagaatctttggatttccaatacatggcagaaaacctgttgttgaaagattacacttccatcttccaggccaacatagtgttctctatgaggaccatgatgatattgatgatgtactgtctaagccaagtatctctgattcaaagtttatttcatggatgaacaccaaccaaaattctgttgaagggagaaatcttacttatgcagaatttgtttctaagtttgtatacaatcagaagaaaatatgttggcaccttaggaagaaagactataccattggcagattactatgggttccaccaattacaggggaattattttatttgagaatgatgcttactgtttgtaaaggacctacctcatttgaggatttaagaacagttgataatgttcagtattctacatataaagaagcatgttttgctatgagatttttacaagatgataaagaatttgttgaggcaatcaaagaagcaaaagactag

SEQ ID NO: 112378 - DNA, 293 bp, Glycine max
  Peptide Sequence Number=SeqID_229156
ttgtgactgacaggaaaccagttaaggacaagccaactgcggatagtggaagcaagtctaggggaagtgccaagcaacatgcaactcagcatgaccagattcccgaagtcttttggaatctcgctgcagagctgattattgccgaggtcgagtttgccgacatcgacggggatctcgcaggcagggatctccccgacaatgtctttccattcagcgacgacaagggtggtgagggtgtcgatgtcgaagttgaggcaacaattggaacccgtccacgagttgaagaggccaag

SEQ ID NO: 112379 - DNA, 354 bp, Glycine max
  Peptide Sequence Number=SeqID_229157
atggagactaagatgagtaaagaatacccaaggcctcactcgtgtacaacgttgatgacctcaatgggggcaatgcaagccacaatctttgcactctgtattgagaaggattggagccaatggaagttgggctggaatattaggcttctaacttcagctttttcgggaattgtggtctctggattagttgtaattgtcactgcttggtgtgtaaggcttagagcaaaagaaatgaaaatgacccctcaattggtgtcatcaaacaaagaaaattttgaacccagtactgtggctgtagtcattgccacactggattatgacaatagtgactatgacaacaataaccacacatga

SEQ ID NO: 112380 - DNA, 747 bp, Glycine max
  Peptide Sequence Number=SeqID_229158
atgggtaaggctgcgtacaacatccctcccccataccttcgcatagcgaagagcctctgggcaatggggtacgaagatctgtttgtggacttgcgtcccaatatggttcgttacacttctatcgaggaagtgaatgcagctctagtagaactcgaggaacatgatcggattgtttctgctgataaggtcagcagtgaaaaacattctggcactgagaagcctttaattaggaccacttccactactgcagtggttggcaatggacaaagcattgataatggtacggaagaaaatgaagtgcaagatgataatgacagtgagactgattcagggagtgacacaattgatgtggagggacatgatgaagagttggatgaggagaatcatgatgatgggtgtgagactgaggatgatgatgatgatgatgatgatgggcctggaccagcttctgacgaggaggatgaagtccatgtgagacaaaaagtgaccgaggtggaccctctggaagaagccaatttcgatcaggagctcaaggctgtagtacaggcaaggaaaaatatttcctgggaatcgtactgctatgctgatatggtgtgccttggcactacaataaggttgctaggcacaacaataaggttgctaccttgtgacaagattgaaatttttgaaataacctctttccttgttggggagtctgccagcatctacccttcccaggttccactaggtgggggacctgtgcaataa

SEQ ID NO: 112381 - DNA, 219 bp, Glycine max
  Peptide Sequence Number=SeqID_229159
atggacgcgagtgtggagttttacacgacatggttaactaagtccaaaggggcaaggatgttgttcgatgtcagggttgagccaacggcctcaatgatgatgaatttgccatcgaaggttgtcatggaggtgggaggaggaggggatgaaagggttcgatggagaagaaacggagaggacagagggagggaaggaagagagaccatgaccagactatag

SEQ ID NO: 112382 - DNA, 421 bp, Glycine max
  Peptide Sequence Number=SeqID_229160
atgttgaatctggagaaaaattgcatcgatgacgtttacggttcattggttcatcattctgaaagaaaggaaaccgagccaggtgcggactgcggatttggggtcacatctgcacggcacttcagagttgttttgggcttgcggacaaggtttttggctttgttaaaactcacatgcagtagtcacgtggcaaatggtaaggaagctattgttgctggattttatcatgaaggttacgaagagccattgttaatgctcatgaaaagaaggggagtgcattcaggtttggtagtgaagggagaggaagggggcctctcattgactacaagattgcgatcagctaacacaaccaggggacttcctgtgaactactgttcaggtttccgtgcacttgacatttcatccacatctgaagtgggtg

SEQ ID NO: 112383 - DNA, 1176 bp, Glycine max
  Peptide Sequence Number=SeqID_229161
cgtcgacggcctaccgcatccgcacggaggcagcgagtacctgtgattgtggcgcacgatgagtcagtgctccctgcgccagatgtagaggctgacgtatttccggatgacccgatggcactgactgatgtagaggacactggggcagacattcctacagactcaggcacccaggctactgaggatgagcctgagggattttcaggtggtccgagcgacccatccgtgctgacccagtatgcgaatcacgttgcttgcagcgtatggacgggagaggagtgtcctgagttgaagttatcctctcatggaaggaaggtctatagtttaggcaggtctgtccctgccattgagggactagttgttgggacaggactaagtcctctgatcgcgtgttcggtagacactggcgatcggggatatttgttctcgtttgtcgagcagtggcaccgagagacgtctagtttccatctccctgtgggagaggtgacgatcacgctggactatgtctcgtcgcttttgcatctacccatggttggcgacttgcacgcctttcagcccttgcacgtggatgatgcggttccgatgctcatgaacttattgatggtctctgcagaggcttccagggctgagacagggcagtgtcgtggaccgtacgtacgcctgcaatgggtatgttatatctacgagcgccgatgccaggtaggtcattggacagctgtggctcgcgcgtatcttcttcatcttctgggttgcattccgtttgctaacaagagtgcaaccaatgttcatgttgtgtatttggaggcccttcgtgacctcagtcagaccgggaggtacgcctggggaatagctgcactgtgctggatatacgagcactttgcctcagtcgcggagttcattgttgatcaggactacgatgaggattcaccacgtgcctaccgtgaagagcatatgtacaccggtgtacagggagcacctggaccgactccggattttggatgtctgttggatcccatatggggagcatcgaccagtctaggacttccatatgatttcatgctattccggtctcctgcgatggagacccgttgctgtgtattaccgaccagagagggtcatgcggtagtttggatacacccagaccatttcttctctgcctttcgattcatgggtgtc

SEQ ID NO: 112384 - DNA, 180 bp, Glycine max
  Peptide Sequence Number=SeqID_229162
atggagaagaagcccccaactagaagccaaaagcgagagttagaagactttgaattggatgtcctgttatcagatgatgctcttattcctacaacagtttttggcatcctccctatggagtttgctagtcaggattggctaaaggctaccttagaagatgatgttttagtcgatgaatga

SEQ ID NO: 112385 - DNA, 942 bp, Glycine max
  Peptide Sequence Number=SeqID_229163
gttgttgccttctctttgggccttatacttcttggagaccctttgcttcctgcagtactatccctatcaaatggtcttcctagtgagctcaagaacactgtggttggggttgatgttggaaaggagggtgaggttgttgatggtgttgagtgtgaagccagtgagactcgtttgttgaaacctcccgaggtgaacgatggtgatactatactgacagaggactcatgtatgtggcaactatgcacgttgttaacccgcaaacgcaacaccaacgttgtccccttcacaaaaccttctcctgaatccgaagacgaaatgtacctctcctcagaaccttacctcgctcgtgacacttcccaaggggattcgttttacgaaaatgaggataccaatgagctatctgatatattgtgctctaaagaggacaagaggtgtgctttagaggaaattgatgatgatgaagaaaagaggaaacaaactgtagatataccgtggatactggacctgtctcatgataaactaggagtgggaaagaccgttaatgtgtttggtcaattgggtcgagaaacaggtgtgaaagagtataacacattgataaaaatgtgcgtaaagaaggctagggcaactgacgatgaattcattggtgtaagagaaatgagtaaggcttttcacctttacaaatcaatgagagatcttgggtatccactagaagagaaaacatatggtccacttcttcggtatttagttgatatgggtttggttcaagaatttcaacttttcactgatattatcaaaacagagaaccctagttcagcttcacgattgggttactatgaaatgttgctgtggttgagagttggcaatgaagaaatgatccgggatatttgtgaatatattacagtcgaagctagagaagagacttctgctttacgaggttggtga

SEQ ID NO: 112386 - DNA, 1845 bp, Glycine max
  Peptide Sequence Number=SeqID_229164
atgtggaaggtagaagatattattccaaaattcaagaatatgcatgaattactggaagtgttgccttcaacctcatcatatgaaaagctcattttgcattgctgtggattagacaagttgattccgttattgctggagagtggagaggctggtctcttttcagaaaacacaaccaagaaggagctatggcaacatttcagaaaagtgggcgacgtaagagaggtgttcattgctaagaaaagaaacaaaaatggaaggagatatggtttcgtaaggttcaaaggagtggaggacatgcttcagctagaaaagaagttagacaacattgtcttcggtggtttgaagatgtttgtcaacatcccaaaatttggaagagctgctcctggaaagccacaaccagtagactggagacgaccacacaataagacaaatgcggaggagaacagacacgcgtacctgaccatgacgcaaagagggctcaggggagcgaagacaggattgtacgtggatgccgtcaaggggaataatccaagagctgaacaggggagactattacatagagggaacttcttaggcaacaggtcgcaatcggaggtgcagttagacatacctctgatagggcataaatggctcaatgaagcatgggtggggagattaaaaaacttgacagtgttcgataaagttgaggatgacattctatgggactgtggagctaatgtgtcaccaaggtacatcggagatgacatggtcttgctcctaggcctcacagacgacaaagcaagacaaatgatggatgaagaaaatgaaggagggaggacgatgtttcacaccatggagaagtggaacccgcggatgcgacctgggcataggttgacatggatacaatgctggggaatacccttaattgcctgggacatgcagcaaataaagaagattgtggcgggtattggagaaatggttgaggttgatgacaatgtagagggacagtggaagatggacatggcaaggatcttacttaaaacaccatggaaaccactcatccaacataccgttagggtgaacatccagggggagatatttcaggtgcatataacggaggaaggcggaacatcaccacaggtgtgcatgtgtcggcgcgagatggagtacaactcatcggacgagattcaatcagaggagagtcaagagggatcgctatggtggataacggcgcagacgtcacagactaaggaaggatccaggcgctgggcagcggtgccgccgtcacagggcggtagcgatgaacatcggaccgcggacgataaggccgggatgaatggcgatgcatcatcctcctcggaaacgaggagtatccaccacgcgccggacaagtttcagaatggaaaggtgccgacatccagcggacaaaacaccaactttgaaccgaaggacaacaacagtgcctatcggatcagcgagactcttggatttggcggaaggagagagaaagagcataaaaaaggaaatgaggaggcagaggtgaacattgacacgctggggaagataagcaatatttcaaaattgtcacgtgacctggaggcatcagatttaaatgggctgggctgtgctaaccacacccccagcacttcattagtctaccaagcaggcagcccctcaacaagcaaggtaggcccaaataattcctggagagttttttataggaaacgctggcgcaaaaagcaatatggccctcttccggaagcagacacggcccaacaattaacaactaagcacccaaacacgcaagactcagcacaaacccagatgaatgaaagagatcagagttgcaattaccaatcaccatag

SEQ ID NO: 112387 - DNA, 1233 bp, Glycine max
  Peptide Sequence Number=SeqID_229165
atggtggttgacagctggaactcaaaccaacaaagaggatggggaggatatgtgctaaaagaaaaaattaaaaccctcaaagaaagaatcaaggtgtggaatagagaacatttcggggataccttcaggaaatataagaagattgaggaagatttaaacaagttggaagagggcacagaggatagacaaccaactcatcatgaggtggcaactaggaagcaacttcaacaggatttgtgggaagcagctcaatcacatgaatcacttatgagacaaaaggcgagatctaggtggattaaagaaggtgattgtaattctagatactttcatatgatgatcaatgctagccgaagaagcaactgtctgaaaggtgtgatggtgaaaggatcatggattgaagagccagtaatagtcaaagaggtagtcaggagtttcttttcacagcgcttcaaagaatcagactttggcagacctacactggatggggtacattttcaaactattactcgtcagcacaatgacatgctggtggagagattccaggaggatgaggtgaaaagggttgtatggggctgtggaagtgacaaaagtccgggcccagatggacttaatttcaaattcattaagcagttctggcacatttttaaaccggatttcctaaggtttttggatgaattccatgtcaacggaatttttccaaagggatccaatgcatctttcatagccttgatcctcaaggtggtggaaccacagatgctgaatgattatagacctatctctctcattggatgcacatacaagatagtggccaagatcctggctaacagattgaagaaggtcatgcctcttattatacacgaaagacaaacaacatttatagaaggaagacacatgctacacagtgtgatgattgcaaatgaggcggttgaagaagccaaaagatgccaaaaaccacgcattgttttcaaggtagattatgagaaggcctatgattctgtatcttgggagtttttaatttatatgatgagaaggatgggcttttgcaacaaatggattcaatggattgaggggtgtctaaagtcagcatcgatttcggtcctggtaaatggtagtccctcatctgagttcttacctcagaaaggacttaggcaaggagatccactatcacctcttctctttaacattgttgtcgaggcacttaatggccttatctcacaactttggagaaaatga

SEQ ID NO: 112388 - DNA, 753 bp, Glycine max
  Peptide Sequence Number=SeqID_229166
atggagaatgttaaagcaattaaagcaatactgagggcatttcaattagtattgggcctcaaaattaattttgctaaaagtagttttggtgcttttgggatgtcggagcaatggacactaaatgcggccaattacctcaattgtagcttgatgcctttcccttttacatatctcggcgttctgattggagcaaatccaagaaaatgtcagacatgggaccctattattagcaaggttcctaaaagggtggtggacaagttggtgagtctacaacggactttcctatggggggaactcaatttcatggaaggtgggatgtggggacaaatttcatttttgggaggacaagtggagaggtggagaccattgtttgacaatgaagtagatatgacggtttctttcctaaatgaaattgagggccatagaatccagcctcagattccagatcagtgggtgtgggtggctgatcctcaaggtcaatactcagctaggggtgcttataatttgctcacgaaggctgctgccaatcagagtaaaccttcggaggaggcaaatcaagttaaccaatgtgttctgtcctttttgtggatcatcggaggagagtgcaagtcacctcttctttcaatgcagcaaaatacttccactgtggtgggaatcgtggtcttgggggcaactagtgggtgctttcccgcagcagccaagacaacactttctccatcacattggtggaatgctgcagggaaggaaggctaa

SEQ ID NO: 112389 - DNA, 2151 bp, Glycine max
  Peptide Sequence Number=SeqID_229167
atggggacaaggtttgatgtggagaagttcacaggggataatgatttcagcctgtggaggatcaagatgcaagctcttcttgttcatcaagggcttgatgatacactacaaggagcctctaagcttccatctacactgtcagacaaagagaagaaagatttgttcagtaaagctcatagcacaatcattctttctcttggtgatgaggttcttcgagaggtagctgaggagaaatctgcaacagagatttggctgaaacttgagagcctgtatatgaccaaatccttaactaacaagttgtacctgaagaaaagactacatcagctgaagatggaagaaggttcttctatcaaagaacatgtttctttgtccacaaaggcagttcttgatttgaaaagtgtagatgtgaggatagacgaggaagatcaagcagtaatgctactatgttctcttccatcatcctttgaaaatttggtggacactatgctttttgggagagatacactcaccttggaggaggttaaagctactctgaattctcgagaactaaagaaaaagataactgaaaataaaggtgaaggtggagatcccaaggcattgatggctagaggaagatcagaaaagagggattcaaagagcaagaacaagaggaggtccaaatccaggaacaagaaggcatgctactattgcaagaaagaggtggtggctgatggatatgaaagtactgaagtgctctccatctcaactgaaaagcatagtgaggaatggattctagactcgggttgctcattccatatgacacccaatctggaatggttcagctcctataaggagatagatggagggaaggttctcatgggaaacaatatggcatgtaatgtcattggcattggaactgttaaattgaagatgcaagatggatctgtaaagctgctccctgatgtgaggcatgttcctgaacttaaaaggaacctgctctctttgggaatgctagatcaatttggatgttcattcaaaggagaaggtggaactttaaaggtattcaaaggttcattacaagtaatgaaggatacaaggcaaaatggcctttacaaactgcaaggcaacactatcttgaactcagctggcctagtttctatctctgaaccaaatgcttccaagctttggcagtatagattaggtcatgtgagtgagaaagggctagaagaactacataaacaaggattgatcggtaatgggaattatcaaaagtcccaaatcaattatcaaaagggatgtctttttagagaagaagacatgatagcagattatcaacagaagtctgattcagttcaaaagggtgttcaagctgagcaaaacagacactctgatcaaggaattaggttggaggtggagaagcttgcacaaacatcaggtccagtagaggacagaaatgaagcatctcatgatgaacctatgatttcatcaattcctgaacctgctgatacttcatataacctggtcagagatagacaaagaaggcaaattaaagctcctgtaagattgggttatgttgatcttgtagcttatgctttgagtatagaaattgattatcaaggctcagaaccaatttcttacaaagatgcaatttccagaaccgatagtgatcagtggagatcagtaatgcaagatgagtttgactctttaatgaagaatgatacttggaaacttgttgaaaagccaacaaagcagaaagttgtagggtgtaaatggattttgaaaaggaaaccaaaagaaacaggaatggatagctacagatacaaagcaaggcttgtggctaggggtttcacacaaagagaaggaattgactataatgagattttttctccagttatgaagcatacaagcatcagaatcatcttggcactagttgcagttcacaaccttgaattggagcaaatggatgtaaaaacaacatttttacataggaatctagaagaaacaatctatatgagtcaacctaaaggatatgaggtaaaagggaaagaggagatggtatgtttgctgaagaaatctctgtatggactgaaacagtccccaaggcagtggtacaaaagatttgactcttttgtagtgtcaaatggtttcagcaaaagttcctatgatagttaa

SEQ ID NO: 112390 - DNA, 3747 bp, Glycine max
  Peptide Sequence Number=SeqID_229168
atgggaaacaatagtatgtttcgttatgcagatggaatggacaagttgttgatgttctttgggaccttgggaagccttggagatggactacaaacccctctcatgatgtacattcttagtgatgtgatcaatgcctatggtgacaagaatagtcatttgacaaggcatgatgtgaacaagtatgctttgaggcttttttgtgctgcacttggagttggactttcagcttttattgaaggaatgtgttggacaagaactgcagagagacaggcttccagaatgagaatggaatacctaaaatcagtcctaagacaagaagttggcttctttgacactcagactgctggttcttcaacaacctaccaagttgtctccctcatttcctcagatgcaaatacaatccaagttgtcttgtgtgagaagatacctgactgcgtagcttacatgtcaacattcctattctgccacatcttggcatttgtactttcatggagacttacactggctgccataccactgtctgtcatgttcattgttccggcacttgtatttgggaagatcatgttggatcttgtaatgaaaatgatcgagtcttatgggattgctggtgggatagcagaacaggcaatatcttcaataagaactgtttattcatatgttggggagaatcaaacactaaccagatttagcagtgcacttcagaaaactatggaatttggaataaagcaaggttttgcaaaagggttaatgttgggaagtatgggagttatttatataagttggggatttcaggcttgggttggaacttttctgatcactaataaaggagaaaaaggaggccatgtatttgtagccggcttcaatgtcctcatgggaggcttgagcattttaagtgcccttccaaatttaactgccatcacagaggcaactgctgctgtcactcgccttttcgaaatgattgatcgagtgccgactatagattctgaagataagaaaggaaaggccttatcatatgtgaggggagaaattgaatttcaagacgtctacttctgttacccatctaggccagacacaccagtcttgcagggattcaatctcactgtcccagcaggcaagagtgtaggccttgtgggagggagtggttcaggtaaatccactgtcatacaactgtttgaaaggttttatgaccctgttgagggagtaatactcttggatggtcacaagactaataggcttcagctcaagtggttgagatctcaaattggcctagtaaatcaagagcctgttctctttgccacttccataaaagagaatatattgtttggaaaagaaggagcctcaatggaaagtgtgattagtgcggctaaagcagctaatgcacatgatttcatagtcaagttgccagatggatatgaaactcaagttggacagtttggattccaactgtctggtgggcagaagcaacgcattgccatagcaagagccttactaagggatccaaaggttctcttgcttgatgaagctaccagtgcactggatgctcagtctgaaagagtggtacaggcagcaattgatcaagcttcaaaaggaaggacaacaatcatcattgctcaccgtttgtctacaattcgaacggctaacttgattgcagtccttcaagcagggagagtcgttgaattaggtacacataatgaactcatggaattgactgatggtgagtatgctcacatggtagagttgcagcaaataacaactcagaatgatgaatccaaaccttccaatcttctaacagagggaaagagctcccacagaacgagcattcctcaaagtccaactgtaagtttcagatcaagcactgtaggaactcccatgttgtatccctttagtcagggattttccatgggaacaccttactcctactctatccaatatgaccctgatgatgatagttttgaagataacttgaaaagaccaaatcatccagctccttcgcagtggcgtttgctgaaaatgaatgcacctgagtggggaagagcaatgctaggaatcttaggagcaataggatcaggagcagtacaacctgtgaatgcatactgtgtaggaacacttatttcggtttattttgaaactgatagctctgagatgaagtctaaagctaaaaccctggccctcgttttcttaggaattggtgttttcaacttcttcactagtattctccaacactataactttgcagtcatgggagaaagattgaccaaaagaataagagagaagatactagagaagttgatgacttttgagatagggtggtttgatcacgaagataacacaagtgcatccatttgtgcaagattgtcctcagaagccaacttggttcgttcccttgttggcgatcggatgtctttgttggcccaagcaatttttgggtctatctttgcctacactctaggacttgtgctcacatggaagctttcccttgtgatgattgcagtgcaaccattagtcattggaagcttttactcaagaagtgtcttaatgaagagtatggccgagaaagctcgtaaagcgcaaagggagggaagtcaacttgcaagtgaagctgttataaaccacagaaccataactgccttcagctctcagaaaagaatgttggcacttttcaaatccacaatggtggggcctaaaaaggagagtattaggcagtcatggatttcaggctttggtcttttcagctcccagttttttaacacttcatcgacagcattggcttactggtatggtgggaggctcttgatagatgatcaaatagaaccaaagcacctcttccaagcatttttaatattactcttcactgcatacattattgcagatgctggaagcatgacttctgacttgtccaaaggaagcagtgcagttggatcagttttcacaatccttgacaggaaaactgagattgatcccgagacctcctggggaggcgagaagaagaggaaaataaggggcagagttgagcttaagaatgtattctttgcatatccatctagacctgatcaaatgattttcaaggggctgaatcttaaagttgaacctgggagaacagtggctctagtcgggcacagtggttgtggtaaatcaactgtcattggtcttattgaaaggttttatgatcctgcaaagggaacggtgtgcatagatgaacaagacatcaagttctataacttgagaatgctgaggtcacaaattgcattagtgagtcaggagccaacactttttgctggcaccattcgagaaaacattgcctatgggaaagaaaacactactgaatctgagataagaagggctgcatctctggctaatgctcacgaattcataagtggaatgaatgatgggtatgagacatactgtggagaaagaggagttcagctatctggaggtcagaaacaaagaatagccttagcaagggccatactgaagaatcctgcaatactgcttctggatgaggctactagtgcacttgatagtgtgtcagagatcttggtccaagaagcactagagaagataatggttggaagaacatgcattgtagtggcacacaggctctctacaatacagaaatccaactacattgctgttattaagaatgggaaggttgtagaacaaggttcacataacgaattgatttcgcttggacatgagggtgcatactattctcttgttaaacttcaaggtggtagctcccctaggtaa

SEQ ID NO: 112391 - DNA, 672 bp, Glycine max
  Peptide Sequence Number=SeqID_229169
atggcacaagaacgcaacaccaactgctgcaggtgctgtttcggcaccctcctctcccttggcctcaccgcggccttcctctggctcaccctccgcacctctccccccaaatgcaccctccaatccctctacctcccttccttcacctccccccaccacaaaaacgacaccctcttcttcaacctctccctccaaaacgacaacaaggacaaatccatcaaatatggtgctgtccttttcaccttcgcgatcttcctcgataataccaccacgcggcctctcgcgaacgcgaccctggagcccttctaccagggccgcagcaagaccacgcgcaagtggggctccgcaagagtcccacgcgacggcagagcgatagcgaatcgctctgccgacgccacggtgaggaataacgggaaggtgttcgtgcgcgtggagtttaggactagggtgaggtataagatatggacgctgttttatgttaaacggcagcgtttggttggtggggcgaatgtggaggtgaatgctagctccggggagaaggtcgagcctaaggggattaggcttggggaaatgccgcctaggctcgggtcccaagctgccaaggctcggagttgctatgtggcgtttctcggagttttggttactggattgtttctcactgcgtttacttga

SEQ ID NO: 112392 - DNA, 351 bp, Glycine max
  Peptide Sequence Number=SeqID_229170
atgaccgttgcattctacacaactgctaaaccaggtgcaattccccggaataaaccttgggatcccagtatcacatttggaagcaaagggttgatcccccagcaccttgaggacaaggtgtttttgatgagggcgagaatgatagggatagtactgcaggaagcaaaaggtctccaagaacaaagcttcctttctcttcttcttcctctggaggttctgacgcctcgaagccagcttatcttcttcttcttccttattattctggaggagttgaccctcgaagtcagtaaccaagccgctgcatgtaacactattctccgagcaagaaattctttaaagactaagaagtaa

SEQ ID NO: 112393 - DNA, 651 bp, Glycine max
  Peptide Sequence Number=SeqID_229171
atgcagcagcaaccatcacaaaaacagttcaaagggttagcaagcaatgagaaacacatgccaatcctggagagcagtaaagaggagccgggatggccgtctttcggacagctcattgttgatctttctaagctttcccttgaagcattagctagcacattcattcaattcataccctcacatttcagacctagcaactccaagagaggcctaacaccactgaaagatcgtcttgtgatgcctgaagatgatgtgccgcctccattggtcaacaggcaaaatgctcaaggacatactcctcttaccgaaaataggatggcatcacaggtccatactcctcttaccgaaaatcggatggcgtcacaggtccatactccaaccatagctgagaaatattcagaaatgaagcccccaaagataaaatcaagcagtttcaaaggacccctctatgtcaagcaagcaccgagccagaaagaaaggccaagacacagacaacgagaaaagagtggagaagtcgttatgggggcagttggagctgaggctaaaccagttgagacaagggctgttgatcataataatccaaagtttgaccattacagtatgagaactaagtatgcatctgaggagaccttccgattcaactctcagtaa

SEQ ID NO: 112394 - DNA, 153 bp, Glycine max
  Peptide Sequence Number=SeqID_229172
atggtgatggagctcacaactgaccaaaacggtgctgcttaccaacactcacttcccgttcccgaggacaaagttcttgtccctgtcgaggtaaccctaaaaccttcaagcacaactaaaatcgacgatgttggttccgccgttgaggggtaa

SEQ ID NO: 112395 - DNA, 549 bp, Glycine max
  Peptide Sequence Number=SeqID_229173
atgggatggtcattgctgatatcttctttcgtttggtgtgttgaagattgttttgatgcgatgattaatgacactggtctgagcaatctggttggtagaacctttggtcttagtgagtcaagttttatgtctgaattagacgatcaaattcctactgccttcgaatacggtacctattgtttaacttcactatgtcaaactgctctaacttttatgttttactctagtaatttgtaccttatagatccttttgctgatgcaaatgctgatgactcgggtgctgggtcaaaggagtatgtgcatattcgtgtacagcagcgaaatggtaggaaaagcctgacaaccgttcagggattgaaaaaggaattcagctataacaagatacttaaagacgtcaagaaagagttctgttgcaatggaacagttgttcaggacccagaactaggacaggttattcaacttcaaggtgatcagaggaagaatgtttctaccttcctagtccaggctggtatcgtgaagaaggatcatatcaagattcatggtttctga

SEQ ID NO: 112396 - DNA, 1252 bp, Glycine max
  Peptide Sequence Number=SeqID_229174
gtcgactctagaggatcccactattcattgctggcatctgaatatctgtgtgaatgtcataagtgtgcgttatgacgctagatcgtcctgggcattttcagtagagcggttagctaacgagtcccgcgtcgcagcgacgccaaagaccgttgagcagctcattaagctgggattcagcgtcaccgttgagcagggtgccgggttgcgcgccagctttgatgatgacagttttatcgccgccggtgccagcatcagtaatccgcaggatgtctggcagtccgacatcgtgctgaaggtgaacgcgccagacgacagcgagatcgccctgatgcgcgcgggcagcacgctggtgagctttatctggccagcgcagaacccggcgctgctggagaaattagccgcacgcaacatcaccgcaatggcgatggattccgtaccgcgtatttcgcgcgcacagtcgctcgatgcgctcagctcgatggcgaacatcgccggttaccgtgccattgtcgaagcagcccatgagtttggccgcttcttcaccgggcaaatcaccgccgccggaaagtgccaccggcaaaatctcggtgccatcgtgcgcgccttcgacacccgtccggaagtgaaagagcaggtgcagagcatgggcgccgagttccttgaactcgactttgaagaggaagcgggcagcggcgacggttacgccaaagtgatgtccgaagcctttatcaaggcggagatggcgctgttcgcagcgcaggcgcaggaagtggacattatcgtcaccaccgcgctgatcccgggcaaaccggcaccgaagctgatcaccgcagatatggtggccagcatgaagccgggcagcgtgattgttgatctcgcggcagccaccggcggtaactgcgatctgaccgtcgccgaccgcgtcacgctgagcgacaacggcgtcaaaatcatcggctacaccgatctgccgagccggctgccaacgcagtcctcgcagctgtacggcaccaacctggtgaacctgctgaagctgctgtgtaaagagaaaaacggcgagatcgtggttgattttgacgatgtcgtggtgcgcggcgtcacggtaattcgtgacggcgaagtgacctggcctgcgccaccgattcaggtctctgctgcgccacaggccgcaaaacctgccgcacagccgcaggtgaaagcggcagagaagcccgctgcgccgtggcgcaaatatctgctgctggcgctcgcg

SEQ ID NO: 112397 - DNA, 255 bp, Glycine max
  Peptide Sequence Number=SeqID_229175
atggaggcgcgtggcgcgagggggcggagagtaggggtggcatggaaggaaggggatgatgatttgttgaagagagatgaagggggtgatgttaggaaggaggaggtgatggtggaagaagccatgttatgggtcaaaattggaaagtttgaaagtactatcatacaagagcgggtttctagagaatgcatggatgacgcgtggcagtttatcatgcaaaatcaacggtgtagacttcttctgtaccattggtag

SEQ ID NO: 112398 - DNA, 144 bp, Glycine max
  Peptide Sequence Number=SeqID_229176
gagcattctgggaatgagaaatcgtgtgtgtggcatgcttctgattttgcagatggagaattgaaggatgagctgttctgtattaggtttccctctgttgagagtgagtctctaggccttgttctgttggaactaccctgttga

SEQ ID NO: 112399 - DNA, 783 bp, Glycine max
  Peptide Sequence Number=SeqID_229177
atgtcctcgcctttagagagctacacgtcctcgcttttagagagctacacgtcctcccttcagaggactacacatactcgccttcagaggactacacgtccttaccttcagaggactgcatgtcctcgccttcagagggctacaggtcctcgcatcagaggagtacacatcctcgccttcagagggctacacgtcctccccttcagaggactgcacgccctcgccttcttaggactaaacgccctcgccttcagagggctacacgccctcgccttcagagggctacacgtccttaccttcagaggactacacatcctcgcattcaggggactacacgtcctccttttcagaaaactgcacgccctcgccttcttagggctacacgcccttaccttcagaggactacacgtcctcacctttagagggctacacgccctcgccttcagagggctacacgtcctttccttcagagggctacacgtcctcgccttcagagggctacacatcctcgccttcaaagggctacacgtcctcgccttcagaggactacacatcctcgccttcaggggactacacgtcctccccttcagaggactacacgtgctccccttcagagggctacacaccctcgcctttagagggctacacgtcctcaccttcaaagggctacacgccctcgccttcagaggactgcacgtcctcactttcagaggtttgcacatcatcgctttcagagggctccacatgtgcaccttcagagaacgcaaggtcctctgcccttaa

SEQ ID NO: 112400 - DNA, 987 bp, Glycine max
  Peptide Sequence Number=SeqID_229178
atggagacgaaggagaacggaccgagcaagaaggtttcgaatgggggaatagatggacccacgaacccgatggtcactcctctgctcaatgatctctaccaattcaccatggcttacgcttactggaaagctggcaagcatcaagaacgtgctgtgttcgatttgtattttcggaggaatccgtttggtggggagtataccgtcttcgctggcttggaagagtgcataaggttcatagctaatttcacgctcgctgaggaggagatcgattttgttagggaatgtttatcttcctcttgtgagttacaactgacaacttcctcgttttgttttatggtggtggatggattctttgactacctcagaggacttgactgctctgatgttgaggtgtatgctattcctgagggaacagttgtttttcccaaggttcccctgatgagagttgaaggtccagttgccgttgttcaattgctcgaaacaccttttgtgaatctaattaattatgcgtcattagtttctactaatgctgcaaggcatcgtaatgttgctggaaaatccaaaactctacttgagtttggattacgaagggctcaggggcctgatggtggagtaggagcatcaaagtactgctatattggtggatttgatgcaacaagcaatgttgcagcaggaaagttattcgggataccccttcgtggtactcattcccatgcctttgttagttcatacatgagccttgatgagattacagacaagtcacttcgcggaaaagatggttcaagtaggtgtgacgattttgttagtctggttcaaacgtggctgaacaaaattcaggtaattcctgagactgaaatggatatattgaaagctgaagctcaatgtagtaaagctctgcatgcttatgcctgtgtctttaatgcaaactttgatgtttctagcacacaacaatttgaagctcatgagtactggcacacatacgactga

SEQ ID NO: 112401 - DNA, 684 bp, Glycine max
  Peptide Sequence Number=SeqID_229179
atgtcttcatcttccatcataaagctagaactcatcaagtataagctcatatcttccctctctgcccaggttgttgaggtgaatgtcaaagttgaaaagccaggagacaataatgttcataacaatgcattttatgctgaagaaaaactgcttaaatcagaaatggaagcaatgcgtgattgtgaccctttatctgctcgtcactggattgttaggaacactaggactgtaaaccgaactgggcatctaactggttacaagctagtacctggctcaaattgtttacctttagctggctcagaggccaagtttttgagaagggcagctttcttgaaacacaacctttgggttactccttatgcacgcgatgaaatgcatcctggaggagagttccctaatcaaaatccacgtgttggagagggtttggctacttgggttaagcaaaatcgatcactggaggaagctgatatagttctttggtacgtatttggagtgacacacattcctagattggaagactggcctgttatgcccgtggaacgcattggtttcatgcttatgccgcatgggtttttcaattgctcgcctgctgttgatgttccaccaaaccaaagtgatttggatgacaaagagaatggcctgccagccaagcctattcagaatgggctaattgccaagctttga

SEQ ID NO: 112402 - DNA, 228 bp, Glycine max
  Peptide Sequence Number=SeqID_229180
atggtgaaggttctcggagaaggtggcgggagagaggaagaagaatgttttggtagagtggtagtatcagtgatagcatggagttattttgtgcctatgggtatacaatattccttagaccacacatgtctcgacaacatcctcaaatcattagatccatcacgcatgaacattgaagtagttagacacgcacttgggcaatgggcataccatccactggctatatga

SEQ ID NO: 112403 - DNA, 372 bp, Glycine max
  Peptide Sequence Number=SeqID_229181
atgttcgaaacatttcaatgggctaagaagttcccaaatgaatgttcaatggatgtcgtgtcggataagctcaaagtcgaggttaccaaaatgggacatcaagttttctttccttcccgtctccttgagcaatcaagcgatccaccaatggttcttaggcaacaatttcttgatggcgagtgtggttgggtgctgctgttggcactcgatcatcgcactgagggtttttggacaattgcggtgttgggtgtggtggttttggttctggtcttcatgatagtggtgaagggcatttacgtccgttatgccgaaatagcctacttggcaagctgtccatgtcccatagtccagacctctaaccccgtccaatag

SEQ ID NO: 112404 - DNA, 135 bp, Glycine max
  Peptide Sequence Number=SeqID_229182
atgttgattgtgcttgttctggttgtcaagcttgacgagagttacatgccgagcaaagtttccatccgtgccggtgatggttttcacaacttgaaggagattaagaccgtggaactcgtgaaggcaactaggtga

SEQ ID NO: 112405 - DNA, 1061 bp, Glycine max
  Peptide Sequence Number=SeqID_229183
atgcctttcacatattatgtctctctttcaaacaatactttgcatggcaacatcccctattccctctgcaatgcttcatatctacaagtgcttgatctttccattaataacatttctggaacaattccctcatgcttaatgatgatgatgaatggcactcttgaggcattaaatctgaagaacaacaatctctcaggccctattcctaatacagttcccgtttcttgtggtttgtggaatttaaatcttcgtggaaatcaattagatgggtcaattccaaagtctcttgcttattgctcaaagttagaggtattggaccttggatcaaatcaaatcacaggtggctttccatgcttcttaaaagaaatatccacgcttcgtgtcttggttttgaggaacaacaaatttcaaggttccctaaaatgtttgaaagccaataagacttgggagatgcttcaaatagtggacattgcttttaacaattttagtggcaagctgccaagaaaatatttcacaacctggaaaagaaatataacgggtaacaaagaggaagctgggtcaaagttcatagagaaacaaatttcatccggagatggtttatattatagagatagtatcacagttaccaataaaggtcaacaaatggagttggttaaaattttgacaattttcacatccattgatttctcttctaaccattttgatggacctataccacaggagttaatggattggaaagaactctatgtccttaatttgtcaaacaatgctttttctggtaaaatcccatcatccataggtaacatgagacaactagagtccttggacctttcacaaaactctctgagtggagaaattcccgtgcaacttgcaagtttgtcattcctttcatatttaaacctctccttcaatcatttggtggggaagatcccaacaagtacccaacttcaatcattttcagcttcttcttttgaaggcaatgatggactatacggtcctccattgactaaaaatccagatcataaagagcaagaggtgctgccacaacaagaatgtggaag

SEQ ID NO: 112406 - DNA, 417 bp, Glycine max
  Peptide Sequence Number=SeqID_229184
atgacccctactcatgatgcggttctgtattacaatggaaggtggaacatgccacgccaaaacaactttgtaggttacgcgttcataggaaaaaatctccaaaaatttgatattccaaaaggatgtaccataaatgaattgaaggatttgatcaagaaagtagcacctaaagggaatcctcctcatgagattcatgaatcccaacttgtaaggcatttgttttttcgacaacttgctcatttggagtattctgacaaagttttgaaatttgaaattattgaggtgaaatctgacgatgacgtgctgaaggtgttggtagagtccaattactggaaacaatttgtgccaatagaaattttggctctctttagtaaatcggttatggaaaatgaggacgaggtggttacgtcgttgtag

SEQ ID NO: 112407 - DNA, 525 bp, Glycine max
  Peptide Sequence Number=SeqID_229185
atgaaagaacggtcttccgtgagagtttgcggaagaacgttctttcgtcggatatattgcctgcttgaggaagaaggttcttccacggactctacggaagaaggttcttccgcgtgttcctgcggaagaagtgtctttcacgtacgcgcggaagaagcttacggccacgcggaagaacttcgtcttcaacctcgcgcaaaaaattcctcacaaatgtcatctaacctaaggctagcctacgctattcaaagagaaatgaggtcgaagccatcgataacggtagctagagaccacagtaaagagggatttggctgtgaagagggcgttgcgggcaacagtgagcgtgttcttgtcatggttcgtttcactatgcaaggtgaagaggcatcacaaggtggtggtggagagagggcgtgcatcggtgaagttgtaggggtcaaggaagggaaaggagagaagtgtgaactgtttgtgagtgtgaagggtcattttgtcattcaacataaaatgcaaactgttagctag

SEQ ID NO: 112408 - DNA, 651 bp, Glycine max
  Peptide Sequence Number=SeqID_229186
atggcattcttaggagaaacttcctctcagatgatcgtcaactcaagttctactccagtacccatgcgagtaccaaacatattcgatttttcaactcttaaaagcagaatacacaacacccttcagctaaacgatgatcaagttgtggatgaaattcattaccggcgaccactggaagatacaggtaacaaaattcacttccaatgtatgcaattgaaaaatgacatggatgtgaacacaatgttaatatgtaatgatcgattttcatgtgttggaccgattgagttgttatgcaccgttggtagaacactagatggaattttaaacttacttgaacgcactatgacccctactcatgatgcggttctgtattacaatggaaggtggaacatgccacgccaaaacaactttgtaggttacgcgttcataggaaaaaatctccaaaaatttgatattccaaaaggatgtaccataaatgaattgaaggatttgatcaagaaagtagcacctaaagggaatcctcctcatgagattcatgaatcccaacttgtaaggcatttgttttttcgacaacttgctcatttggagtattctgacaaagttttgaaatttgaaattattgaggtgaaatctgacgatgacgtgctgaag

SEQ ID NO: 112409 - DNA, 642 bp, Glycine max
  Peptide Sequence Number=SeqID_229187
gttttaggtgcacatgttagcacaaaagggagcaatgctgaaaatgttgtgaacccatcaggcaaatatatggatgagtggagctcacgttttggtcatggttctgtctatggattccttgagcctcagtcgatacacaaagcaaaggatcgacatgttgaatgtgaacattacatacaaacatgggtgaaggaatctcaacgagaggtgtacctaggaacttacttgaatcagaatgatgttgttgcctggttctgctcattacgtaagaagcttaatattcatatcaaagctacaattaacaatgcaatgaagacaataaagaccactgtggatggtaaaaatgatcaaggaactcctaagtggattaaagtaaagagccatgttcaaagcgggggctatgagtgtggctattatgtgatgcattggatgtggaacatagtaagcaggggtttaaagaatgattggagcatgtggtttgctgatgacacaacattagacatcgagacaataacaacaattcgcaagaaatgggcaacatattttgtaaaagttaaaaacatccgatgtagaaagcctaggaccaatgagagaagggtcattggaagggtcaactgtaggggtggtcctgcacttggttag

SEQ ID NO: 112410 - DNA, 1673 bp, Glycine max
  Peptide Sequence Number=SeqID_229188
ctcttcctgattttgataaagtgttccaagttgagtgcgatgctagcggaattggaataggggctgtgttgtctcaggagaagaaaccaattgctttctttagtgaaaagttgagtgaagctcgtcgaaaatggagtacttatgatcaagaattttatgctgtttttagagctcttcgccagtgggagcactacttgattcatagagaattcattttattcactgatcaccaggctctgaaatttctccatagtcagaaactgatcaacaagatgcatgctcggtgggttagttttctgcaaaagttcccttttatcattcaacataaatctggagcccttaacaaagtagctgatgctttgagtaggagggattcgttgcttgtcactttagcacaggaggtagtaggctttgaatgtctgaaggagttgtatgagaatgatgctgagttccaagaattatgggctaaatgccgtgagcatccttgtgacgattttcatgttcgtgaagggtttctttttaagggaaaccgactgtgcattccatgttcgtccttgagggagaaattaattagggatctacatggtggtggtctgagtgggcatatggggagagataaaaccattgctagtctggaagaaaggttttattggccacacctgcgaaaagatgctggaaccatagtcaagaagtgctatacttgccaagtttctaaaggccagtcacaaaatactggtctttacatgcctctacccattcctgatgacatttggcaggatttagctatggattttgtgttgggtctacctcgtacccagcgaggcgtggattccgtgtttgtggttgtagaccgattctccaagatgtcccattttattgcttgtaagaagacagctgatgcatccaacatagccaaactgtttttcagggaggttgtgcatcttcacggagttccaaaatccattacttcagacagggacaccaaattcctcagtcatttctggatcaccttatggaagttatttgatacatcactgaacaggagttctacagctcatccccaaactgatggacaaactgaggtcacaaacagaactctgggaaatatgattcgatgtgtttgtggtgacaaaccgaagcagtgggatttggctttgcctcaagttgagtttgcttataacagcactatgcattctgctactggaaaaacacctttctcacttgtttacacctctgttcctaggcacgtggttgatttgattaagctgcctaaggctcctggatttagtgtggctgctgaaaatatggctgaagagattatagctgtgaaagattctgtcaagtccaaattggaagctactggattgaaaaacaaaattgcggcagataaacgccaaagagtcaaagtgttcaatgtgggagatgaagtgatggtgtttctgcgaaaagaaagatttccagttggtacctacagcaagctgcagcctcgcaaatatggcccgttccaagtgactcgcaagatcaatgacaatgcttatgtcgtggcccttccagcatcaatgaacatttctaacactttcaatgtggcagatatatatgagtaccatgcagatgaagtcctttatcgagatgagaactcggggtcgagttcttttgaggtggaggagactgat

SEQ ID NO: 112411 - DNA, 342 bp, Glycine max
  Peptide Sequence Number=SeqID_229189
atggaaagggaagcaagagagagagtgaaagaatcattacacggggaagctgtgaaatggatggatagattcactctcactctaaatggaagtcaagagcttccaaggctgttagccagagccaaggcaatggcggatgtatacccggttctcgatgaagaagtgcaagagcagatgaaggctgacatggaggccatgaaggaccaaatgacctccatgatggaggccatgatgagtatgaggaggatgatggaggacaacgcggccgcagtggttgccgccagtgccaccgttgaggcggatccgactcacccatccggcataaaccaagcaagtcgtcca

SEQ ID NO: 112412 - DNA, 183 bp, Glycine max
  Peptide Sequence Number=SeqID_229190
atggagaattggcgaaaagcgctaggcaataacttcgtagggctccagactccgctatgcaataacttcgcggggctccagacttattggtggaggatgcatgaacagcacaaggcaatgacattcatgggactccgtaaaaaagtggagaatggagaattggcgaacagcgctatgctataa

SEQ ID NO: 112413 - DNA, 318 bp, Glycine max
  Peptide Sequence Number=SeqID_229191
atggcatctgggggctgggaaatcctagctattcttagcatgatattggggaatctcattgctattacccaaacaagcatgaaacgtatgcttgcgtattcgtccataggtcaaatcggatatgtaattattggaataattgttggagactcaaatggtggatatgcaagcatgataacttatatgctgttctttatccctttgaatctaggaacttttgcttgcattgtagtgggggggggctacgtaccggaactgataacattcgagattatgcaggattatacacgaaagatccttatttggctctctctttag

SEQ ID NO: 112414 - DNA, 582 bp, Glycine max
  Peptide Sequence Number=SeqID_229192
atggagggggtcatgtcgcaacatatcatgtcacgtgaggtgagggtggtcgcaaaaaggaggagggggaggggcataaaaagggggcaaaggatgcatttcattgggagattgaaggttcttgagggggagataaggttcgtgtgggatgaggtggacaaaggtggtggtaccaaagagagtatgaggatttatgatgttggcatgaagaagaaaggtgttgatgagtttcctttctgtgtgcatttggctgccaggattgcttgcaacaagtacatgacgaaattcgctggaaagggatgcattccacttgagagtcaggctgcatcacttccatccgctgggtacttgtgctacagtggctattggccaggtcctcctttctgtccgccgtatggactgcaacagccatcatgcacaagaggccctcatcgagctaagtttaagttccccggatgccaaaagattatatcagagtacaggattatgcctgatggtgtgaatgccaagcttcttgggtgccatggaccattggctaactgccaaccaggaagagcctttttgtctagggctactgcatag

SEQ ID NO: 112415 - DNA, 681 bp, Glycine max
  Peptide Sequence Number=SeqID_229193
atgaagaataagaaggttgaagcagttggtgtctcgttaagcgaggcttatgcgcttagtgagcaacatccgctaagcgaggcactcagctcgcttagcgggttgagagaatctggaagagaatctgtcattcatgcacgcgcccagcacgccatcagctcgctcagcaagtacccttctgcaggtgcatctgaggttgatatcgtggctaaagatcaacctaggagggctcggcttcccaacccttattacagctctttgcatggctcgaggggtagttccagacccctcacattcgagtccttgagtcccgctattaatttggcgtatatcaagaaaaattgctggaacccggatgatccttcgatcacatttccggggacccgcaaggctcgagctcgaggacctgagggccctttttcttctacttccttcactcctgcttcgacttcttcagttccagctcccattccagctccaagtattcataacttggctcagcattggcccatcattagcatggaggatttcatggctcagccagaggccgaggcccaaccggaggttacatcagaggctactccccagacttcacctgctacgacaccatttgtggaggtttctgaggaggaggaaggcgccgaggagactgactacgcaactaatatggcagcagcgtag

SEQ ID NO: 112416 - DNA, 2565 bp, Glycine max
  Peptide Sequence Number=SeqID_229194
atgcagctcactcacctgtgccttatcatgccctcagattatgataaactagagccacttcatgcaactccacaaacaaatattaaagggtcacaaaaaaaagttaagtccagaaaacaacaccctcaaggtgcatgttgtggaggccatgttgttgctacccttcttcatggttctttgactaggttgtgtgagacaaagtggtggaacaacctatgccaacatgggacaagaagaaaaaccaagcagatcaagagttcttgtgttgtgtttcatgacatggagggtgtgcaactatcttccatgattggaaaggacagcaacattaatcatccaaggattttcagctatgctgagctctacataggatcaaggggtttctctgaggaggaggttctaggaagtggagggtttggcaaagtgtacaaagctgttatgcctagtgatggaacagtggtggctgtgaagtgttgcttggcagggaaaggtggtcaatttgagaagacttttgctgcagaacttgcagcagtggcacaccttcgccacaagaaccttgtccccttgaggggttggtgtgtttttgaggatcaactctaccttgtgtatgattacatgcctaatttgagccttgaccgtgttctgtttcgaaagaacatgaaggaggagccactaggatgggtgaggcgtgggaagattgtgaagggtttggcatgtgcattgcactatttgcatgagcagttggagactcaaatcatccacagggatgtgaagaccagcaatgtgatgcttgattctcattacaatgctaggttgggggactttggcttggcaaggtggcttgagcatgagcttgagtatgagtatgagacaaggaaagaatcaacatcaagaaagtttgagcatttcagactgagtgagacaacaaggattggtggcacaattggttacttgccccctgagagcttccagagaaggagcattgctacctcaaaatctgatgtgttcagctttgggattgttgtgttggaggtggtttctggaagaagggctattgatctcacatactctgatgagaaaatcatcttgcttgattggatcagaaggcttagtgatgaaggaaggcttgttgctgctgtggacacaagggtaacagatggttcctacaaggtttttgaaatggagcatttgattcacataagcctcttgtgcacactccatgaccctcaattaaggccaagcatgaagtggattgtggaggcactttctgacgtgtcaaacaagttgccaacactcccttcatttcactgccatcctatgtacatctctttgtcttcctcttctgagactagtccaaacagcacaaaaggcactggcacaagctcaggaacagaaattgctactagcactagcaatcatactaattccaattccaaatttgtcacagccacaggagagactatatatgtaactgctgaagctgaacacagaaacagtggaactagctcttctaagagtagcaagagagtgatgcatcatcagccatcatttgttgaagcacctagggagataccatacaaggagattgtttcagccacgggtaacttctcagagtcccaaagggtggctgagcttgactttggaactgcataccatggcatccttgatggccactaccatgtcatggtgaaacgccttggcttgaagacatgccctgcattgcgccaaagattctccaatgagctaaggaacttggcaaaacttcgccacaggaatttggtgcagcttagagggtggtgcactgagcaaggagagatgcttgtggtgtatgattactcagctagcagatttcttagtcaccaacttcaccatcataacaatgctactaaaaatggtaattctgtcctcaaatggcatcataggtataacatagtgaaatcacttgcatctgctcttctctatctgcatgaggaatgggatgaacaagtcattcacaggaacataacctcttcagcagtgactcttgaacctgacatgaccccaagattaggtagttttgctctggctgagtttttgtcaaggaatgagcatggacatcatgtaatcaccaccaggagcaagtcggtttgcgggattttcggctacatgtcaccggaatatgtggaatccggagaggcaaccacagctgctgatgtttatagttttggtgttgtggtgcttgagattgtaagtggacttaaggctgtggattttaggcaacctgaggtgctattggtaaagaaggttcatgaatttgagatgagaaagagaccacttgaggaactagcagatataggactaaatggagagtacaattacaaggaactaatgagattggtaagcttaggagttgcatgcaccagttctgacccaaaattaagacctagtactaggaagatagtaagcattcttgatggcaatgacaaattaatcatgggggagaacatggagagcagggaagattggagagaaagaaatgcttgctctttgtcactggttaagagaatccaagctctaggaatacaatga

SEQ ID NO: 112417 - DNA, 5286 bp, Glycine max
  Peptide Sequence Number=SeqID_229195
atgtccttcaatcaatcaaagtcggagaagaacgacgcggtttatcgaaaaaccgggcgatccgccagcttcaatcagcagagaggaggctcctatggcaggggtggcggcggcggcggggccgcgccgtcgagcagttcactctcctttagccggagttttaacaagaagtctaataatgcacaaggtgggcaatctagggtaaaccccccagggcattcaacagagtccaatagtgcatctactgcccaaaccattaatggttcccatgtacagccacaattacatggagcatcagatgggccagctacaaagtcatctgaatcaccagctgctcataggagtgctggaattcttccaaaagctccaacttctctacaggcccccttgatttctgatccactccctccctcaagccctgctaagggagatgcgtctaaggcattcccttttcaatttggatccattactcctggctttgttaatgggatggctattcctgctcgtacaagttcagctcctcctaatttagatgagcagaagcgtgatcaggctcttcacgactcttacaaatctgtgccttcagtgccaattcctcctgttccaaagcagcagcaaccacctaggaaagatgctggcgtcactgagcaatctaatgcaggggacagttgggagaatcatctagggtttaaggcaaaaaaggatcctcatgtgtcagctttgaccccggcaagccagatgcctaagtcctctgttcctgtaactgggatttcaatgtcaactccatatcaccagtcacaggctcctttacagtttggcggtgctaatccacagattcaatctcagggtatgtcagcggcatcccaccagatgcctataccgatgcctttaccaattggcaatgctacacaggtgcaacagccagtttttgttccaggtcttcaacctcatccaatgcatcctcaggggatcaggcatcaaggccaaaacatgagttttgctcctcaaatgggtcatcagttgccccatcaattaggtagcatgggcattggtatcggccctccatatccccagcagcaaggaggaaaatttgctgctcctcgaaaaactactgtaaagataactcatcctgagacacacgaagagctgaggcttgataaaaggacagatgcatattcagatggtgggtcatctggtgctaggtcacatcctaacataccttctaagtcacctggtaaatcttttccggcttctcatcctgcgaactactattcttccagctcatacaataccaattctctctattatccacctagttctcttccattaacaagtaacccgatgtctcctaattctcagccaccaatatttaattttactgtgaatcatggtccgcaaggcgtgaatttcatgaattcatcatcacgtggttccccatctattaataaagctagcactccaacagaggatgcatctctgaccattaagccaagtggtacgtctgctattgtggactcatcattgtccaattccagtatttctgatgttcaaaatacagaatcccctagttcaacagcatcttgtgatgctagctcctctgtgctgcaaaaagggtctgaaacttgtttggaaatctttttacaacagcacaagttgtctagtgattctgtcccagttgtgtctaataatgaaggcaggagggaatctcttagtaggtccaactctttgaaggataagaaaccagggaagaaagatcaattatcacagcatcaggtttctgtacaatctcccacagcggataatatgccttctcatgctgttgaccatggtatatctgatactggagtttccaaacctgtaggaactaaaacaaaccattctgcggaaattaccactgaagaccttccaacatctaatacaatacctagtagcacttctactgctgaagtgaaaaccaatgggtctgcagaagtttctacttttgtatctggtgcacaaactgttgacagagtgcacaatagtaatcctgataagatagatgaattagctgaaggtaaacaactaaagcattatgatgaaagtgatgagccatcatctcctgaaggatacaaatcaaatatgtactttaatggaacagaaattaaactaactgaaaaagatgctgcaattgtaagcactgtcttaacaggaatactggatgaatctgcaagttataatgcaaaatgtgtaataggtgataatttagggacatgtactactaccacattgcattattctagggatgtctcttttagaacaaatgatagtgtagttactaatagatttgtttcaggaaaatttggcatatcagatctgcagtctgctgatcttccagagacaacatcaatgcatgtcaaggatgcctcagagaatactggcggtgagtcaggtaccaaggatagaccaactatagaaccaaataaggtgaaaactacatctaaagggaagaagaaaagaagagagatacttcagaaagcagatgctgctgggtcaacatctgatctttataatgcatacaagggacctgaggaaatgaaagaagctgtcttaagttctgagagcacagaaagtaccaccactttgaagcagttgccaaaagatgctgctcagtcagatgctttagcaagtgaaaagtgtggtcacagtaaagctgaactcgatgactgggaggatgctgctgacatgtctacccccaaactggaggttcatgataaatctcaacaagctggtgatggaagtggaagtacagccaaaaagtattcacgtgatttccttctgaaatttgcagagcagtgcatggatcttcctgaaggttttgaagtcaccacagacattgaatctttgatgagtgccaatattggtagttctcatgttttcgagcgtgattcacatcctagtcctggaagaattgtagatagaccaggtgggatgtctcggatggatcgccgtggggatgtggtaatggaggatgacagatggagtagagtttctggtgcttttcgttctggacgtggtttggatggcattggaggtaatgtgggattccgatctggccaaggaggcaattttggtgtcttaaggaaccctcgtgcacagacaccaccacaatatgttggagggatcctttctgggccaatgcaatcagtgggaaatcatggtggaagaaataatcctgatggggagaggtggcagcgttctgctagcttccagcagaggggtttaattccttctcctacccaaactcctttacagatgatgcacaaagctgagaataagtatgaggtgggtaaagcaacagatgtggaagaggtaaagcagaggcagttgaaggctatcttgaacaaactaactccgcagaattttgatagactttttgaacaggtgaaagcagttaatattgacaatgcagtcaccctcactggtgtcatctcacaaatctttgagaaggctctgatggaacctaccttttgtgaaatgtatgccaacttttgttttcatctggcttctgagttgcctgattttagtgaggacaatgaaaagataacctttaaaaggttattattaaacaagtgccaggaggaatttgagaggggtgaaagagaagaagaagaagcaaataaggctgatgagggtgaggttaagcagtctgctgaggaaagagaagaaagaagagttaaggctagaagacgcatgttgggaaacatcagattgattggagaactatacaagaagaaaatgttgacagagagaataatgcatgagtgtatcaagaagttactgggtcagtatcaggatccagatgaagaagacattgaagctttgtgcaagctgatgagtactattggggagatgattgaccatccaaaagccaaggtacatatggatgcatattttgaaaggatgaaattattgtcaaacaacatgaatttatcttctagggtgaggttcatgttgaaagattccattgatttgagaaagaataaatggcaacaaaggaggaaagtagaaggtccaaagaagattgaggaggtgcacagggatgccgctcaggagaggcaggcccaagctggtaggccaggtcgcggtcttggtaacaatcaatcagctagacggaatcccatggattttggtccaagaggatctatgctgtcttctcccaattctcaaatgggtggattgcgtggtcttcctactcaagttcgtgggtatggtgcttctcaggatgctcgatttgaggaacgacaatcttatgaggctaggaccttgtcggttcctttgcctcaaagacccttaggagatgattctataaacttggtaccccaaggtggtctcggtaggggaatgtctacgagaggatcaacagcaatttccaatttgccaatatctgatgtgcttcctgtccatggaaactctcatagaatgaatataggtcttaatggtcacagcaatttatcggagtgcacaccatatagctcaagggaggatcttgtttcaagatatggtaatgttaggtcttcagggccatctgcttatgatcaatcaagtgctccagagcgtaatgtaaaccatgataacagagactggaggagtgcagatcggaatcttgaacctcctgctcatttgcaagggtcaatggtctctcagaatgcttcttcagagaagatttggccagaagaacgactgagggacatgtccttgtcagcaataagagaatactacagtgctagagatgagaacgaacttgctttatgtgtcaaagatttgaactctccgagcttccatccttccttggtttctctctgggtcacggattcatttgagagaaaggatgcggaaagagatcttttggccaaactacttgtcaaccttgtgaaatctcagcatggaaccttgaatcaagttcagctcattaaagggtttgaatctgctctcagtacattggaggatgctgttaatgatgctcccagagcagcagagtttcttggccgaatttttgcaaaagccataacagagaatgtagtttctttgaaggagattgggcagttaatacatgatggtggagaggagccaggtagtctcttagaagttggacttgcagctgatgttcttggaagcactttggaggtaattcaaagcgagaagggggacgcggttctaaacgagatgcgttcagactctaacttgaggttggaaactttccggcaacctaatgctaaaacatcaaggaagttggaaaaatttatttag

SEQ ID NO: 112418 - DNA, 312 bp, Glycine max
  Peptide Sequence Number=SeqID_229196
atggtaggcacttatgtgccggtcgatggatcctttcgtggtgcatggtgttggtataaggtggccaataagctgaaatcagaaggtcacaatgtcacaaccgcatgtctgcttctgctatcaattaatccaaagcatatgcaagagagaaaaaaggtgattcttgttggtcacggtcttggtgggatatcagtatctgttgccatgggaaaataccctgaaaacatctctgttgcagtttgcatcactgcaactgttgtctctgaaaccgaaccacatcagattttcttcaagatgtacttttctcactag

SEQ ID NO: 112419 - DNA, 246 bp, Glycine max
  Peptide Sequence Number=SeqID_229197
atgtttgcacttgtccaagaatctcatctaaagaaatcagctactctagttgcaaaagagcgggctctgaccttgggacctcgccttcgcttccgctgcgacgagcacccaccatttgtggttcacgcaccaagcccaataagtgctgggcgtgaagggggtgtattgggaaaatacccaagtcccacatcggctgcctcaatccttggagtgcaacttatatacctgttgggcaacttcacttaa

SEQ ID NO: 112420 - DNA, 186 bp, Glycine max
  Peptide Sequence Number=SeqID_229198
atggtcagggtcactctgttttgtgagaatgctccaaccacatgggatcaacataggcttaaaggagcactcaaaccgagtgtctttatccccaaggccgaaactctgaagaatccgttagggcctcaccttcatgattcaggtccaatccctaaaacaatttttgcacggaaacactgctcatga

SEQ ID NO: 112421 - DNA, 224 bp, Glycine max
  Peptide Sequence Number=SeqID_229199
cttccatcccttactttgggttcattgatgaaatgtgggagcttaactatgtgaaatttactggatttacgctggtagacctaaagaaacttggttaccacaatgaccctttcatcatggcagaacaagctcgacaaggcaaaacaattggtgttaatgtagaagatgatgattcatacatggacacctatgttagtcctttgaccgcacaaatcactcctaac

SEQ ID NO: 112422 - DNA, 858 bp, Glycine max
  Peptide Sequence Number=SeqID_229200
atggttaagttaacgaatttttcaaggaaaatcaagtatttcctaggaattgaagtggcttattcaaaacaaggcattttcatttctcaaaggaattatgtgcttgatcttttgcaagaaacaagaaaactcggatgtaaacctgtaggtgttcccatcgagcaaaatcatgaaatgagcattgaagaggagagtgtcaaggttgacaaggcccaataccagagactagtggggaagctgatttacttggcgcacactagaccagatatagtatatgcaactagggttgggagacagttcatgcatgatccaaaggtgagacacttgcaggctgcaaatcgtgttctgcagtgcctcaaagatactccagggagaggacccttgttcaaaagaggtggaagcttaactattgaggcttatactaatgcagattacacaggttcaatgagtgatagaaggtccatttcaagcaattgcacattcttgtgcgggaaccttgtcacttggagaagtaagaagcaaagtgtagtggctcgatcaagtgtgagacaaaatttagatctatggcacaaggaatctataaagtatgagggtctcatgaagttgttttgcaacaataaatcaactttcaacattgcacataatcttgttcagcatgacaaggcaaaacactttgagatagatctacacttcattaaggagaagctggatagtgaatcgataacgacctatattccttcttggcaccaactagcaaatgtcttaagaaatggcttgccaacaaaacatttcagtcaacttacttggaagctgggaatgatagatattcattcactagattggggggtgatgttgtaa

SEQ ID NO: 112423 - DNA, 831 bp, Glycine max
  Peptide Sequence Number=SeqID_229201
atggatcgccggaaaagcaacgagacaacgaagtcgtcgacaacctcaaccgtggaattgccaccaccaatctcagcctcagaagcccttatagtcaacgcattatgcgcgcttggcttggccttcgccttctggattgcgaacactgtctactccatcgaactcgttactcatccttctctcacactcttcttcatctggattacagagctccccattgtgacccttctatacagtcgatatcgacaaaatcggaagcaatgcacgtacctgcgagctgttgggagaggggttctaggagtgcctgttggggcactactgaattttttaggagctattgctgtgggggcgcctgttacatttcagtatcttcccaagactgtaaattgggctcttatgatgtctgtgttcacaacaattccagcgtcatgtgttcttggttcatcgtgggctgactggcgacgtatatttgcacaaacaaagccaaaaggatctatagagtacctgatttgtttaccagcacatggagcagttattggagcatggtttggggcttggccaatgcctcttgactgggagaggccatggcaggaatggcccatttctgtgagctatgggaccgtagctggttacctggtggcattggttgcatcattgggctttgttcttgcttgtggacctgtttgtaggcaatggataatgaattatgatgacaaagggaaaattggtgctataaaactccaggctctcgccatgacatggtccagcatggggttgaatccattatggatctattgtagacagtattaccttgcatttgtaagaggctaa

SEQ ID NO: 112424 - DNA, 444 bp, Glycine max
  Peptide Sequence Number=SeqID_229202
atggtgcgagcttcccttttcaatttggagcatctagatatattacgggactctatcgaacatccagcttccgttttcaatttggagcttctcgatatactactggattcaatcggacatccttgtataaagttattgtcgtttgaatttgctacgagcatccatttcaatttggagcatctctatatattgtgggactcaatcggacatccgagtaaaaagttattatcgtttgaatttggtacgagctaccgttttcaatttggagcatctcgtttgaatttgctacaaccatccattttgaatttggagaatctcgatatattacgggactcaatagaacatccgagtataaagttattatcttttgaaattcctcagagcttgtgttctcaatttggagcgtctcgatatatgacggtactcaatcggacatctgagtaa

SEQ ID NO: 112425 - DNA, 324 bp, Glycine max
  Peptide Sequence Number=SeqID_229203
atggcactatgtttcatggatatggggtcatccattgacagaaattgtgttaaggctattgaaggtgtgcaacctgcaattcttgaaaatgctccagttaaagctccctccgagataagaaaatctgaatataaggaagatgggcttcctgttgatgtggattcaagcaccacaagaggagaaagaagaggtatgggatctttactagtgaagaaggaatttaatgaagatgaagctgaagaggaagttgaagcagcccccattgagttctgtgctccactacaagctgatgatattatcacagtagtggaaggctttatctga

SEQ ID NO: 112426 - DNA, 192 bp, Glycine max
  Peptide Sequence Number=SeqID_229204
atggaggccattagaccttcggaggatcaacttgttgcacaggtctatgtagagtcaaaggaaccattgatgcatgtggttgcccctgaaccaaggatcgccttctataagggtgtcgaggacacacttttccttcttgattttgttgtcttctgcgcagaaaacattgaaattgcatctcattctacatga

SEQ ID NO: 112427 - DNA, 603 bp, Glycine max
  Peptide Sequence Number=SeqID_229205
atgccgccggcgaagcgcaaagcggagggaactgctgcagctgccgcttcttctgcggcggctccgatgagagtcactcgtgctgcggcgaagcgcgccgccgcgagctccgaccctccgccggtgccggtggttaagaaggcggcgaagaaggccaaagttgctgctgctgctaagaagcagaaaaggaacgaaaaggaaaatgaagatgttccggttgagagcgagaacaaagcggaagaaaaagaagaaggaggagacgcctccgagaagaacgttctagacgcttccaacaagaccatcgtcgtcgaacactgcaagcaatgtaactccttcaagaccagggccaatctggtgaaggtcggccttgagaaggccgacattggaatcactgtgattttaaaccctgagaagggacctaataacgtgcacagggcactgccaatttggccaaggaaaggatgctttgaaatacggcaagaagggggtggcaagaagttcataactctcttggacttgaagcgtccatttaaaccaatgaaggatttggacatggacaaggtcatctcggacatcattgaggaaatatcaaagactagttga

SEQ ID NO: 112428 - DNA, 1080 bp, Glycine max
  Peptide Sequence Number=SeqID_229206
atgtcggaggtcaacatgagcttctctcactacatggatgatgaatatgagaaactcttccggagaatgaaccctcccagggttgtaatcgataatgaagcctgcaagaatgccaccgttatacgggttgatagtgcaaacaagcatggaatacttcttgaagttgtacaaatcctcactgatctaaacctcatcataactaaggcttacatttcttctgatggtggatggttcatggatgtttttaatgttactggccaagatggaaacaaggttactgatgaagctattttggattacattagaaagtctcttggtcccgaatcttgtgttacatctcctatgagatctgttggggttaagcaaacaacggaccacattgcaattgagcttatggggactgataggccagggctgctttcagaagtgagtgctgttctgaccaacctcaagtgcaatatagtgaatgcagaggtgtggactcacaacactcgtgctgctgctgtaatgcacgtgactgacgaagaatccggttcggccattactgatcctcagaggctttctataatcaaggagcttctatgcaatgttcttggtggtggcaacaagaagaggggggctaagactgttgtcacagatgaagccacacacactgagagaaggcttcaccaaatgatgtttgctgatagggattatgaacgagttaatgatgatgatgactttgatgagaagcaaaggccaaatgtgaatgttgtgaattggtctgacaaggattattctgtggttactattcagtgtaaggataggccaaagcttctcttcgacacagtttgtactttgacagacatgcagtatgtggtttttcatgcaaacatcgatgctgagggtccagaagcatatcaggaatactacatcaagcacatagatgggtcccctgtgaaatcagatgcagaaagacaaagagtgatacaatgtcttgcagctgcaattcaaagaagagtttctgagacttgcatatggtattcaattattcatggagtcaagcttgtgcatgtgaagcctttttttttgtctaggtag

SEQ ID NO: 112429 - DNA, 336 bp, Glycine max
  Peptide Sequence Number=SeqID_229207
atggcaactggacgggacagggcggggatgggtattgtctcctcgtctccgacctcgactccccaacatgtacctgtacccgtttctaatgcccgatgtacgggaatgagtatgggacgggtagtgacattctcgtccccgaccctgaccccgactaaaaaagtcaggcatggcacccgtgcggggcgggggtggggagtactccctcgctccccatctccgaaccttatcgtgcttcccgtccccgtccccgctccacgtggtgggggtattttttgtcccgtttccgttccctggctccccacggggacctgcggggatcccattttacattaa

SEQ ID NO: 112430 - DNA, 387 bp, Glycine max
  Peptide Sequence Number=SeqID_229208
atgacgccactggattcaatattcaaagacacgaaagagagtttgaaaagcgtgttaacaaaaataaggcttaacctaagaagtgggaagtcgacgtggcacgtggtgattgaggaaatgaaccttgaggccaagatggtgaaccagaacaggatgaggagcaacacccggttcgcatacttgggcatcgtggaaacgtggctgaaggtgttgggtttcgtgaaggtggactcggtggacctgcttccaccagatccacctccaatcactcacttggatctcaactttctagattcttctctaagcaagcttcatgatgttgaatcaagattgattcaaggagttttgatgataataaagatgatgacaaaaagtccaagagaatga

SEQ ID NO: 112431 - DNA, 302 bp, Glycine max
  Peptide Sequence Number=SeqID_229209
atggtggtgattgcgatgacggccatgacaattatgatggaaacggtcacgacggtggtgatcgtcatcataaccaccaccattatcgccgtcaccaccaccaccattgtgatcgtcgccatgaccatcgttgttgccaccaacataactatcaacatgttggtggcgacgatgatgatcatgacggtaatcatagtggtagtgatggtaatggcaacgacaataattatgttggtggtagcgacgatgattgacgagcatagtggtgattgcagtggtgaccatgacaattggtggaaacg

SEQ ID NO: 112432 - DNA, 369 bp, Glycine max
  Peptide Sequence Number=SeqID_229210
atgtacaaacctatcaaaagaaccataaattggggaaaagacatgattttcccaaagcttttcaacacaaaattttgcttgtcctcaagcaaagaaagaacagttcacttgtcctcaagtgacaagctcacagtggttattcaaaattgtgtttgtttccaagcattcaatcacatgacacaagtggcatacaatgcttcaaccaacaacttttcacaagatatgcagattttcaaagataggaacatgattattaagcaacacaagatatgcagatatcaaggaaggatcatccagccaaagcctcacggtcactgtttcactcaagcacaagtgtttaggctatttatcaatcaacaaccaacataa

SEQ ID NO: 112433 - DNA, 219 bp, Glycine max
  Peptide Sequence Number=SeqID_229211
atggaaaccatattgaaatgctttaagcagcttgatgtttgtggtaaagtacatttgaagtcaaagttgcaagaaattacttatcctgatatgaactctatgtgtcctcctccagaaaaggattctattgaaaacattattgatgtcaaagcggatgataattatggttatcgggcaatagctgcgttattgggtatgagtgaagaaacaggtcattag

SEQ ID NO: 112434 - DNA, 441 bp, Glycine max
  Peptide Sequence Number=SeqID_229212
atggcattttcagagtcactaggttacagtgaaaaccgaccaccccctcaagttagtactcagaaagctagacctacccggacaaatgtcaagctcccttctaccgaggactacaatgaaggctggtgggcattatatgtggacacagcctccaacaacaagggtagtggcataggcattattacccttgaagggcaagataacatctccattgagcagtctgtaaaattcgacttgaaggcttcaaacaaccaagtagagtacaaagctctcatcgctggcctgaagttagaatcaagatcgaaagagatagtccacgtcaacagaggacagaactaccgagtagatgcttttgccatcctaacgagcactaagagaccagtccaacatcagacattcatccaggagatccttaccacccccaccatcaatgttacctag

SEQ ID NO: 112435 - DNA, 510 bp, Glycine max
  Peptide Sequence Number=SeqID_229213
atggcaggggacgagggggttattaggaagcaaggacaacaatcccatagtgacaggcaacaacaaatcgaagccaagctagatcaagtcgacacctttgcaaaaggcggcggggggagaggcaaggttatgaataccattgtcggtggttttgctggcgatgtcgatcccgagcaagatgacccaatggggcatgtcctcatagacgatgacacctcttacaatgttctgataagcaaatcattgttgaatgctctaggcataatcgtttcaatgcctcatctcgcaatgaagttccccaaccataagggcaaaatagtcactatcaaagtggaccaggtgttgcaccaagctagaccgatcttgacccaaggaaagatgaggaagacaggaggcatacatcaaccgagtaattatctttattccaactgggcaaggcattgcaccaatgcacctggatgggggaaaaactcaacaaacaccttcaaaaaaggattgaagacatgttga

SEQ ID NO: 112436 - DNA, 546 bp, Glycine max
  Peptide Sequence Number=SeqID_229214
atgaccacccctgttgttgttaggggtgtagatgtagttggcaaaggcaccctcttatatcaattcttctatcttgtccttcaggaccatgcattcctctgttgtatggccgaagttttgatgatttgtcttggatgtacttcgttctatccttgttgtggtcttctttttcctgctctaccaatattggaaagcttattactcctccatttggatgtatcttgctgctcatgctcgaagctcgtccaagtccttgggttgcttctggcaaaggttgtcggcgaatggccccattttgagtgctatgatcatagaatgcaatccaacactagggtcaagactaaggaggagaaggagttgtcgcaacatgcccttcacgagcgagcgagggcgaggctcacgggtgcgctttccaaaggaggaaagatgcgcggagtcgccaccaacgaaggtattagcacctctcacgtcgacaaaagcggggcttttgctcctacgtaccctcatttggagaggaaatcagacctacgtagttctttcttaagc

SEQ ID NO: 112437 - DNA, 1270 bp, Glycine max
  Peptide Sequence Number=SeqID_229215
atgtccacgagcagagtcgacggcgcaaactcctggactcacaagctctggcacgactctcgtgctggttttgtgtcgaaaattcgcatcaatggaccgtacggtaccgggtttaacgacatcgaggacaagacgcaaatcgtcgccatcggcgccgggacgggcatcgtcccgatgctttcgttggcgaaagccaaggtgaacgagttctctcgaatgaatgctcaagcacgtttgaacgatttggccgccagagacgctaagaatcgcgagttcgcgcagaactacagcagagaatcgtacacgctgaaggatctcttgtacaaatcgctcggcctagagatgaaggcgtcgagcgagaagtgggagaatctcagcgttcaagctatacttttgaacaagcagtacacttggcgagaaaagaaattgcgagaagccggtgataacgccacgaaacgtcattacgagaagcttctcgcgaatagtatattgaacgaagtcgtggacctcacgcaaatcgccttcccactgatcgaattgctctccgtcgcgtttgtcatttcgttctcacaaaaccacgcactcgtcacccaagccatgcgagaactccctctgtggatgttctttgggtgtcactgctatttcttctgtcactggatgttgaccaaaatgaacacccctatttggtgggtcgatctcatcatcaacgccacgtccaccatggcgtttgccctctggtacaacatgattcgcgaggatcgtaagctgtggagtctctacatgatttgggtgttcggcgctctttcagcgtaccgaatcgctagaatatctagtgacgttctgttgacgggcactcccagctcgcgcaccgtgaacgcgtatctcgaacgaacgggcgacgcctcgagcgtgactgaaaagttcaccttcgtgttcatgacgccgcagtgcgacttttgcgaaatcctctggcctgacttggagtctcttcatcaaacgatcgccaagaattatggtgacgcagctggacgcgttttcgacattcaagtctactgcacctcgaaagactctgcagaaaacgaagcgttgcagaactacgtcaagggcactgcactcggcgccgctggcgcgcttcgcatggagcgccccgacttggacaaactcacgagccgtcccatcctcgatcaagtgctgaaagatcagttcacgggtgaaaacaaaccgtcgttcacggctaacctcgtcgctttttgcggcgggacgcagctcg

SEQ ID NO: 112438 - DNA, 781 bp, Glycine max
  Peptide Sequence Number=SeqID_229216
ttcaagaggtgaagaagttgatcgcgaagatcaaagagctgctcgatcaacccggtgggggcgattggagcgcaagaacaggctcaaggtgtacgagggattgtactcagccgcgacgcgagatttcgaaacggcgaccaagttgtttttggattcgttgagcaccttcacgtcgtacgaattgctgtcctacgacgatttcgtcttttacaccgtgatttgcgccgtcgtgacgcttccgcgcacggaactcaaggcgaaggtgattgattctccggaaattttgagcgtgttgaaccgcttgccgggtctcggtgactttttgaacgcgctccacaagtgcgactaccgcacctttatgagcgcatttccgatcgttgcgtcgtacgtcgaaaagtccgtgtgggtgaacccacactttcgttactttttgcgtgaagtgcgcgtcgtggcgtacgcgcagtatttgcaaagctacaagagcgtcaccgtcaagagcatggcggatagtttcaacagtcgacggggtgttgcaaacaaaccgcccggatttgaagaactctctctaccaaagtttgatcaaagacggggacgccctcttgaacaacgtgtccaaactcagtcgagtgatagatctttaggcgcggtcttaggaaccccgcgcgtcttagcgcgtgacacggatcgatatcataaaaacgttcgcattcaacgctcgctcggcgcatcgcagcgcgaatcgtccgcgtccgttcgcgcgcactacacgcgactcgattag

SEQ ID NO: 112439 - DNA, 251 bp, Glycine max
  Peptide Sequence Number=SeqID_229217
atgtcgcgatccatcgggtcgtttccagaacgcgcgcgatacgtcctgcgatacatctatcccggctcgacgcctcgaaacgggcgcgtcatcgacctgggcgagctcgacggcccgtcggcggcggggcttcccatcgaggcgacgatgatcgccgacggcgtggatcccgcgcgttggagcgtgcgcgtgttcgataactttctcgaaggctggcgcacgctcggcgacggcgccacgacggcgtgctg

SEQ ID NO: 112440 - DNA, 225 bp, Glycine max
  Peptide Sequence Number=SeqID_229218
atgacaagcacccttttgtgtctgtgtctgatgaaggcaagggtggtagaggcaatgaaagattcagaaaaccaacatagagaaaacacttcaactttcacctcatgtcatgcaccaacgagggtggatctagttcctcaaagaaattcactaccactgcaaacaagaggttttgttggggagatggggttgcttctatatgattggagtactgcttatgcttga

SEQ ID NO: 112441 - DNA, 681 bp, Glycine max
  Peptide Sequence Number=SeqID_229219
atgagcgacgatggattgacgcccgtggcgtcgccgtcggcgttgtttctcggcgaacgcgtgttgagtcccgacgtttccgcggcgcccaccgtcaccgtgcagggatctcgtccattcatgttggaggtgcaagctctgacgaacgaacgcgcggaatcgagtcaaggcgggatgacggcgccacccattcgcaccgccgtcggtttgcgtttcgagcgcatgcaattgttgctcgccgtcttggccaagtttgtcctcggccggcgagtgcaaaagcacgacatcttcatcaacatcgtcgggggcatgaaactcgacgatccgtccaccgacgtcgccatcgcgttggccatcgcgagcagtttcgtggagaagcctctgccgccggacatgtgcttctttggagaggtcggtctgggaggagagcttcgacccgtcatgcaggcggagcgacgcatcgccgaggcggcgacgatgggtttcaagcgtgtgctcttgcccgaagcgggaagttcgccggatatggggaaaaagacgggcatcgaactcgtgcggtgtaacacgctggcgcaggcattggaggcggcgctcgacgtcaagccgtctcgctcggcgatgaagacccaacccaacgggtcgtggccgagcaagtttccgaaacaaaaaaagttcggttga

SEQ ID NO: 112442 - DNA, 349 bp, Glycine max
  Peptide Sequence Number=SeqID_229220
gtcgactctagaggatcccacatctgaaccggaggacccgcaaccgccgacgcgcaagagagggcgcccgagaaaagagcccgaacccgaacccgagcttgagacggaggaggcgggcgaacagccggctaagcgcggacgaggacgcccgaaaaaagccaaggttgaagaggatccgagcactccgaagcccgcgccgagatcgcgcggacgaccgaggaaaaccgaggcgacgcccaagacgaatcctgcgctgaaaaagctcggcgattatctctcatccccgaacaaggaggcgccggccgccaggacgcggcgctcgacccgtaactctcgaagaggcgcatag

SEQ ID NO: 112443 - DNA, 375 bp, Glycine max
  Peptide Sequence Number=SeqID_229221
atggctaaggaggcggcgaggtcgacaatgattacacaatggtcctgtgattcaagcatggctgacgggagggggaagcaagagaatgtggtggtgtcatggttaggatttgtgagtgtgtgggtgtgggcacatactgctgggtctcgcgagagtgaaagggaaaagtgctttaaagcccgaaatgacaatcattcactttataaaaccgtcttagaatgtcaatcttctaagacgtttcagagtacatttgttgagattcatggcctctcttcctccagaggaaaagcatctatttccatggaaaagtaccctgagaaaatctatgttgttgttttccgcacgaccacttatgtctctcaaaatctcacttag

SEQ ID NO: 112444 - DNA, 939 bp, Glycine max
  Peptide Sequence Number=SeqID_229222
atgaccaaatctttggccaataggtcgttcttgaatcaaaggttgtacacgttcaagatgccatcgggtaaatcctttgaggatcacttggatgatttcaatacgatcattcttgatctggagaatattgaaatcaaggtggatgatgaggatcaagtgttgttgttgctgcttatatcattaccaagtcagcatgatagcttattagacatgctcatatatggtagggactcgctgtcattggatgagaacagagagaaggatcacaagaacaagaagggatcaagatcgaagtctcatgatggaaggaaaagaaggtgctttgtgtgtgggagtgaggagcatctcaagaaagattgcccatacataaggaaaaagaaggagggaaatcaaaagagtcagaatggtgatgcggacatggccatagaaggaggcacacatgtaaggctaaaggggagtcctgatggtcatgaaggggtccttagtgttcctgaaggggagattagtgcatggcttgcaagtctatggcataagagacttggtcacattagtgagggaggtctgagggaactcaaaaagcagaagttgattggaaaggagagtctagatgcattggagttttgtgagcactgcatctacgacaaggccaagaggttgaagtttcctgttgctgcacaccattcgaaggggactctggactacgtccataacaatctatgggggtctgtgactgttctttcacacagtggagcaaggtacttcctatccatcattgatgatttttcgaggaaggtatgggttttcatccttaagattaaggatgaagtctttgctaagttcaaagagtggaaggtgttggttgaaactcaaaccagcataaaggtcaagaagttgaggactgacaatggtttggagttttgttctaatgaatttaattag

SEQ ID NO: 112445 - DNA, 819 bp, Glycine max
  Peptide Sequence Number=SeqID_229223
atggatcagaggagctatgtagctaaggtgctgaagacgttcaacatgaatcagtccaaggcagtgttgacacccatggcccaacatttcaaattttctcatcagcattcacctcagacgaaggaagaagcaacatacatgaagaaggtgccatatgcgaatgcagtgggcagcatcatgtatttgatgatctgcccaaggcccaacctggcatatgctatgagtttagtcagtaggtacatgggaaaatcaaggaaggtacattgggaagctctaaagtggatcttcagatatcggaagggaatgtgcaaggcagaattgttgtatgctaagcatgaaagctcaatggacgatgtggttggatttgttgattcaaactatgttggatgcctcgacaccaaacgattgcttattgggtatatgtttaagttctgttgtaacactgtgagttggaagggtaacctacagcatgtggtttcactgtccataaatgaagctgaattcattgctctcgctgaggcgatcaaggaggctgtgtggatgaagggtatggcaatgagcgtgcatactaaggtgaaggatgctaaggtgtactatgacagccaaagtggcattcacttggccaagaaccaaacgtatcatgagaggacaaagcacattgatgttaagctacactttgtgagggaggttattgcaaatggggaagtagttgttgcgaagatccacactgaagacaatccaatgggcacattgattaaggcactaccaaggcctaagttcaaacattgtgtacagatcatgaaggttgaaagagcatga

SEQ ID NO: 112446 - DNA, 810 bp, Glycine max
  Peptide Sequence Number=SeqID_229224
atgcagggttcttcgccacaagccgtgaattctccttgtttggtgagccaacccaagtgtcaaccagtttggacaacgtcttcatggaccgaatgccgagcagcggtaccgccggctagtggcggtgtgcaaaccagacgcgtaacgtgttcctgccatgatacttgcgacgaaagtcagcgacctgttgatgttagaacatgcgagcatttcgatgagtcgctgcagaaggcggatgaagggttgccgcaagactggaacaagacaaagatcccacccattaaggatattcacgactatgtactatttgaacatcgtaccatggccgtgagcgcccgattcccggcctctgtgtccacgtgtcttgctgcctgtacatacaagccgagatgtcccggtgttgtgttttctggatttctcacaggcggcacgtgcggtctcattgccgtacatgcgctcaactacgtgccgtttcagcgcaccggtgaatctgggggttgcgggtgctcttcgtgtggtgcaaaggctgcgtcgtcgcacgtttttatgcgtcgagctttcttgatgtcatatcctcaacccttacttatccgagccatcgaggatcttggcaacagaactgaatggagttcggctcttggtgaagctgtcgtgctttccaacgaacgcctgacgagacttacctcaaacgttgcttcaaatgatccgatttggcggtggattcaagactcccttggtgctcaaggtgttccacttcgaaaatctctctactcgctcgctttaccactgcatccgaacgtcgtaccgcat

SEQ ID NO: 112447 - DNA, 114 bp, Glycine max
  Peptide Sequence Number=SeqID_229225
atgggagggcacaaaggagttcaacattatggtacgaacaacatcaagaagatgacggacaagaacgttgagataatataccattttcctgcaagaactcttgaaacaaattag

SEQ ID NO: 112448 - DNA, 582 bp, Glycine max
  Peptide Sequence Number=SeqID_229226
atgtttcaagctatcgtcacgtgggacggttcaacggtggctgatacgattttgagctttgccgacaacgtgaaagccaacgtcgattacagcgaattcaaaaaagacatcgcggcggcggtgaatcagttccaatcgtcaacgccgcgagccggcgagtgcatgggagcgattttcgaaactgtccagcgctatcatttgtgcctcgatcccaatgtcatgatcgccgtcgtcaccgtgatggtgttagaggggtggcaatggcgcttggatccgacggtgaacattttagattacttggacgacgtgttgaaagcgagcgcgcgcaaatacgctcgcttggcgattgccgattacgcactaaaagacatgtgggctccatttagcgagccaaacgttttttcgcccgaggctgcggatcccatgtgggcgttaacgcgcgagaggttcaacggcgccttgccgctcgaaaacgtagaacgtgccagcgcggatcgccgtcgtcaccgtgatggtgttagaggggtggcaatggcgcttggatccgagggtgaacattttagatcagggtttagggtttag

SEQ ID NO: 112449 - DNA, 831 bp, Glycine max
  Peptide Sequence Number=SeqID_229227
atgagcaccatacaagttgtgctgggaatggttttggtgttgttaatgcatgtcttcaatgttttggcgttaaggtcaagatcaccgagaggaaagcttcataggcaagggattcatggtccttcacctcacttctacttcggcaacattccagaaatgaagacccttttgcttcaagttcagtcagctccaaccactcaagttaaagataaagatcaacatgtttctctttctcacaaatggccttttactctctttcctcacattcaaaagtcccttatacttgttttctactgggactatacagtggctaatggtgacagatataaaaatggtgaaggaaatcatcatgtatacctctttggatttagggaagcctacttatttgtccaaagatctgggaccactcttgggccaaggcatattgtcagcaagtgggcaaatttggctcatcagaggaagataattgcccctgaactataccttgataaggtgaagaaagagttaaactcaaagatatcaaagctcataaaacatcaccagaaggaaactcatgagcatgatctcttgcaaatgatacttgagggagcaaagaattgcacgggtagtagtgatggcctcttatcaaattccatgtcacatgacaggtttgtgatagataactgcaaaaatatattatttgctggacatgagaccattgcaatcacagcatcatggtgcttaatgctgttagctgcacaccaagatcggcaagattgcgcccgtgctgtggtgcttgaagtttgtggaagaggtgctctagatgcaagtatgcgtagaagcttgaaaacg

SEQ ID NO: 112450 - DNA, 582 bp, Glycine max
  Peptide Sequence Number=SeqID_229228
atgatcaccgcaagcgatgctattttgagcgcgtgcgcgaagatgcgcatctcagcggatggagttaaacgcacgggtaagcctggcgggaacgatgacgaccgagtcgaagcgagggttctgcgagcggtggaagagattttacgcgccattccgagtgaattgaatgttgacgcaatcagagacgccaaatcgagcaacttgtctcccctcaacataaatttgattcaagagactcaaaggtacaatcaactgttacgctctgtgcacgaatggttgcgtcaactggatcgcggcattcgcggtctcgtcgtgatgtcgcgggatttggacgaactgtacgccgccgtcgcagagaaccgagtaccacagctctttttgcgcgcgtatccttcgctcaagtcgctgtccgcgtggacgtccgacttggtgactcgcattcgccagctcagcgattggtcgcaactcgagagcacgcagtatccagcgacgatttggctcgcgggatttacgtatccttcgtgcttcttgacgtccgtcttgcagatgacggcgcgcaaaaactttgttcccatcgactaa

SEQ ID NO: 112451 - DNA, 513 bp, Glycine max
  Peptide Sequence Number=SeqID_229229
atggagcggaagtgggagtcaatcgaagcttcacccaacaaagaagagggggacaagcccttaatgggccttactaaaaacaccaacactggaataaaacaagaggatgatggcaatatggcaggaaaagcaaatgggccagcaagcacgatgaaagcttattccaaagttcattccagaactagagggtgcggaaagcaaataggtcacatcaaagtagatgggccaattgatgagatatcaacaaaatcaaatagaaatgaccaaaaggtggtcataagcacatcaaatacttgtgataaatactcaccagtaacaagaggcaatggtctaaaggaagtggcagaatgggaagaacaggataagcgacagtatgcaccatgtgctctaccagatatcaaacgtaatgaaacatgtaatcaaagaaaaagtaacatcatattaggccatggctcaagatctgggagtaacatgcgggaaagaggaggaatcattgattattatgattcttaa

SEQ ID NO: 112452 - DNA, 756 bp, Glycine max
  Peptide Sequence Number=SeqID_229230
atggattcgccgggacgcgccgcgttcgggtctccggggatggagggtgagatgcgtcaactcagggagcaccaacagactcgagaggaaatgttgaaccgcgtgcacgcgctgaagagcgaacttcaggagtggaggtataagatggacgggcaggtgaagaattacaagggcgagttggcgtcgctcagagagacgctggcgagcgagacgacggcgttgaggaaagagttggaggagacgaacgagcgattgaagcgacaggcgatgacgacgagggatgaacaccattcgatctcgcagtcgccgggtgggcgagagtcgtatcgcgtcgacgacgagggttcggttggcgcgcgcgcgtcgccggttcgcggggtcggtcaacgtttgacttctttattccgcgacgacgggcgacgaggacgagggagttcgtcgatagtggtattgaacatgtggatgacgatcgatgaggcgttgaaacgcgtgcgttcgcatgccgacgtcctcggggcgggcgtcgcgacggcgaacggcgaactcattcgagcggcgggcgatttcgacgcgcgcgcggcgagacgcgcggttcgtctggtcgccgtcgccgcgcacgccgtcgaggacgcgtcggacgaggaggggtgcgactcgccgtcgagatcgatggagacggtgcgggcgagacgaggcgatcgcgaactcatcgtcacgcgatgcgggggcgtggtgctcgccgtgtcgacgcggtga

SEQ ID NO: 112453 - DNA, 444 bp, Glycine max
  Peptide Sequence Number=SeqID_229231
atggatgatatcatcatctatccagatcgtgtagacaactggacttggaaggaagattcaagtggtgtatacactgtgaggaatgtgtatacaatgcttattggcgactatatagacaaaaatcaggatggggctttcaatgtgttgtggaaagtaagggtcccaagcaaagtttccttttttagttggagattgttaagagatagaccgccaactacggaaaacttgcgtaagatacatgtggaaaccaatgatccaatgtgcccattctgcaaaagtttcgaagaagatgcaacatttctattttttagctgcaaaaaaattctgccactatggtgggaagctttgtcttggacaaacacatcaaaagcattttcccaatgtccaagacagcatttccttcatcatgcgcttggaaagacatttggtgtttggttccaatga

SEQ ID NO: 112454 - DNA, 1645 bp, Glycine max
  Peptide Sequence Number=SeqID_229232
ggttgtaaatgaaaaccgcaatttcaataccttgagagacatgcttgttgatagtgcttggattgacgaaattggaagggtgaaagaagagatatgttcgatcttcaaaaacatatttgaggaggtagattgggtgaggcccaaacttgatgaggttagatttcgggccattggtcatcacaacaatgttagattgacggagcgtatcagtgaaaaggaagtaaaggaagttgatgcaatcctaccccccaaggctctagcttctctaggaatcttctcaaggaagtttctcaaggaagcttctcaaggagcttctcaaggaagcttctcaaagaatcttttcaaggaagtttcccaagaaagcttctcaaggaagctctcaaggaagtttctcaaggaagctaccttggctataaatagaagtatgtgtaacacttgtgcatcatctccaagctttttatccaaggcactctcttggtggcgaagctccttcttccatggcttattccctagtggatggtgtctcctctcttctcttctcctttgtctttcgctgcatctcgatggtagaaaatcaccattgaaggacctcattgaagctcaaagatccagcctacatagaagccccacaagtaagcttccatcagaagttgtgtgggaatatggaagtgacaagactcctaggccagatggcattaatttcaaatttattaaagaattttgggaggcgcatgatccacaaaaccttaatgattttaggcctatctccttaataagatgcatatacaaaattgtggctaaggtactagcaaggaggatgaaggaggtgatgccattaattatagatgaaagacaaactgcattcatagagggtagacatttgttgcacaacaccctgattgccaatgaagatttcttattgtacatgttgaggaggatgggtttctgcgatagatgggtctcttggattaagggctgcctaaattcagcttctatctccatattggttaatggaagcccttcggccgaattcatcccacaaagagggttaagtcaaggagatccactatctcctctcttatttaatgttgttacggagggactaagtggcttgatgagagaagcatcggagaaaaagttgtttgaaggcttcccggttggtaggaatgaggcagaaataagtatcttacagtatgcagatgatacaatcttctttgggaaagcctctagggagaatgtcaaatcaatcaagaggtggaagaagtatgatgctacatttctaaattgtagtctattagccatacctcttctctacttgggtatccctattgggacaaacccaaggcgtactaaggatacaacagaggtttctgtggggtggaggattagagcaaaggaagattgcttgggtaaaataagagtcagtgtgcctatcaaaggagaaaggagggttggaaatcagggacctaaagaaaatatggtgaatggaggaattgggatgaagagagaaggggcaacattgaatcgtcatggtgtggagcaagggtgtgattctgggaggatgggtgaaaggatgatgcaacaacagtccattcaacagatgggaggtatcacaagggcaaggtgggagtggaatttccaatag

SEQ ID NO: 112455 - DNA, 871 bp, Glycine max
  Peptide Sequence Number=SeqID_229233
atggatgaaatattattcgacgaggtacgcacacaatattctaactggtgattttgacgagtcgccacagctgtactccgaaagtgtaagacccgaaggtagatcgcctcagcacaaaggctcacgtcaaaatatggtaccacccgcgcccgcacctccacctggcgctccgaaacaacaggaaactcgtctcatttacttgccggatggacgaatgaacacatacaacggacagccgccaaatgcgcgatacaatggtaaaggtcagcgtattcttccaggaggtggaggaggtgcacgcttcataccaccagacgagtacaaggaatttttacagcttggccacgggggtatattcgacctagatttggataatatagatgcaatcaggagggctcgtctcgagcagcacctgcagaacaaaatagaggcatatgcggtggattcagtagacactcctgtcatagattccgacctcccattagaagtaagaatggcgattggtagtgtggactctgcttcggttcaggatgtaccaatagcaccgagttatggacatcaaccgaagcaacatgaggttccatgctcaactttttcatcacaacagatagcaaaagttctaaattcggatagacctggaactacacacggacaccctagtggtgatcgagtcaacgacttgagcgatcaaacgactgtttcagataaaaataaagtcataactgagtttgatggcttgcaagtgaaagtggaagcacttcagcaagagtataagagtgccatggaaagtgggcagatgacacctgagaagaacttccaactgcagcagcaaatgctgcaactaaagagacgaatgatgaaatttgcatga

SEQ ID NO: 112456 - DNA, 537 bp, Glycine max
  Peptide Sequence Number=SeqID_229234
atggagaatctttgtgttcgttttaacgacaagaactatgctgcttgggagtttaagttcaagatgttcatgaaagggaaaggcatgtggggaaatgtcaataggtcctcctctaaacccacaaccatggctgagttggctgcttgggagacgcaagatgcccagattatttcttggcttttggggtccattgagcctttaatggaatattattttggtttcctgaacttatgggttgaacattctgctatactttatgctattgttccgagaacttctttggttgttgttcaagaggtttatgaggtcactaaacgggaccaattcctcatgaagcttagacctgaatttgaagttgtacgtgttgctctcttaaatcggcacccacttccctctctggatgtatgtgttggcgaactgcttcgggaagaacaacatcttctcactcaagtagctctatcgcatgactcttctatttcgaaagctattgttgttgcctatactgcccgggataatggcaaaggtcgtgatacatga

SEQ ID NO: 112457 - DNA, 306 bp, Glycine max
  Peptide Sequence Number=SeqID_229235
atggatgaacagatatcaagagcaaaagaaaaggcttctagtaggaaggctatcatggagaaagtggagaagtggatgttagcatgtaatgaagagcattggctagaagaatatagcaggaggagctcacaaaaacttgagacgtgtcgaatgtgcccgcataatggtcagcaaaatgccagcaaacacactaagcttacaaacaattcacaaaaccttcttctgctccttagtcagagaaccattcgggaagaaggcacgtcaatccctattcacattttcaatcccccaataagacaattgtga

SEQ ID NO: 112458 - DNA, 888 bp, Glycine max
  Peptide Sequence Number=SeqID_229236
atgaagttttgcaactattgtaagcaacatggccatatcatcatggactgtcccactaaaccaccacggcttcaggtgcaagcttttcatgtagctaattctatgagtgagacacccacttctatcccaaccaatgttgatgccttaactctagagaaggtgcagcaaatggtgctttctgcattatctaccttaggcatccaggcctccaatcatatgactggtgccttggaacatttaaacaatattcacacttataatggcactcaaaacattcagattgctgatggtaatactctttcaatcacggctgttggtgatattactccttcctttcgtgatgtctctcctagacttgtttctaatttaattttggatgacgtgtcggggaaggtgatcgcgacggggcctaaagtgggcagattatttccattctggtttactctacctagacttttgtcttttaattatactggtgtcccaaataagtatgaggattggcacaaaaagtcgggtcacccaaattcagttgttttgtctcatttactgaaaaatggattcttaatcaataaaattaccattcctggttcatcctttaactgtcctgtatgcaaacttgttaaaagcaaaaccctcccatttccttctaatgctcattgtgctgacaaatgtttcgacattattcatagtgatgtttggggtatatcgcctatcttatcacatgccaagtacaaacattttatggaagctcaatgttccacctcgtgtgaaggtgaatttatgcaaaaactcatccatgagttgcaatgctactttggaggcgcagaaaccattaactatgagaggatacatataaggtgtactaggatatctctcaattttgcataa

SEQ ID NO: 112459 - DNA, 270 bp, Glycine max
  Peptide Sequence Number=SeqID_229237
atggtaatcaatttgttgtcactctcatctgcagaagtaacagatccgggaagtcttactctagaaatagtccagcagcctacaacgttttacaagactgaagctgaagtaaagagattggatcaactaaaagcaagcaagatgaaggagctattccagaagaagcaggaggaactgaaattgatatgcaagaaatcacatgtggagattccttcaagggaagagatgaagaatataattaacctcataaactcaggtgaatctaactaa

SEQ ID NO: 112460 - DNA, 306 bp, Glycine max
  Peptide Sequence Number=SeqID_229238
atggtggcccaagcccgggctgttgatatcgctcgtggagacgtcatcatcgcgattgtggatggcagcgcgcgcccttggcgtgctcggctcctgcgcgctcctggcgtcggcctgtgggctccccattcggccgtcttgaaacacggaccaaggagtctgacatgtgtgcgagtcaacgggcgagtaaacccctgggttacggtgcccaactgcgcgcctaacctagaccccacaaagggtgttggtcgattaagacagcaggacggtggtcatggaagtcgaaatccgctaaggagtgtgtaa

SEQ ID NO: 112461 - DNA, 439 bp, Glycine max
  Peptide Sequence Number=SeqID_229239
gatcccacccacagattacagagagattgaggctaccttatgcataccaggccgagggttcatcttgaacgctgagggccatcctgggaggatactcaggaaagatttgactactttagcccaggtgtggagtgttctctcatactccaacttggcccccacatcacatacctctaatctaacagtggacagagctaggctgatctttagcctagtctctcgcatggacatgaatataggagctcttatgaaaggatctgactcttcacaattgaatttgaattccaacgttcagatgcactggatgttgtcaccagaggttcgcctaataggggagagttcaaatgacaatcctgctcatctccatggtgattctaacatcactagtgaccaagtctccagcgttcacattggtaatgtcgttgctagtggtgtcatg

SEQ ID NO: 112462 - DNA, 1098 bp, Glycine max
  Peptide Sequence Number=SeqID_229240
atgtgctcattgcaaacgcgttggtcacacagaggatgtttgttataccaaatttgttaccctccagggcatccgaaatacctagggcaacctcgtcttccctacaaatcttcttccggtggcggagcttctggtggtagagccgtcaacgatgtcgtcgccacacttgggaatgaggctcacacactacctcacattagagatgacaagcaggatctaaacacgttgaagacgattggtttggctagattgaaggaaggactattccatttgctaatcggaaaagataggtcaccatccacaaacaacattactaccaacaccatcaatgattcaaagctttggcattttagattaggacatttatctagaaatcgtctcaatgattatgtgattttggatgttaatgcaaaagagattgtcatttctagagatgtcatatttcatgaactaattttaccttttcacatcactcctatcaatccaaaccaacattcacctcctcttcctaataattccatcactgacttactaaataaaccaccctcaccttccataccagccaacacaccttatgttccctttgagaccacatccctttcatcacctttaccaaattcactcagtagccatgtttctaatcctccattcaacgagcctttccttcactcaccatcaaccacgtctcctccttcctcaaatgaatcaccaatctcccatcaacctccttctcctcgccggtcaactcacgagacccatcctccttcctatctttccgattatcaatacaaacttccttcaatcaagtcagctcaactctcttccacttgctcatatcctatccaagcttgtctctcttatgctcgaatttctccatctcatcatcactacctcatggctctctcatctgatgaagaaccaaccagcttccacgaagccagtaagcatcagtgctggagggatgcaatgcaatgcgaaattgaggccttgcagtcaaatcatacttgggatgttgttcccactcccccatatgttcatctaattggttgcaagtgggtctataaaatcaagcggttacctgacggtagtgtcgaataa

SEQ ID NO: 112463 - DNA, 1212 bp, Glycine max
  Peptide Sequence Number=SeqID_229241
atgtctctaaaaatagcagcagaagtttatccaaaatcaccatcagagacagggatggagcctttggtgttagtaaaggaatatgaagaagatagacacaaggtggcagtagagaaacttgagaggctttgtgaagttgggcagagtggaaagccttctcttgtcactgacctcatgggagaccccatatgccgtatccgtcactttcaattgcatgccatgctagttgcagaatatggagaagaaggagaagttgttggggtgataagggggtgtgtaaaaacagttacaagagggaattcggtttatgtagaactagcctatatcttggggctcagagtctcccctcggcacaggagatttggcattggcacaaaactagttgaacatttagaagagtggtgcaagcaaaaagggtctaagtatgcatatatggcaactgattgtaccaatgaaccatccgtgaatttgttcacaaaaaaatgtggttactcaaagttcaggactctaaccatactagtgcaacctgtgcatgctcactacaagccaattagctccaatgttgctgtgcttcgccttccgccacgcctagccgggtccatgtataaccatatgtttgccaattcagaattttaccctaaggacatagagttaatcttgtcaaacaagctgaatttgggaactttcatggccatcccaaagaagtacttatcgaaatgtgatccaaaaaggggcattctgcctccaagctatgcaatattgagtgtgtggaacaccaaagatgtgttcaagttgcaagtgaagggtgtgtcaccatgggcacatgcttgttgcgtaggtacaaggttgttggatgaatggatgccatggctaaggctaccttcatttcctgatgtttttaggccatttggggtttattttctctatggactacacatggagggaaagtgtggtgcacaactaatgaagtccctgtgtggatttgtgcacaacatggctagagatgatggtggttgtggggccattgtggctgaactgggccaaagggacccagttagagacgcagtcccacattggagaaagttctcatgggcagaggacatgtggtgcattaagaatcttgaggacactaagaaggatatccaagaatctgattggttcacttctagatcctcttcgccagtgatatttgttgatcctcgagatttttga

SEQ ID NO: 112464 - DNA, 3399 bp, Glycine max
  Peptide Sequence Number=SeqID_229242
atggtgatggccatggccatttcatctccttcttacaacctcactttccttcttcctcgctcaggctcacttcaacctctttctttaactccgccatcttgttctttttttgctcaacctctccgaaacctttcactcaagttctgtgcaaaaattcagagcgttggagttggaagagaaggtccagcttccgatcccaaggccggcgtctcactttacaaacctaaatcctacgaagttctcgttagcgatgccgccaattccctctcttatgctcttcaagacggaaaacttcgcctcgaaatcgatttcccgcctttgcccagcaacatttcttcttataagggatcttcagatgagttcattgatgccaacattcaacttgccttggctgttgtacgaaagctcaaggaaaagaaggaaaccagagcttgcatagtattccctgataaaccagaaaagcgccgggcctgtcaattgttcaaagcagctctagattcaattgatggcattaccataggttccttagatgatgtccctactggacctatgacttcatttttcagatctgtcaggaacacccttgattttgatttcgaagatgacaatgaaggtcgttggcaatctagtgaacctccatcactctacatattcattaactgcagtacacgtgaacttgcatatatagagaagtatgtggaaaaatttgccacatcaacaccaacacttttatttaatcttgaactagacacactacgtgctgatttaggcctcccgggcttcccagccaaagatttgcactaccgctttctttctcaattcactccagtgttctacatccgaatcagagagtattcaaagacagttgcaatagcaccttatattgtcaattacagtggagctgtattccgccagtacccaggcgtgggaggttcaagaccaatctctcctgacatggcttcaattgaccttgtcgaagtccgttctattgcgctcctcaatgcgactcactcctacgaggtgtgggagacgattcatgagtacttccaactgcagacgaaggttcgtgtgcatcaactttgcactgaccttcgctcggttcaacttgatggaaaatccatgtgcaagtacctttcgcagatcaagagcatagcagatgaactcgccgacattggctgtacggtgaagcacgaggagtatgttgatgtgattctcatcaatcttctgcaagaatacatgccggtcattgctgttattgaaggaaatttcaaaatgcctccgtcgtggtggctatggagcggtggtgtctcggaacgtggtggtgcctctgatcgcggtggtcatcgtggcggtgctcctggccatggtcgcggtggtcgctttgcaaactctcagtgccaaatctgtttaaaatttggtcatactgctaatgtttgccatttgagagctgataaatcctatcaaccaccagattctatgatgtatgatccaacaacacagcaacccgtcaatttcaaaagttccaatacttggacgaatccttacaaatctgctgctcctagtgctatgattactgattccacctctcaaggtgcttctgctgaagccgacactacttggatccaagactcaggtgccttgaatcatgttaccggtgcagttcaaaacatcactcggttttcacactttgatggtcctgaccagatctacattggtaatggtcaaggtttgcaaattaagggttctggttcttcatctttcatctctccctttaattctcaagtttcctttaaacttaataatttactccatgttcctgccattactaaaaacctgttgagtgtgagtcagtttgctaaaggcaattcagtatactttgagtttcatcctcgcttgtgtcttgtcaaatctcaggagactcgtgaaattttgcttcaaggtgctgttggatccaatggtctctattcctttcctcatctaaggctgcacaattcttctgtttctgctgtttccccttgtaagaataaggctcatgtacaatctgtccctgtacattccttggctactgtcacctcggttgatgttccagctcctgctgttttgtcttctagttctagtactctttggcacactaggctaggccttccaaatttacatgtattgaagcttgttctcaatcaatgcttatggggtccctctcatgtgatttcctttcctggatgcaccaaccttgacccaagagggccactcacagacctacgtacctgctggactacgtgcatgaataggacaaaagctgttagtagtgctaatgataattaccttgatctcgaactcagggaaagtagcgctatcactctcacagtgtttcaacacttcaagtctatggttgaacttcaacttaatcataagataaaaagtgtacaatctgacggggcaggggaatttagaccttttacatcctttttagcctctcatggcattacccacagacttatatgcccacacactcatcatcaaaatgggactgttgagaggaagcatagacatattgtcgaaagtagtctcactttgttgcatcatgcttctttaccaccaaaattttgggactttgcctttatgactgcagtttaccttattaataggttacctagtgctgcactcaattttgatattccttatctcaagagtgtctatttcttggctactctcagtcttgcaagggttataagtgtctttctgcttctggcagaatttacatctccaaggatgttatttttaatgcacaaagtcattgaatcccctactaattctgtcactcattctgcatctcagtcctctcatactgcagctactgagtctgtttcctctgagtcttcttctcagtcctcacctcaaccaaatgttcctgttgcttcccctagttcaaacactggttcaggtcagtcttctgctgctcagagttctggttcaggcctgtcctctgatgcccagggctctgattcaggtcactcctctgcttctccgaattctggttcaattttcaacagttcagcaaaggatattcccagaattgtcaatgatcaccctatgcaaaccagatcaaagtctggattcccaatcctagacttcacccttctctttttctggtgcacagtttttcgtgttaaagagaatgctgatggatctataaacaagtacaaggctcggttagttgccaagggctttcaccaggttcatggttttgattttcatgaaaccttctcccctgttgttaagcctatcactgtcagaatcattctcactttagcactcactaatgcatgggatttgtttcaacttgatgtgaacaatgccttgttaaatggcttgttggaagaaactgtttatatggtgtag

SEQ ID NO: 112465 - DNA, 633 bp, Glycine max
  Peptide Sequence Number=SeqID_229243
atgtgtgatgctgactgggcttctgatgtggatgacagacactctacctctggctcttctatttttcttgtacctaatctgatatcttggtggtctagaaagcagcaagttactgcatggtcaagtacagaggctgaatacagggctattgctcaaactacagctgaattgacatgggttcatgctttattaaaggaactgcatgaccctttctctcctcctaccttgctgtgtgacaacaagagtgctgtaactattgctcacaatcctgtttttcacagccgtactaaacacatggaaattgatgtgttttttgttcgtgagaaggtgttggctaaactacttcagatttaccacattcctgcctttgatcagtgggcagatatcttgaccaagcctctctctccatccagatttgaggtgatgcttaaacaagcagatggttcttatgcttgcatagcagaaagtgcaaaccgcttcagccttggcgaggccaaagaggaattgttgagggtcttgggacttcaagaagaagagggaagttccctagaatttcttcgaagaggctacaaggcaagcacgtggtgggaagaagattttgattcagaagtatcttctgcatggcggagttga

SEQ ID NO: 112466 - DNA, 390 bp, Glycine max
  Peptide Sequence Number=SeqID_229244
atgtctggaggtaagagagccttttgtgtaaggctattcatgtccgaatctggagagaagaaactgagcataagttggtacggtgaaaggaaggttaaacgaatgaatatttctcctaacacatcatctaataaattatttatattgctcaacgaccaagggtacttcacatatgagaaggaagaacgggatcaatggaaggattatgtggacaatcctatgagactatcaactctaaccaataagcagagaactcggattaaggctgttgtgaagtctctcactggttctggagccggttgtgctactagtcttagagaaggcaatagatgtgctggtgccttagccaattttgcttgtgacatgaagttggagttcatgcgtttgtag

SEQ ID NO: 112467 - DNA, 1842 bp, Glycine max
  Peptide Sequence Number=SeqID_229245
atgtcaaatagaaagtatgaatctagttataaaaaattgaagaaaaaacgaaaagttgaaaagctaattgaatctcaacgtggtgcccttgataaattttttattattcataaaaatgacgtaaaagcaagttcaatagatgaaaatgtgacagaacaaccattgatagatcatactgacaatgaggaaaatgttatagaacaaccacctatagataatactgacaacggtgtagaacaaccacctagagatgatactgacaatgatgaaaacgtgatagaacaaccacctataatggaaaacgggtttgcattggctttagaatccacagaaaaaatggctatcgaaatggatatagagtcaaaatttcgtgaaaaacgctcaaaaatcgcttcattgacaagttcaaaaaatgattcaactccagcacatgttaatcttgatgacaatgacaagctacttggtggactgttaacctctggatttgatgaagaatcgtgcataagtaggattcagtcccacttgtaccgcaaagcttctcctcacaaaccttctccatatttgatatctaaactacgtaactacgaagaaattcatacaaggtgtggacctaatactagagcttatcacagaagcatgacaatgattgaacactcaaagaacaaaggtgctgctacattgtgtaagtaccttatctggacacctgctaatggtttgggtaaccaaatgattaacctggctgcaacatttctttatgccatcctcactgatcgagtgctacttgtagaatttgggaaagacaagcatggcctattttgcgagccatttctcaattcaacttggatattgcctcgtaagtctcctttctggaatgaaaagcatatagagacatatcagatcttgctagagaaggatagggctagcaattcaacggaggatttaccatcagttctgtttattaacctacaacacacacgtagtgaccctgagaaatattttcactgtggccatagtcaagatctgctccagaagattcctttgttgactttgcagtctgatcaatactttgtgccctctctgttcatgaacccatttttcaaccaggaggttaccaaaatgtttccagagaaagaaacagttttccaccatttgggtcgctacctttttcacccttcaaacgaggcatggaaactgatcagcgattactatgaggcacacttggccaaggcagataaacagataggcttacagattagagtatttagtcctgtttctactccacagcaagcagtcatggatctagttttaagctgcacattgaagcataagatactgccacaagtggatttgcaaacttctgctggaaaaaaccagactactgtaaaagcagttcttgtggcatctttatatcgagagtatggagataatctaaagaggatgtatcggaagaatccaacacttagtggggaagtgataaaagtttatcagccaagccatgaagagcatcaaaagtataatgataataagcataatatgaaagcttggatagacatgtatctgctaagtttatctgacgagttggtgactacctctctctctacttttggctacgttgctcagggattggggaatttgaaaccgtggcttctttacaagctagtcaataacgagacccattttccaccatgtgaacgagatttctcatcggagccttgttaccattttcctcccaagcattactgcaacggagagcccctcaaagatattgtttcttctttcccctatttgaggccgtgcaaggattttagggttggtttgaagatggtcaaagattctatatag

SEQ ID NO: 112468 - DNA, 510 bp, Glycine max
  Peptide Sequence Number=SeqID_229246
atgaattgtgtggatggttttgcttttgctcctcattggatgcttagtttcgcatttggaggtaccattgattaccctgaagatgctgatgccatgaatataatgagctttggataccttgggtgctctggtgagactttgaggattgctgatattgacaataatgatttgagagtgtgcgaactggtgttccctggtacatggcatttggtgcatatgatcaatctcatggaacatcttcccaccaggttttgcagtaattattataagcgcgtaggggagtttcatccctatgatgaggacattgtttatttgcattcctatgttgatgggatttacactgcaaacctggggactaacaaagttgtgcctatttctggttatgacaaatttgatattagtccctttcaattagagctctctccgattccattcaaagacaatgattttagttcaagaaagacacataaaaacacaccaagtgatacctctgcaccgcaaacctattag

SEQ ID NO: 112469 - DNA, 201 bp, Glycine max
  Peptide Sequence Number=SeqID_229247
atgggtataatcaggagttgcttctctttcattgcagggacggtctttgggatttacgtggctcaaagttatcaagttcctgacgtcaagaaggaagctgacactgccttgttacaggcaaagcaagttgaggaaaaatatcgcaagtccaacccggggagtgttatgcccggagtgacaattaacaattgttattgttaa

SEQ ID NO: 112470 - DNA, 747 bp, Glycine max
  Peptide Sequence Number=SeqID_229248
atggctgcaacatttctttatgccatcctcactgatcgagtgctgcttgtaaaatttgataaagacaagcatggcctattttgcgagccatttctcaattcaacttggatattgcctgagaagtctcctttctggaatgaaaagcatatagaaacgtatcacatcttgctagagaaggatggtgccagcaatttaaaggagggtttaccatcagttctgtttattaatctacaacacaccctcagtgaacctgagaaatattttcactgtgaccatagtcaagatcttcttcggaaagttcctttgatgattttgcagtctgatcaatactttgtcccttctctgttcatgaacccgtttttcaacttggaggttaccaaaatgttccctgagaaagacacagttttccaccatttgggtcgctacctttttcagccttcaaacgaggcatgggaactaatcagtagctactatgaggcacacttggccaaagcagatgagcgaataggcttacagattagagtctttaatgctatttccactccacaagaaacagttatggatctagttttaagttgcacattaaagcataagatactaacagaagttgaattgcaaagttcagcatcttctgctagaaaaaaccagactactgtaaaagcagttcttgtggcatctttatatcgagagtatggagataatctacggaggatgtatcggaagaatccaacagttatggggaagtga

SEQ ID NO: 112471 - DNA, 300 bp, Glycine max
  Peptide Sequence Number=SeqID_229249
atggactgccccctgtgtaagctctgtagcatggagtgcagcatctgtggtgtaaatgaaaaatctgaaagtcctgcagataaaggaactagaagtggtatctgtgtagatgctagaggaatagctggagtcggaatgggaggtactggggttgtggaagaagaaggagctgttgtctttggtgttgctgaagtagtggggacctatgttctcttacccctggccttccttgaccctctaaatgtcactgttggatcatcaagattccaacagttcttcttaatatatgtcaagttaatg

SEQ ID NO: 112472 - DNA, 270 bp, Glycine max
  Peptide Sequence Number=SeqID_229250
atgagcttgatgcacaggtggcctggccaggagcctagccttctccttttggagggggtagggcctccgcagcccagtagcctgaaccagagcaggcagcaacagcagcagcagagggggaggatgagctcacccctcccgagtccttttattttgatgcaggtgtacacatggctcaggaggaggagacttccacaaactagatcccagagcgatccccagcacccacacctgatgatgtcataccatctgcatccacatctgagttag

SEQ ID NO: 112473 - DNA, 546 bp, Glycine max
  Peptide Sequence Number=SeqID_229251
atggacatgaacataggagcacttatatctggacagatctcgctcattgctcagtccaactcctcgaggcttgaatttccagccctcatcactgccttgtgcaaggccctgggagtcagctcagattctctcacttataagtcactcagcccagccattaatttgtcttatatcaagaagaattgttggaacctggatgacccttcggtcacttttctagggacccgcatatccaaggctagaggatctgaggccccatcttcttcagctgcccctgctccccctacttctactccctctacttctgctctccctttagctctagcagccccaattcttccagagcctgcactaaggctagctcctcattatgcagagcttgcaggatgtagaccagttatgagcgtggaggagtttctacagaaggatgatccagcaaccgtagagggtactcagcaggcatctccagtaggcactcctgcattggacttgaaccaggaggccatggatcaggacccatcaccaccgcatgaccaggatcactaa

SEQ ID NO: 112474 - DNA, 204 bp, Glycine max
  Peptide Sequence Number=SeqID_229252
atgaaccctgagaaagtgtgtatttctgctgcgtgtgtactgcttgtctgcatcttcgttgcttcatttcaagaacaatccaagttatggttactagctttaggcgctaagcctgacctgtcaggctatgcgccactttgcttctttaggctaagcacgccttgtgcgctaagcctgagtgtcattctgatgaggttgagctaa

SEQ ID NO: 112475 - DNA, 451 bp, Glycine max
  Peptide Sequence Number=SeqID_229253
gaaatgccaccgaggaagctctccgcaaagagatctaggagggacgccacgaccgaaggaaccagcgccgctcctgagtttgacagccatcaaaggatggtcgttccaccgagagggacgcatccagctcagggacgatgagtacacagattttcaagaagagatagctcgccggcgttcgacgtcgctggtcactcccatggctaagtttgacccggatatagtcctagagttttacgctaatgggccagccgatggatttgacgaggaggccatcgcccagctgttatgcataccgggtcaggattttgcccgaaccgctgccgggaggcgggtgcggatcatgcgcaccagcatgaccaccttgactcagatgtggatgacgttgctgcttagcaacgtcctgagtagtgatcataactccgacctccctctgccgaagtgtcagttg

SEQ ID NO: 112476 - DNA, 375 bp, Glycine max
  Peptide Sequence Number=SeqID_229254
atgaaggcattcaagccatatcaacctcagaagtggtgtatagggaagttatatggaagcatagaagagtcaataaggttgaacgacaaagttgaggaaactaaagacgggtacaaagaagaaatacttaatactacaagaaaagcacaaggtggaggaagttcaggaggcacaggaagtagaggaaagacaggagctggtggcactgctgatgttaatcgccggccacgtcaaagttctgcaccatcagagcctctcttttgggtctcaatatttaatccatttaactcgtgcatgaataatgatgagttttgctctcatactgctatttaccctgtcagtcgatcatgcacaacggtttacaacagaaaataa

SEQ ID NO: 112477 - DNA, 1160 bp, Glycine max
  Peptide Sequence Number=SeqID_229255
ttgataagagagatgatgatcaacgtgaaggaatcgaccatggtgcggccggcggaggaggtggcgcggcgggtggtgtggaactccaacgtggacctgatgacgacggtcgcgtcgagattgactgcgacggtcagggggtgcttttcgtggaggccgacactggcgccgtcatcgacgatttcggcgatttcgctcccacccttgagctccgccagcttatccccgccgtggattattcacaaggaatagcatcctatcccctgttggtgttacaggtaacacatttcaaatgtggaggggtttccctgggagttggtatgcaacatcatgtagcagatggagcctctggtctgcacttcatcaatacatggtcagatgtggctcgtggcttggatgtttccattccaccattcattgatcgtacaatacttcgtgcccgtgatccacctcgacccatttttgatcacattgaatacaagcccccaccagccatgaagactcaacaagctactaatgcatcagcagctgtctctattttcagactcacgcgtgaccagctcaacacactgaaagccaaatccaaagaagatggcaacacaatcagctatagttcttatgagatgttggcgggtcacgtgtggcgaagtgtaagcaaagcaagagcacttcctgatgatcaagaaaccaaattgtacattgcaactgatggaaggtcaaggttgcagcctcctaccccacccggttactttggcaatgtgattttcacaaccacacctatagctgtggcaggtgatctgatgtcaaaaccaacatggtatgctgcaagcagaatccacaatgcattgttacgaatggacaacgattatttgagatcggctcttgactatctagaactgcaacccgatctaaaagcgctggttcgtggggctcatactttcaagtgtccaaaccttggtatcactagctggactaggcttccaatccatgatgctgactttggttggggaaggccaatattcatgggacctggtggaattgcatacgaggggctatctttcataattccaagctcaaccaatgatgggagcctatctgtggccatagctcttcagcctgaccatatgaagctgtttaaggatttcttgtatgacatttga

SEQ ID NO: 112478 - DNA, 1449 bp, Glycine max
  Peptide Sequence Number=SeqID_229256
atgcctatggcaccgccaatattgttgccattctttctgtcctttctttctctctgcctcctcatcaatgcaaacggagtgatgcgttcttttcaagagaagaagatattcaacgtgcaaacgttgcagaacaaacaccaacttggtaaccaggcttgcctcctcccggaatcaagaaaggagaaaggtgctattgtactggaaatgaaggacagaggacattgctcagagaagaaaattgattggaacagaaggcttcagaagcagcttatattagatgatcttcgcgttcgttcaatgcaaaacaggattcgaagagtagcctccacccataatgtagaagcttcacaaacccaaattccattatcttctggtataaacttgcaaaccttaaactacatagtgacaatgggattgggtagcaagaatatgactgtgataattgacactggaagcgacttgacatgggtccaatgtgagccttgcatgtcatgttataatcaacaaggaccaatattcaaaccttctacctcctcttcctatcaatcagtttcatgcaattcatcaacctgccaatctcttcaatttgccacaggaaacacaggagcctgtggaagtagtaatccatcaacttgtaactatgtggttaactatggtgatggatcttacactaatggtgagctaggtgttgaagcacttagttttggaggtgtttcagtgagtgattttgtatttggttgtggtaggaacaacaaaggtctatttggaggagtctctggccttatggggttgggaagaagttacctctcattggtatctcaaactaatgccacatttggaggagttttctcatactgcttaccaacaacagaagctggttcttctgggtcattagttatgggtaatgagtcttcagttttcaagaacgctaatcccatcacttacaccagaatgctttcaaatccacagctttccaacttctatattctcaatctcactggcatagatgttggtggtgtggctttgaaggccccattaagctttggcaatggtgggattttgattgattctggcactgtgatcacaagactgccctcatctgtgtacaaggctttgaaggcagagttcttgaaaaagttcacgggtttcccttcagcaccagggttttcaattttggacacttgtttcaatctcactgggtatgatgaagtgagcatacctaccataagtttgcgttttgagggcaatgctcagctaaacgtggatgcaactggcacattctacgttgtgaaagaggatgcttcgcaagtttgcttggcacttgcaagtctttctgatgcatatgacactgctattattgggaattatcagcaaaggaaccaaagggtaatatatgacaccaaacagtccaaagtgggatttgctgaggagccatgcagtttcgcttga

SEQ ID NO: 112479 - DNA, 1122 bp, Glycine max
  Peptide Sequence Number=SeqID_229257
atgggttctagaatcccatctcataagcttagcaatggcctctatgtatcagggcggccggagcagcccaaagaaagaactccaacaatgacatcaacagccgtgccatataccggtggagacataaaaaagtctggagaattggggaaaatgtttgatattcctgttgatggctctaaatctaggaaatctggaccaataacaggtgctccgtcacggacaggatcttttggaggagctggttcacattctggacctatccagcctaatgctgctgctcgagccgcctatactacttcaggtccaatgacttctggtggcatggctggttcaacttcaatgaagaaatcgaattctgggccactgaataagcatggggaacctgttaaaaagtcgtctggtcctcagtctggtggagttacaccagttgggcgtcaaaattccggacctcttgctcccgttctacctacaactggtctcattacatctgggcccatatcatctggcccacttaattcttcaggggctcctcggaaagtgtctggacctttagaagcgacaggttcaatgaagcttcaaggttctgctgctgttcacaatcaagctgtgactgttcttagtcaaggtgatgattccttcagaaggaattttccgaaggcggtgttatggttattaattctgctttttgtgatgggtttcattgctggtggttttattcttggagcagtgcacaatgctattctccttattgtagttgtggttctttttggcctagttgctgcatctttcacttggaatacttattggggaagaagatctattatgggcttcgttgctcattatccagactctgagcttagaactgcaaaaaatgggcaatttgtgaaggtctccggggttgttacctgcggtaatgtgcctcttgagtcatctttccagaaagttcccagatgtgtatatacgtcaacaagtttatatgagtatcgaggatggaactcaaaagctgccaatcctacacaccgtcggcttacttggggccttagactgctggaaattttgtttactaagcaaaggatgtattcagatgggtgttctaccctcaagccagttacaatgtattga

SEQ ID NO: 112480 - DNA, 462 bp, Glycine max
  Peptide Sequence Number=SeqID_229258
atggcgaagaaatcacagaaaagcctcaaaaacaacaataacaacaacaccactaggaagcgcacacgcaaaagcgtcccaagagactcacctcctcaacgaagctcaatctataggggtgtcacaaggcatcgatggactggtcgatacgaggctcatttgtgggataagaattgctggaatgaatcacagagcaagaaaggaagacaaggggcatatgatgatgaagaagccgcagcacgtgcctatgacttggcagcattgaagtactggggccaagataccattctcaattttccattatcaaattatgaggagaagctcaaggagatggaaggccagtcaaaagaagaatatattggatccttgcgaagaaaaagcagtgggttctctcgaggagtttcaaaatacagaggcgtagcaaggtacttgaaccctgctctgttcactgcaaaatgctag

SEQ ID NO: 112481 - DNA, 648 bp, Glycine max
  Peptide Sequence Number=SeqID_229259
atgatttacatctccctctttctcaagaaaattcttcttaatatcatcaaaatcttcatgatttacaaccctggatggaggaatcaccctaatctcagatggtccagccctcagcaacaacaacagcagcctgctccttccttccaaaatgctgctggcccaagcagaccatacattcctccaccagtccaacaacaacaacaaccccagaaacagccaacagttgaggcccctccacaaccttccctcgaagaacttgtgaggcaaatgactatgcaaaacatgcagtttcaacaagagaccagagcttccattcagagcttgactaatcaaatgggacaattagctacacaattgaatcaacaacagtcccagaattctgacaagctaccttctcaagctgtccaaaatcccaaaaatgtcagtgctatttcattgaggttgggaaagcagtgtcaaggacctcaacccgtagcaccttcctcatcagcaaatgaaccagccaaacttcactctactccagaaaaaggtaattctgatttgcagaagcagcacattccccctcttccattccctccaagagcagtttccaacaaaaaaatggaagaggcagagaaagagatcttggaaacgtttagaaaagtagag

SEQ ID NO: 112482 - DNA, 165 bp, Glycine max
  Peptide Sequence Number=SeqID_229260
atggccctcggcgttcgcttattcgaacccactcaagcggcgctttccgtttgttccgggctaggcaaaggaaacaacaatgtgtggcgaatcgtgaccgcgtcgttgtcttaccttgattggtttctgcctttaactttgtctcgacctctgactgtggcctaa

SEQ ID NO: 112483 - DNA, 1545 bp, Glycine max
  Peptide Sequence Number=SeqID_229261
atggcctgttatgacacattgcagtatcttgatgagaacaagaagctgattgtagcaataatggaaaatatgaaacttgggaaaattgataaatgtgccgagtaccaagagaaaattcaacagaatttaatgtatttagctacaattgctgatttgcagcattcacaaacactaatcatgcctccacagatgattccaccaccctctaggatgcaaccagaatactatatgcaacatcctcagggtgtagcaatggttcagcaacaagggattttccctccaaatatgcaattgcaatttggtaatccacaacaacaactacaccagcacgccattcaagggcagataacaaggataggtaatggaacgtatcccatgcatagtgagaatgttcttgaaggtggccatagtggtggctcaacttcaactgcaagtccaaataatgcatgtggtggaagcatgcaaggaacttctgaagatggagatggcttcgctctcgtcgccgactttctatgggcctctacctcttccactcttcccacctccaccaaaccctccgcatttgtggttccctccaaccacaataagaagaaatatgagaatgccactgcttctggaagattccttgccgcggcttacgccgatttggatgcgccgcagctcaagtggcaaaagatggctcctgctcccgtccctcgccttgacggagccgccattcagattcgggatctcctctttgttttcgccggctacggcaccatcgatttcattcgacatgccgaaagagatggcgcactcgcatttgggatggtgaccgatggaagatacatctatgtggtgactggacagtatggcccgcaatgcagaggtcctactgctcataactttgtgctcgacactcaaactaggaaatggcgggatctacctcctttgccggtacctagcattaaacataaacaacagattcaaagggaaggggaaggatctggtcaaactcacttattcccaccttctttcttggatgctggcttcactctctgcctttgttgcttttggatgctcactgtttttggctctaagaaaatcatgggtagacttcatgtgatgggtggcagtaaggagaatcgacatacacctggattagaacactggagtcttgctgtgaaggatggaaaagctttagaaaatgagtggaggagtgagatacccattccccgtggaggacctcacagggcttgtgttgtggttgatgatcgtctttatgttcttggtggtcaagaaggagattttatggccaaacctgggtcacctattttcaagtgctcacgcagacaagaggtggtttatactgatgtttacatgttggatgatgatatgaagtggaaaacgctgcctccaatgccaaaagcaaactcacatattgaatttgcttgggcgcttgtaaataactccattgtcattgttggaggcacaacagagaagcaccctataaccaagaagatggttttaaacggagaagtagtccagtttaacttgaatactttg

SEQ ID NO: 112484 - DNA, 534 bp, Glycine max
  Peptide Sequence Number=SeqID_229262
atgtctatccacttccagaagatcaacagcaaatgtgcacttgtttgtacctttaattgttcatatagggatacttctgaattagaggaatgggctcataagcagtatattgcaaaacatcaacagggtccttctcaacagtggggcaacttctactattttaggatgcagaatataagtgacatatatttcattggaggctttggtactgttgcttgggtggatgtaaaggaatatgaaacccttcaacctgataagattgcagttgatggtggtgaacagtatttaaaggaactcaatgctatcttctcaaaacccctaaagaaacttctatctagtgagactgaggtagatgacgctgcactcatatctatagacagcaaaggaactgatattagggtccgtcaaggtgctcagttcaacattcagaggatatcatttgatgaagggcagagtgtagaaacattggaagaagctaaagctgctcttcggaaattaatacacaaaggaaaagtgtacaatttgcagaaataa

SEQ ID NO: 112485 - DNA, 609 bp, Glycine max
  Peptide Sequence Number=SeqID_229263
atggaagcactctccttcatcatccccaaagactcttgttctcttctccttcgcactccttcttcatattcctcttcgtctgtcagaactccgccgccgccacttgctttcttcaaaaccacccaacactctcactcgcctcaccttctccgtcttcgcgtttttgccctccctaaccccgacgccgatgaacccaccaacgacttcgctttagcgtctcatcctcaggaaaatttaagccattctgagactgagagttccgaagatgatcaagatgctccaccacaaatggacatgtcgtggtcaacgatcacagccccagctggaagtggatccggtggtggcaccagggctggacttttcagaacacccatttctggtggcgtgcagagtgccacctcagctcacggtttacctagaccggctttagcagtacggaatttgatggagcaggcaagatttgctcatttgtgcactgtaatgtctcgtatgcaccaccgacgagaaggatatccatttggttctctggttgattttgcaccagactcaacgggtcatgatttcaatctagttttgatccttgctgagaaaagagtgagaatatggtag

SEQ ID NO: 112486 - DNA, 857 bp, Glycine max
  Peptide Sequence Number=SeqID_229264
atgttgaggctgctgaaggctttataccatccaagaaatcagtacctacttcagcttgatgatcgttcctctgagtctgaaaggatggatttagctatctccgttaaatccattaaggtgtttgaggaatatggaaatgtgaatgtcattgggaaaagttatgccatcaataggatgggatcttctgctctttctgctcctctgcatgctgctgctttgcttcttaaactcaacccagattgggaatggttcatcaccttaactgcttcagattatcctctcatgactcaggatgatatccttcatgctttcacattcttgccaagatatgccaactttattcattacactaacaagacagttcgcaacaagcaacgagacattaatcaaattgtggtagaccaaggtttacactacgaaaagaatagtccacttttctttgctgtggagtcccgagataccccagatgcttttaagctatttcgagcaatgtggcttatcctctgggacactgatccatctgaatcccaattgcttgatatgtcacactatgatacaatgctggaaactggagccgcatttgcgcgcccatttggcgaaggtgatgtggttctggagaaaattgatgatttgattcttaaccgatcatctaatgggttggtccaaggagagtggtgttcaaactcagaaataaataagactacaaaggcttcagaagctgaggaagagttctgctcacaatctagcaatgttgatgctgtaaagcctgggccatttggcatcaagcttaaaactctacaagcagaaattgtgaactcgaggaaattcagaactagccagtgcaaatcctttgaaag

SEQ ID NO: 112487 - DNA, 213 bp, Glycine max
  Peptide Sequence Number=SeqID_229265
atgaatacgcaaaccacaagcccggtgatcaaagaagaagaagaaaaggaggaaggaacaaaggaagtggttcaagaagaagaagaagcgtctcacccttacgcatttcatgtttctggtcctcgtaatttggccaaccttaattggagagaccttataagttcgagctggtggtttctgattgaaggaagtatcgtgaaatggaaaatgtag

SEQ ID NO: 112488 - DNA, 183 bp, Glycine max
  Peptide Sequence Number=SeqID_229266
atgtttgtattcaacaactctttaaaaggacttgacgatactccacaacctaaatccaaggctggagctaggtggattgttgttaaatattttaatgatgttagaccattgaaatcagagagattgaaggcacttcgcatccagtgggtaaagtattatctcaaagttagaagtgaaacttag

SEQ ID NO: 112489 - DNA, 165 bp, Glycine max
  Peptide Sequence Number=SeqID_229267
atgaaagtggtggccaagctagcctcttctccttccaatcaaccccacgacgtcgaggaacttcccggctcgaacttcaaagttcgtgaacaaattagtttgcatcaaggagtggcagtttgtcaacaaggacattggagtcaagaaaccagggaagatatttga

SEQ ID NO: 112490 - DNA, 459 bp, Glycine max
  Peptide Sequence Number=SeqID_229268
atgaaggacatcccttcatcatccactctagctcctccgtcagtaactgtaggacaggaggtccaaggctcacaaactttagtccctatgctgcaaagcttattccgaggacagtttattatcatgcacaacctgcaagagttggctcataacaggccaatcataactatggagcattttcttgagcaagtagcctggcctgaagctcaacttccattggttgatccagagccaactaacccacaatctctagtggtaaatccactatcttctcttgagcgtgaagtagttcccccatctccacctctgattatcatctccgatgcatcatctgatgaagcagctgcccctcctgattcaccaaaaggagaaacagctgaccttcctacttccctagttggaggaatttctgattcgtcatctggagaagcttttaccctcactgattccccagtttag

SEQ ID NO: 112491 - DNA, 603 bp, Glycine max
  Peptide Sequence Number=SeqID_229269
atgtctccttccaattcccccgtcgccgccgaaacgctattttccggcacggtgttcctgattctcctccacctctctctcttccttactcccacactttctcttgacttcctattcaactccttcgccggcgtcaccaacctcactctcatcaaagatgcccgcgtcgacgcctccgtcatccgcatgaacaacgactccaaccaatactcctacggccgcgccttctaccccatcaaaatccccatgaccaaaacaaactcttccatttcttccttctccacttcttttgtcttctccatcttgccgcagatatcgaattcctgcagcccgggggatccactagttctagagcggccgccaccgcggtggagctccaattcgccctatacacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 112492 - DNA, 394 bp, Glycine max
  Peptide Sequence Number=SeqID_229270
atgacggaggcgtcgacgcgggcatctttgatgagagtgaggttggtgacgccggcgaaggagttgaataggaagtcaagagaaagtgtgggagtaaggaagagagagaggtggaggagaatcaggaacaccgtgccggaaaatagcgtttcggcggcgacgggggaattggaaggagacatcggtgtgggtggaatagaggagttgtccttgtccccctcaagcctcaaggcaaggccaaggggggcccggtaccagcttttgttccctttagtgagggttaatttcgagcttggcgtaatcatgcggaagtgtatactggcttactatgttggcactgatgagggtgtcagtgaagtgcttcatgtggcaggagaaaaaaggcttgcaccgg

SEQ ID NO: 112493 - DNA, 417 bp, Glycine max
  Peptide Sequence Number=SeqID_229271
atggcacggagcgtgtttgctctttgcccttatttaggaacctatgggataatatctaggggtttgctaataactaatttcccaacaatttacaactcacacggccgttctctagaggtatcatcactcaagataataatattgtggcggcctaactcacaaaatcagtccccagtggagtcgccaactgtcgcaacgtgcccttttgcgggcgagcgagggcgaggctcacgggtgcgctttccaaaggaggaaagatgcgcggagtcgccaccaacgtttatttatggaaaacatcggaaaaaccgaaggaaaccggtcaaaatgaaaattctaagttcgggagttgtatttacgcttgaggaaggtattagcacctcttacgtttgtctcaaaggacaacagcctattttttag

SEQ ID NO: 112494 - DNA, 582 bp, Glycine max
  misc_feature (75)..(75): n is a, c, g, or t
  Peptide Sequence Number=SeqID_229272
ggactccacgtcctcaccttcagagggctgcacgccctcgccttcagaggactgcatgtcctcgtcttcgaaggnctgctcgccctcgccttcataggactacacgtgcctaccatcagagggctgcacgccctcacctttaaaggactacacgtcttcgccatcagagggctgcatgccctcacctttagaggactacatgtcctcaccttcagaggactgcacgtcctcaccgtcagaggactacacatcctcaccttcagagggctgcacgccctcgccttcagaggattgcacgtctcttcttcagacagtctacccctgcgggatcgcacccacaagacactcagtggacccggaggagtccaacagggccctagggtttccagctctggttacgggcctctgtcagtcctacagggtgcccgttccccccagcaagggatcgcgcccgcaagacacccagtggagtcgaagaagtccaacaaggtcctggggtttctggctctgattacaggcctatgtcagttctacggagtgctcgtcgtccccaacaaggtcattaggccccctattaactag

SEQ ID NO: 112495 - DNA, 737 bp, Glycine max
  Peptide Sequence Number=SeqID_229273
gaagcatagatgtggcaattgttaaagaattctatgcaaacctatatgtccctaaggacaaagaaccaaagcatgttagggttcgagggcacttgattaagttcgatgcggactccctcaacaccttcttgaagactccagtggtcttggagcaaggggagagcttaccttcttactctaggttctacaggttgaggccagaccctcaagagctggcagcccgactgtgtatccttggaagaggatttgttcttaacattgagggcttgccatggaagctcttgagcaaggatcttacaactctggcgcagacttggagtgttttatcttattctaacctagccctgacttcacatacctctgatcttaatcttgacagggctagatctcgctcattgctcagtccaactcctcgaggcttggatttccagccctcatcactgccttgtgcaaggcccgaggagtcacctcaaattctctcaattatgaatcactcagcccaaccattaatttggcttaaattaagaagaattgttggaacctggatggcccttcggtcacttttccagggacccaaaaatccagggctagaagatctgaggccccatctccttcagctacccctacttttgctctcccttcagctccaacagccccagttcttccaggtccctccactcagagctcagagcctttcatgtctatgctgcagagcctgcaccagggccagctcctga

SEQ ID NO: 112496 - DNA, 390 bp, Glycine max
  Peptide Sequence Number=SeqID_229274
atgagtattgaagaatccattcatgtttcttttgatgaatctaatgctattttgtcaagaaaggatatactagatgatattgcagaatctttagaacaaatgaatattcacggacaagattctaaaggaaaagggaaaggaagcaatgaagaccctccagaagaagccaaatcaaatgatgaacttccaaaagaatggaaagcttcaaaagatcatcctcttgacaacattattggtgatatctcaaaagtgcttgtaggcctaggatcttcttcatcaatggattcctttgcttcttggaagatgaatggcagcggaatggagaaggaagagagagaggagacgccacttcaaggagaagatgattctagaagaagctcaccaccatag

SEQ ID NO: 112497 - DNA, 312 bp, Glycine max
  Peptide Sequence Number=SeqID_229275
atggtgttcagccctttgaaggcgaggacgtgtagccctctaaaggcgtggacgagtagttctcttaaggcgagggggtgtacccgtttgaaggcgaggacgtggactcctctgaaagcgagggtgtgtagccctctgattgcgaggacgtgcagccctcctaaggggaggacgggtagccctctgaaggcatggatttgtagtcctctgaaggcgaggatatgttttcctctgcaggtgaggacgtctagccctctgaaagcgaggacgtggagtcctttgatggcaaggacgtgtagccctctgaggtga

SEQ ID NO: 112498 - DNA, 438 bp, Glycine max
  Peptide Sequence Number=SeqID_229276
atggccttagtagctgacttcgatttagagttgcaccaaatggatgtgaagacaacttttctgaatggtgatttggatgagacaatatacatgcagcaaccaaaagtgatcacttccatgggatttgaggagaataaggttgatcagtacatataccttaaggccaatggaagcaaatttttcttccatgtgctatatgtgaatgatatattgttggcttctaatgaccttggcatgctacatgactcaaagcagatgctaatgagatcttttgacatgaaagatctagctccattggagcttgtaggcctaggatcttcttcatcaatggattcctttacttcttggaagatgaatggcagcggaatggagaaggaagagagagaggagatgccacttcaagggaaagatgagtctagaagaagctcaccaccatag

SEQ ID NO: 112499 - DNA, 453 bp, Glycine max
  Peptide Sequence Number=SeqID_229277
atggataagcttggctatcaaaggacgacgaatcttggtaaatatttgggcgtccctcttcatcatgagagggcttcggaacatagctacaaatttctccttgataaagtaactggaaggcttccaacttatccatggcgggaagggaaagatgatctttgggctagagtgatccgtgctaaatacaaatgtggtgatgatgtgctttctgtaattgattcgaaaagaaatggcactaacttgtggaaggggattgttaaaacgtcgggtacagttaaatcaaacctaatttggctcatgagaaatggaaggagaattagatttatggaagattgttgggttctaagtcagggaactttgtctcaatataaaccactagtgcttgggaaagtagagatgttccagttttcttttttgttgataacaatagggaatgagacactgccaaattag

SEQ ID NO: 112500 - DNA, 237 bp, Glycine max
  Peptide Sequence Number=SeqID_229278
atgaatgttggtaagcatatcaagtatgaggtggctacatcaaaggtgataaaccttgattttgattccttcctcgaagagaatcctcttgtcaaaaagcaaaagatgtacaagaacaagaggaatgagagaatgtcatatgctactaaccaagttgatgttgaattaaataatccagcacgagccgccgctattcttgtatacagaatttctacaaagcaccaaacctgcacttga

SEQ ID NO: 112501 - DNA, 1131 bp, Glycine max
  Peptide Sequence Number=SeqID_229279
atgatgccatcacaaagaagcatctcagaagtgcaaggcatgcaaatagatatagctgatgattctggtataagacccaaaacgattcttgaattgatcagtaaacaagtaggtggtaaagatgtcattggatttacacagcaagctcagaagaactatctccgtaataagataaagcgagagttggcatatgggggaagctggcatttgggaaatatgatgaaggatagttctttctttttgaaagattttaaagcttgtatgtttgactctgatgatgaatcaaaatttgaagaagcttggtatattttgctccgcaaatataatgttgagactagcacttggctagaaggaatttacaaaatgaaagaaaaatgggctagttgctatatgaaagatgcttatagtataagaatgcaaagtactcaacttagtgaaagtttcaatgctagtgtgaaagattatgttagatcaagcttggatataatgcaaattttcaaacattttgagcgagctgtggatggcaagcaatacaatgaattagaggctgaatacaatagcaggaaaaaacttcatcggctaaggatagaacacttaccattattaaagcagaaattacctgatcaatacactataaaaagatggagaagagatgcaagagacattgttgttcaagatgctacggctcgagcgtctgactttgaggagacatacttgtacattgatcatgtggctgataaattacatgaaaagatagatagttattataagttaccagaagatgaacttaagactttgaaggaaaacataattgagagcattgaacaatctcattcattggagagagttattgaaaatgtgaaggggttgaaaaagaaagaaacccaaaagggtagaaaaagattgagaagtcgggtagaaaagcaacccaaaaggaagacaaatgcttcacgttcaaaaaaaggattaaacaaaccagtaaagaatgttgaggtttccaagtcaatggcatgcatgggtcctgaagaacacacattcaatagttctaacaactttcaacaagaaaagactccagcttctcaattatcaaatgctaacagtgaaaataaggtgtgtgagaaagaaatatga

SEQ ID NO: 112502 - DNA, 1413 bp, Glycine max
  Peptide Sequence Number=SeqID_229280
atggatgaagaaattgcagccattgaacgaaacaacacttgggagcttactagtcttccaaagggacacaagacaattggtgtcaagtgggtgtacaagacaaagttaaagaaaaatggagatgttgacaagtttaaggcacgcttagtagctaaaggctacaagcaagaatttggtgttgactacaaagaagtgtttgctcctgttgcccgacatgatattgtcaggttggtaattgcgcttgcaactcaacattcatggcccatttttcaattggatgtcaaatcggcattcttgcatggagatttggaggaacaggtatttattgaacaacctcctggatatattaattttggaaatgagcataaagtatatagattgaaaagggctctatatggattaaaacaagctccaagaacttggtatagtcgacttgaagcttattttttgaaagaaggatttcaaaaaggtccatatgagcatactctttttataaaaattagtaattatggaaaaatactcattgtatgtgtatatgtggatgatcttatttttactaggagtgatgctgccatgtttgacaaattcaagaaatccatgatgattgaattcgatatgattgatcttggcatgttgcattatttcttgggcattgaagtaatgcaatctactgctggaacctttatttctcaaaagaagtatgtgctagaaattctggacagatttcaaatgaaaaattgtaactctgttagcacacctactaaagtgggtttgaagcttgttcgagatcttgaaggaaggaagattgacaacactctttacaagcaaattgtagggagtctgatgtatttaacagccacaagacctgacataactcatgttgtaagtcttattagcaggtacatggaatgtccaagagaaatgcatcttctagcaacaaaaaagaattttttgatacttgcaagggactattggttatgggatgttttcaagaaaggagaaaagatagatttaattggtttcactgatagtgattatgctggagatcaagattatagaaagagcacttcagaagtgaagatcaagttgctgatatacttactaaacctctcaaagctcctttatttcagaagctacgagaattgcttggactatgatttcttcactttaccctctaaagtgcagcctggctgcactttaggggagcccgatccgattcaaaagtggttatgtgccaagataagggagaattccaagctagctagtgatccccaacttgcacaatacccgcaaaaggtaaagaatattgctcagcaattcacctggtttgaacctgatcatgttcctagtgaggaaaatgatagggccgacatactttcaagattggggagttcatcaaagccaggaaactga

SEQ ID NO: 112503 - DNA, 645 bp, Glycine max
  Peptide Sequence Number=SeqID_229281
atggcaatcgtcaacaagatgcggatccatggtgacaaaaaggaggatatcactgtagttgagaagattctttggtccatgactccaaaattcaactttgttgtttgctctactaaagaagctcatgacatcgaggaactctcaattgatgaactgaaaaaacatcaacaacaccatgagaatcaattccacagaagaggaagagctcaaggaggccatcattttatagctcacataccaaagtcagcagacaagtcagatgttgaatgctaccgatttcataggtatggccattatcagtcagaatgccgaactaacttgaacaaagacaatggagagaaaactaactttgctgaaaaggaagaggaggtgtctcttttgatgatgtgtcatgtgaaggaagaaactcaacaaaacatgtggtatttagacactggttgcagcaaccatatgtgtggagacaagatgatgttctctaatttagatgaaaccttctgcaatacagtcaagtttagtgataattccacaatttttgtcttggggaaaggaatggtaactctccaaaccaaagagaattcaagtcacactatctctaatgttctttttgtcccaaatttaaagaccaatttacttagtgtgggttag

SEQ ID NO: 112504 - DNA, 336 bp, Glycine max
  Peptide Sequence Number=SeqID_229282
atggagcaaacacctcgtgggtcatggtcgtggctcgtggtacttgcggcttccaagcttctctcgagcttgtcgttgacacaagcagcaagctgccaagcttctcttgagctcgtcgtgtttgtgggtgggactcgcggcttccaacagaaccagacaaccaccgcactgcgcctccgtgtcgcgtgtcgtctgaaatggcacggtggtggtggagacggcctgaacggcgacaatggaattgatgctaagaatgatagtggcgcgacagagaacacaaagagatggaggaggaagaagcttggtttgcggtgttgtatgaacaccgcgagggag

SEQ ID NO: 112505 - DNA, 912 bp, Glycine max
  Peptide Sequence Number=SeqID_229283
atggctccgaaaaagctttccgcgaagagatctaggagagcgccgcgactgaagggaccagtgccgcccccgagtttgatacgcttagaggccatcaaaggatggtcgttccaccgagagagatgcgtccagctcagggatgatgagtacaccgattttcaggaggagatagctcgcagacattggattccttttgacgcagatgccctcagccaattcttgggtgacccgctagtgttggaggaaggccaggagtgcgagttcagtcagaggaggaacagggccgacaggttcgacgaggaggccattgtccagctattgtgcacacctgggcaggatttcgcccgaaccgctgccgggtggcgggtgcggatcatgcacaccagcttgaccaccttgacccagatgtggatgatgttgctgctcagcaatgtcttgcctagtgatcaaaactctgatctccctctaccgaagtgtatgccacccaccaggcaccctctagacccggataagtctaacagggccctggggtttccgacattgatcacgggcctttgccagtcattcgggattcccgtcacccctagtaaggtgatccgaccgccgatcacccgggctttcattgagaagtattgcacgcctagacaggcacagagtgatgcacctcaggacgcagacgcaccaccttatcaggccgatcccgctggccttagtcagcaggggcagggtttcgctccttttgcgtgccctactctagagcagtttagggttgaggtcgcatggcccggagattggcccgaggcccaggcaggggaggcgcctgcaggatcccccggcgatgtagaggaggcccgcatggatgaggagataacagatttgctcagtttcttgggagggagcagagccacatga

SEQ ID NO: 112506 - DNA, 567 bp, Glycine max
  Peptide Sequence Number=SeqID_229284
atggcgccaagcaaacctggaataatgagattgcttgaggataaggcgaggagggacgtggctgaggttgttgctgccaaagtcgttgctgctgcagcaaatgacactactggtgggtcggttacaccgactaataatttggtggagaaggaaaatgatgacagtcagcgaagaaatgtcctcagacatgatgttcgcaaaaatgatctcatcaatttgggtgaatctcaagaccatcctggttcgaccaagtctgatcttcagtctccagtggatgcgaatgccgaggctaacagattgactgttatcgacgttgccactaaagacaaagccagggagctatatcatgaaaggaaacaactagaaaagaacaagtttgccttggttaaggatttggaacgcttagataaatccgagattgagaagctccgcaaatcaaaaaatgaagcccttgaggagattaatgtgttgactgctcggctagaatccctggacatagagatcaaaaagataaaggtcaaagtgacaaatgagaagactaagtttgccgctccattgttggtccgg

SEQ ID NO: 112507 - DNA, 651 bp, Glycine max
  Peptide Sequence Number=SeqID_229285
atgaaaacacttggcatcaactcccacaatgttgttgtgagtcttattgttagagggcttgcaaattcaaagaagattgacaatgctatttgggttcttgatttgatgcttgagatgcaaattattccaattgttgatactttcactactttaatgcacgtttattacaaagaagcttatgtcacaaaagctttagaattgaagagcataatggaagattgtcatgtgaagcttggtgttgttgcatacaatgttcttatatctagcctttatactaacaataagattgatagtttgtatcccaattggaaagttgtacttgaagctttgaagaatctgatttgggatgacattgtgggaacatttgatattcctgaagtgtccaatgccaagaagaagaaaaacatgatggaggataaaaggaagaaaaaacaggaggaatcaatcgaatctgggggttcaacaattgttgaccctctatctcccattgaaagacatgtcaagtggaagatgacccgcaccaaacactttgggaatatgacatctgtggaggcacaacaaatatctgataggattgcaactactgccattgggcaacctgagcactcaggtcgtgtttgtgctgtgggacttggtgtcaccattagctaa

SEQ ID NO: 112508 - DNA, 294 bp, Glycine max
  Peptide Sequence Number=SeqID_229286
atgtctattcatgtagggttgaaatctcttcgtggaagaaggtggtgctggcaagggatgatatcaaagggattcaattcctcaatggttccaactctaatttcaatggctccacctccacatcagcataggagagaaatgccaacgacaaatgccaacgactgtgctgacaacaagggaggaggtggaggaatgggatgtggcagtggtggcgacaacagaggaggggagtttggggtcgaggaactggccgaggggcatttggcttctcctcgagaaactagcctcttgtag

SEQ ID NO: 112509 - DNA, 489 bp, Glycine max
  Peptide Sequence Number=SeqID_229287
atggatcccttcaattatccatatagccactctagggaagtacatcctaatgaagaagtcgatgcttcaggatgttatggaacaagggaactagtttttcaagagtttcttattaggcaaactattggtcctaatcccaaaaatcttatatttgagcttaggccaacaacaagaaaggttatctgctacaaaggcaatgcgctactgattgaagatgaagatgctccacctactagatatgttaaggctcgttctggaagacttttcaaacatgaacttgaggctctaaagcataagattgagcttacaagtctggattggttttccatgaagaggttctacaaacacaaggatcattgctctggtctagaacctaatgagaaacctcctacaaatatagttcatcctgacataaaattggctgagttgttgaagacaagggaagcaattgcccaagctttggaagatcatgttcatgctaagaaatag

SEQ ID NO: 112510 - DNA, 252 bp, Glycine max
  Peptide Sequence Number=SeqID_229288
atgtccatcatggtagcctttttagcactcttccttagaacttctataacaaacaacatcttggtggttgaaatggaagagctagagaaggtttgggttcagatgaaggtgagggtagtgggaatgtcttttctgtttgtgggtagtttgggtctaggttattcctttaagtttggttgccctctagatggtgccattccagacaaattaacaccaacatgtcttatgatttgggtgaaaagcataccataa

SEQ ID NO: 112511 - DNA, 537 bp, Glycine max
  Peptide Sequence Number=SeqID_229289
atgaggggcaccgtgcatgagcctcaagtgaacataggggcagatcaaaagttctcacctgtcgatgtttttaaacaagaaaaagaaaaggggggacaaaccctaggactacacgtcctcgccaacagagggctgcacgccctcaccttcagagaactacatgtcctcgccttgagaggactacacgtcctcaccatcagagggctgcacgccctcacctccagaggactacatgtcctcgccttgagagggctacacgccctcatcttgggactacacgtcctcgccttgagaggactacacgtcctcaccatcagagggctgcacgccctcacctccagaggactacatgtcctcgccttgagagggctacacgccctcaccttgggtactagttaccctcaccgtcagaggactacacgttctcgccttgagaggactacacgtcctcaccatcagagggctgcacgcccttacctccagaggactacatgtcctcgccttgagagggctacacgccctcatcttgggtactag

SEQ ID NO: 112512 - DNA, 417 bp, Glycine max
  Peptide Sequence Number=SeqID_229290
atgacatgcggagacaaattacggtcattcgcacgctcgatgggtggtaaacgcgcagagacagattctgcgccctttatcattcaggagcagcgagtcaagtggaacaacaagttgggtggtaaacgcgcagagacagattctgcgccctttatcattcaagagcagcaagctgagtggataaacgcacatagacgaattttgcgccctttatcattcaggaacaacaagttgggtggtaaacgcacagagacagattctgcaccctttatcattcaagagcagcaagctgagtggataaacgcgcatagacgaattatgtgccctttatcattcaggaacaacaagttgggtggtaaacgcgcagagacaaattctgcgccctttatcattcaggagcagcgagttgggtggtaa

SEQ ID NO: 112513 - DNA, 625 bp, Glycine max
  Peptide Sequence Number=SeqID_229291
aggactacatgtgctcgccttcagagggtcatgtaccttcaccttcagaggactacacgccctcaccttcagaggactacacgtcctcaccttcagaggactacacgtcctcgccatcagagggctacacgccctcaccttcagaggactacacgtcctcgcctttagagggtcatgtaccttcacctttagaggactacacgccctcgccttcaaagggctgcacgccctcatcttcagcggactacctgtcctctccttcaaagggctacacgccctcatcttcaaagggctacacgccctcaccttcagaggactacacgccctcaccgttagaggactagacgttctcgccttgagaggactacacatcctcgccttcggagggctgcacgccctcgtcttcagaggactatatgtcctccctttgagaggactacacgtccttgtcttcggagggctacacgccctcgccttcagaggactacacgtcccccttttcagaaggctacacgctctcgcctttagagggcgacacgtcctggccttcggagggttgcgctctccctcgccttttgggggctatgcgtcctcacttttagtgggctccatatccacaccttaa

SEQ ID NO: 112514 - DNA, 207 bp, Glycine max
  Peptide Sequence Number=SeqID_229292
atggcgttgctacttagcaacattttgcccaacaaccgtaatgtcgatctccccctgcggaagtatcagttggggtcgcgcccacaagacacccaatggaccggagaagtccaacagggccctggggtttccaactttggttacgggcctctatcagtcctacaggatgcccgtaccccccggcaatgtcatgccatcgcgacatag

SEQ ID NO: 112515 - DNA, 196 bp, Glycine max
  Peptide Sequence Number=SeqID_229293
gaagaagaagaagaacatatggaggaagaagaagaagaagaaagacgcaaggcaagttgtgattgtaacttgcaaggctacagtagataatcgtgaaacccgtggcttcatttattggcctcgtcaagttgtgattgtaaaggctacaaaagatggtgccattatcaagccacaggggcaggtcactgggagttag

SEQ ID NO: 112516 - DNA, 441 bp, Glycine max
  Peptide Sequence Number=SeqID_229294
atgaatgaacggattgtcatcatcaaaaatggggagattgtagaagcaattacttccaagattattttgataatgccaaagaatcaagggttaagcaagttccaaagaattaggcttcaagaatcaagtctcaaagaattaagattcaagatatatcctcttaatctgatggactcttgtctctttctgatgggcatactatcatttgggttaagtggtctaacattacttctcgattcaaaattggcaagaggtttgagatgggtcgtttcaccgatgcgagggatgccatgtaaccaaacgatctcaacggagaatctagcggctaaagattgggcgaaacctgagctggttgcagaagtggatgaagtaacacttgtgattttgttgggtaccctaaaaattaagggtagcctaccctatgagttaagggtaccttaa

SEQ ID NO: 112517 - DNA, 1221 bp, Glycine max
  Peptide Sequence Number=SeqID_229295
atgcttgacatgttcaacctccgcaacatcacagtggatgcgcaaaacaaggttgctgtggtccaagccggtgccacacttggcgaactttattataggatttgggagaagagtgatgttcttggctttcctgcaggggtgtgccacactgttggtgttggtggtcatttcagtggaggagggtatggtaacatgatgagaaaatatgggttatccattgatcacatcagtgatgctcaaattgttgacgtcaaaggtaggattctaaacaaggagtcaatgggggaagaccttttttgggctattagaggaggtggaggagcaagttttggtgtcatattatcatacacaattaagttggttcctgtgcctgaagttgttactgtttttcaggttgagaagactttggagcaaaatgccactgatcttgttgtgcaatggcaacaagttgcaccgtacacggatgaaaggcttttcatgagactgcagttacaccccatgatttcgaacgtcggagagaggcacaaaactgttagagccgcggttatgactatgtttctgggaggagcagaagagcttgtgtcacttttggacaaaaagtttccaactttgggtctaaagaaggagaattgcattgaaatgagttggattgagtctgtggtttggtgggatagttttccaaatggtgcccacccagaagctctacttggcagaaatctcaactcagcaaagttcctcaaaaggaaatctgattatgtgaaggatccaatttccaaagacgggttagaatggatatggaaaaggatgattgagttgggacaaacaggtatggctttcaatccatatggcggaagaatgaatgagatttcagcaaatgctacagcatttcctcaccgagcaggaaatctgttcaaaattgagtattctgccaattgggaggaacctggaggttctgcagagaagaactttacaacacaaattagaaggttacatagctacatgacaccatttgtgtccaaaaatccaaggagggcttttctgaattatagggaccttgacattggtattaatcaccatgataacaatagctaccaagaaggggaggtttatggttttaagtacttcgatgacaacttctatagactggcgaagattaaaactgaggttgatcccggaaactatttcagaaatgaacagagtatcccaacgctaaaattgtga

SEQ ID NO: 112518 - DNA, 402 bp, Glycine max
  Peptide Sequence Number=SeqID_229296
atgcaactagtagaaaaagatttttcaccattacagaagtgtactacaacaattcatatattagcatacagatcacttgtcgatagtgtcaatgagtatgttagaattaccgaatgcactggaattcaatgcttagaagcttttgtaagggatgtgaacgagatattgtgggatatatacttgggaaggccaaacaataacgacatcaatcgtctactacaaattagagagacatatgggttgacagatgacgtttatcctgatttggatactttggtgaagaccattcccatgtcacaaggagagaaaaaaatttattcacaaaatgtcaagaaaggatgtgaagagaatatttggtgtgctaaaatctcaatttacagttatatgttgtccatcgcataa

SEQ ID NO: 112519 - DNA, 336 bp, Glycine max
  Peptide Sequence Number=SeqID_229297
atgacgttgtttgagatggaaactgaatattatgggtttgctatggtcgcacgcaaatgccaaccggttgcctttgcactatgcacaactgcgaaaccaggtgcatttcactggaatagaccttgggattcggtattgcttttggaagccatgaatctgttagaaggtgctgagttgtcaggaggatactggttcatagggaatatgctattggcatattgcttcccatcgtgcagcactacattgtcgccattttccacttctctgttattttctttttgcattctagcaccttctgttttcatagcagcacccttggctagtgcctctatataa

SEQ ID NO: 112520 - DNA, 534 bp, Glycine max
  Peptide Sequence Number=SeqID_229298
atggtgcaaggaatggttgcacaggtgcaggacatggaggcacagtctgcatgggaagtggagccgataatgatgcgggacttggttgcatgggtgtggggcatggaaacggaatcagcatgggttgcggagtcgacatggatggcggagtcgacatgggtgattggctttgttgcattggcaccgggcatgaaggcacagtcaacctggaaagcggaggcaacggtggtgactgcacggaggaagaagattggtagtggtggctggttaacgggattggcagttttagaaaaatggcatccagtttggattccatggaagcttgggtcacgacgaagcggagttgagctgcagcaagtttggccatggcggcctcgaggtggtccgccatttgagatgtgtgttgaaatggaagggatgagtctgacagaggtggttgctgatggaggcaaccaaaacaacacacaagggaaaggaagatcaattggaacattatttcaaaacatgaaagtagcagcagtgctttcacgttaa

SEQ ID NO: 112521 - DNA, 1146 bp, Glycine max
  Peptide Sequence Number=SeqID_229299
atgtctcgccatgtaatcttcattgaagaccaattccccttctcccaatccaaccctcaaccatcaccacacaattcgtggcttccactccccaatatcatacctcccttggccgaaaccgcctcaccaaattcaatggcacccaatccccaaatcgcatccccacatcactctccaatatccctccaaatcagcccaaacataactctttcaaatcactccacttcaacgtcacacaattcaaccgtaaccccacctctaaattctaataactcccacacaccaaatcaacatacatccataacacatcaatcacccagtactacccaaacatctaatcaaccaacacccgaaccacaccatccaccaagtaacaccacctctcccaaccctttaccaatgccaccaccagtcgactacacatcaacatcaacctcggtgccttcaagacctgttgcacggtccatgaacgacatacataaacccaacaaaaaattcttgctggtcacaaaacatcccataccaccatcacatgaacctacattgtctcacaagcaatggcttccctggagtggcgtgcatgccgccatggcctcaaaattcaatgcactaatccagcaagggacatgggatctagttcccaaaaataaagcctctaatctcattgggtgtaagtggatgttcagacttttgaaaactgtctacatgcaacaaccaccaggatttcacaatccagactatccttatcatgtttgcaggctaaagaaatccttgtatggtttaaaacaggctcctcaagcttggtttaacaccttgtattccttcttactctcctatgggttcatcaactccaaatccgacccgtcactgtttatctatctcaaaggtaacaatgatcaagcaatacataggtgcatttccacactagctacggtgttctccattaaggacttgggatacattcatttattccttagggttgaagccattcctaccactcaaggactattccttagtcaacacaaatatattcatgacttgcttggccacacacaaatggcagatgcaaaggttgttgattcaccaatgtccacctcttctcaactcactcaatatgatggcacaagtgcagttgacgctacttaa

SEQ ID NO: 112522 - DNA, 1680 bp, Glycine max
  Peptide Sequence Number=SeqID_229300
atgtgcacaatatcagaatcaggctataatatctgcacaaatcagaaagagactatagcacgattcggttgcgattcgaaatgtggaaatgtttccattccttaccctttcggaatgcgcaaacccaaatgctatgcaagcgagccgtttgaaatagaatgcagacacaataaaaatggttctcaaggtgagaaactgatcgcaccctacctcaagtatataaatctagaggtaatgtacattgatcttgaatacggtacggtcgggatcaagaatccaatttttcaccctggttgcgacaacactagtacaggcataaatctcgaaggtggtcctttcgtgtattcccaggattacaactcatttgtgaccgtaggttgccaaaacgcagccttgttgttgtcaaacgacacgatacttactgcctgtgtgtccgtgtgttacgacgacccaaaaaatgccaatatgatggacgtgtcaagttgtcgcggcaagtactgctgtgagacttcactgccaccgtaccttcaagcatacaacgtctcagttggaactgtagaagtgaaaagtgagatcaaaccagagtgcggttatgggctgattaaagcagattattttcagttcaattacgtgtacgatgaatacaattcaagttactgggttcctactcttgggaacctaaagaaagtaaaagatgttcctgcggtgcttcaatgggagattccgattcacatgcccaacaattccttccccgaattccgtacagatgcggattcatatgccaactacaactgcagttacactaatgttacatctgcacaatcaaaatcgggttggagatgtacatgcaaatatggcttcaagggaaatccctaccttgaccaaggctgtaaattaggccaaggtactgtttacaaagggatgctagtagatggaaatattgttgcagtgaaaaaatttaaggtcaacgggaagactgaaatccctttgcttgtttatgaattcattcccaatggtaaccttttcgaatatatacatggacaaaatgaggacttaccaatgacatgggaaatgcgtttgagaatttccattgaagttgctggagctctattttacttgcattcagctgcttctcaacccatttatcacagagacatcaagtcaagaaatatactattggatgggaaatatagggcaaaagtagcagactttggtgcatcaagaatggtttccattgaagctactcatctcactactacagttcaaggaacttttggatacttagaccctgaatacttccgtactagtcaattaacagataagagtgatgtctacagctttggagtggttcttattgaacttttaacagggaaagagccaatatcctctgcgaaacaacaagaacttaaaagtttagtttcatattttctcctctctatggaggaaaatcgcttgtttgatattgtagatgaaagagtcatgaaggaagcggagaaagaacacatcgttgtagttgccaatcttgcaagaagatgcttagagttgaatgggaaaagacgaccaactatgaaagaagtcgcattagaattggaaagtatccaaaaatcaaagaaacagtctgctgcacaagaacaacatgaagaacttgagcttcctggaattgatgacttccaactttga

SEQ ID NO: 112523 - DNA, 540 bp, Glycine max
  Peptide Sequence Number=SeqID_229301
atgtcatctggtgaagttaatgtggacaaagctactttgttcagcttaaaggatttagagaaagccactgaccactttaacttgaacataattataggaaagggaggccaaggaattgcaggagcactgttttacttgcactcagttgcatctcaacccatttatcacagagacatcaaatccacaaatattctattggatgaaaatgtatggaggaggataatctgtttgacattattgacaaaaagagttgtgaaagaagcagagaaggggcaaatcattgcagttgctaatcttgcaaatagatgcttagagttgaatggaaagaaacgtccaactatgaaagaagttacttttgagttagaaaggatcaagagattggttaaatccaatgcagaacaaaaccatgaagaaattgaacttggtagaatagaagattgccaaccttgggttgcatattccacatcaaattcgttgccaactctaagcagtgaaacaatctcatcagactcggaggttatacctattgttacattataa

SEQ ID NO: 112524 - DNA, 1161 bp, Glycine max
  Peptide Sequence Number=SeqID_229302
atgcagcagaaaactatgtcatacgcagagttttgcagcaagtcacaacccaacatcaaccttggtggaatcatcgtcaatgtaaaaaacgaggttgccatggtccaagccggagcaacacttggagaagtttattacagaatctgggagaagagtaaagttcttggcttccctgcaggggtgtgtcccactgtcgatgtcggtggccatatcagtggaggagggtacgataacatgttgagaaaacatggattatctgttgataatgtcattgatgctcaaatcgttgatgtcaaaggaaatcttctaaacagaaaaacaatgggagaagatcttttttgggctattagaggaggtggaggagcgagttttggtgtcatattgtcgtttacttttaagctagttcccgtgcctaaaacgcaggtggcgccaaccactgatgagaggcttttcatgaggctgttattgcagcccgtgagttccaaggttgtgaagggagggaacaccattagagcctcggttgtggctttgtttctcggaggggctaacgaggttgtgccgattttggcgaaacaatttccgcttcttgggttaaggaaggagaattgcactgaggtgagttggatggattcggttctttggtgggacgatgataagagtctgaaaaatggtgccaaacctgaaaccctattggataggcatgccaacactgctgatttccttaaaagaaaatctgattatgttcagaaagctattcccagagaagggttggagtttatatggaagaggatgattgagttggggaaaacggggcttgtgttcaacccttatggaaggaaaatggctcaggttcaatactctgtgacttggaaagatccttcacttgctgcggctcagaatttcttgaatcaggctaggaagctgtacagttacatgaccccttttgtgtccaagaatccaagaagtgcctttttgaattatagggaccttgatattggtgttaacaactttcgtaagaatagctttcaagaaggggaggtttatggggcaaagtacttcaatggcaattttcagaggctcatcaaggttaagactgtagttgattcgacaaactttttcaggaatgaacagagtattcccctagctccgagcaaagcatag

SEQ ID NO: 112525 - DNA, 461 bp, Glycine max
  Peptide Sequence Number=SeqID_229303
atggcctctaagaaacgtaagagtagtgattctaggccacaggaccagaatgataacaggatatttcaatcagaggaagcctggaatcgatatatcgataatattttagaccgaaggatccttctagaaaggaatgtggaactttatcattctgagttcaatgagtttaaagtagaattgggaaggcaaaactttcacaaacgcctcgtcaaccttcaggaaggaagcatagatgtggcagtggttaaagaattctatgccaatttctatagtccaactccagtgttattagaggaggggaaatccttgcccacttattctagattttgtagactaagagggccaaccatggaagctcctcagaaaagatcttaccactctggctcagacatggagcgtcttcttgtactcaaactagctcctacctcccgcacttcagatttgaacacagacagagctag

SEQ ID NO: 112526 - DNA, 498 bp, Glycine max
  Peptide Sequence Number=SeqID_229304
atgcaaaatcaggcacatgttggacatgggatgccttggtatgctcatgctattgctgaagccatcatgcgcactgcaaatttctctgtgcctctaaaaatatatgaaattggtggtggatctggaacatgtgccaagggtataatggattacataatgttgaatgctcctgcaaaagtttataacagtatgacttacatctcagttgagattagtccttcacttgctgaggtgcaaagagaaactgttggtgaagtgcgcagccatataccaaagttcagggtagaatgtcgtgatgctgctgaccggattggatgggggcaggtggagcaacaaccatgttgggtaataatgcttgaggtgtgttttataattgagaagcttttatgtcctccagttcaaatattttttccagtaaaggaaaaggacttgtggaatggtcacgggagaagagtttcaaatcctattatgtttctgaagcaaataatgcattactaa

SEQ ID NO: 112527 - DNA, 483 bp, Glycine max
  Peptide Sequence Number=SeqID_229305
atggcaatgaaacgcaaagaaaagttcttcaaacaaaatggagggttgttgttagaacaaagactatcttctggtgaagttaatgttgacaaaattaaactcttcagcttaaaggacttagagaaggccactaattactttaatataactagagtacttggtaaagcaggccaagggcaaaagccaatatcctctgttaaagaacaagaacttaaaagtttagctccatattttcttctctgtatggcggaaaatcgtttgtttgatatcattgatgaaagagtcattcaggaaggggagaaagaaaacatcattgtagtttccaatctagcaagaagatgcttacaattgaatgggaaaaagcgaccaaccatgaaagtgacattagaattggaaagtatccaaaaactggaaaaacaatctaatgcacaagagcaccatgaagaacttgagcttgctggaattgaagatagccaaatttga

SEQ ID NO: 112528 - DNA, 267 bp, Glycine max
  Peptide Sequence Number=SeqID_229306
atgctttctcgcactcgcacctttcctctcatttccctcgcttccaaagtgtgtgcccctccactggaagccctctactccacccacattgtcggcgacaagcccgttctggttcgggattttattcattctgcactctaccatccgttacatggctacttctcccaaagatcgcggtccgttggagttcttcctaatgctattaagttcaaccaacttcaaggtgctgctccttgcattcgtttatctgttatcttagttatttga

SEQ ID NO: 112529 - DNA, 246 bp, Glycine max
  Peptide Sequence Number=SeqID_229307
atgtccattggatttaatgatgaaatatgtgcaatttcaggtgaaaataagttgagcttagctcatcagtgggctaagcgtgcatccaccgctaagcgcagcttcaacacgcttagcgcgatagaagaatctgacaggacatcatcatcaaggtcgcgtgctaagcgcaagattagtgcgctaagcgtagcagttgtcttcagccaggctcagtgcacgactagggctaagctcaaatccacttag

SEQ ID NO: 112530 - DNA, 666 bp, Glycine max
  Peptide Sequence Number=SeqID_229308
atggctacaaccactgtcatcactccactactattctgtatctgtgtttgtcttggcttctgctccagttctttgtcagaagcaacaccagttggttatggctacatcatctcaactgttaacagttatcccataagcgtctctttggctgcaaaccttaaactcatcaaaccatcctcggttttcggacccgacattccgcacctctctcttgctgccagttttgagaacaaggatagattgagagtaagaatcactgactccaacaaccaaagatgggaaataccccaacaagtccttcccagagggtccccttcccaatattaccctctttactacttcaataccaaccaaggtttccaacactctctcagtctcacacatccagactcagaccttgttttcactctccacaacaccaccccatttggcttcacagtctcgcgcaaatcctccaacgatgtcctcttcaacacggcacctaacccttccaaccccgaaacttttcttatttttaaggatcaatacctgcagctctcttcctctcttccatcacaaagagcctctctattcggcctcggggaacacaccaagagctccttcaagctgcgaccgaaccagacccttacactgtggaatgcagacattggaagtgacaacttggac

SEQ ID NO: 112531 - DNA, 144 bp, Glycine max
  Peptide Sequence Number=SeqID_229309
atgacgtgggctaagcgtgcatccaccgctaagcgcaacttcagcgtgcttaacgtgacagaagaatctggcagggcatcaatatcaaggccacgtgctaagagcaagatcagtgcactaagtgcagcaggtgtcttcagctag

SEQ ID NO: 112532 - DNA, 150 bp, Glycine max
  Peptide Sequence Number=SeqID_229310
atgcccagggcacagaatttcatagcacactacggtgcctatttcgggaaaagagctttggaggcagcaagaggagcagcttttgtagagatacctaggttttgtgactttagcattgggaaatgcactgttgccttaaaagttgattga

SEQ ID NO: 112533 - DNA, 393 bp, Glycine max
  Peptide Sequence Number=SeqID_229311
atgaaccctactgattttcgctttctgcttgctccttcttccattgaagctccttcacctgttcttccattgaagcttctaccccttcttccattgaagctccttcacctcttcgacttcatcgctccaacttctccgctcgaagtttcgttaattggttcgtgtactgttgaagaaaggcttgaggtctttgaccgtgagaagtttaacaattgggtggagaagggtgtagctccagccattgaacccagtttaaagctctatgaagatgttttgaatctgggattcaaggttattctactgacaggacggagtgaaaggcacaggagtgtcactgttgataatttgatcaatgctgggtttaaggaatgggaccagctcatactaaggtaa

SEQ ID NO: 112534 - DNA, 918 bp, Glycine max
  Peptide Sequence Number=SeqID_229312
atgaatggattactagaatccaaagcaacaaacaaggcattgacgaatataactggagacaatgctgcttcatggaatgatttggcatactcaatccgggctatattaaattccggaatctttggaattccaatggttggagcagatatatgtggtttcttaggaagtacaaatgaagaactttgccgccgttggacacagttgggggccttttacccttttgccagagatcattcagacaagaactccaataggcaagagctttatctttgggactccgttgcagattcagctaagaaagtgcttggcctccgttatcgtcttctcccttatttgtacacactgatgatgtcacaacttaacgaaataagctcacaatttctattaggtaaaggggttctggtgtcacctgtgctaaaatctggagcaaccactgttgatacatacttccctaaaggaaactggtttgatctctttaatttctcgaattcggtgaacggcgaatcgggcaagaatgtcactcttgatgctccatccgatcacataaatgtgcatgttggggaaggtaacattttggccatgcaaggagaagcaatgacaactgaagctgctcggaacactacttttcaacttgacatagcagggacattggtaagctttaatgccacattactgaacactactagcgttcttgttacatctaaggttaccaatggagcatttgctttggacaaaaagtggatcttagagaaagtaactgtgttggggatacctaagcaaagcaagaatttagcaaggaaaaatttgaaatttgtgaaaacacaaaatgatacctcctcacagtttgatattgtggaagtttcaaaattgtctcagcttattggagaggactttaagatggacattaaaatcaggtaa

SEQ ID NO: 112535 - DNA, 669 bp, Glycine max
  Peptide Sequence Number=SeqID_229313
atggctacacgatggaggactgaggtcgctaccactatcaacactaagatgatcttttgtatctctttgactgtcaaccttaatctcataaattccctctatatttatggacccgacatcaaaaacctctccctcactgccagttttgagaccaaggataggctgagacgaaaaggtgcccctgaaagttctcctacgcctcagcctcagcctcagccacaagactctccttcaaatctcacactaactcatccagactcagaccttatcttcactctccacaaaaccaccccatttggcttcacagtctcacgcaaatcctccaatgatgtcctcttcaacaccacaccagacccttccaacacctcaaattttcttatttttaaggatcaatacctgcaactatcttcctctcttccacctcaaagagcctctctttacggtctcggtgagcacaccaagaaatccttcaagcttcagccgagcctcctcaccatgtggaatgcggacattcctagcgccaacgtggacagcaacctctatggctctcaccctttttacatggacgtgagatcaacctcctccgatggaagagtgaaggccggcaccacacacggggtgttgcttctcaacagcaatggaatatatggacgtcgagtacatcggtga

SEQ ID NO: 112536 - DNA, 255 bp, Glycine max
  Peptide Sequence Number=SeqID_229314
atggtggctcatgaggaaaatacaaggatcatgtatgagcaaacatgtagaacaaaaaggcccggaaaatcatctctccttactgcgtatttgggggcgcagtgccccatgtgtgcagttaagaagacgatatggatctttcgacttcccatgacaaaagacgagatccacatacaaagcatgtgtgacggcatgatgcagatgcgcaaaagcgcaacagggggatgcacagagtacgacaatatccataaataa

SEQ ID NO: 112537 - DNA, 1626 bp, Glycine max
  Peptide Sequence Number=SeqID_229315
atgggagtcctttctcctcatagaatccaactatcattcttttccattgtcgtgttgctttctattccttggtcagcttcagctgcaaattcagctcccaacacttttgttcaatgccttctaaacaactcagagccctcttaccccataacatcagcaattttcacaccaaacaactccttattctcttcagtcttggaagcctacatcagaaaccttcgtttcaacacctccacaacccggaagccattccttatagtgaccccttctcatgtttcccatgtgcaagcagccattgtttgtgcaaaaaagcacaaattgctgatgaaaatccgaagtggtggccatgactacgaagggttgtcttatgtggcttcacagccactcttcatccttgacatgttcaatcttcgatccattgagattgacatgaaaaccgagacagcgtgggtcgaagccggtgcaacgcttggtgaagtttattacagaattgctgagaagagtaaaattcatgctttcccagcaggggtttgtcccactgttggggtaggaggacacataagtggtggtggctatggcaacatgatgagaaaatatggtctctcagtggataatgttattgatgcactaatggttgatgttcaaggtagattacttgatagaaaatcaatgggtgaagatctcttttgggccatcacaggtggtggtggagctagttttggtgtggttcttgcctacaaaataaaactagttcgagttcccgaaacagtcactgttttccgggttccgaaaacgctggagcaaaatgccactgacatagtttataattggcagcatgttgcaccaaccatcaacaacaaccttttcattagacttgtcttgaacgttgtgaacgttacacaaaatgaaacaaagactataagagcaaccttcgtagctctattccttggtgactccaaaagccttgtttctctcttgaatgacaagttccctcaattgggtttgaagcaatccgattgcatcgaaacaagctggcttggttcagtgctgttttggacaaacatcaacatcacagctccggttgaggttttgcttaatagacaaccacaatcagtcaactacttgaaaaggaaatctgattatgttaagaaatcaatttccaaagagggtttggaagggatttggaggaagatgattgagttggtggatacatcactgaatttcaatccttatggtggaagaatggctgagattccttcaacaacatctcctttccctcatcgagctgggaacctatggaagatccaatacctagcgaattggaataaaccagggaaagaggtagcagatcactacataaacttgacaagaaaacttcacaagtacatgactccttttgtctccaagaatcctagaggggctttctttaattatagggaccttgacttaggaagtaataactacaatggtaaaaatagctatgctaaagggagagtttatggagtgaagtatttcaaggataacttcaacaagttggttcaaataaagaccaaggttgatcctgataatttctttaggaatgaacaaagcatccctatgctaccatatcataaattattagagtaa

SEQ ID NO: 112538 - DNA, 123 bp, Glycine max
  Peptide Sequence Number=SeqID_229316
atggaagtccctgaagatatagcaaagctaaatgctcggcgcttgcaaagaattgaacaaaggcttttaatctcgtgcttggtaagcaaagctttacataagttattggcgacagctctttag

SEQ ID NO: 112539 - DNA, 1167 bp, Glycine max
  Peptide Sequence Number=SeqID_229317
atgccgtttccgtggaagaaaaaccgcgtcccccgaatctcccaaatcgtcgccgatctccaatcgcccaaacgcggcggctccctcgtcgtcgagaccggcttccccacctccctcatcgaccttttcgtcaaaaaccgaagtcgcttccaaaaacaccgctccaaaaaaccaccgccgccgccgccgccaaaatccctctccgccaccgatccgcctcccccgccgcctccctctccggccacctctccgccgccacgcgtccccacctttccagccactccaatacaacaaaacgacaccgccgtttcggctccggatcgaattgcccagtgctctccccggtcgggtgtgaacgctgtcgttctcgtcgcgaagattctgatggtgttggttctggtcgcgagcgtggagaggctcaccgtcggaatcaccgcgtcggcgttctcccttctgcttctcgaatacgcaggccggcgcgtcgtggtttcgtgttctgttccagaatcatggtggttccaaaaggttgggatgaaggagcgtgttgaaagaattgaatttgaatccgaggaattgagcaacaagggtttgtcaatcgatgaaattgaggatgtggaaacaaccgacgaagtgggtgttagttgcgaaattggtgacgtggcattgaaggttttggagccgtgtttatgtgatgaagatgtttctgaatgcaagattagacctagccgaagtggtaggtttaggtccaagatggtgaagcttgtttctaagaaatttcgtgggtctaagaaagagaaaaagggtgaggtgaataaacacaatgagggtgagtcagggagtgaaatttcaagcgctgtgggggaagaaaagttaccaattttagaaattgaagtagaggaagagaatggggataataagtcaagtaacagtaaacttgattgtggaatcacttgttcctatgataatgagaagagagtggaaagagttgggaattcagatgaagatacacagctggtaaaagattcatgttggtctaaaagactgaggagtgaggagaggattattcccatgataggaactccaaccatttgttgggaatccaacttcatgcgttgtactttgagatatggatggcaaaagattgaaaaggttagaagatgcagatag

SEQ ID NO: 112540 - DNA, 123 bp, Glycine max
  Peptide Sequence Number=SeqID_229318
atggctgcatctccaaccaagaaagctatggatgaagtacctaaccatgattcacaacatgaagtgtctgttactccagccaactctcaactaccaagaagcatatcaagaatgaatgaatag

SEQ ID NO: 112541 - DNA, 867 bp, Glycine max
  Peptide Sequence Number=SeqID_229319
gttgggcatcttggagaagcttatgaagagtgggttcaccagcccattgtcagcaaggaaggcccccgtttctttgaaaatgagattctggagttctggaacttggtgaaactcatggcgaccacttcaactgctcctgctttgtttggaggtggtttattgggttatgtaatgtatgattgcacccattattacttgcaccatggtcagccaaggactgaagtgccccgaaatctcaagaagtaccacttgaatcatcactttcggatccaggataaaggctttgggatcacttcatcactatgggataaagtttttggaacacttcctcctaaaatggatgccaaaaccaaatatggatttggctgccaacctgtcccagtcattcgaaatgaaactgaagcctctcatacttggcgtgggatcgttatgacatggagtcatattgaagataatatcacctggagtattaataatggtgattcagcccgtttctggactgaccgttggattcctggtttccaacctctctcttctatgatgcagaatgtttgttctaccattgctgcaataaatccacctgttcaaggttacaaagatactccaatatggtgtacctcgagaaatggtatgctatcagttaagactgcatattggtatcttgcaggttattatgataatcccagggatgagtctggagatttcaagatgatttggagatatgaaggccctcagagagtttgtttgtttctatggaaattgatgcatgggaggttgctccctaatgaagaaagaatccgtcgccatatgacaaatgacagtgctagaatccattatgcacattctgtgattgtgaagacatcatga

SEQ ID NO: 112542 - DNA, 261 bp, Glycine max
  Peptide Sequence Number=SeqID_229320
atggtttgctttatattgattgacaaggttggtcggttcagaataccactggatggaagtccatatggaacactagaggcggcattggagccaaatgaacatgggagaggaggcatcgacatatgcagtattggagccaaaggaacactagagtatactgtctccaagaagttatttgtcttgactatggcgacaaaggctttcaagagacattggtattttgcaccaagtgtaaggcttaagcgttgcataggtacttaa

SEQ ID NO: 112543 - DNA, 316 bp, Glycine max
  Peptide Sequence Number=SeqID_229321
cgctaaggcaatcaattctcgacgctccagactcgatggtggaggacgcatgaacagcgctaggcaatcaattcatggttctccgaataagattgagaatggagaattggcgaacagcgctaggcaatcaattcgtggggctccagactcgatggcaatcaattcgcggggctccagactcgatggtggaggatgcatcaacagcgctagccaatcaattcatgggtctccgaataagattgagaatggagaattggcaaacagcgcttggcaatcaattcgcgacgctccagactcgatggtggaggacgcatga

SEQ ID NO: 112544 - DNA, 218 bp, Glycine max
  Peptide Sequence Number=SeqID_229322
atgccgacaagtgactacgatggaaacggtaacgggctgacaaagattgaagttggtgacgatgaagaaggtcatccaacggtgaaggctcaaaccattgatgagcttcactctttgcagaagaagaagtctgcaccttccactcccaagggcacttttcctgcgtctaacagcgtctttaccgaagaacgcaacaaacagcagctagagtccatcag

SEQ ID NO: 112545 - DNA, 315 bp, Glycine max
  Peptide Sequence Number=SeqID_229323
atgacttctaaagacctagaacatctgacacaaaaaatcaaggaccaactggagctgttgctcactgaaaaaggactcgtactgcctcctaagcctgaggttggtccttttgttgctcctgtcaacacaaagggaagctctatcgatccctcggggcaagacccatacacagatgaatcagacaaatgtgggttttatgttgatggcattcatcctcgcctagttgcccttggaaaagtttatgaggggtcgacaatcatccacaacatccctttgggcaatcatcaagtgaaggtcggtgttgaggaagtttga

SEQ ID NO: 112546 - DNA, 390 bp, Glycine max
  Peptide Sequence Number=SeqID_229324
atgagaggattgcacgccctcgccttgagagagctacacgtcctcatcttgggtactagttaccctcaccgtcagaggactacacgtcctcgccttgagaggactacacgtcctcaccatcagagggctgcacgcccttacctccagaggactacatgtcctcgccttgagagggctgcacgccctcaccttggaggactacacgtcctcgccttgagagggctacacgccctcaccttgggtactagttaccctcaccgtcagaggactacacgtcctcaccttgagaggactacacgtcctcaccatcagagggctgcacgcccttacctccagaggactataaatcctcgccttgagagggatacacgccctcaccttgggtactag

SEQ ID NO: 112547 - DNA, 462 bp, Glycine max
  Peptide Sequence Number=SeqID_229325
atgggaaagttagatcatttagaggaaaggttcagggccattgcaggaggtgaagattatgcctttgctaacctaaaagagttgttcctagaacccaatatcatcacccctcccaagttcaaggtgttggactttgacaatttcaaggggactacttgccccaagaaccatctaaagatgtattatcggaagatgggggcgtacctaaaagatgaggaattgctgatacattccttccaagaaagtcttactggggacctagtggttgccttcgttaggcagtgtcagtataatgtcgtcagattaggatgcaactaccaaaacatgtgcaaaaagggggcacagatctttcaaaaagaatacgcccaaaaggtggagagacctgacaactcaagtggcacctcaatgacggagaaaaatgatgacaatgatagtagacacattaccagtattctactatga

SEQ ID NO: 112548 - DNA, 501 bp, Glycine max
  Peptide Sequence Number=SeqID_229326
atggtggcgcagctcgatgcggcgctgtatcactatggtgagctgctggaacgggaaaccggccgcgcggtgctcacccagccaggggcgggtgcggcgggcggcatgggggcggcgctgctcggcatgctcaatgcgcgtttgcggccgggcatcgagatcgtcaccgaaaccctgtgcctggatgaggcggtgcgcgatgccgatctggtgatcaccggcgaaggccggctggacagccagtcgatccacggcaaaacgccgatcggcgtggcgcgggtggccaagcgccacggcgtgccggtgatcgccatcgccggcagcctgacgtcggattaccaggtggtgcatcaacacggcatcgacgcggcgttttcggtgctcgatggcatcgtgacgctggaagaagcgctggcgggcgccgatcgcaatctgcaggtgacggcgcgcaacgtggcggcggtgtggcgactggcgcaagggggaggcccacaggcatag

SEQ ID NO: 112549 - DNA, 132 bp, Glycine max
  Peptide Sequence Number=SeqID_229327
atggctgctgacatcccgacccagaacggaatgccggccggaaaggaaatgaggggaactgagatgaagcaagagaaacacggcgtattgctggtgaacctgggcacgccagatgcgccgacctcgtcggcg

SEQ ID NO: 112550 - DNA, 147 bp, Glycine max
  Peptide Sequence Number=SeqID_229328
atggatcaagggatctcccaattatgtggccccgcatgcccccggactctcgggtcatgcatttcatttctaaacaaccatttagaggaaacaccgggtccaacaaagataggagaaaatcactcaaagtgtatcaatctcacacag

SEQ ID NO: 112551 - DNA, 534 bp, Glycine max
  Peptide Sequence Number=SeqID_229329
atggtgttttgtactattgatgactttccaacagatggaaatttcactggatatagtgtcaaaggacaccatgcatgtcctatctgtgagagaaacacaagctttacccaattgaaacatggaaagaagaaattttatacaagacaccgaagatttcttaaaccttatcacccgtatcgacgattgaagaaaacttttaatggaagtcaggagaatgaaagtgcgccgcaaccattagctgtaaacgaagttcatgatcaggtgaaggacatcataactatctttgggaagacccaaaagaagacatcatctaagatgaacatatggaagaaaaggtcaatattctttgatcttccatattggtctagtctacgtgtgcgtcactgtctagacgttatgcatgtcgagaaaaatgtttgtgatagtttaattgatacccttcttaacgttaaaggcaagacaaaagatggtttgaaatgtcgtcaagacctggttgacatgggaatacgagagcagttgcatccgatatcataa

SEQ ID NO: 112552 - DNA, 1356 bp, Glycine max
  Peptide Sequence Number=SeqID_229330
atggccttttcatctggtttagaagactcaaactcaactacagaagtaatactcacccaaagcagctcttcttacacatcccttttgcaatctttaataaggaacctcagattcttgaacagttcagtcccaaaacctaacctaattgtcactccacaaaacctagcccacattcaagcagcaattacttgttcaaggaaacatggcctacaagtgagagttagaagtggagggcatgactatgagggtctttcttatgtctctgatgttccattcctcatcattgatctcataaaccttaggtccataaacattgacattaatgatgaaagtgcatgggttcaagctggtgctactcttggggagctctgttatgcaattgcaaaaacaagtaatatgtgtggcttcccagatggtagttgtcccacagttggtgtaggaggccacttgagtgtagttggatttggcacaattttcagaaaatatggccttgcagctgatcaagtaattgatgctgaaatggtagatgttaatggaaacatactaaatagaactttgatgggggaagatcttttatgggacataagaggtggtggagggtcaagctttggagtgatcactgcatggaaagttaagcttgtacctgttcccccaaaagtgacaattttcaatgttgcaaaaacacttgatcaaggtgcaaggacagctgagaacctgcttcctttgatgcaaaacaattttgctgagttgggtttgcagctcaacagcttcactgagatgagttggattcagtcagttctttacaaatacagattattcaatcaatggacccttggaggttttgcttcagagaaaccaaacattcagaagcttcaaagcaacatcagactatgttacagaacccattcctgtggcaggtttggaagggctgtggaacatgttgctcgaagagaacacagtcaacacaccaatctgatcctgacaccatatggagggagaatgagcgagatttcaggatcagaaactccatttccacatagaaatgggagcatatatgggatccagtatttggtgtattgggactcaaatgaagaaacaccaaagcacatatatgggatgagaagattatattcatacgtgacaccttatgtttcaaagtgtccaagggctgcatatttgaattatagggaccttaacctaggagtgaaccgaggcagcacaagctatgaagaagcaaaatcttggggtgtgaagtattttaagtttcattttgaaagattggcacgagtcaaagctgaatttgatcctagcaatttcttctggcatgagcagagcattccaccttcgtttaattaa

SEQ ID NO: 112553 - DNA, 1065 bp, Glycine max
  Peptide Sequence Number=SeqID_229331
atggtccttgagggtcttgctgaagatcaaaatatcattaaagaagacaatgatgaagtgacagagatatggccggaaaatggcattcatcattgcctgaaacgaggagggggcgttggtatctataaggccgaacgtgtttgggtctgcatttgggacgaggtgaatgcgatgattggtgggtctagagggtgggtgttctgttggggtaaattggagatgaaagtaggtgcttgtagtgtctttacgaacagttcaacgaagctgatgaggggtgatgagattccgttaataccggcccgagagactttagccattgcacacccagaacaagattggtttcgcacaggggcaggacatgaagatcaacacagaaggcttcgaaaagaaggtgataatccaacgtgtgaccattgcccaccatcacccgcaagggagctatttggcacagtgacaagcctacgactaggcccaccaggcgcaggatttcaagggcgagatggcccgaaaggcgtcttcgaaaggcttttcataatccccaataagcagaaatgccctggaggaacacttgtggccgcaatgaaatttttcatcgcagttgaaacaaaggccttgttcgcgctgcaatgtcagctcctccagttagaggcgctagataggaaccgcggggagcaacagccaccggcggcgcgagaggcgttggtgaagaaaaggaagatgatcgaggacgtggcggccgacgaccgtcaaatagtttctcctcctggagacgggccaaccctgccgcctggaccaagtcctgagatgaagcaagttaagaggaattgtggcggcaaaccaacaatccgattggccaagttttcaaacttcgccagaggatggggacgcaagaggtggtacagctgtggaagaaaaggggataaatggttctgtgagagcttggtgatggcatcctccaaatggtttgagtttgctttggagcgagtggactcaaccataaacaaggttaatgaaagcaccaatgttagggaaaagagaagaatgagactcgacttcgagggctag

SEQ ID NO: 112554 - DNA, 1317 bp, Glycine max
  Peptide Sequence Number=SeqID_229332
atggtctcgtctcaaggggtagcatcggtgccaatgaaaatcctcgccattcgtcaatggcctacaccacactcggctcaaaccttacgcagttttcttggcctcgccggcttttaccgccgattcatttggggttacgcttcgattgcggcaccactaacaaggttgttgggtcaggatcccttcgagtggtcaccggaggcagatcgtgcctttcttgacttaaggcaagtgttgactaatgcccctgttttgcaactccctgactttgaactttcatttacggtggaaacgaattcgtctggtgtcgacgtagtgttatctcagaagagatatccacttgcgttcttcagtaaaccttttccacccaagcttcttcgtgcttccacttatgtgcacaaactctttgccataaccactaccatgaagaaatggcatcaatacctcttggggcaccgtttcaccatcatcaccgatcatcgtagcctgcgagagttgataatgcaagtgattcaaacacctgaacaacaaacgtatttggctaaattgatggggtacaattactccattcaatgtcgttcaagatcggctttcattccaacattactcacagaataccactcatctcccattggagggcatatggggatctcgaaaactctcgcttgtattaatgataactttttttggcccggaatgtgcaaggatgtcgccagctttgtcgtacagtgccttgactgtcaacatacgaagtacgagaccaagaagcaggccagcctcctctgtcctctaccagtctctctccgcccttgggaggacttctccctcgacttcatcgttggtctgccaccatttcgaggctatacgaaaattttggtcgtggtgaatagattttcgaagggcatccacctgggtatgttacccacccaacactccacgcattcagttgccatgctcttcatggacattgtgggtaagtttcacggtatgcctcaaagcttaatctctggtcatgagtcagttctggcaggacttattccggctaagtggcacgactttgcgaatgagctctgcctaccatccgcagaccaatggtcggacggaggtattgaacagggtcatcaagcaatgtcttcaagccttcgtgcatcagaagccatcatcgtggggcaagtttttaaattagatcgagtggtcctacaacaccttgatccattttggttcgggtttgtccccatactaattcacctttgtcaagaagcccctttccattccacaataccttacaggcacttcaaagctggacgtagtggatga

SEQ ID NO: 112555 - DNA, 420 bp, Glycine max
  Peptide Sequence Number=SeqID_229333
atgccacccaccaggcaccctctggacccagataaatctaacagggccctggggtttctggcatttatcacgggcctcttccagtcgtttggggttcccgtcacccccagtacaatgatccgaccgccgatcacccaagccttcatcgagaagtactgcacgcctaaacaggcgcagggtgaggcacatcaggccgtagtcgcaccgccaccacctcatcaggccgatcccgctggatcactaggcatggagcattatctacagcacttggttcaccagcaggcggccaaccaccgggggcagcccgaggcccaggtaggggaagagcctacaggatcccccggtgaggtagaggaggctcgtatggatgaagaaatgattgacttgctcggtttcttgggaggaagcggagccatgtga

SEQ ID NO: 112556 - DNA, 786 bp, Glycine max
  Peptide Sequence Number=SeqID_229334
atggcttctatacacagccttaattgttttgttttctttctactattggctcttggcattagttctgccagaaggtcccttctcactcttgatggaggctatggtgtaggccatggcattggtggtggctatggcggtgctgctgctggaggttatggtggtggtggaggtggtggttcaggtggtggcggtggatatggaggggagcatggagttgttggctatggaggaggtagtggtggaggacaaggagggggtgtaggatatggtggtgatcatggagctggatatggtggcggtggtggtggtggaagtggcggtggtgcgggttatggtggtggtgtagagcatggtagtggaggtggttatggtgaaggtgaaggaggtggagctggaggaggatatggagctggtggagaacatggcattgggtatggaggaggaggtggaagtggtgctggtggtggaggcgggtatagtgaaggaggagcacatgggggtggatatggcagtggtggaggagctggtggtggtgaaggagggggaggggtaggtggttatggtggtggcgaaggagctggaactggtggagggtacgatgcaggtggagaacatggtggtggttatggaggtggtcaaggaggaggaagtggaggaggatatggtgctggcggagaccatggtgctgctggctatggagttggtgaaggaggtggagctggtggagggtatggtgcaggtggagaacatggcattggttatggaggagtggtggaagtggaggag

SEQ ID NO: 112557 - DNA, 696 bp, Glycine max
  Peptide Sequence Number=SeqID_229335
atgggaacaaatcaaaccggcaagaggttttaccaagtcaaggttaaaggcctagatacctccagcatcaaggaattaggacagttgatggaacctctccgaatgcaagccttccgcaagacttacggaaagatcttagatttgaccatagcagagatatccatagaggccattacgtcactcacccaatactacgaccagcctttgagatgcttcatgttcggagacttccaattggtaccgaccattgaagaatttgaagagattctaggatgtcctctcgagggaagaaaaccatatcttttcttcgggtgtctcccctctttgagcaggattgcaactgtggtcaaagattcagcaaggggtttggaccgcgtaagacaaactcgaaacggcatagcgggcctaccatggaagtacctagaagacaaggcgagggatatggcaaatcaagaagattgggtcccgtttatggatgtgttagcattgctaatctttggggtcgtcctctttcctaacgtagatggtttggtggacctagccgccatcgacgctttcctcgcataccactatagcaaggaaagcccggtggtagctgtcttggcagatttatttgacacatttgaccgaagcaagacacgagacacccgtgtccgcttcagagccatcgctcgtgtactgaaaagaggagaatag

SEQ ID NO: 112558 - DNA, 363 bp, Glycine max
  Peptide Sequence Number=SeqID_229336
ctggctgcgcagcgcggcaacatcgcgctcgccgatcaggcggcgcagggtgatgtagagggtcttgtaggacatgggggtgctctccaggcaaacggcgcctggcggccccccgtcactcaggcaggcaggggccggcgggcaggcgccaggaacaggcaacaagcggtcatccggggcgcggtgcgcccggcagggtcggggtccatctgcgtctccatgaggggagggtgccggccaggattgccctggccagtggcgctattgtccgcccctgaatgggacgggcctagaggctcgtgggttagcccggctataccttggtatagccggcatgcgcagcgccagtcgagggctcaatga

SEQ ID NO: 112559 - DNA, 330 bp, Glycine max
  Peptide Sequence Number=SeqID_229337
atgacaaagaattggtccactatgcttgccacactatctacaagtatgcctaacttcacttgccaaaagaacatgaacaaaattaataacttcaactaccttaaccaagaatgcctaaccataatgcctaacttcagagttcataatgccaaactatctccagagttcatactacctaaggaagaatgcctaacttcaatgagacaaagtaagaccgagagacacaacgacaacagaggtgagatggagccgagaacacagagcaacaatgaagaggaacaacgtgcaactgagatggagacaggaagaaagggcagcgggaaagagtaa

SEQ ID NO: 112560 - DNA, 129 bp, Glycine max
  Peptide Sequence Number=SeqID_229338
atgtatcgtgagccccgtggctcgttcggtgtagaaggtcgatcgaaagtcggcccgtgcgatcataccagcactaatgcaccggatcccatcagaactccgcagttaagcgtgcttgggcgagagtag

SEQ ID NO: 112561 - DNA, 1741 bp, Glycine max
  Peptide Sequence Number=SeqID_229339
atggcgggcggttatctgcagcagcgcattgacgatcgcatcgaggcgatgatggcgatcggcgtggatgagatgagctgggacgatctcgacgacagccattacagctggccggacgtggccgaggtgcgcgactaccgcggcaaagtgaaaaccgtggtaagtgaattcatccgcaccatgccgctggatctgccgattgactgggacagtccggcgtgggtgattctgatgggcattgagcatgagcgtattcacctcgaaacctccagcgtgctgatccgccagctgccgcttgagtggataaaaccgcagccgcactggccggcgtgtccgcaggcgcgccacgatcgtgcctcggtaccggccaatacattggtggcgatgccaggcggacgcgtcacgcagggtaaaaccgatgatacctacggctgggataatgaatacggcagccttacaactgagctgaaaccgttcaaagccagcaaaatgctggtgagcaacgccgagttctttcattttattgccgccaacggctataacgaacgccgctggtgggatgacgaaggctggggctggcgcgagtttgcccaggcgcagatgccgactttctgggtcggcgacatcgcgcaacctgacgatctccggctgcgtctgatgaccgaagaagtggcgatgccgtgggactggcccgccgaagtgaatcagctggaagcggcggcattctgccgctggctggcagaagagagtggcaaagcgatccagctgccatgcgaagccgagtggatgcagctgcgcgagcaggttgccggcgatcagccggactggatcgacgcgccgggcaacatcaatctcgcccgctgggcctcttcctgtccggtagaccactttgcccagggtgacttcttcgacatcgtcggcaacgtctggcagtggaccaccacgccgaccaacggctttgaaggcttcagggtacatccgctgtatgacgatttctccacgcccacctttgacggcaaacatgcgctgatcaaaggcggcagctggatctccaccggcaacgaagcgctgaaatcctcacgctacgccttccggcgccacttcttccagcatgccggtttccgctacgtggtttcctcgcatcaggagagcatggcgctgaatccgtatgaaaccgacagcatggtgtcgcagtaccttgatttccagtacggccccggctattacggtgtgccgaactacgcggcggcgctggtcgacatcgtgctgccgcactgcgcgcagcgtggccacgcgctggatatcggctgcgccaccggtcgtgccagctttgaactggcgcgccattttgctgcggtcaccggcatggattactcggcgcgctttatcgacgtggcgctgcagctgacctcgggcgaggatttccgttacgtggtgccggaagagggagagctggtggagtatcgccaggtgcggctgaaagagtttggtttcgatgagaccctggcgcagcgcattcagtttgtgcagggcgatgcctgtaacctgaaaccgcagccagatggctacgatctggtactggcctctaacctgatcgatcgcctgcgccagccgaagcgcttcctgcaggacatcacgccgatgatccgctccggcggtttgctggctatctcctcaccttacacctggctggaagagttcacgccgaaggagaactggctgggtggtttccgtgaaaacg

SEQ ID NO: 112562 - DNA, 227 bp, Glycine max
  Peptide Sequence Number=SeqID_229340
atggccaaagtagaagatcagcggatggcgcagggtgatggctttattaaagtacgcgcgctcatcggcgaggcagtcgaacaggctttcgtacagctcccaggtctgggtgaaataggccagcagttcggcgcgtttggcgtcgctgctgctgccggaaagccgaacggtgcgggtgggcgcaggcaattgatcgtgaagatgagcggttgtcacagtgaacttcc

SEQ ID NO: 112563 - DNA, 327 bp, Glycine max
  Peptide Sequence Number=SeqID_229341
atgacagaccttctcaatgagtcaatctcttgctttctcataagggtggactcttgggtactagtaccctcaccttcagaggactacacgtcctcaccattagagggctacacgtcctcgctattagagggctgcaccctcatcttaagagaactacatgtcctcgccatcagagggttgcacaccctcgccatcggaggactacacatcctcgccttcagaaggctacacgcccttgccatcagaggactacacgtcctcaccttcagaggactacacgtgcttgccatcaaagggctacattcccttgcctttagaggactacac

SEQ ID NO: 112564 - DNA, 303 bp, Glycine max
  Peptide Sequence Number=SeqID_229342
atgggtgacttagacaaatgcgggttgtatatcgaagaaaattcttctcaactagttgccctaggaagagtttatgagggatccataactgttcacaacatccctttgttgcatggccaagtgagggttggtgttgaggaggttaaagatgcagaggctcccgttcctgtacccactgacgaggcagttgtgtctccagcaaaacctgtagatagggtgcatcctgaggtcaatgatctcctatatctgatgacattggtcatcccacagcttttcttgagacctctccaggcatctaactga

SEQ ID NO: 112565 - DNA, 207 bp, Glycine max
  Peptide Sequence Number=SeqID_229343
atggagtccttactcatagttatatcatatgctggctccttttttaaggctacttactgtgaaagggggctaagtcgcgcttctgtaactgaatatcttatacagcacatgctggagatgaacacaaatgtgcttgtttgtgtcctgatttcttctagtaaatctctatgcagcttctttaatttacctcgagtcagttgtgtataa

SEQ ID NO: 112566 - DNA, 220 bp, Glycine max
  Peptide Sequence Number=SeqID_229344
gattcctgaacataagggatgggttgtccctgtgtggttcagaagttgtaaatggatttttacaaagatagtggaaatctcaagtgggttgcttgagtactggacttgccatatagggaattggaaaggaggattggtgccatcccttgaagaatttgagtcaagaagcaaagggccaaccaccttaagagctattggactaagaagcactccaaattga

SEQ ID NO: 112567 - DNA, 270 bp, Glycine max
  Peptide Sequence Number=SeqID_229345
atgaaagcggtactcccgtttgaggtagaggtcccttcccaaaggatactagcaaaatcaggcttagaagaatcagagtgggctcgaacacgctacgaccaactcaaccttattaaaggtatgcgcttgacggccatgagccatgggcgcctgtatcaacaaagaatgaagaatgcgttcgacaagaaggtgcatttgcgcaagttccatgagggggaccttgtgctgaagaagatgtcccatgctgttaaagataatcaagggaagtga

SEQ ID NO: 112568 - DNA, 582 bp, Glycine max
  Peptide Sequence Number=SeqID_229346
atggatcgtcccgtcggacgtaagcgagcacaggtatgtgaattgaaccaaaaggcttccccctggcgccagcctgatctatcctgtagccgacatgacagtcgatgtgcctccggacggcgagggtcgccaaggcaatgtccggccacaagcgacttcgaaactcggccggactctcaatggagagtcgtcatgtcggaacaatctgctgcattgccgtccctgccctttgcgcccgtcgatgtttgcgacggaatacatgctgctgtcgccttcgaggtgctgcgcgatcaatatagcctgcatgccgcgacgattgcggcgtggtgtgccatcgacgcgcgcacccaaggtgatgaggtccggtaccgtttctggttcggcgtgttttgcgaacttcgcaaggcctcgcctgtcttttctctcgtgctacccacagcctccaaactgcggccgttcttacctgaaggaacctattttctgtctgcaaacggcagaggcagcgacgttgatcgcctgcttcactccaaggatatcgggagcgctattattcgtcaaattcgatcaatcatcgaaaactaa

SEQ ID NO: 112569 - DNA, 624 bp, Glycine max
  Peptide Sequence Number=SeqID_229347
atgaagggaattacaagagtaccgtaccgggcacgttgtgatgctttgacggtcacagatgtgtgctggttgccttacactgagcatcgaggggttaaggggtttgagctgatttcatcattccagggtcaactgagatggggtcctatggtggtcacagctcgaccggagagggtgctacggcagtttggttacattcaaagcatccctccaccgcctgttagcgcttcattatcatatgatgatataaatgacaggtgggtgcattttgcggaccacgtactagctgtcggtgagctttgtgcggattacatggagtggtttttccggatatctcacccattcatgatatcgacccaggcaggtgaccagcccagacatgcacctaccccagaccatgaggagtacatgcagccggccatcccacaagttccagtggcatttgacccccctccacttgcagtggatgattacgaaggctatgaggcgatcgcagaaaggttggagcgtgtgctcaaccttaggatggtcactgtaggcacaaagttacatgatattatgcaagattgcctcacgatcgccagagggggtgccagtgcagatggaagtgttagggctcgatag

SEQ ID NO: 112570 - DNA, 645 bp, Glycine max
  Peptide Sequence Number=SeqID_229348
atggcccgcatgaagaaaactggacagatgacgtctgaggcagcaaaggaaatagctgacaggattgcgtcacagggatctttcgtcccccatggacgtcaggatatcctggctgctaccattgggcgaccagagcaccctggtcgtgctcgtgttgttggagccggtgtcaccattaagcaatactttggatcggcttcacgaacatcccgcagttcttcctccatgcctcctgaagacctagaacagctgacccaacaaatcagagaccaactggaggagtcaatcacagaaaaagtgactcgaaagatgatggcatccttcagccagatgcagtcccagtttcagtctcagatgcaatcacaaggacttgcactacctccagagccaaaggttggtccctcaggtcctcgtgtcagcacaaaggagagttgtgttgctccctcagggaacgatccagggacgagtgactcagacaaatgcgggctatacattgaagaaaatccttcccgcctggttgccctaggaagactttatgagggatccacaacagttcacaacatccctttgttgcatggccaagtcaaggttggtgttgaggaggttaaagatgcagaggctctcgttcctgtacccactaacgag

SEQ ID NO: 112571 - DNA, 381 bp, Glycine max
  Peptide Sequence Number=SeqID_229349
atgggacaactggccaagcagatagctgacaagtcatcaaacagctttggagcaaatacggaaaataatcctaaggaggaatgcaaggctgtgatgaccaggagtaaaaggtttgtggaagctgaggatgaagaaaatgaggtagacaaggaacaactgagtgaaaagacaggtgttgaggttaagaaaaatgatgtgaaggagaagagtagaagtggaaaggttgtggaagaaagtgtggaagtaccatatcatgtggtgccttccaagaatgaaaaagatcgtcatttggcaaggtttatggatattttcaggaaactggaaataacctgccctttggcgaagctctgcagcagatgccactctactctaaatttttga

SEQ ID NO: 112572 - DNA, 887 bp, Glycine max
  Peptide Sequence Number=SeqID_229350
atgctgcgggaagccgatcggctggatcagcagcgtcagcgcggcgagccgctgccggcgctggctggcattccctatgcggtaaaaaacctgtttgacgtcgccggtcacagcacgcttgccggtgccagcctgttcagcgagcggccggtggcacagcaggatgcgtgggcggtctctaagctgcagcagagcggcgcgctgctctccggcatgctgaatatggacgcctacgcttacggctttaccaccgagaacacccattatggtgccacccgcaacccgcgcgatctgtcgcgcgtggccggcggctcatctggcggttccgcggcagccgtcgctgccgggctggtgcacttttcactcggcaccgacaccaacggatcgattcgcgtgcctgcttcgctgtgcggcattttcggcctgaaacctacctttggtcgtctgtcgcgcagcggcagccacccgtttgtcgccagcctcgaccacatcggtccgtttgcccgctcggtggaagatttgagtctggtctacgatgcgctgcagggcggcgacgccagcgatgcgtttcaggcggcgcgccctgcggaaccggtcagtgacaggctctctgcaggcagcgaaaagctgcgcagcgcggtgctgggcggcttttttgctgactggtgcagcgatgaggcgcgcgcggcggtggcggtagcggccagcgcgctcggcgcgacagaagaagtgacgctgccccaggccgaactggcgcgctcggccgcgtttatcatgaccgccgcggaaggcggcaatcactatctgccagctctgcgcacccagccagaacgctttgagccgaattcacgcgaacgcctgctggcgggcacgatgctgcccaacgc

SEQ ID NO: 112573 - DNA, 552 bp, Glycine max
  Peptide Sequence Number=SeqID_229351
atgcgagcacatccagagagggaggctatcacgcatctactatgcataccggggcaagatttcacccgtgccgctgccaaaagaccagtgtggatcatgcgcaccaacgtgaccacttttacatacattctgcccggcgaccacaatgccaatctccccctgcagatgtatcggttgggatcgtgcccacaagatgcccagtgggcccgaagaagtccaacagggccctggggtttccagctctggttacgggcctctgtagtcctacagggtgcccgttccccccggcaaggtcacgtcatcatagggattgcgcctgcaaaacacccagtggacccgaagaagtccaacagggtcttggagttgtcaagctctaattacgggtctgtcagttctacggagtgcctgtcacctccagcaagggcctcaggccccctactaatcaagctttcatcaagaagtactgcgtccccaggcaggcgcagggcgaaacaccacagcagcctggggatggccggcagcgggcaacagacgcaccgccatcacctctag

SEQ ID NO: 112574 - DNA, 1318 bp, Glycine max
  Peptide Sequence Number=SeqID_229352
atggcgatgctggcgctgttgctggccggcgtcggcaccacgtatatgcagggcgagtttttcccggcctccgatcggcctgagctgctagtgagcctggcgctgccagccagtgcgtcgcagcaggccaccctgcgtcaggtgcaacgccttgagcagattgtctccgccagccgggatgttgaccactattcgtcttacgtcggcaccggtgcgatacgcttttacctgcccatggatgtgctgctggacgatgaaaacagcgctcagctggtggtagtggccaaaagcctggccgcccgtgaacgactgcagcgctcgctggatgcggtgcttgcccgggatttcagcgacatcaccacgcgcgtcgcgccgctcgagctcggtccgccggtaggctggccgattcgttatcgcatcagcgggccggattatcgccaggtgcagcagctggcagagcggctggccgccgcactcggcagctcagcgctgacgcgtgacgtcaatcaaaccgccggtgagcctgaacgcgtaatcactttgcaggtgaatcagacggcagcgcgcgcagccggcctctcttctgacctgattgctcagtatctgcatacgctctggtcaggaacgctgatcaccacagtacgcgatcgcaaccggctgattgatgtggtgctacagggcaacgctgcggcgcgccacgatctgagcagcctgtccggactgctgctaaccgcgccgtcgggcgcaaaaattccgctgacgcaggtcgcaacaccgcagtgggggctggaggatcccgttatctggcgacgccagcgcttgccgtttatcaccgttcagaccgatacggcgccgggtttgcgcgcggaagccgtctccgccgccctcacgccgctgattgccaccttcagggccagcttgccggccggttaccgcctgagcgaggacggggcggtagcagagtctgacaagggcaaccagtcggtgatcgctatcctgccggtcacgctgctctgcatgcttctgctgctgatgttacaactgcggcggatttcccgcatgctgctggccctgctgatggcgccctttggtctgccgggcattgtgctgaccatgctgccgaccggcacgccgatgggctttgtggcgctgctgggtgttattgccctggctggcatgatcatccgcaacgcggtgattctgatcagcgaggcggataacaacgttgatgcaggtatgccgccggacgctgccattgctgccgccgccgaacaccgcgcacggccgatcgtgctcaccgccagcgccgcgattctcg

SEQ ID NO: 112575 - DNA, 270 bp, Glycine max
  Peptide Sequence Number=SeqID_229353
atggtggggtacgcaccttcaagctttgcggatttggtcttcgccgatgaaaggattgaagtgggtctaaaaagaggcaaatttaatcatcctacttggacgaatgaggaaactggggcaaatgaagagggtgagaatgaaggagaaacccatgctgcgtctgttgttcctacatggaaacttcccaccaacccaacaaacatcattactcagccaatatcaacccttctccgtacccaccacacagttatccacaaaggccatccctaa

SEQ ID NO: 112576 - DNA, 378 bp, Glycine max
  Peptide Sequence Number=SeqID_229354
atgtattacgggactcaatcagacattcgagtaaaaagttatggccgttcgaaaatactcagagcttcggtattcaatttcgagtttctcgatatattacgggactcattcagacatccgagtaaaaacttagagcttcagaattcaatttcaagcgtctcgatatattacgggactcattcagacatccgagtaaaaagtaattgtcgtttgaaattgccgagagcttcaacattcaatttcgagcgtctcaatagattacgggactcaatcagacaaacgagcaaaaagttattgtcatttgaattagctcagagcttcagaattcaatttcgatcgtctcgatatattacgggactcaatcagacatccgagtaa

SEQ ID NO: 112577 - DNA, 240 bp, Glycine max
  Peptide Sequence Number=SeqID_229355
atgaggattcttttgataggccaaggttcaaaaaattctaaggttgtgtctcagtgggggcttttatcgtgggagcccgatcttgatatctgggccaggtgggcactcaagcatcccgtttatggcattgtgatactacggttgggaatttacacaaatagacccaacgtttccaagttatgttctttcatcagttcaatgaattcatccattcttatctcggttattcaagaaaaataa

SEQ ID NO: 112578 - DNA, 334 bp, Glycine max
  Peptide Sequence Number=SeqID_229356
gacactttttagcactgccacacctcttgggcttaaggttattcctcaagtaaaagagttgttggatgagggtttgacctgggtgctcatatgggacaccttagtgatcaagaggttcccacagaccctacgagaaaaaggtgttgagggaagaagcccagagtttcaagaacctatggatttgaggtcaaatccttttcaagggagaggggataatgcaatcctacccccaaggacattagatagaagatcccaagaagattggaccagagatgcacgagaaggccctacggttctcatgagccttaacgtagattttgggcccatggactaa

SEQ ID NO: 112579 - DNA, 661 bp, Glycine max
  Peptide Sequence Number=SeqID_229357
cccagtggccagggaatgctgggggaatgagcgctgttaaccgccatcaaacaggacgtaagagggtaataatcatggcagaagaaaagaaaaatgctcaggtgattaacggcgttaacgacgatattgccgaactgaaatcgctgtctacgctgcgccagcgcgtggtcagcgacggtgaaatcgtctccaaatcggccaacggttttcggctggcaaatggcaataccggtgtgatgctgcgtaatgatggacgcgatttttatgcgctgacgacgccgggtggccaagcgcttaacgggcagtggaacaccctgcgcccgttctcattcaatttggcgtctggtcgggttgcgatgcaaaacggtgtggacatttccggtggggcggtggtgtcacacaacgcaggtatctccacctcgaccaccggcccgaccccgcttatcaatggacaaatctataactccgcacctttaaaaagtgatttcactagcggcattgtcaccacaaccaccatgttgggatcccgcgtcattccggggaaggataacttcgggttaatttcttaccgcgactggcaggggaattggaacgaacttcaggtcagaactaacgcggaactttccgtcgggcaattgaccaaacgcaattctgacggctg

SEQ ID NO: 112580 - DNA, 501 bp, Glycine max
  Peptide Sequence Number=SeqID_229358
atgactgaagacatttttgtcttcaaaatgtgtgcagattaccgtataaggcgtctccacatgctacctgacttctcacaggtcggggtaacatatttgtgtgtgtgtgcggataacccctgggtatctccgcatgctacctggcttttcacaggtccgggtagcagaactgtgtgtgtatggataactgttgggtatatctgcctgccacctgactcatgggtcaggatcaacagatgttgtgtttgtacggataaccacttggggtatttccacctgccacctgacgcatgggtcaagattaacaaatgttgtgtttgtatggataaccacttggggtatttctgcctgccacatgacgcatgggtcagggttaacagatattgtctttgtacggataatcacttgggtatatccgcctgccacctgacacatgggtcaggatcagcagatgttgtctttgtacggataatcacttgggtatatctgcctcccacctga

SEQ ID NO: 112581 - DNA, 177 bp, Glycine max
  Peptide Sequence Number=SeqID_229359
agcctccgctgatcgccatctccctcgggccactatccacatattacacaaaattcatagctggccagccaccacaagcctcattgctttgtggtcttgttttccttttatctgttgactgccaggagctcgcctgcttaggtacatcacaggttctcactgaccgactatgcccgg

SEQ ID NO: 112582 - DNA, 402 bp, Glycine max
  Peptide Sequence Number=SeqID_229360
atgtttggtgaagatatagaagaggatgctgacattcctctcattcttggttgcccattcatgtctattgcaagctgcatggaggacatgggaaagaagatactacagatgggcatagaagatcagaagatcagctttgatttgttccatgaggacaaagatccacctcgccaaaatgtctatctgaaagtgcatgtgatggaggaaaagagacctgagaagaaggagccactaagcgccaatctcttacggtttttgaactcttcgaagtgcgctaagcgcgcttgttgcgctaagcacgcctgttgcactaagcacgcctgttgcgctaagcctgaactactctctaaagcgttaagcgcagcctgctacgctaagccccaaatgctcactgtaccttag

SEQ ID NO: 112583 - DNA, 294 bp, Glycine max
  Peptide Sequence Number=SeqID_229361
atgagtgaaatagaggaggtgcaagagcaaatcaaggacgacatggaggtcatgaaagagcaaatgaccacaatgatggaagccatgatgagtatgagaaaaatgatggaggtcaacaaggctatagtcgttgccgcaagtactgccactgaggtagacccaactcacccatctggtctcaaccaagtccaaagcaagcattgcttcccaccatatggcttgccacccaatgtttcacatgctcctgatgataacatcgacaactctattcccacacccattgtcataccctaa

SEQ ID NO: 112584 - DNA, 189 bp, Glycine max
  Peptide Sequence Number=SeqID_229362
atgggaggtccaggttggctagacacaaatggcaagggatccggtggaggcaaagcttgtggtggggccactggaattggtggtggtcttaatgaagagaaacatgttaccaaataccaaccaagaagatatggtgttacagaggccattgaagaaattgccaagaagggaaggtggtccgggccatga

SEQ ID NO: 112585 - DNA, 717 bp, Glycine max
  Peptide Sequence Number=SeqID_229363
atggccacggagcttctccaaattgatccccctcagctcacttttacctttgaattgaagaaacagagttcctgcttggttcatctcatcaacaacaactcttctcaccatgtcgccttcaaggttccttccttcgcctctcccacctcattcactctcctaactttgctgaatataaggtcaaaaccacgtcgcccaagaaatactgcgtcagaccaactgtcggcatcgtcaagccacacggaacatgtgatttcaccggctcagcgcacagccccacctgatctgcactgcaaagacaagttcctcgttcaaagcgcggttgtcccaaaaggaacaaccgaggatgaaatctcctctgacctgtttgtcaaagatagtggaaggcttgttgatgagaagaagctaagggtggtcctcattaactcaccttcttcccctgtaaatggagatctcaagcaggatccacccagtcaaatgcttccctcccttacagctgaaaaaggtatggaagcagctcaggatatggaggaggatggagctgataagggaacttttccaagtacaaggagtgttgagaaggtgggggacatgaagcaagtaaatgatgctgtgaatttgagttttgctactaaggattccgaggaattgaagtcaaggttgagtataatggatgcaaagctaagagaggttagtcatcaatgcttcttaacttag

SEQ ID NO: 112586 - DNA, 1216 bp, Glycine max
  Peptide Sequence Number=SeqID_229364
cctcgccttcagagggctgcacgccctcacctttagagggctacacattctggccttcagagggctacacaccctcgccttaagagggccacacgccctcggcttcaaaaggctacatgccctcactttcagaggattgcatgtcctcgccttcaggggactacatgtcttcgccttcagagggcttcacgtcctcgcctgtagagggctacacgcctttgcctttacagggctacacgccctcgccttcatagcgctgcatgccctcccctttagagtgctacacgtcctcgcctttagagggctgcacgccctcaccttcagagagctacacgtcctggcctacagagagttgcacgccctcgccttaagagggctacacgccctcggcttcaaagggctacacgccctcgctttgagaggacggctgcacgccctcgccttcagagggctacacttcttcgccttcagagggctctacaccctcgcctttagagggctacacgccttctcctttaaaggactgcacgtcctcaccttcagagggttacacgtcctcgccttcagagggctgcacgtcctccccttcagagggctagacgtcctcgccttcagtgggctgcacgccctcacctttagaggactgcatgtcctcgctgtcagagggctacacgccctcgccttcagagggctacatgccctttcattcaaaggactgcacgtcctttccttcagaggattacacgttcttgccttcagaggactgtacgtcctcggctttagatggctacacgtactcgcctttagagggctgcacgtcctccccttcagatggctacacatgctctccttcagagggctacacgccctcgcctttagaggactccatgtcctcgcccttagggtactacacgtcttcgccttcagagggcttgacgtcctcacttatagggggctacacgtcctttccttcagagggctacacgccctcgccttaagaaggctgcacacactcgccttcagaggattgaacgtcctcacgttcagtggactacatgtctttgccttcagagggcttcacgtcctcgcctgcagaggactacatgccctcgtatttggaaggttacacgccctctcctttagagggcttcatgccctccctttcagagggctacacgtcctcaccttcagagggctgcacgctatcaccttctga

SEQ ID NO: 112587 - DNA, 225 bp, Glycine max
  Peptide Sequence Number=SeqID_229365
atggttaaagttgtctctagaatacgtccattggatttaatgatcaaatacgtgcaatttcagtgggctaagcgcgcatccaccgctaagcgcagcttcagtgcacctagtgcgacaaaagaatctggcagagcatcaatatcaaggtcgcacggtaagcgcgagattagtgcgccaagcacagtagttgtcttcagccaggctcagtgcacgactggcgcctaa

SEQ ID NO: 112588 - DNA, 180 bp, Glycine max
  Peptide Sequence Number=SeqID_229366
atgaagtactttgttgatagtcatctcagagaggcaaactttcaagaaggatattgggttatagtcaagcttcgcccttatcatcaatcttcagtgactggaacaacccacaccaagctcgcaaaacgctattatgggcccttcgagacgatacctcctaggaagattgggcctccttga

SEQ ID NO: 112589 - DNA, 426 bp, Glycine max
  Peptide Sequence Number=SeqID_229367
atggctcaaattgttcaaactctggagcaacaaaagtatttatccagattaatgggatataattttaccattcaatacatatcagactgtttgaatgtagtggccgacgcgctatctcacatttcgaaggtttccaaaggcacggtcttcttactgtcgatgcctcatttcatgttcttggtagaactcaaacgtgaattagttgatcacctaaagttcatagctctccggcgagacctgcaagatcgtccagaaaaccatccggatcacacttacactaacggcttaattctacagaatggtcatatttggttgcctagtaacttcaatatcattccattcgacccccaccggtggtcatatggggatcacaaagacattggccagattgcaggaaaattttacatggagttctatcaggaatga

SEQ ID NO: 112590 - DNA, 557 bp, Glycine max
  Peptide Sequence Number=SeqID_229368
atggtgctgctaagcccgaaccttgagaagcttaacgctaatccttgcggcaatggccagctaagcgaattgtgtctcgctaagcgcccagtggcgagggcgaggccagctgagtttccttccacatctacaactcctactccagcatccacttcagcagctccttcagttccagctcagacaaattctcaggagatggtagcttggcctgggactcaaccttctcttcacagggaagatgctgggactcaaccttctcttcacagggaagatgaaggtcccacagcccaggtaccacaacatgtggaggatgagtcatctgaggccaccattccagagccatttgttgtaggggaggaggcaggtgagacacaggtgagacaggtagctgctgccactcctgagagatctcttgaggccactttaaatcctcctgcaccagtagaggacctaccctcacctcagcatgcagcagacccctccactcctaccctagagatacctgaggacctgaccacaccagtcctgactttgacacttctcctccagctactcca

SEQ ID NO: 112591 - DNA, 159 bp, Glycine max
  Peptide Sequence Number=SeqID_229369
atgagtgtatcacctaagggaagtcaggagttgttgtcttcattgtcacggtcagctgattacgatcctgaaaagattgtctttgtcactcctgccaaaagaatgagtggtgaattagattatgatgaatacacacaatatgagctatcaacgaactag

SEQ ID NO: 112592 - DNA, 618 bp, Glycine max
  Peptide Sequence Number=SeqID_229370
atgtttaagcagggaatgacaaccaaagaaaatgacaagaaaaagaaaggaatttcacttaaagcctcatcttccattcaagaagaaagtgacaaagaggacttgaatgaaatagaagaagatgatgatttcagtctcttcataaaaagattcaataagtttctaaggaacaaaggaaatcaaggaaaaacaaacttcaatccaaataaaagaggagaagatttatcttctattccaaagtgttatgaatgtaatcaacctggacatctaagagttgattgccttggtttcaagagaagaatggaaaaatctggcaggaaaaccttcaaagataagaaggcaaagaaagctgacatcacttgggaagataacaatatggattcatccagagactcagaaaatgaagtcatgaatctaagtttcatggctaaaaactatgaaagtgaagaagaggtaacatcttctaacaataacttatctatttcctttgatgaacttcaaaatgcattcaatgacttgcaaaaagaatcagtcaaacttgccaaactagtttcattttctaagaaaactatttcaaatttagaaaatgaagttttgaaattaaatgaagaactataa

SEQ ID NO: 112593 - DNA, 150 bp, Glycine max
  Peptide Sequence Number=SeqID_229371
atgtataaacaaaatcagaaggactttctcaggcttgtagtgagatcaaaaagcacaaaaaatcaacaggaatttaaagatcctgtgattggtcctgggtgtcctgtgtctgaccctcctcctcttccgacaaatgaagtacaggagtag

SEQ ID NO: 112594 - DNA, 219 bp, Glycine max
  Peptide Sequence Number=SeqID_229372
atggtgagccaaggaggacaatatggtgttggaggctttgagacggtgggaaaggaagaaactgtgataatgacggaggaaaaaggagcaacaatggtgacaattttagacggaggttccaaggagggaaatcttgggatatttgaaactaaggagatgcaagtagcaaaaaataggatgcaagaagcaattgccaatatttattatagcatacattga

SEQ ID NO: 112595 - DNA, 1074 bp, Glycine max
  Peptide Sequence Number=SeqID_229373
atggatcccaagggctcaaagcagcagcagccacaggaggtggtaccaaaattcctcagcctcccccaacaccactaccaacaacaagggaattccaacaacaacaacatgggagagaacaaaccatcagaggttaaggatttccagatagtggtagctgctgagaaggacgagagcaagaagcagcaacagttggcaccaaagaggagttccaacaaggacaggcacaccaaggttgagggcagggggaggaggataaggatgcctgctctctgtgctgccagaatcttccagttgaccagagaattgggccacaaatctgatggggaaaccatccagtggctcctccagcaggctgagccatccatcatagctgccactgggactggcacaatcccagcatctgctcttgctgctgctggcaactcactctcacctcaaggttcctctctttcatcagccttacaccaccaacaccaaaagattgatgaattaggttgtgggtcaggtgggagcagtagggccagctggcagatggttggggggaatttggggagaccccatttgggtgtggccacaacaggcctatggcccccccatgtcagtggatttggatttcagacagcaacaacaacaacaacaacaacatcatctggtccatctaatgccaccttagccactgagagctccaattacctccagaaaattgccttccctggctttgacttgcctacttctgccaccaacatgggtcacatgagtttcacctcaattttgggtggtgctggttcccagcagatgcctggtttggagcttggactttcccaggatggccatattggggtgctgaatccacaggccttgaaccagatttatcagcagatgaatcatcaggctcaagctggtagagtgcatcaacagcatcagcatcagcaacaacagcatcagcaaactcctgctaaggatgattctcaaggctcaggaggacagtgcaagcaattgaatgtgggagggggaaacgggaaagcggcacttagcagaggattaagcgtctcaaatcaacatcacacttaa

SEQ ID NO: 112596 - DNA, 210 bp, Glycine max
  Peptide Sequence Number=SeqID_229374
atggtgaaaaacttaaaagaaggagcaatggcaagagactttgaagaaggactagccacgcaaggtttcaaaaaaggaggagaagcactagtagggcttttaccacgaagaaagaatatattcatggaaaagagaaggaataggaacagaaacataataggaaacgttgaaaggaaaaggaaacataataggaaaaggaaacgttattaa

SEQ ID NO: 112597 - DNA, 933 bp, Glycine max
  Peptide Sequence Number=SeqID_229375
atggctacgggatatctatcaaaggagatgcgaggcccgacagtggatagttgcagctcgtgcgtatctcctacacttgttcatttggacgcttttcgagacttggctcagagtgggacctatgcctggggagttgccacgctggcgcatatgtatgaccagttaaatgaagcttctcagagcactagccgacagattgctggttatgtaactttattacagtgttggatatatgagcattttcccggtgttcataacagcgtgattgatgatgggtatgatgagacgtcaccacgtgcctgctggtggcttactacgaaggcttatatgaagggattatcagcattgtcgtacaagacatgtatagatgcactgacagtccctgatgtatgctggatgccttatggtgaccaccgaggagttagggcgtttgacctcatctcatgctttcagggccttcatctttctccacttgggccttcatccttctccactcaggggctttgtccttctccacttgggccttcgcccttctccacttgggcctttagcctgtatttggctagtttcatgattctcatcagatggggtcccattgtggtttcaagagattacatggagtggttcttcccgatatctcattcgttcatcacacccacacaggcaactgatcagcccagacatcaacatgtcccacagcatgaggcatacgtggagccagatatcctggaggatgcttgtgaagcaattgcaaaaagtttggagcgtatgctcaacctaaggatggtcactgaaggcacagagttacatgagatcatggaagactgcctcaggatcactaggggtgtcacctcagatggaaatgtgtatgttagggtgcgacgaagatggcgcacagatcattcagagatcatgtttatgtcttgtatttga

SEQ ID NO: 112598 - DNA, 231 bp, Glycine max
  Peptide Sequence Number=SeqID_229376
atgggatcagaaaccgtgagtaatggacacattaaagagagggtatgtcccagtcccatgtacaagaatataacttcccgtggacttagtagtaagacttctgttgtggtgaacctagtttcagttcagaccaacaaaatgaaaagggaggtgaactcaagagaagaagaggctgaattccaactatgttggcatccagcccctaagcctccaacaagatatacctcataa

SEQ ID NO: 112599 - DNA, 1071 bp, Glycine max
  Peptide Sequence Number=SeqID_229377
atgaatgctctgttcagaccttatcttctccgttttattatcgtcttctttgacgatatcctaatttacaatcactccttcagcgaccatttgactcatctggaacaagcttttcaactctttttgcaaggtcaatttgttctcaaaatttcaaagtgttcattcacccaggcgcagattgaatatttgcatcacgttgtgtcaactcaaggggtccaaccagttgcctctaaagtccaggcagttcaacactggccaatacctcatagcacgagagctttacgcagcttctttggtttggccggattctatcaagcaccattaacatctttgatgatgaaggaaccttttctatggtctacagaagctcaacttgcttttaataagatcaaggaagccttatcatctgctttggttttgtccctccctaatttcacccttccatttacagtggaaacagatgcttctgggacagcccccgtcaagaagtggcgccaataccttttgggtcatcactttgtcattctcacggatcatgacagcctcaaggaactgatgactcaggttgttcagacaccagaacaacaaatgtatctagcacgtttgatgggacaagattatagtatccaataccacactggagcggatcgtttgatacagactacggaggtttggatgacgccacttctggtgaaggaagataagtcaagggttacacaaccattcttgttgtcgtggatcgcttttccaagagaattttcctgggcatgctacccaatcatcacatatctcactcagtggcgatcctattcatggacatcatcggcaagctccacagcatgccacgaactattttgcatgagtggcactcagttgtggatgagctcgacgtaccatcctcagacgaacggccaaacaaaggtcatcaactacgtcatcgaacagtgtcttcgcccttttgttcataacaaaccagcttcttggggcaaattcatcaattgggcagagtggtcttataacacttcttggcattatggatcagggacaacaccgtacaagattacattttga

SEQ ID NO: 112600 - DNA, 657 bp, Glycine max
  Peptide Sequence Number=SeqID_229378
atgagcacttacctctcagagtttgaatatttggccaatcgcataattggtcttccacctccacttctcctcaactattttatctccagcttaacacctaagattcggcgtgaagttcaagccattcaaccgctaactttgaagttgtcacctaaggaactggcgtcccgccgagaacatggtttgtgttttaactgcgaggagaaataccattgcggtcacaagtgttcttctagggttcatgttttaatagccgaaaaagatgatgaccctcaggaagacactcttgctttggggcctttacccaacccaccagaccatccaaacccaacaatgacccaaataagttttcactcgctcgcgggtcatttggcccctgaaacgcttcttttagtgggttacattggctctcagcatatggtgatattaatttatgggggtagcaaccacaacttcatccaagagtccttagcactccaactgggcctccccacccacacaagcccctcgttgagcgttatggtgggtaatggtcagtacttcccctgtaaccgcctttatgaagccattaccattttgattcaggatatcagcttcaccttagacctttacgtgctacctttgtgtggcgctaacttagttctgggcgtgcaatga

SEQ ID NO: 112601 - DNA, 108 bp, Glycine max
  Peptide Sequence Number=SeqID_229379
atggaacaaatgcaagctgaaattgaagcacttaaagcccaagtttcacaagttgatgtctcaaaggagcaaattgcatttcttatgcagaatgttagaggaaatgag

SEQ ID NO: 112602 - DNA, 258 bp, Glycine max
  Peptide Sequence Number=SeqID_229380
atggtaactagaaccgagaaaaagaaagaaagaaagagcagtctattatactcactagacacccctttccctcaaaacagagcgaccatagaagacagcgacaaccaacacattgaagaatacctacctcactgccttcaacccctttcactaactctattaacaagagttaacgaggttggagctatgcaaaggggatggaggctgcaacaaggatgcaaggaaggaaagacgcatcagaagggattgatttcatag

SEQ ID NO: 112603 - DNA, 240 bp, Glycine max
  Peptide Sequence Number=SeqID_229381
atggaatacatgtctcatgttccttatgcgagtgttgtaggcagtctcatgtatgcaatggtgtgcacaagatttgacctagcacaagcaattagcgtggtgagtagttggaagacttcacttcagcccacacttgccttgtctactacagaagcagagtacatggctctggcagaagcaacgaaggaaggtatccgattgaaaggtcttattagcaacctcaagtttccagaggattaa

SEQ ID NO: 112604 - DNA, 255 bp, Glycine max
  Peptide Sequence Number=SeqID_229382
atgataaaattaagagcgatgctaagcattatatttgggatgacctctatttgtggaagtagtgcagtgaccaagttattaggagatgcattccacccccatgagattgactcagtcctgtgtagaagcaagcttcatgatgaattaagattgattcaaagaagttttgatgataacaaaggtgatgacaaaaagctcaaatgtcaagaacacatcatgataacaaagatgatgatctcaagaatcaaagaatga

SEQ ID NO: 112605 - DNA, 414 bp, Glycine max
  Peptide Sequence Number=SeqID_229383
atgccgatgcagtccttggattggattatgcttagcgcacgactagcgctaagctcaaatccacttactcgtgctaagcgtgagggtggcgctaagcgcaatgttggtaacaacaacaacaagaaggccagggcacaaaattccacatcacgccacaatgcctatttcgggaaaagagctctagaggcagcaagaggaacaacttttgcagagatgcttaggttttgtaagcttattattgttagggatttagaagcagtagcaaccccagaagaagaacctcgatctttcgaggcatcttctagttttcctattgcaaggcattctcatatagaacctgttgaaggtacaatcatggctgaagagccaagaagagtaaccctggaggattattcaagttctaatgtgccataa

SEQ ID NO: 112606 - DNA, 303 bp, Glycine max
  Peptide Sequence Number=SeqID_229384
atgaagcgaagtagtaggcaacattactcgtaccttaaactgcaatgtccgagccaagtcccggaacccacgcagatttttcgaccaccgcgaaaatctgagaacgcacgcgttgaggttgtggttttgttaaacgcgagataccaaaaattcagtgtccacaattttatgtatgaaaaaaaatcgacggtcagatcggactgtggaattggagaagcagcgtatgaacgccgtgacgtggcgaagaaagttaatgtggcgcttttggaatgggggagcagatatttcggggggaagcagtag

SEQ ID NO: 112607 - DNA, 381 bp, Glycine max
  Peptide Sequence Number=SeqID_229385
atggcatggacacctaggccagaattgggagggaaatgtcaaaacctccagatcaaaaaggaagatgagtcaatgacgtccattggattaaatttggatggcacgactaaggaagctttttccttattcctcaaagaaaaggccaacgtatttgcatggaagccggtggatatgttgagcatagatccaaactttttctgtcataagttgatagtaaaccctttagtgaaacctgtgtgtcaaagaaggaggaaaatgactctcgaatgcctagaggaaattgaaaggcaagtgaaggagttgctaaggaaattgaaaggcaagtcaacccttcagcgaaacctttcatacgacttggctggccaagatcatcctagttaa

SEQ ID NO: 112608 - DNA, 1151 bp, Glycine max
  Peptide Sequence Number=SeqID_229386
gcacctttgttggggtttactatagtgaggagctcaagtatgctagagacataggctacactataataccaatttgtggatacctcttcgaggagatggaaagtccattcaaggactacattaattctctctttgaaagcagatccaatgctaaaaagaagggaaataacgccctatcttttgtatataaattactaatgaactcgttatatggtagatttggcatcaatcctcaaagcacaaaaaccgagatgtgcaataaatctaaacgtgaccgtatatttagacgccctgagtttatagacgatgtctttattagagaggatctatacatggtatcttatctaaccaatccgggtaaggggccttcttattgggaccccccgaagaactccgcggtacaactagccgcagcgatcactgccggctcaaggatctatatgtacaagtatatttcaagagaagactgcttatatacagacaccgactctattgtccttaatccacttccggaggaagatgtttcctcttctgtattaggtaaatttaaattagaagataagatcttggagggattctttttagcacctaaatgctatagctataccacagaagagtcagatggcaataagaaggtctataagtacaagggaccgggtagaaatgttataactccagaatggtataaagaacagtacgccgacccttcccgaagtctgataaagaaggtaacttatcaatttcaacccgattggaaagaactctcggttaaaaagaaagagagtacaaccactcttagaactctcagtaactccaagagaatacctttctttaatgaaaaaggtaagtatgtaagtacagatccacttgatatcgatgacttgtcatctctaaattacattggaacaaaactattagaaagttttaaaaggaaaacagctattttagaaaaagagaattcggctctttctcagaaattacagaagctggaacaggaaagaggtataatagcccagcggagagtagaagaaggaaataataccgaagataataatacattagagcaaaataatcctaaaagggctgaagataatatcaatggagatctattggatccagatacgatgccgcgggataaaaagcccccctga

SEQ ID NO: 112609 - DNA, 378 bp, Glycine max
  Peptide Sequence Number=SeqID_229387
atgtcgcgccaagaaggatggacatgccagataagggccagagttgcaggtcacgtgtcgtccctcaagaggaaatgttggcccgaaactaacttttttgagttttgggccttccgttgcagaccctgttcgaatgaaccgatgtctcctgttatttattttggattctctgacgtgcaaacatgggacaggccacctttggagagtctcacagctttcccagataatttaaaaaaaaaccccaaacaggggtacttaggcaagtttacatggcccgaaactaacttttttgagttttgggccttccgttgcaggccctgttcgaatgaaccggtgtctcttgttattttttttggattcgttgacgtgcaaacctga

SEQ ID NO: 112610 - DNA, 297 bp, Glycine max
  Peptide Sequence Number=SeqID_229388
atgtatgaatatcttaggagaacccgcacattaacgcgtaagcattcctttcaaaattcgtatggatattcatgctttgttggaaaagggaaatggctccaaagaaactctccacgaagaagtctagaagagacgccacaagagaagggtccagtaccgcccccgagtttgatagtcatcgtttccggagtgccgagcaccagcagcgcttcgaggccatcagaggatggtcattccatagggagaggcgtgtccagctcagggaggatgagtatacggactttcaagaggagatag

SEQ ID NO: 112611 - DNA, 585 bp, Glycine max
  Peptide Sequence Number=SeqID_229389
atgcatagatctcccacaggcaacatagtacctctagacttggagattgaagccaccttaagaaggaacagggccgagaggagaaggaagttgttgcaagataggaaaatagcttccattctagaagaagaagctcaatcttctgactctacatcatctgattcactatcatcaagggaatcagctatatacttacctgaagcttctgtcatggctgatgaacaccataaaagggttatccttgaggattactctagtagctcagtgtcgggaacttatttcatggattaccaaatgaggacccctatgcacatctggcaacgagaagcgaagaagtggctccattcattcaaaggtaacaatctgaagacgtggggggaggttgttgagaaatttatgaagaaatatttccccgagtcaaagactgcagaagggaaagctgttatttcatcatttcaccagttccctaatgaatcctttagtgaagcattggagaggtttcggggtttgttgagaaagactcccacacatggattctctgagccaattcaattgaacatgtttatagatggactgagaccatag

SEQ ID NO: 112612 - DNA, 108 bp, Glycine max
  Peptide Sequence Number=SeqID_229390
atgactaaggtggtctcctacactttgcacgttggttggagaatggcctttgttaagaggacaagaggggggaccatcaaaacacaggactttgacactcaagcgtaa

SEQ ID NO: 112613 - DNA, 360 bp, Glycine max
  Peptide Sequence Number=SeqID_229391
atgggtccacaaaatacatgtggaaagttgtatggcactccaatacacacgttagccctccatgttagccctgacactggagcatggacgtcaacctttagcagtcgggctcttaatagacatgatgcaatcctaccccccaaagttgtcgcaacctacccttcggcgggagggcgacgtggggctcacgggagcatcttccaagggaggaaggcgcgtggagtcgccaccaacgtttatttgacgaaaatgtcagaaaaaccggaaaaggtgtggtcaactttaagtgtgaaaggttcgggagttgtttttaagaatgggaaaggtattagcaccccacgtgtccgtcacaagggatga

SEQ ID NO: 112614 - DNA, 567 bp, Glycine max
  Peptide Sequence Number=SeqID_229392
atgttcctcaccaggagcaagaggaaggagagccttggaaaagaagagagagttgaggaagtagtggaggatgtgagtgataaggaagtagaggacgacaggaaagagaaagaggctgacaataaagagaaagaattgagagatgagaaaaatgaaaaagaaaaaatagtaagcaaagctttcattgatttgggggcaaacatcaatttgatgcctctctctatgtgtcagaggatcaggaacctgaagattaccccaactagggtgactcttcaactagtagacttctctattacaatgccatatggtgtggttgaagatgtcctggttaaggttcaacaattcacctttcctatggactttgggatcatggacgtaaaggaggatttagacattcccctgattttgggttgtccattcatgcttactgccaaatgtgtaatggacatggggaatggtaatctagaaatgagtgtggaggaccagaaggtgaccttctacttgtttgaaacaataaagcaccccagtgataacaaaacttgcttcaaggtcaagatgattgagtag

SEQ ID NO: 112615 - DNA, 843 bp, Glycine max
  Peptide Sequence Number=SeqID_229393
gtttgtactctggtcagataccggagtatcccgattttgatgtcaacttcaattcaaaatccgtaagtgatgattcttcggaaaacaatataaaacattcttatgcttttctaagagaccatgaacttcatgatcaatatgttgtttcacacctgccctaccataagcttagagcaaacctttccgaaagcgataatgagaacgatgataatgtagagacatccggttttacgggacctccaatctgtttagggactgacatcggacatctgaaacctgatttcgttacgatattccataacagacagagtgctgtttcacttgctaattcagaacatctaaaatatttcaatgatgacctgtacatccactgtcaatcagagaaaaaagaaaaagcagaagctgcggttttcaatgtaacaagcccgctagtgaaagatactttaatcgacaaagattatgtagcacaaatccgatccattaaccatatagaactccgtgctcaggaaaaaggctatatccagaccttatatgtagatgaaggtcaatatgtaaaaaagggacaactgctatttaaaattatgcccaacctttatgaatctgatgttaacagggcaaaggcagaagcaaaatatgctcagatagaataccagaacactaaaaatctttcagataaagatattgtagctccgcaggaaatggcaatggctaaagcgaaatatgaaaaagcccaggctgagctttcgtcaatgaatacgcaccttaaatttaccgagatcagggctccttttaacggaattgtaggccgtctgcatgttcggaaaggaagtctggtagacgaag

SEQ ID NO: 112616 - DNA, 567 bp, Glycine max
  Peptide Sequence Number=SeqID_229394
atgggagcggtgtacgacatcgcgaagagcggcatcggggttgcgtcgatgggtcacgccggagctggattgattttgtgcttgattcaagaggagcgtgaatttgacgagttgagtagccaagacagaataagccactccagaagcaccccaaacccccaccctccaacccccattgtccacaagcacactaaatccaagaaaaaaagatcagatttcgagaaagatgactttgtctcttgcaacaagtgtagaccacactcctgcgacaaaatcttcatccttcccttggatcccataattatggctagtgggtatcttgtttatttgctctctactatctttcttccctttattttatatgctctgttgcttcacaaatttgtcatgaaaaaggagttctggaggacgacaacggcagtgcaaaatcagtattttaatgaagttagaccattggaagcagagagattcaaggcgcttggcatccaatgggcacagtattatctaaaagttagaaatcaaacattggatgttaggcaactatgtaactttaggttacttaattaa

SEQ ID NO: 112617 - DNA, 267 bp, Glycine max
  Peptide Sequence Number=SeqID_229395
atggccatttggcttagtggtagtcttatacgtattgtaaactgtaagaggtatcttgtacccgctgatttgactgttggtcagtttgtgtatgtggtgcggaagagaatcaagctgagtcctgagaaggcgatcttcatttttgttaagaatattttaccaccaactgcggcaatgatgtctgcaatttatgaggaaaacaaggatgaagatggctttctatatatgacttacagtggagagaacacatttgggcttgtgttctga

SEQ ID NO: 112618 - DNA, 539 bp, Glycine max
  Peptide Sequence Number=SeqID_229396
atggctgcagaggctcaatgtccatatgcccttcatgctaggggcaaagagattctcattgaagatgatgaatatacaccctcaacccactatgtaaagacaaggctaagtagactcttcaagcatgaagtagctgctttacaacagaagagggatctaacaagtaaggattggctagctctgaaaagatattacaaattgggagctcactgctctagtctggaatctaaagagaatccaccattagatggagttcatcacaagaccgaacattgttatcagacaactagtcacaatctctttgaggtacttcacactccaccttcaccttcattcatcaagttaagcccatcattgaagaaagtgaattctgataatgagatccttgtttttactgaagatacgaccatagaagtttatgatggccctcctccatcttgggagtatgtgcatttacatgaagaagcattgcttaagactcgagggtcgcttgctgaagcttttcaagacaaaactcatgttgaaagaaaagctaaaag

SEQ ID NO: 112619 - DNA, 1452 bp, Glycine max
  Peptide Sequence Number=SeqID_229397
atgacttggaaaagcagaggagaattgccttctagaagcgttatctcgcagagatgggcactgtttctctgcttaggaagtttctgtgctggaatgctcttcactacaaggatatggactatacctgaaaacaacaaaggactagcacggccaacagcctcagaagctgaaaaattgagtttagtttcagaaggctgcaattccagaattttgcaagagatggaaatgaagcacgataaagacacttatggtgaagttttcaagagtcataattccatacatttttcttcttattttcttgttctagaagtgcttcgggataaactcacccaaaaaggcccttggtcttgttattttttattattttgcatgtcaaacttatgcgagagtattgaatgtagaacattggacaaggctatttcaaacttagagatggaattggctgctgcaagggcaactcaggagtctctacgaagtggtgctcctatttcagatgatataaggttgagtgaatcttcgggtaagagaaagtaccttatggtcattggtattaacactgcattcagtagcaggaaaagaagggactcggttcgatctacttggatgctacaaggtgagaaaagaaagaagctagaggagaagggcattatcatgcgctttgtaattggacacagtgctacatcaggtggtattttagacagagctattgaagcagaggacagaaagcatggagatttcttaaggctgaatcatgtggaaggataccttgaattgtcagcaaagacaaaaacctactttgccactgctgtgaacttatgggatgctgatttctatgtcaaagttgatgatgatgttcatcattatattctttctgtttcagcaacactgggagaaactctagttagacatcgatcaaaaccacggatatacattggatgcatgaaatctgggcctgtcctatcccaaaaaggggtaaggtaccatgaacctgagtactggaaatttggagaggctggaaacaggtacttccgtcatgccacagggcagttgtatgccatttcgaatgatttggctacatacatatcaattaaccagaatgttcttcacaagtatgccaacgaggatgtgtcactaggatcctggtttattggacttgatgtggagcatatagatgatcgaagactttgttgtggcactcctcctgattgtgagtggaaggcacaagctggaaacatttgtgttgcatcatttgattggagctgcagtggaatttgcaggtctgctgagaggattaaagaggtacataggagtgtagagaaaaaaatgtcattttacacgagaaaagcaggagtgagagagaaatatgatgcttgccccatggaccttcaacattttaagaggagattgaccatggtagcagctagtaagaggacgtgcgcacgagatatatag

SEQ ID NO: 112620 - DNA, 288 bp, Glycine max
  Peptide Sequence Number=SeqID_229398
atggtgaagaggacacaacctgcatatcaaaggcaagccaagaatgcaaacagaagaagcatctatgatgagaagatttcagggggttggacatgttcaatgttcatgtacaaaacacaaagagagagagagagagagagagacagaaaagatacacatactctgaatattactaagtctctaaagagttttaaagaaggtagtgcccaacatgagaccacgaaatatgggtatagtggtggtggcattgaaggagttgcattaaattctcaaccaccttggcactga

SEQ ID NO: 112621 - DNA, 204 bp, Glycine max
  Peptide Sequence Number=SeqID_229399
atgggttttggtaccccttgtaggcaaattgaccctaggcttttcgtcattactgtaagcgaaacatcacgtggcaggaacaacatggcatttcgccagtggggttggcaaaacaggcatgacatttcgtcattggagttgacgaaacaggcacccatcacatcacgacaacagtgggttttgctggtggtattagcgaaatag

SEQ ID NO: 112622 - DNA, 255 bp, Glycine max
  Peptide Sequence Number=SeqID_229400
atggatgtcattagagttgtgcattcatatttagacatggaagaaaattatgaggagaaggaattgcatggaaagcagtttgagctggacagtgatggcaagattcattttaagattaggcagttgcttctaaatgtaacccattttagggatatgctaaaggaatttagaatactagaaggatttaaattgtggcgggttaaaaatgaaaaaagtaggatgattgttgagtgtgaaaatatggagggagtgtga

SEQ ID NO: 112623 - DNA, 256 bp, Glycine max
  Peptide Sequence Number=SeqID_229401
atggggtcgaaccaagcacatgcttttaagaaaaagttttcatcaagccaaggtcaagtatggaagaaagaatgtgctttacagggcccttaccaaacatgtgccaaagctagagtaatgagtgaaatagaggaggtgcaagaacaaatgaaggttgacatggaggccatgaaagaccaaatggctgccatgatggatgccatgttgagcatgaagaaaataatggaaagcaatgcggctgcaattgccactatga

SEQ ID NO: 112624 - DNA, 336 bp, Glycine max
  Peptide Sequence Number=SeqID_229402
atgttcaggaatgttgttgttcttaaatattcagatgaatcagacttgatcaatgttgtgctggatatgcttcccgatactgaggtggtcttttctcaacaatttgtgtttgttaccgcggatgatgtccgttcaatgcttgactcgaccgaccctatagagcttgaatctcaatctgtgtctgttaccgccgatcatgaccctcttctcaggattccattaacaccaactaagcacgtatcctctgatgaattggatgatgaacccaaaaactttgagatttcacctgcgcaagtttcctcaaataaattacccaagcattgtcaggctgaatga

SEQ ID NO: 112625 - DNA, 282 bp, Glycine max
  Peptide Sequence Number=SeqID_229403
atggcttttcaaataacatgcctttatcttgtggttgctttagacgttattggcgtggttgatgaaatggttgaagatgaaaggcccatcgttattcttttgacacatgccaggatcaaggaaggccaggctccgatcatatccgccagcaataattctttgaaggcgtctaaactaatgaccaacgagcttgtgttggaaattcaagaattcaaaaagaggcttttagatttagggattaaggtcagatcagttttgacacctattggacaagggagttaa

SEQ ID NO: 112626 - DNA, 2235 bp, Glycine max
  Peptide Sequence Number=SeqID_229404
gcgacagccgcacagttcacgacatgcgtgacccgatccagacgggtatcgttcaggaaggcttcaggctggctgaggtcgccaatcaggatattatccacattcagagaggccagtttgtcctcaggaacgttgaacttgcgcatgttctccagcacgcgctccagcccgctctgcggatcgctggcacgcgcgagcaaaagcagttttacgggttgatcgctggtgagtattttttccagtactgcaccgcccagaaatccggaaaggaaatcaggtggagatattggacattacaggggaagcgtggcgctggcggtttgctggctaacgtccccgtaatgaccatccagcgcaatcatggacgtggtcagcagctcaaccagcagcataaccccaaccttagcattgagcgcgcctgcgctcagtggtccctccggtttggcggccaccagctgcatatcgctaagggacgccagcgggctacgtggcgtattgctgagcgccagcaccgtaacgccgcgcttgcgggccagtttcaccaccgtggtcgcattcatggccgcacggtgcatatcgctaaacagctgcgccggtttgcccagccgcagcagcttatagtgcagatactccccgagtatggcgctggccgcaacgccgtaaatctgcacggactgtgcctgatgcagcgccagcgcggccttttccagcagcgcgcggtcgaggagtcgggcggtatcctgcaaagcctgcaccgattcctccacgacgttatcaatttcgtccccggcctgacgcacgggctggccctgctgaatatccagcgcaagcgccatcttaaattcgttatagcccttgcagcccagcgtgcggcaaagacgcgtgacgctggcctcgctggtatggctttcgcgggccagctcggtgatcgtcaggtagagcacccgggcaggatcgctgaggacaaactcaccgagtttttgttgtgttgggctgtacccggaagcctcctggcggagcttcagcagcaggttttcatgatccgacatgccacgtccttaatgcgtttctctgcgcctagtgtggcggaaagcgggggaaagatgccagtcatttcgaaaaagtatgatcgggctcctgcgcagcgctttggcaaatccttcatgttgcccatcgccgtgttgcctgcggcgggtctgctgctgggaatcggcggcgcgctatcgaatcctaatacgctgacggcttatccgtttttagatgtgggctggctacaggcgattttcaccatcatgagcagcgcaggttcaatcgtttttgcgaacctcccggtgctgtttgccgttggggtggccgtcgggctggccaaaagtgataagggtacggctgggctggcggcgttactcgcatttctggtgatgaatgccaccatcaacgcgctgctgatcctcaccggcaaactggcgcacgagaacccgggagccgtgggacagggcatgacgctgggcattcagacgctggaaaccggcgtgtttggcggcgtggtgattggactggtgacctgcgcgcttcatcatcggtttaataagattgcgcttccgcagtttctcgggttcttttggcggctcgcgctttgttcctattatcagctcgctggcggcgatactcgtcggtgcgctcatgaccgtggtctggccgcatttccagaagctgatttttggtctgggcgggctggtggatgcgaccggctatctgggcaccctgctgtacggctttattcttcgcatgctgggcccggcacacagcggatcttcttcgctcaactggctgacccgaacacgcaacatttctatgagggcacgtcacgcttcatgtccgggcgctttattacgatgatgtttggcctgctcggggcgtgcctggcgatgtaccacacggcaaaacccgagaacaaaaaacgcgttgccggactgctgctttctgcggcgttaacctcgttcctgacggggattaccgagccaatcgaattctcgttcctgtttattgcgccggtgctctacgtcatccatgcgctgtttgacgggctggcattcatgctcgcgcacatgctgcatatcaccatcgggcaaaccttctccggcggtttcatcgacttcgtgctgttcggcattttgcagggagaggccaaaaccaactggatgttcgttccgctggtcggcgtaccgtgttcttcct

SEQ ID NO: 112627 - DNA, 726 bp, Glycine max
  Peptide Sequence Number=SeqID_229405
atgcttcttgctcttgctgcccttcacaattggcatctccggcaactcgacgtcaataacgcattttttcacggcgaccttgacgaagaggtatacatgactcttcccccaggtctccatgtgcatgatcgcaatctagtttgccgccttcaacgttcattatatggtttgaaacaagctagccgtcaatggttcacacggctctcttctttcctcatctctcatgacttccgccaatctgcaacagaccattctctttttctccacttcaataacagtgatatcactgccgttctcgtttacgttgatgacataatcatagcaggtaacaatctcgacaccatcacgcatatcacaaaccttcttgatatagctttcagcatcaaggaccttggcaccttgaagttctttctcggtcttgaagttgctcgcaataacaagggcattcacttatctcaacgtaagtacgtcttggatatattatccaactcaggcatgcttgcctcacgacccgcttcaactcccatggactactccacccgattaacagcctcgctaggcacccctctatcagaagcgtcttcctcctcatatcgccggttgattggtagactcatttatctcaccaacactcgtcctgatatcactcatgctgttcaacaactcagccaatatatggctcaccctacttcagctcactcacaagcagcattccgtgtcttgtga

SEQ ID NO: 112628 - DNA, 435 bp, Glycine max
  Peptide Sequence Number=SeqID_229406
atggcatttctgagaaaaactgacatccaaacaggaccattcacatgcggatgtggcaaagataatgatcagcctgttctaaggtatagagttgaagtaatggttagccaaaacaatgacagtagcaagtttttgctctgggaccgcgaatgtgctgaattgattggtgaaatagctgatgaagtgaatagggtcaagattgaagatggtgatgttgatttgaatgcttctcctcaagcacttgataggttgttgggttatgtgcttgcttttaaggtcaggattcaatcaaaattcaggaatgtcattgttcttagatactcaaatgaattagatttgatcaatgttgtgctcgacatgctggctgatactgaggtatgttccaaaatagatgcttcgaatgttgattgcaataatgctatgcatcctgaatgt

SEQ ID NO: 112629 - DNA, 363 bp, Glycine max
  Peptide Sequence Number=SeqID_229407
atgcctaatagttcatcccatgctaaggttttcatatttctagcttcttggatggctattgttttttgttcccacaccttaggaaagttgtctaggatctttagtaaaaagcaacagttggagatagcatgtgggattgaagcctcagggcatgagttcctttgggtatctcctaaaaatatgtacgttgatgttgaagaatggttgccacatgattttgaagaaaggattaaggaaaataacaaaggaatggtagtgagagcgttgcttcatcaacagttaatgttgaagcacatgtttttgaatgagaagttggtgattgaggtgcacaaaattggggtgaaggtgagggagtgtgagtga

SEQ ID NO: 112630 - DNA, 393 bp, Glycine max
  Peptide Sequence Number=SeqID_229408
atggctgaagctggtggtagctctcagacggaaacaacaaccaaacctcaacttatataccggtgtaagaaatgcagaagaattgttgcttcagaggaaaacatagtttcccacgagcgcgggaaaggagaatcaagcttcaagtggaaaaagagaagcagtgaatcctgggaaatggaaaagcaatcagttgattgcacctcagtatttgttgagcccatgaaatggatgcaagcagtacaagaaggtcatgtggaggagaaacttctctgtatgggttgtaatgctcgtttgggttacttcaactgggccggtatgcagtgcagctgtggagcctgggttaaccctgcatttcagctgcataaaagcaaattagatgagtgcaatatgtaa

SEQ ID NO: 112631 - DNA, 462 bp, Glycine max
  Peptide Sequence Number=SeqID_229409
atgaaagtttcaacagccattcctattctagatacacaaattgacttctatgaatcagcaagccatgacaagatgagattgaacaaaagagcaaacattaatcaccagagtcatattgcaaaatgcactgaaacaaatccagtcaattacaaaaccgaacataaagattatgggaggaaacattatacaagaatgatagtcaaagttttgattaaaaaaaacaaacccacatttactattgcacaggttcaaaccaatggagtccacaacgaagcaatatccaaaaccaagagagaaggacgaaaggtatacaaaatatgtttgtttggtggtaacaatggcgacaatagtaacaatgatcatgctagtggtgccaatgaccgtgcattggtagtgcttggtggtggaggtcgttatgccaatggtggcatgatggtggaatggtggcagtgcaagtggtag

SEQ ID NO: 112632 - DNA, 366 bp, Glycine max
  Peptide Sequence Number=SeqID_229410
atggttgtcgaagtattggcaatcaaagtttctattcttgcgaacatagggtcgaaccaagcacatgcttttaagaaaaggttttcatcaagtgaaggaaagaacacgcttttattgtgcccttaccgaacccgtgctagagctagagtaatgagtgaaatagaggaggtgcaagagcagatgaaggctgacatggaggccatgaaagagcaaatgaccacaatgatgagtatgagaagcatgatggaggtcaatgcggctacagttgttgctgcaagtatcgccacagaagtggacccgactcacccacctagctttgttggatcaagtggcctcagaataattaagaaaggggggttgaattaa

SEQ ID NO: 112633 - DNA, 600 bp, Glycine max
  Peptide Sequence Number=SeqID_229411
atgactctgaaattgccttattgccctatatttgttcaagtcttttataacaacttggaaattcatgatggagtcatattttctaaagtacacaaaatacccattgttgttgatcaatccttgttttactccctaaccaaactgagcagtcaaggtgtgccttttgaaggaaccttagttgatgattattctagtcatgatgctcgtaaaatagtttgtgttgaaaatgctgataagactggtcgcttacttgttggttcctttacctttgaatgccgtgttatgcattttattctctgtcatgtgttgcttcatcgttctactaacctttctcaagcctctgagaaagatttaattttgttgtgggcacagcaaactggtttgcaaaaggattacctagctagtgctcccaaggaacgcactccatctccaccacctagggatccctcctctactttactgaatgatgttctcaacgagattcaagatcttcgtgcatttgtcggagaaaggtttgattccatggattctcgcatcactcctcttgaggatgacatgggatttatccgtcgttgctttgatcctccaaccaatccttag

SEQ ID NO: 112634 - DNA, 609 bp, Glycine max
  Peptide Sequence Number=SeqID_229412
gacatatttgctgctggaactgatacttcagcatcaacactagagtgggctatggcagaaatgatgagaaatccaagagtgagggagaaagcacaagctgaattgagacaagcttttcgagaaaaggaaataattcatgaaagtgatctagagcaacttacttatttgaagttggtgatcaaagagacattcagggtacacccacctactcctttattgctccctagagaatgctctcaaccaaccatcattgatggctatgaaatacctgccaaaactaaagtcatggtaaatgcatacgcaatttgtaaggattcccaatattggattgatgctgataggtttgtccctgaaaggttcgagggtagttctatcgatttcaaagggaataactttaactatctcccttttgggggaggacgaagaatatgcccaggtatgacattgggtttagctagcattatgcttccactagctctactactgtatcacttcaactgggaactcccaaacaagatgaaacctgaggaaatgaatatggatgaacacttcggattggctattgggaggaaaaatgaattgcatttgattcccaatgttaatttatga

SEQ ID NO: 112635 - DNA, 171 bp, Glycine max
  Peptide Sequence Number=SeqID_229413
atggagctttccgccattactgtaagcgaaacattatgtgactggaacagcatgacatttcgccagtgggattggcgaaacaagcatggcatttcgccattgaggttggcgaaacaagcacccatcacatcacgacagcagtgggtttcgctggtggtattagcgaaatag

SEQ ID NO: 112636 - DNA, 588 bp, Glycine max
  Peptide Sequence Number=SeqID_229414
atgcaaaatcaggaaattcaggttggaaacagctactccatggaaaattatcaatgggagcaagagttacaaccctacaatcaatatgaagaagaaagaacttctaatctggataatttattgatgcaattcaaggaagtcactgaatatactcaacaagcatttaaaagttttgaaattcaagttggtaagctagcagaagaagtgactaaatttatggccagaagagaagaaaactttataaaggttgaagctcaagaggaaagccctgtacgaaaccatgattcaaaagaaaaagatgaagataaaagtgaggagaaagcacaacaatgggagaagtactcacaagtagaaattcaacaagaaagtattctccaagtcaatacccatcctcatcaactgattgtcaaggaagaaagacatggagaacatgagaaagccttaagtgctattctttccttgatcactagcacttctcttgcaatgatatggaaggtgcttccagaatacatgactttcatggagtctctagctaggaggcaaaaatacaaggaatatgtgttctttgtgaccttcatgccaccttga

SEQ ID NO: 112637 - DNA, 348 bp, Glycine max
  Peptide Sequence Number=SeqID_229415
atgggggagcagtggagacaattcaagtatgatttgacatcgaaatgggcatttgcagccgacaaggaaagtgtcgacgacactgatatgcgcaagaaggcacaagccaaccagaaacataacattgcccctcacgtgttgtctcgtgagggttatgaatattcagaaaacaagttgatggatgagaagagaaagaaaaaactagaggaagctgctcaatccggaagcactaacaccgtgattgatcctctatctcccatcagacaacacatgaaatggaagatggcccgcacaaagaaaactgggcaaatgacgtctgaggcagcaaaggaaattgctgagaagatt

SEQ ID NO: 112638 - DNA, 588 bp, Glycine max
  Peptide Sequence Number=SeqID_229416
atgcaaaatcaggaaattcaggttggaaacagctactccatggaaaattatcaatgggagcaagagttacaaccctacaatcaatatgaggaagaaagaacttctaatctggatactttattgatgcaattcaaggaggtcactgaatatactcaacaagcatttaaaagtttagaaattcaagttggtaagctagcagaagaagtgactaaatttatggccagaagagaagaaaactttataaaggttgaagctcaagaggaaagccctgtacgaaagcatgattcaaaagaaaaagatgaagataaaagtgaggagaaagcacaacaatgggagaagtactcacaagtagaaattcaacaagaaagtattctccaagtcaatacccatcctcatcaactgattgtcaaggaagaaagacatggagaacatgagaaagccttaagtgctattctttccttgatcactagcacttctcttgcaatgatatggaaggtgcttccagaatacatgactttcatggagtctctagctaggaggcaaaaatacaaggaatatgtgttctttgtgaccttcatgccaccttga

SEQ ID NO: 112639 - DNA, 429 bp, Glycine max
  Peptide Sequence Number=SeqID_229417
atggtcacagggcacaattactttctctggcctctaattcggctaattatagttggtactgaagaagttcaacaatcagtggatagaaagattgaattgcccaacatccatggcagcaaccgggtgagtcagattgcccaagttgagaaaatcttcaaagtgcaacaaatgaagccaaatgagaagtttcaattcacattcatgatcatggaggggtcagcagggcatttgttcgtgttattgagaaagaagacatcagatttgacctgggaaaatttgacagtggctatggttcaaaggttcccaggaagacaattgtgcagtttgtatgaaagattacctaccttgcagcaaatggatttattgacgagtacatacaagattttggaatcctggtggcacaggcaaaacacactgggaaggatatag

SEQ ID NO: 112640 - DNA, 2010 bp, Glycine max
  Peptide Sequence Number=SeqID_229418
atggagatggtgaatacctggattgagcttcgacgtgcgttggaatctcagtttggtccttcgctttttgattgttctatggcagaattgaacaaggacatccgtagagatgtggttgcccaggctcctaattgtatgaggagaagcctatgttatttctgtgatgagaagttttcattcaaccataagtgtcctaatagacagtttttgttgttacaatctgagaatgatgatgctgagcttgaacctcatgatagtgaagacagatttgatagtgtggctgataatgcggaggtgattcttgaggatcatcacttgtcattgaatgctttaaaaggtgacagtttagacaatttcttacagccaagagtggctaaatttctcaaattacctgtggaaccagcacctttttttaaggttatggtgggaaatgggaattatatggaagctgaaggaatgattagcaagttaactatcaaagctcaaaatgccaggtttcaattgcctgtgtttttattaccagtatcaggtgctgatctcatcttaggagctagttggctggaaactattggtcctcacatagctgattatgacaagaggatgttgaatacagatgctgttgctgagatttttaccatgcaattaattgagcccaattctgtacaatttcctttattggagttgcccactgatatggaacctaaattggccttacttctgcattcttatagtgctgtgtttggaactcctacgtatcctcacagccagaaggaggaaatagagaaattggtgaatggtatgcttgaagaaggaattattcagccaaaaattgattatttgggacacaccttatcaggagctggtgtagcaatggagacaacgaaattacaagctgttttggattggccattaccaaattctcttaagcaattaaggggatttttgggcttgacaggatattatagaagatttgtgaaaggttatgctacaatagcagcatccttaacaactgatcttttaaagaaggactcatttaagtggtctgcaagtgcaagtgccactactgcccttaataagttgaaggaagttatgacttcagctccagtcttagccattcctaacttcaaggaaccttttgtactagagactgatgcttcagctactggaattggggctgtattaaagtttcatgccattacggaagctttggctaagttcagacactacctattgggccataaattcattatctgtactgatcagaaaagcttgaaggaattattagagcaaaggttgcatactcctgatcaacagcagtggttacccaaatttttgggatatgattttgttattcaatacaagctaggtagggagaatattcctgctgatgcattgtccagaagtttttctatggcgtggtctgaagcagttggagtgtggatgactcaagtagcaacattaattaaggaggatgctattctggctgcactttataaacaatgtatagagggaactgtgtcaggaactgaatatacagttaaggatggcttgttgttttggaaaggcaggatgatgattcctttgaatgaggcattgaaacaaaaaattatgcacgagtttcatgcttctaagattggaggtcatgagggaatcaccaaatcagtttccaggatttgtaaacaattttattggcccaaaatgcagcaagatataagggattttgtgagaaagtgtattatttgccaacaagccaaggtagaacaagcgttgccagttggcttattacaaccactgccaattcctcaaagaatttgggaggacattgctatggactttattacgcatttgacatcttcatatgatgcctttattgttaatatagtaaagatgcatggctttcctaagaccattgtctcagatcgagatcgtgtttttattagtgctttctggcaacagttattcaaagcccagggcaccacattggttatgagttctgcttatcacccttag

SEQ ID NO: 112641 - DNA, 429 bp, Glycine max
  Peptide Sequence Number=SeqID_229419
atggctgttctcatgcggtttgttggaagggacaaaaatactactttcagtgtggacgttgtgggacctctacaccaaagggtagtcccaaccataaggcaccatgtttttaccatttatgtctctgaagatatgattcaacaaaattatcaactggttctgccaccagaggcttcaatttatttaattgcatcaaaaaaatatatggttgtggatcgtggtagtggtaggcatcagaaatggatgattaccatgaacaatggcctgtcatgtgttgctgatgtgtggattcattatttagatgagtgtcatttgaaggctggagatgaggtcatctttttctacaacattgaccaacatctatgggaggtcctttataggaagcaggttacatgggatgacacagaggatgaagctgactccccttga

SEQ ID NO: 112642 - DNA, 315 bp, Glycine max
  Peptide Sequence Number=SeqID_229420
ggtagcaaaggatcattaaattgtaaacatcatgagccacatgatgagggaagcagtatcaaatcaatgctttacaagcttttggtcaatctgaggagtggtgtcttcatgctgcaaattgatgcatttgcaaatcctaatttggttaagccagaaattctgcagcatttccgtaatgatgttgctggcagctgtattcagattcacaaaaaagatgagtggatctggaaaatagaccctactagacaatattcggtaattaaaggagagactacaaacaaagacaaatttgaggaggagaagggtggcaattaa

SEQ ID NO: 112643 - DNA, 474 bp, Glycine max
  Peptide Sequence Number=SeqID_229421
atgatgagtttcaagagagaaaggaagaagagcttgtccaaagctctaaaagtgcatatgcaagaatctgatggctcaaacaactctggtggattcacatatgatgaagtagccctcacgtccagaaagttgaaacagatgatgaagaagaaaaacaagtatcaatactcctctaggcgcaaggatgactcaaatagtaagaagaataaaaattcatacgatgaacaagccaacatctatctcgtggaagatacagatgataaggtcaagactctagaagagagtctaagcctgggcagtaagcctgatgaaactttcattgtcgaaaaactaaggaaaaaagtagcatgtcttactaaggagtttgagaagttctttgaaagttcaaagactctcaccactcttttgaaattccatcaacatccccatgataagtctggtctgggttttgaaaaagggacaacattgatgtga

SEQ ID NO: 112644 - DNA, 219 bp, Glycine max
  Peptide Sequence Number=SeqID_229422
atgacgatagttgattcatgtacatggagatcccttgtatcaaaagtcttcttggcaggaaagtccatacatggagtccaggcagtgggtctcgtaggcgttgtagaggtgcaagatattagagcatattggtggcaatggctaagcgaggtggggaaaccatggttaagccttaagggccaccatggaatactcgtgaatgaaaatgactttccttga

SEQ ID NO: 112645 - DNA, 526 bp, Glycine max
  Peptide Sequence Number=SeqID_229423
gactacatgtcctcgccttgagaggactacatgtcctcgccatcagaggactctacatgtcctcgccttcagaggactacatgtcctcaccatcagagggctgcacgccctcacctccagaggactacatgtcctcgccttgagagggctacacgccctcaccttgggactacacgccctcagctttagaggactacacgtcctcgccaacagagggctacacgccttcacctttagaggactacacgtcctcgccaacagagggctgcacgccctcaccttgagagggttgcacgccctcacctttagagggctacgtgtcctcattttcaggaccggtagtttccttttaacggtccctgggccaccccctgatattggaggagggccaactgtgcgagcacaaccagagagggaggctatcacacagctactatgcataccggggcaagatttcacccgtgccgctgcaaagagacgagtgcggatcatgcgcaccaacatgaccactcttacacagatatag

SEQ ID NO: 112646 - DNA, 210 bp, Glycine max
  Peptide Sequence Number=SeqID_229424
atgaagttggcgaaaaaaggagagagcttttgggaagaaagcaatagagatatatgtgagcgatgcaacaaaggaaaacagggcaagggagcaccaaaaacctcagctttcaagaggattctaggtgttagagtgatttctaggttcctagagctgaaaggtgataacttgtcatggaaggctaaagctcttgttgggaatttctgctga

SEQ ID NO: 112647 - DNA, 634 bp, Glycine max
  Peptide Sequence Number=SeqID_229425
aaaagatgaagagcttagaggaagcagcaacggtgttatcgacgactatcataaatggttgaaggctcggacgcaagggataacttggctctcgaagctaaagatttctagcggggaagaagctgaagtccctgaggagagagaagaagtgcaagccttgaaagtgaaacttgaaagaacgcgagtggtcaaggaaaagttcaagatgacagccatcagggtctggaaagactgtaaggagctgagggatgtcaacatggtcgcgaccgaagcattagagcgagaaacgaagagggcccgaaaagaagaatggggccaaaacaagttccgaggggctttatgggcagcaacagtgaactcaagcttcgaagggataaaagggacaagtcgagggtcgaagaggagcttgaccgaacagctgagtaggacagaagagaatatatggacaatcgttgatcagtataaagggaagttgaaccaagctgttagccatgagcaaaggctagaggacgagcatgcaaaagtatcggctctgcaagcagaaagggaagcaagggaaagagtgatagaatcattgcatggagaagctatgaaatggatggataagttcgctttcactctgaatgggagttaa

SEQ ID NO: 112648 - DNA, 195 bp, Glycine max
  Peptide Sequence Number=SeqID_229426
atgagtttgtgagtgattgtgagatcctagaggtgaaggagacatcctcgccacttgtagttttgcaatctttcatcttgtttttctctttgttgttaagaaggcttcctgggtcattcaatagtggaaactggtctgactctgaagtccttgatagtgcagggctgagttgtcatgctttcacgaggaatcggg

SEQ ID NO: 112649 - DNA, 150 bp, Glycine max
  Peptide Sequence Number=SeqID_229427
gtgtgcctaaaagcaagagattcactatggtacttggattgtggctgttctaggcacattccaggtgacaagtccaaactctatgactttgtatcaaaagatggaggacacgtcatgttcggagacaataacaaagaaaaaataatgtga

SEQ ID NO: 112650 - DNA, 159 bp, Glycine max
  Peptide Sequence Number=SeqID_229428
atggaggagctaccacctgcaagctctacagtaataagatctgcccctgatgaatactctaaagcatggcttcaaagcactgagagtcttgggcaatcagtgcaggggtggcagaagtgggctgagctgcgaggtaggcactcggttagccaagagtag

SEQ ID NO: 112651 - DNA, 438 bp, Glycine max
  Peptide Sequence Number=SeqID_229429
atgcataaggcattgcgatcaaatgctccactcccatatccccatttgattactttatttctacaacatttcaatatccctcttgactctgagccctttgtcaaagtcaagagatccttctctataggtgcaaatgtagtttcctccttcggtaaccgcaaagagagggatggctcttgggtgaagaaggatgctccggtacaagccactgaagactgctctccatcaccacattctcagagagatgactcttcatctcttttgcacaacattcttgaaaggtttgatggacttcaaacctatgttggtgagaggtttgatgctttggaacgacaagtggacacgcgattcgatgcaatggactcaaggatcacaaaggttgaagaagatgtcaccattattcgtgactatcttgatttacctcctccaccaccatta

SEQ ID NO: 112652 - DNA, 471 bp, Glycine max
  Peptide Sequence Number=SeqID_229430
atgagtttaaaccttgagctgaatttgacgtgtgaatcaccgaggaagaaagaagaaggctatggttatgacatgaatgagaaaaagagttctcgttcttcccctgggggtttgagagaattacgtgaggatctgtttactgatcaaccaagcaagtttaataagaaagattcagatggtaaaattctttctccttcatggttgtcattatctgaagatgattataaagagatggttgcaacagtttgcatgcgttgccacatgttggtaatgttatgcaagtcatctccttcatgtcctaactgtaaattcatgcacccaccagatcagaacccttcaaaattcttgaagagaagcattctcgatcatccaaaacccatccatgttgccagagcagaattgaatttcggtacatactttcaggatttggaaacaagacaacccattgttatggatgatggtggctcttaa

SEQ ID NO: 112653 - DNA, 261 bp, Glycine max
  Peptide Sequence Number=SeqID_229431
atgaactatattattgaagaatctatccatgttgtttttcatgagactaaccctataagaccaagaaaggaaacacttgatgatattacagattcattagaagacatgcacattaatgagaaagggcacaaaggcaaaggaaatggtaatgaagaagactttcaaattgatgaaaataaaacaaatatagatcctccaagagagtggagaacttcaagatatcatccttttgataatattatcggtgacatctcaaaaggg

SEQ ID NO: 112654 - DNA, 156 bp, Glycine max
  Peptide Sequence Number=SeqID_229432
atggtgctaagccagtctctggaaaatgaactgaaaggtgctgaagactccgaattccctgtgaaggaaattggaaatgaaggtctcacaaaacggattctcagaaaaggagtcacttggcaaactccattctctggaaatgaagtgaaaggttaa

SEQ ID NO: 112655 - DNA, 246 bp, Glycine max
  Peptide Sequence Number=SeqID_229433
atggaaattctcatcctgagtcaaggtttatggtggtttgaggtcttgggtcaaaaggcttgcagaacgaccggacatgatgtatgtcagggtgttggtttggccagcggttcagggataaaggggatgtcccacatttatttccatgacacacatacaacaatgatgatttcgaaattttatgcaaaactggtcatgcatgcacccatgtggacactcaagcatcaagtttttatggtcatgtga

SEQ ID NO: 112656 - DNA, 420 bp, Glycine max
  Peptide Sequence Number=SeqID_229434
atggcatctacgaaaaggaaggctccttctacaccttcccaagttagatttgatcggtctaggttcacatctcaagaagcttgggagaggtatacggatattgtggtgcctaggaaactaccagagaggaatatggaattttacacgaacctctttggccccgaggataaatcacctaagcaggtgagggtgagaggtcatctggtgaaatttgatgaagacactctgaatacctttctgaagaccccaatgattatggaagagggggaaaatttttgcgcttattccaggtttgcactcctaaggcctgatcctcaggagttggcggctaagctctgtatcatagggaggggattcaagctaaatgctgatggtcagtcgttgaagatattaagggagaacatgaccactttagcttag

SEQ ID NO: 112657 - DNA, 444 bp, Glycine max
  Peptide Sequence Number=SeqID_229435
gtccctcaacccatggagagacacatgaagtacctcgagaccacactttagccgacttcgagcctcacctcggatatgccactgagggacaagcatttggaggcgtacccttgccaaacactttggggggtcctcagtatcgcccacaaccacaacccttgcattttatggtgggaagagtccttcctgctatgattgaaagggagaaatttgatcatattgaggaaaggctaagggtcattagaggtggcagaaattatgtctttgctgatatggcaaaactatgcctagtgctcgacgttgttaaccctctgaagtttaaggtaacgaattttgataagtacatgggaactacttgccccaagaatcacctgaagacgtactgcaggaaaatggaggcatacgcgaaagatgaaaaattgttgatgcatttcttccaggaaa

SEQ ID NO: 112658 - DNA, 480 bp, Glycine max
  Peptide Sequence Number=SeqID_229436
atgaccctagcacccatgttgctgctggagaaccacccaattcacctgaaccctgcgcactacatcagtgagattattagagaaggcacaaaaaatggcactgctttctttaagtgccatggacatgagcaatttgagatgacgggtttggatcctgagtataataggttgttcaatgagggcatggtgtgcactgctagggttgtgtccaaggctgtgatcactggctacaaagatgggttcaaccagattaagtccttggttgatgttggaggtggcattggagggtctctttcggagattgttagggcttatcctcatatcaatgccatcaactttgacttgcctcatgtggttgccactgctcctaagttcgatgggatcacccatgttggaggtgacatgttcgtgtccattcctagtgctgatgctatttacatgaaggtatatcaaaaactgatcaataccatatcttcttaa

SEQ ID NO: 112659 - DNA, 255 bp, Glycine max
  Peptide Sequence Number=SeqID_229437
atggctcgcttaggttgtaaggcttcaaagacaaatccaatgggagtcacattcttgtttcatcattcatctataaacaatttttttcaagtgaggttggatagagttctcatgaatcaagaatggaggattgagtctcccatagtgaagtctaccacgaggaccctcgtcattccatatcgtctcaagcttcagtgccaaaatttcgatagcggtcatggtagatattaccattaccttagtgaacttaattaa

SEQ ID NO: 112660 - DNA, 1336 bp, Glycine max
  Peptide Sequence Number=SeqID_229438
agggctgcatgccgtcagcttcagaggacaacacatcctcgccatcggagggctggaagccctcaccttcagaggacaacacgtcctcgccatcagagggctgcacaccctcgcctttagaggactacacgtcctcgcaatcagagggttgcacgccctcaccatcagagaactacacctcctcgccatcagagggctgcacgccctcaccttcagaggactacacgtcctcgccatcagaggactacacgtcctcgccaaaagagaattacacgtcctagccatcaaagggctgcacgccctcaccttcagaggactacacgtcctcgccatcagagggttgcacgccctcaccttcagaggactacacgtcctctccatcagagggttgcacgccctcaccttcagacgactacatgtcttcaccatcaaaggcttgcaacacctcgcctttagagacctacacgtcctcgccatcaaaggggctgcaagccctcaccttcagaggactacacgtccacgccgtcaacagctgcacaccctcgccattagagaactacacatcctcgccatcacagggctgctccccctcaccttaagacgaatacacgtcctcgccatcagagaactagacgtcctcgccagcagaaggctgcacgccctcaccttcagaggactgcacgtcctcacaatcagagggctgcacgccctcagctatagaggactacacgtcctcgccatcggagggctgcaaacactcaccttcagaggactacacgtcctcgccagcagagggctgcacaccctcatctttagaggactacacgtacttgccatgagagggctgcacaccctcacttccagaggactacatgtcctcaccatcagagggctgcacgccctcaccttcagaggactacacgtcctcgccattagagggttgcacgcccttgcctttacagggctacacgtccttgccatcagagggctgcacgccctaaccttaagaggactacacgtcctcgccatcagagggctgcacaccctcaccttgacaggactacgcgtcctcgccatcagagagctgcacgccctcaccttcagaggactgcacgtcctcaccatcaaaaggctgcacgccctcattttcagaggactacacgtcctcgccatcacagggctaggactacacgtcctcgccatcagagggttgcacgccctcacctttagaggactacacgtcctcgccatcagagggctgcacaccctcccctttagaggacttcacgtcctcgccatcagagggctgcacaccctcgcctttagaggactacaa

SEQ ID NO: 112661 - DNA, 366 bp, Glycine max
  Peptide Sequence Number=SeqID_229439
atgaaggcatcttttcacaagctgttgttgaagaaagatggaaacagagcaacctgggaatatccatttgctgttgctggcattaatatatcatttatgttgatacagatgttggatttatgctcagaaaagccacgttgtattccaggcatgaattttgtcaagttattaggagaaaatgaagaagcatttgatgttctatactgtatagcttttgagatgatggatgcacaatggctggctctgcatgcttcttacatggattttaacgatgttctacaagcaacacgaatgcaattggagagagagctatccttagaagacatcaacaaaatacaagacctgcctgcttacaatttgttgtaa

SEQ ID NO: 112662 - DNA, 220 bp, Glycine max
  Peptide Sequence Number=SeqID_229440
atggtttcaactgatttgccggtgtataatgaggaaggggaagttcaattgcaaccactagtggtctgggataagagaatgaagaagaagggaaaccgagctataatggaagtacttatccaatggcgacataccaatctcaaagatgctgagttgagcttagctattagagggatgtgtgtagctaagctctaccttctcaaggaagcttctcaaggag

SEQ ID NO: 112663 - DNA, 282 bp, Glycine max
  Peptide Sequence Number=SeqID_229441
atgaaggtgaaggtagcggtgttcagtattgcggtggtcgtcggcggcggcatacaaggtgtacggttgatcgtgcggatcaagttgatctgtaaagcaccaccaccacaccgccaaacgccagttgaggagaacgcgcgaggaagaagcagagcagagcagcacaacagcaccaccaccacgccgccaacaatggtgaagaagcaacccacgtcaccggcaccaacagtccactcgaggtcgcggaatcacgcagaagaagaagaagtctggtcacggtag

SEQ ID NO: 112664 - DNA, 874 bp, Glycine max
  Peptide Sequence Number=SeqID_229442
atggcgaagctgaagacgagcattgattcatcgttctgggacttcaacgtggcgtcccctcagctgcacgaaggatgggtcaagtccgttccgggcgacccgtttccgttggacggctccgtcgccagcagagtgctccggccacgacagctctccgtcatcggaaacgggttgcctcttcccgtcatcgttccctcgctctctcccacttcgcccaaggacttgggttccttctgtctccagtccctcctcctcaaactagctaatcctcgctggtggcttaccatgactggacagtttcgtcccaggaagctgattgctgatgttaaaaatgagatctctaatgctgaagaatttgatctctccacagtcaaggatgttgcgaagcatttcattaacaagtcactttattctttcgggttaacctcacaattcgcttttcctccttcaacatccttgctgcttgctatagaaggccatggtgaaaaagaaagattgcgcagcaaagtgatgcttcctgatcatgaccttacgttggaagcagcatggcctcaattatttgttgaccacaaaggaaaatattgggatgtccctgagtctttatctgttgatttgtcatcccttgtgtccgaatctggattgcgataccacattgggatgcataaaaacagtgttaatccccaggcaatgaatgcaaccaatggtaacccaccactgtctctactgccagggttatgtgcgaaggttgccgttagttatgagaagatcaaatacttctggagagataagggtgctgcagaacaagagaatgaagaggcgcttccatatgatgtgcgccttaaggaacctcatgcagcagtatccggaattattg

SEQ ID NO: 112665 - DNA, 321 bp, Glycine max
  Peptide Sequence Number=SeqID_229443
atggcgccaccaccactggcgcttccgcgtaggagctgccacgtggagagggacgcgcaaaaggtgacagggtgcacagtgctacaacagactgttgtagctgcaggaagcaggaaggaaacgccattggagcctgcgggttgcgtttgcaggtccaacgcgccatcacgaggagcgctttcctccttttatatgcagttctcatgctgcattgtgctacccgtttgctcaaccttcttcaagcttgcttccttgcttcctttggttggttccttgcttcctttgcatctttggtttctgctgcttgtaacttcttggtaa

SEQ ID NO: 112666 - DNA, 1383 bp, Glycine max
  Peptide Sequence Number=SeqID_229444
accaccgccgcaatagagacccgcgccggccactggccgcgcatttttgccaccgacgtctacggcaaaacgctcggcatcatcggcctgggcaatatcggtaagcaggtggcactgcgcgctaaaggcttcaatatgcgcatcctcgccttcgatttttatcccgatgacgccttcgccgccgaacacggcgtgacgtttgtcagcctcgatcagctgacggagcacagcgacttcatcaccttacatatgccgctcaccgaccagacgcaaaacctgttcgacgccgcgcgcctgaagcgcatgaagaagagcgcgtttctcatcaacgcgtcacgcggtggcgtagtgaatgagcaggatctctaccaggcattgcaggataacgtgattgccgccgctggcgcagcatccgctgttcaccctgagcaactttatccccacggcgcaccttgccggttataccgacggtgccatcagcgccatcggcgaacgctgcgtgacgcagattgtgcagtgtataaaacagggcgaacgcccgatgaatgtcatgaacgggctggcctgacgccgccctcctctgtcacccttttcgcgtggataatgattatgaccaacaccgcacgctcaacacgcatcagatggtggatcgctggcctgatgtggctggccattgccattaactatattgatcgtaccgtactctctgccgccgcaccgcacctgatcaccgagctcgacatcaatccggaaatgatgggctttatcatggcggcatttttctggtcctacgcgctgttgcagatcccggcaggctggtttgccgaccgcttcggccagaaaaaaggcctcggcatcgctgtcggctggtggtcgattgccaccatggcgatggggctcgccaccggctttaaatcgctgctggcgctgcgtctggcgctcggcgtgggtgaagcggcggcttatcccagcaacgccggtattaccgcgcgctggttcccggatcgcgagcgcgccaccgtctccggcctgttcgacagcgcatcaaaatttggcggggccgtcgccatgccgctgatcgtctttatgatcgcgctgttcgactggcgtctgacctttctggcgattggtgccgtcgggctgatttgggtcatcgcctggtacttcatttatgccgagaacccggaagaccataaagcgatcagcgccgatgaagtgcgcctgatccgcgatggccaggcgcagaagcacggtgataagaacgtgcggccgatgaagtggtacaagctgctgcgctaccgcaacatctgggcaatgtgtattggcttcttcaccatcaattacacctcctacttctttatcacctggctgccaacttacctg

SEQ ID NO: 112667 - DNA, 453 bp, Glycine max
  Peptide Sequence Number=SeqID_229445
atgacttcatcgccatggaaaacgccggttctggtgattgccgacgattttaccggcgccaatgacgcaggcagcggcttcgcgctggccggcgcacgcgtccacgtgctgttcaataacctgacaccctcggaggccggcgcagcggatgtgctggtgatcagcaccgatagccgtgcggtcagcgcagcggaagccgccagccgcacgcatgccgccattcagccgcatcagcagatagcgcaacacggctggctgtttaagaagattgactcaacgctgcgcggcaatccaggcgctgaggtagccgccgcgctgcaggtcagcgcgaaacggctggcgctggtggtgccggcggtgcctaagctgggccgcatcacgcgcggcggggaagtgtggatccatcagcagcgcctgactgacaccgaatttgccagcgatcctaaaaccccg

SEQ ID NO: 112668 - DNA, 1155 bp, Glycine max
  Peptide Sequence Number=SeqID_229446
atgaatatcaacagcaccgtgatcagtggctatcaggctttgaacgatctcagctatttactgcaggataagcagaaggcgttgctggtcacggataaaaacattctgggcattccggcggtgcaggcgcttatcgcccggctgcagcagcagatcgccagcctgagcctggttgatacggtgccgcccgagccgagccagcatgatgtggcggcgattgttgcggcgctgccgcacggcgacgtcgatctggtgataggcattggcggcggcagcgtgctggatgtggcgaagctgctgtccgtgttgtgcgtggccgatgcgccaaccctgacggcgctgctggccggtgagaagccgcacacgcgtaccgcttctttactgatcccgaccacggccggcaccggctcggaagccacgcccaatgccatccttgccattccggagaaggagaccaaggtcggtattatttcgccggtgatgctgccggactacgtggcgctgattccggaactgaccaccagcatgccggcgcacatcgcctcgtcgaccgggattgatgcgctgtgccacctgattgagtgctttaccgccaccgtggccaatccggtgagtgataactatgcgctgatcggcatgaaaaagctgttcgccagcctcgaaaagacccttgccgaaccggacaacctggaagcacggctgaatatgttgtgggcgtcctactacggcggagcggcgatcgcccatgccgggacgcacctggtgcacgccatgtcctatccgctgggcggcaagtatcatctgccgcacggcgtggccaacgccattctgctggcgccgtgcatgcagtttgtgcgtccggcggcggtgagcaagttcgcgcaggcctacgatctgctgccggatgccaatagcgcactggatgaagaggccaaatcgcacgcactggtggcctatttcgccgcgctggtgcagcgccttaaactgccggccagcctggaagcgctgggcatcgggccggatcatctgccgtatctggtcgaagccgcgctggacgtgcagcgcctgatgaagaatgtaccgatgaaagtcagcgccgacgatgtgcgcaacgtctacctgacgctgtttccggcgttaaatcactcagcatga

SEQ ID NO: 112669 - DNA, 1329 bp, Glycine max
  Peptide Sequence Number=SeqID_229447
atgaagggacaaagccgtctcgaccagattatggactatctcaaaagtcataatctggtcactgttgaacagctggtgagcgccatttctgcttcgccagccaccattcgccgcgatctgattaagctggacaaggaaggggtgattagccgcagccacggcggcgtcacgctgaaccgctttatcccgacgcagccgaccacgctggagaagatgcagcgtaacctggcggagaagcaggccatcgcccagttcgctgccagctatgtgcagtccggcgatgcggtggtgctggatgccggcaccaccatgctggaactggcacgacaactgacccatttgcagctgcgggtaatcaccgccgatctgcacattgcgctgtttttgtcggagtttaaacagattgagaccaccatcatcggcggccgcatcgatgactccagccagtcgtgcattggtgagcacggccggcgcctgctgcgcagtatcaatccggacattgcgtttgtcagctgtaactcatggagtattgagcgcggtattaccacgccgacggaagacaaagccgggctgaagatggatatgctggccaacgcgtgccggcgcattctgatggccgacagcagtaaatatggctcatggtcgctgtactgcgcggcaccgattgatagcctgacagatgtggtgaccgattctcgtcttgatgaagcggtaatacttcagatcaaattccttcagcaacatcttggtatgaaagatgttttcctgataaacgttaacgtccaccatgtcgtacatcgctttcatatcctcggacatgaagttctgaatagaattgatctcatggtcgatgaaatgcttcacgccattgacgtcgcgggtgaagccgcgcacgcggtaatccacggtcacgatatccgactccagttggtggatgagataattcagcgccttcaggggcgaaatcacgccgcaggtcgagacttcaatgtcggcgcggaagatgtgactcttgtcgaggtgcgccaccaccgaactgggcagcgggccgggatgctcggaattatcgatatcctgcggattgatcggctcttcgctgaccagaatcgtcacgctggcaccctgcggctcataatcctggcgcgcgatattcagcacgttagcaccgataatcgagcaggtctcggtgaggatttccgtcaggcggttggcgttatattgctcatcaatataggcgatatagccatcacgttcggcttcgctattggcatagcaaatgtcgtagatacaaaaactcaggcttttggtcagattattgaagccatgtag

SEQ ID NO: 112670 - DNA, 219 bp, Glycine max
  Peptide Sequence Number=SeqID_229448
atggtagccataagcccaacaaagattactcaaccttcatttccccaaggatacaactcgaatgtgacatgggcttatcatgggggagttccagggcattccattgagcactgtatgaccctgaaacacaaggtcatgacaaacaacagtagcagatatgccgaaacctatacaggtgttggatcgagtggcctcagaataattaagaaggggggttga

SEQ ID NO: 112671 - DNA, 228 bp, Glycine max
  Peptide Sequence Number=SeqID_229449
atgcatgtatgtgtacattatggaaaaatactgccaacaccttatgttgggggaaatgtcttgaaaattatgaccaggccttgcttaaagggaatagaagagaagactgccaacttggaaggaagtgagaaggctctagttgcacggcatgaagctagtcatgctgtagtaggtactgcagtagcaaaccttcttgctggacagccacatgttgagatatgtggatga

SEQ ID NO: 112672 - DNA, 183 bp, Glycine max
  Peptide Sequence Number=SeqID_229450
atggcgccaaaatacttgatggatttgctctgggatactacttgtttgtgtggatgcgaaatctaccggcaagtgcaccgggccgtcaagcatttgcaaacagaaatcatgattgtgaatgaaagtaaaagtatgttctatcctaattacaaagcaataaacatgagcaagctcaagtactaa

SEQ ID NO: 112673 - DNA, 420 bp, Glycine max
  Peptide Sequence Number=SeqID_229451
atgcctcaggatgcagtagtggggttgtgcttagagagatgggcttgcttggcgctatgccattccagagaaagatttgggcttagcagggcatggggcgcgctgagcgagtggatgattgaaattttttctaagttctttcctcatccaatgcttcagagaagcttttgccaacctgatgcaagctccattggagcttgtaggcctaggatcttcttcatcaatggattcctttgcttcttggaagatgaatggcagcggaatggagaaagggaaagagagaggagacgccacttcaaggagaagatgagtctagaagaagctcaccaccataggaggccatggataagagcttggaggaagaaggagatgaatgaagggagagggagagaagagcacgaaattttgtgctctaaatga

SEQ ID NO: 112674 - DNA, 228 bp, Glycine max
  Peptide Sequence Number=SeqID_229452
atggtgctattttctgaaggcgcgctaagcaagtctgtctctctaagcgcccaatggcctccaagaagagaaaatcatccacctccagacctcaagaaccttatgacactacgagattcatttttgaggtcgcttgggagtgttatgagcagaacgtgcattccagaaactgtggaagcaatgctttccaagtttattttgatgatgccaaagactcgagtcaagtga

SEQ ID NO: 112675 - DNA, 444 bp, Glycine max
  Peptide Sequence Number=SeqID_229453
atggttaggttgttgagttggccacctgctatggtcttccatttttttggcaggattgagtcaatggttaggttgtttaacgtgctttcagttccagttgagtttgccaactgctatggtcttccatttctacgcagggttgaccaaatggtcagatggctttttaacctccatttcactcctccgctggaacaacaagcatgcggcagacccctactagcagctagaatgcatgtctggactcttgaactcacacagtccctgcttggtgatcctaaaccattggtgcttccacctcttgtagcaatacatcttccttcttgcggttttcatatgacgattttaagaaggttcggccctccattgcaatggcctgtccttccagttggccctggctttcatgacaagtgtgttgctcgaccatggtaccggtttctcgcttaa

SEQ ID NO: 112676 - DNA, 870 bp, Glycine max
  Peptide Sequence Number=SeqID_229454
atggaggattataagaagaaccatccttatcagcaacagcaacagcatcagcatcagcaagaagaagagaaagaagtagtgtgtgagaagatggagaggtatcctagggatttgcttcaaggattttccatcagtggtgttgctactattagggatgataataacaaaattaacaataataacatgatgcagcaacaacatcatgttcttcatcatcaccatgagcagcagcaacagcaagagcagcatgaggaggacgatgaagaggttgagttgaaccttggtctttctctcggtggaagatttggggtggacaagaacgccaaaaaaaagaggcttttacgctcttcttctgtggtggggacaatgcctctgttccggcaggacgatgcggtggcgccgtcggcggcggcgttcccggcgctcatgaggacgtcgtcgctgcccacagagaccgaggaggagtggcggaggcggaaggagatgcagacgctgcgccggatggaggcgaagagacgccgctcggagaagcagaggggttcccgggaggtcttcgccggcgccggcgaggaggtggaggcaggggggactatggcaatgggattcaacaagtttggttcttcggcggtggcggttccgccgccggggtggggtgttccggcaaagcaagttgttcttggtgatgtgttggggaagggaagggggtttcaaggattgtttgggcaaccatcttctcagggttcggctgattctcaaggaggaagctcttcatcaatgtctgaaatggatagcaaggcttttctagattgtggttcgcgttgcggtgagacagaaaatctttgccggaaaatgtggccattgcgattgtga

SEQ ID NO: 112677 - DNA, 429 bp, Glycine max
  Peptide Sequence Number=SeqID_229455
atggtggaaaggggaaattttgatcatataaaggaaaggttgagggccattaaaggaggcgataattatgctatcgctgacatggcagagttgtgcctagtgcctaacgtcgtcatccctctagggttcaaagtgtcggacttcgataagtacaaggggactacttgcccaaagaatcacttgaagatgcactgcaggaaaaagggagcatatgcgaaagatgaaaaattattgatgcatttttcccaagaaagtcttactggggctgccctcacttggtatactaatttagaaccttcccgagtccattcttggaaggacttaatggttgccttcattaggcagtatcagtacaattctaatatggctccggatagaatgcagctacaaaacatgtgtaaaaaggagcatgaatctttcaaagaatag

SEQ ID NO: 112678 - DNA, 1068 bp, Glycine max
  misc_feature (1054)..(1054): n is a, c, g, or t
  Peptide Sequence Number=SeqID_229456
atgctggtgaaggtggcgccggacctgagcgagcgcgacatcgatgccgccgcccgcgtgctcggcgagctgcagcaaggtggccggcgacccgctggccaacgaggccggcggcctgtccggtgcgccggtgctggagcagtccacgctggtgctgcgccgcctgcgttcgcgcctgcccgaatcggtaccgctgatcggtgtcggcggcatcctgtccggtgccgatgcggtggccaagatggccgccggcgcggcgctggtgcagtgctacagcggcctgatcttccgtggcccggcgctggtctccgaatgcgtggaggcgatccgtcgccgtcgcgaagcaccaagccgcggcgcggtggccccactgtgagcgcgcccatggataccgtcgacggcaacgcaccgctgcgctggacgctcacccgcaatgcgccgctgcaggcgctgaacaccttccatgtgcaggccagcgccgcgcagctgctggaactgcacgatgccgcactgctgccggacgtgctcgcgctgcccgaggtggccaacggcccgctgttggtgctgggcagcggcagcaacgtactgatcgccgaggacctgcttggcacggtactggtgttcggcaaccgtgacatcagtttccttgaacaccgcgccgaccatgcggtgatccgcgccggtgccggcgtgccctggcacgggctggtgatgtggtccctgcaggagggcctgtccggcctggagaacctggcgctgattcccggcaccgccggtgccgcgccgatccagaacatcggtgcctacggcgcgcaggtcggcgaattcatccaggccgtcgaggcctgggactgccaggagcgggcctgggtgcggctggacaacgaacagtgtggcttcgcctaccgcgacagcgtattcaagcagcagcctgatcgctacctgatcaccgccatcgagctcaagctgccgctgctgcacgatctgcgcatggactacgccggcatccgcgaggaactgcaggcgcagggcgtggaattgccgagcgcggtgnacgtggccaatgcg

SEQ ID NO: 112679 - DNA, 750 bp, Glycine max
  Peptide Sequence Number=SeqID_229457
atggcgggcagccagggcttcctggcggtcacgcagctggctgaccagctggcgcagcgcggtttcttcctgcagctcacgcaggccggcggtgttgggcgaggagatgttgaccgtgatgtagtcggccagcggatagaccttgtccaggcaggcgatgtaatcgtccaccgcctgttcgttgggggtgtccttgttcttgccgatgttgatgccgagcaggccgcgacggttgcgcgcgcgttcgacgttgcgcaccagcgcgtccacgcccgcattgttgaagcccatgcggttgatgatcgcattgtgcgccggcagccggaacaggcgcggctgcgggttgccggcctgcggacgcggggtgatggtgccgatctcgacgaagccgaaacccagcgcgaacaatgcatcgatgtgctcgccattcttgtccaggccggcggccaggccgaccggattggggaacgtcagcccaaacaccgtgctcggcatcggcgcgatgcgtgcggccagcagcggcgtggtgccggtgcgataggccaagtccagtgcggacaggccgaggccgtgggcgcgctcggcgtcgagcgagaacaggaaggggcgggcaagcgaatacatgcgtcggttcagtccagcgtgccgaggaatgctcgtgttcgatattcaaaagcaacctggccgtcgaccgcgtgggcggcgaacaggtcctgcagggcggcgatcatcagcgcatggcgcggatga

SEQ ID NO: 112680 - DNA, 141 bp, Glycine max
  Peptide Sequence Number=SeqID_229458
atgatgcatgcacctgactcaacactcagatgcaatgtgggaactgtgctgagtttgtcgagatcacccggttatgcacgtaacagcccccctcccataggtgatcagcctgggagcccaaaggtgttccctaccaggtga

SEQ ID NO: 112681 - DNA, 164 bp, Glycine max
  Peptide Sequence Number=SeqID_229459
atggctatccaattcaagaagaaaacaaatgtgaatcaaaagcaaatattcatagttaatcaaagaataaagaataggtgtcttggagagaagttccccagcaacgacaccaaaaacttgatcgagctcggcaagtgcaccggacacacaagtagtataaaatg

SEQ ID NO: 112682 - DNA, 258 bp, Glycine max
  Peptide Sequence Number=SeqID_229460
atggcatgggagatgataacaatgatagtagacacgttaccggtgctctactatgagaaaatggtaggttacaaaccttcaagctttgccaatttagttttcatcggcgacaggatcgaagtgggtttgaaaagaggaaaaattgataatcctgttttgatgaatgggaagcctggggcaaatagagaggatgagaaggcagaaggaacccatgttgtgactgccattccttcatggccaaatttcccaccagcttaa

SEQ ID NO: 112683 - DNA, 580 bp, Glycine max
  Peptide Sequence Number=SeqID_229461
gtggtcaatggtttttcaagaaaaacattggtgttaatgttgaagatgatgatttaactgttgatactcgtctcagtcctttctccacacaaatgccgcctacagtcaacagagaagaagaagttgacaacgagagactagtcgttcatgtagatcttgccactaggaaatccgatggtccacacaaaaagaaatttataatgtatttggggatcatcactcaagacatggtggatgctacaattgataattggaaacaagtccctatagctcaaaaggatttaatttgggaggatattcagttagatttgacctccaaatgggctctggcagatgacaaggagggcgaggatgataaagatgtattgattgcaatcattgggcaaccagagcaccctggtcatgtccgtgttgctgagccgatgcagtcccagatgccattgcggatgcaatcacagagactcggactgccttttgagcctgaggttggtccttctgctgctagtgttagcacaaaggaaaattatgttgatctcttgggtcaggacccagacacgggtggctcaaagaaatctgggct

SEQ ID NO: 112684 - DNA, 811 bp, Glycine max
  Peptide Sequence Number=SeqID_229462
gaaggatagtttcataacacacagggcgttctgtgatgcattggcggaagaaagtgctagactatcagcaaatcaattagctgccgtcgccaccaccacatcaaatccattccaatctctccatcttttccaaacccaacaacagaacttccaaaaccaccaaatcagcagtttcaaccaatgggactcatctcaagaaaaccctaaccctaccaatattattgccactacttccctccacatcaagccagagtctcaaaccttccacaaccccaccctctcttcacttctccaacagcaacaacctaccaacaacaagggcatgatagcctcaaccttcgggaacctccacgtggccacgcaagcatctgccacgtcagcatacatgtcagccactgcgctgcttcaaaaggctgcaaccgttggagccgctgccatcacgggccctgttgggccacaacagcgcgtgacgggtcacgtgaatcacgtgacccaccacctcggctcgggcgagttcggaatcggaacagtgagtcaactcgacccagtggtggcggtgccagataacaactacatgagaacaacgttcaagggtgaccgtctcacaagggactttctgggtctcacggcagatgctaccggcggcgcggttgacgttagcaccaacgtgaaggatatgttaacgttcgcggggggcgtagagtaccaccaaccgcaccgtcagcatcaccaccacgcgcttctgaagccccaacaaggcttcggtttccttgggacagccactgcccccgagacgtgggggaattgttag

SEQ ID NO: 112685 - DNA, 429 bp, Glycine max
  Peptide Sequence Number=SeqID_229463
atgggacctcatcaagaagagacagaactagtggacttaggaaccgacagtgcgaaaaaggaagtaaagataggcacgggtatgaccgcacccatccgtgaagaattgatagccctgctaaaccaagacatctttgcttggtcatacctagatatgcccggtttgagttttgatatcgtaaaacacagattacctctaaatcctgagtgttccccggttctccggttacaatcagataatgtcgcaacctacccttcggcgggagggcgacgcgtgactcgcgggatgcgtgttccacgaaaggaatacgcgcggagtcgccaccaacgtttatttgaggaaaacgtcggaaaaaccggaaaagacgcgatctacgaacttttaagtgaaaggttcgggagttgtatttacgcacggggaaggtattag

SEQ ID NO: 112686 - DNA, 198 bp, Glycine max
  Peptide Sequence Number=SeqID_229464
atggagttacgaacgccgattaaggtagaaaatggtgtaccagcaaatatgctggtgcccctagcagttcccattgggcaacgtgcagttttacttgggcccagagaggcagttcaatttaaacaagcaatttactatatgcactttcatttttctaagtacaccctgtaccccattctacctctcaattatccataa

SEQ ID NO: 112687 - DNA, 422 bp, Glycine max
  Peptide Sequence Number=SeqID_229465
ctccaggagggaatttggcgtactctttgaatggaacatcaggggacaaatttcagttcaaagcctcacaaaatggaatatacaaattttgctttcacaaccctgcttcaacgccagagactgtatctttctacattcatgttggccacatcccgaacgcacatgacttagctaaagatgaacatttggatcccattaatgtgaagatcgccgagttgagagaagcactagagtctatcatatcagaacaaaagtacttgaaagcacgtgatgctaggcatcgacacacaaacgaaagcaccagaaagcgtgttgtcttctacacaatcttggagtatgttttgttcgctgctacaagtttattacaagtggtatacattcgacgtctgttcagcaaatcatttgcttacaaccgagtgtag

SEQ ID NO: 112688 - DNA, 309 bp, Glycine max
  Peptide Sequence Number=SeqID_229466
atgacttctggcttagcgccagtcatgctcgctcagcctggaggttcaagcggcgaaagggtagagactagaggctatgatgacctaatgaccactttcggtcaaggccagctcttaaagagcttaacaataagatatctacttgttgatgcaaatacatcatattttgctttgattggaaggaagacacttaacaagcttggagtcatagtctccatgtggcatctaaaaatgaaattccacaccctgactggggagattgtgactatcaaggaagatcaaaaggaagcacaaaagtgttattcatag

SEQ ID NO: 112689 - DNA, 582 bp, Glycine max
  Peptide Sequence Number=SeqID_229467
atgcgtgatcataaagcccaagaacttgcctccgtagaccctgaaagtacatttttccaggttgaggcgcatgtcatatttgtggagctcttccaagacctcttccaaatctatcacgtgttgggttatgctctgggatttgacaatcatgtcgtcaatgtagacctcgacatttcatttgatcttctgcttgaacattcggttcatcaatctctgttttatctggagcaaacgtccaggaagcttagcacttggaatttggaagctccatcgactagcctgttgaggttgggtagaggcgatgcacctatgttcatggctggtgaggtccctaccgagttgcatacgctgcctgtgtttgggtttgagctacagcttgacgagctcttcgatgggcttttggcctctagtagaagtgtcaccgcacgaatctatatcgaatttgtcgtccacgctcacttggtagatgatcagggctcggatgggaggcccttcgtccatgttcatgacttgactaccttaagcctttatagggtgaggcttggtaggctccctagtgggaggataggatgccacctctag

SEQ ID NO: 112690 - DNA, 288 bp, Glycine max
  Peptide Sequence Number=SeqID_229468
atgtcactcgccgtggatggcacataccagagacttagtggtgtgctcttccatacatgtcactcaccgtgggtggcacgtattggagacttagtcctaaaaggagagctcactaagggcagtccttgggttttaagagcgtcggagctacaactatggattctatttgctccattgtctaggcttgctatgaccatgaatggaccttcccagttgggaccaagctttcttgctcagggatctttattggcttcacctcggactcgccacatgaggtcaccgggttga

SEQ ID NO: 112691 - DNA, 378 bp, Glycine max
  Peptide Sequence Number=SeqID_229469
atgcctccagtacatgtcagttcacgagtaacacatatgcaagagcacaacattacatctccagtacgtgacacgtatgcaagagcacgatgcccaaaacccaggtcaaacaattcccttgtcgatcctccaaagggctcacaaaacccaaggtctgcccttggaatacaagtctataaaaaaccaaggtccctccttggtaccaaaaacccaaggtctacccttggtatgcacgcctacaaaacccaaggcaccccgttggtctgctcattcgcagcaactacaacggccaaagtccaaggtctaggctccatgagtcaagacgacctacccctaaactggctggcaagggcttcaaccaagtgcagtccaaactaa

SEQ ID NO: 112692 - DNA, 375 bp, Glycine max
  Peptide Sequence Number=SeqID_229470
atgttggttctggccaacactgacctcagatatataccgtccaaggtagcgaaaggatcacacgtcgaggaaagagacaaaatggcttgcaagtccaacgagcttattggacacactattcaaggagaccaaaccaatcttgccagtcagattcatctggatgaaaaacaggaagattggcacactaggtcgaatgttgaagaaggggcacaaaatttcaaaggccctcaccatggcccacctattcgggcggagttgggaaggggccacattcaagtgctaaagaagagcacacaaaaaagtggtcaagggaagaacgaggcccaataccacaaacagaaacctgtacatggaaaggaaaggcagattacctga

SEQ ID NO: 112693 - DNA, 773 bp, Glycine max
  Peptide Sequence Number=SeqID_229471
atgggccttcgtgccctgaggcaagctgtagagatgacacctggtatgggtcccccttctagtttgcaagatctacctccggctccatcggtcgtcgaggctcctgctcttgctactactgttgctgctactcttgctcctccatgtcctcctgtcgtaccagtttgggaggttactcctgttgttggagttgatgcgttggctacttcagttagttttgttgcagcgtctacatccaccgttaccacacccttgttgagtgacgatgtggcgaccactagtgctcctgtgatgttgcctcctcattttttggctccctctgttccaccctctactatgttggcggtggcatcaccttccttatcttctcgtccccatgtctttttagaccacttgtacacttccagtgatgttgattcactgtgggaatgggcagcggcaccaggaggctttgcacaagtggtcatccttggagacgaagagtgccttaaggtagctaacaccaccatcaccttcgctgaagctataagttcaaaccaccaactatcttccaaggttggcaatgtcttggccaagttgctgagcacatggttggacagtgatgaactgttcgcacgctgtaaaggcattgtggcagagaaggacaagcttgccaaggtggttgctaatttggaggcccgactaaaagagtcagtgttcgggttggaagagtctgagctacaggtggttgaggagagggaggacaacaaggagcttgaagaggagttgaagat

SEQ ID NO: 112694 - DNA, 189 bp, Glycine max
  Peptide Sequence Number=SeqID_229472
atggctgatggaaaactgatagagaagaagggtagggttaacctagggttaaaaagtgagaatgactgtgggaaagcttgggctgtgcaaaggaggaaaatgaatgaccaaagtgaaggtaagagccatttcaagggtaaattgggtgttgaggagtcaaattttgattcggtagagttttcgtcgtaa

SEQ ID NO: 112695 - DNA, 279 bp, Glycine max
  Peptide Sequence Number=SeqID_229473
atgcgtctaccggggaaggagagtctgctgatgaaatctcccataaccataaatgagattttggatgttagcatttcgtttctaaatgaccatttagaggaaacactgggttcgacaaaaatagaagaaatccactcaaagtgtatcaatctcgcacagggtaaggtttatggtgagtcaggattttggctcaaggcttgtagaatggctagacatgatacatgtcagggtttggtttggttcaaggataaaaagggatgccccacattatttccatga

SEQ ID NO: 112696 - DNA, 204 bp, Glycine max
  Peptide Sequence Number=SeqID_229474
atggttacttccatgcttcaacttgactcgatgaaccttttcgtaaaagcacgagcttggttcaaccccataacccagggaatggcaattttgatcgccaatacttcatcaacaattcatagggatgcaagactcgagaatatgcatgctatgcatggaaaatttgaaggggaaaacgcaagggtcacgcatgagcaaacatga

SEQ ID NO: 112697 - DNA, 948 bp, Glycine max
  Peptide Sequence Number=SeqID_229475
atgtcacttcaaattagatcgattcaagttgtccgtgccacgtcaccggatcaatccaggagagagggagagatgggaatgaagcattcaacacgtacgcatggccaggacgtactggcgttggccatcgcgctggccttggccgccgccgtcattccggctggcgccgccgcgcagcaggccgcttccaccggcgcgcaggacgccaccaacctggacagcgtccaggtcaccggctaccgctacgccattgaaaagagccttgagcagaagcgcgacgccaacgccgtggtcgaagtgatcaccgccgaagacgtcggcaagttccccgacaagaacgtggccgacgcactgcagcgcgtgcccggcgtggtcatcacccgcagtggcggcgaaggcaagaccgtcagcgtgcgtggcctggcaccagacctgaccctgacccagttgaacggcaactacgtcgccacgtcggaaaccaacgacgaagcgacccgttcgttcaactacaccctgctgccgtcgaacatgctgtccagcgcggagctgttcaagtcgccggaagcacgcatcgacgaaggcggcatcggcggcacggtcatcctgcacacccgtcgtccgctggacatggaatccaactcgggtttcgtcacgcttgagggcacctcctccgatacccaccacgatatcgacccgcaggcctcggccctgtattcgtggcacagcaaggacgagcgtttcggcgtgctgatcggcgtgacgcagcagaagcgcaccacccgtaccatggaagccagcaccgaggactaccagtggtatggcgccggcaaggcgcgcgatgcctatggcaacgtgcaggcgcaggatggcatccactactggtggggcaagtccggtttcaacaaccagaccggcggcaactacagcgatttcttcatgccgacgtcg

SEQ ID NO: 112698 - DNA, 1137 bp, Glycine max
  Peptide Sequence Number=SeqID_229476
gtgtttgcacctgttgcaagaatagagacagtgagaattattactgctatagcaagtaaaaaagggtggcatatgcaccatatggatgtgaaatcagccttcttgaatggtcctctagaggaggaggtttatgtgagtcaaccacctgggtttgaaataaaaggaagtgaagaaaaggtgtacagattgaacaaggctttgtatggcttaaagcaggcgcctagagcttggaacaggcgcattgatggctttctaatgaagcttggattcctcaaatgtacaactgagcatggtgtttatataaagggcaacaatactactaacttgattgtagtgttcctgtatgtagatgacttgcttgtgacaggaaataatgagactgaaattgccaactttaaaggagagatgacgagagaattcgaaatgactgatttggaccttatttcttattttcttggaattgaattcaagagaactgatgaggcagtgatcatgtatcaagggaggtatgcaagagatgtactgaagaagttcagaatggttgactgcaattctgcagacacacccattgccactggtgtgaacttggtgaaagatcctaatgaagaagaagtagatgtactctcgattatggtactctgtttcccagtgctgccaaaaaatgtaatgttctgggatatagtgattctgataggtgtggagataagagtgataggaagagcacaacaggttatgtgttcttctatggtgatgccccaatctcgtggagctcaaagaaggaacaagtggtggctctctcctcatgaggcagaatacattgcagctgctatggcagcatgtcaagctcaatggcttgataatatttttggtgaactgaagatgaaggaaaagggtgctattacaatgatggtggacaacaaatctgccatcaatctagctaaacacccagttgctcatgggaggagcaaacacattgaaacacgatttcatttccttagagagcaagtgacaaaaggcaagctaagtgttaagtattgtccaactactgtgcaagtagcagacatattcactaaaccattgaagattgatcagttcaaagagttaaggagcagattgggagtgattgaagtgcagtga

SEQ ID NO: 112699 - DNA, 618 bp, Glycine max
  Peptide Sequence Number=SeqID_229477
atggaagggaatttgtactttactatcaatggtgtagagatgatcattgatgctggagtttggaaaaaagtagtagggatagatatgggtggaatccgcaaatttgaagaatttgcatatggctacaataagatgcaaacttatagaggtatgctccttgacccaacaaggattcttagaaaccgcctaggagttggtggtctgatagttgaagatagaatgctagtgtatctcattacctacattctaccactaaggtccagcaataatgctcaagttactgacgacgacttacaaatcgtatatgggatgaaatcaagtattcaaatgaattggatacttctgattaaagatattatgttgaagagccatcaactagtggattatgaatttccatatgttgtcttagcatctggattcattgattacttcaatatcgatgtttctaatgagatagtagacttcaccaaagcctctaatgagataaccaaaaggcatctcaagaagcttgggatgagatatgtttatcatgaattgattatggtcagagagccacctacagcagaaaacatcaatcagatggaagaagaagctcaacaagagcctgctcaacaatga

SEQ ID NO: 112700 - DNA, 240 bp, Glycine max
  Peptide Sequence Number=SeqID_229478
atgggcccaaaatctaccctaaggctcatgagaaccctagggccttctcctgcatctctgcccaatcttcttggagtcttctatcgaatgcccttggggggtaggattgcatcaccttctatgtctgatctatgggatgtgtatggtgaatgggatgaaacttacatgttcatacgtcatttaccatcttatagggagttggcaatgcttgagttggtaactgccgataatgtccactaa

SEQ ID NO: 112701 - DNA, 639 bp, Glycine max
  Peptide Sequence Number=SeqID_229479
atggcaccggcgaggtacaggttgatgaaggatatctacacgcggtcgcagctggaggcgttagctgcgaacaaggagggattcttcgcgcggaagatggcggagaacaagtctcggccggaggggctgccgccctcacagggagggaagtatgtagggtttggatccagcctgacatcgtcgccacaacggcggaatgatgcgcaaaacgattacttctcttccgtttcgcaggggattaggaagttgtctttggttgctgcctctatggctaatgttgttcaggctggcatgaaggagttcacttccaagcctcaggaagctactgttgatctgccttatgttgcctttgcagtaaggccaaatcctggagtttgggaatttcctcctgtagattttcagcactatgctggatatgtcacagtcaacgaaactaatggccgagtgctcttttattggttctatgaggccatgaccaagcctcaagacaatccattagtgttgtggcttaatggagggtgttcttctgtgggatatggagcaacacaagaccttgacccatttttagcggacactgatggcaggggccttaaattcaataacttttcctggaacaaaggtatgaaacgtgagatctag

SEQ ID NO: 112702 - DNA, 294 bp, Glycine max
  Peptide Sequence Number=SeqID_229480
atgggttgcaggctatcaaaaaaccacaaaatcgatattaaaataaccagtaaaaaacaatcagagatattagccaaaaatcgattcacaaggtcgaggccgaatagcaacctgaggttttcgaagcttactccgtctccgctgttcctttctttgccttctgcaaggcactctgatgctttagcatccatcaagaaatacaacagtatgagtgatggaaagctattgcaaattgagtttgttggaacatatgcatgttcagctactccggttgtcacgcctttgtcaaactaa

SEQ ID NO: 112703 - DNA, 606 bp, Glycine max
  Peptide Sequence Number=SeqID_229481
atgccaaggacgatgagttcacagtcatccaccaattttggccaatcaaatcttttgccaggtctagttgtccacagatttgacgccacattcgatgttcacaagaactacattgaggttccattagcataccatagacagtggtacccgcgttacccgtcttttgtcgtcttcaactgtaatggaatcaaccattttatgataagacttcaaaaatatggtgagcgatacttctttgcggataggctgaacgaattccgaagaaccatgaaaatttttgaaactgtcaaaatcacttttgttgccccggacaaagatacgactttccatgtgctgcccacagatgctttaaaatttttagttgcatccaaaaaatgtatccatgtcaaacgaagtcatggaagacgttacctttggaagatgaccatggataacggtctcccatctgttgttgatccatggtacgaatacttaacggaaaatgatttgatgtcgggcgatgaggttgtcttctactacaggttcaatgaacgtgcatgggaggtcatgtttcggaagcatgttaaatgggatgaagtcgggtgtttgcttctgtttgatgattaa

SEQ ID NO: 112704 - DNA, 684 bp, Glycine max
  Peptide Sequence Number=SeqID_229482
atgtcacgctctagacgttggatcgacatgaaccccgaactagaacacctcctggcgaatgtgcccaaaataacacctgaagagcaaccggaatggaaggaattgacaaaaaagatacaggatactgtggctccacccgatgctattttcgtcatcgttagcgccagagaccagattttcggtgaagttggtaaagtatatactgtcaagtttaaggacgtgctggaaggtgtatggcatttggttgatagagatgatacttatcataccgttgtctacaaccgagatctggaccaaccagccattgtggctgggtggacagcactatgccatttttaccacctaaccatagatcatctcgtttcgttgcatcattatgggttccttgcttgccgaagtcattccctaagtggcactctttgtatcatcaagtgcctggacattccaagtacaatatattatattttgaaagacaaaggctggtataatttgcacttgggaaatgtagcagaatgtcggctcgtgttcaatcatcataggatgccactcaaaattggagccggatggaaacaattctaccagaccttgtctttggatgctggggcgaaaatagtgttcgagttcattaatcctcgtgttaactgcgttctgtactggctctgctctgttgatgaaatgcgttag

SEQ ID NO: 112705 - DNA, 114 bp, Glycine max
  Peptide Sequence Number=SeqID_229483
atggggatacttgtatggtctgaagacctaaggagtgtgaatctcagtcatgaactggcattgaccttgttggatatccctggtgggggaaaaagaatggttaaagagttttaa

SEQ ID NO: 112706 - DNA, 957 bp, Glycine max
  Peptide Sequence Number=SeqID_229484
atgagaacaataccatttacaggaacctcacaaacagtttcaggacacaatcctgtgactgaatctataaaccaacatcctggaatcctaaatagattcttcagaagaaaaaactcccaaaccatacaactggaacaaatagtagacataggatctaacattgatatcgggtcaaattctaggataaactccttcaatcctagacaattatacaacctaaactggctaagttctgatagaactagtttatatagatataaaaggatcaatgacttttatcttcttgctggaagacacgagattatcacattaacctcagaacaaactggtcgacaacatcttagtataaatagaagatatgtacacccagggttaattgccataggcgttaggtctctaacaagatcttttgtgggagctaaagcttttgtggtgctcttcgatcaaaggttcagagataataattcccagaccataatagggatgatagaaatagacctaaaccaaacagtctccctgatgtatatcacccctaattatacagtgaatcttagtgatttcatacaaaacataaacttagaagtccagacaataggttttggaagaaactttgtgggacataacttacacttagatatcaccttcatagttagaataagtggtcaaatatcccctagatataggataaacactaatccattagtgacaaccttatcatctgatggaattcaatttttgccacctgaaattttttattcctctagaaatcagaataatcaatggcaaacacataacaatgttggatcctttaggagtgccataaccactcctggaccaactataataacaaatagaagaaatagtctttcaataagtaacattgaagaaccagaaacaacaacagagctgaacaaaatctatgaggagggagaagagaagaaactgaagcgacgatag

SEQ ID NO: 112707 - DNA, 222 bp, Glycine max
  Peptide Sequence Number=SeqID_229485
cgagaatttgctaagcgcaaccttcagtggctaagcgcgaggaagaatccagaagaagatgagctgtcaagttcactaagcgcatcactccaggtcatcaagcgcactgcttcagctcatctgctaagagaaacaagcgcgctaagccaaaatctacttatgcgcgctaagcgatgcagatctgtgctaagcgcacaagcacgaacaaggccacctatttaa

SEQ ID NO: 112708 - DNA, 597 bp, Glycine max
  Peptide Sequence Number=SeqID_229486
atgaagaaccaggttaaagggcttatcggtaaagatgaagatttgcaattcattatggagatagttaatcagcgtcaattacttaggcatcaaacaaatggtacaaataatataaaaaaggtgcattggaggcattttaaaaaagttatagctcttggcatggactgtataacgatctctctaggcataggtcacttgatgatgtgccatcttccaaatatgtgtacctcaagaaggtctttagaacgagtcactgcttttgaagatgatggagattaccagttgcaggcagttgatgcaaataatcagcaaaactttgaccagactcaaagttctcataatgatactacattaagaaagccaaccacatcaagtattagaacaaactcttttgtggaacctagtaacaagaacaatgtcgtgggtgctcaaagctcaaagctttctacgctgccagttaacaagttgattgtgctttacgtggttttcaagcttgacgagagttacacgccgagcaaagtttccatccttgccggtgatggttttcacaacttgaaggagattaagaccgtggaacttgtgaagccaactgggtag

SEQ ID NO: 112709 - DNA, 480 bp, Glycine max
  Peptide Sequence Number=SeqID_229487
atgatccaatcaaagatagctagcgctttctttcacattcgcatagagcccccttctacccaaacttcaacctcaccacaacaaatgtccaccataaacacattaacccagaaatactcctccctgtttcaacctctgaccactctaccaccatctcgcccaaccaaccataccattacccttatacccaacgcatctccggttaatgtgagaccatatcgctacccctgttaccagaaacaagaaatagaatctcaagttgcttttatgttgaaacacagcctcattcaacctagcactagccccttttcttctttggtgctgctagtgaagaagcacgatggctcttggcggttctgcgtggactatcgtgccttgaatgccatcacggtcaaagaccgtttcccaattcctacggtggacgagttacttgatgaattaggtggcacaaaatggttttcaaagttggaccttatgtag

SEQ ID NO: 112710 - DNA, 417 bp, Glycine max
  Peptide Sequence Number=SeqID_229488
atggcccaacaaggcgtgaaggctaatttgggttggggacgagtcttcaattggttcaatgggaaccgggttcagggtcgtgagggaggtgaaaggcgtttgaagggaatggaaggagaagggtgtttggtggggttgggaagtagaggtgtcggagaaacaggtggtggaggacatgggcctagtggtcttgttgccagagaagctgtttggatcaacgatggcagttgcaaggatcctcgtacattgatggggcaaaccaggcttcaagggcatgagcgtgaagaagggcagaccaataaatccacccagtcggatcagagccgtcgaagcaaggaacttcgagcttcaaacgatgttgagtatcagatggtggggaaatcaccaattttggtggacatggagagatgggatgag

SEQ ID NO: 112711 - DNA, 336 bp, Glycine max
  Peptide Sequence Number=SeqID_229489
atgtattttcatcccaaattgcaaacaagatgcactcaagttcctcaaaatgatgatggtgggcaccatatggttaatcaatgcttgtctatttttaaatatccatatcgttctattggaagtggaagcaatagattcttgacagaagtggaggttcaaattgcagagacttatgtgcttgtaaattgcaaagaaattgaaccatttctccaacaatttgaggacttgctaaggcaatcataccttggtatcgctgatgttcaaatattgaaacttcgggacgagaacttcaatggttggttgaaacagctagtgagcattttcatttactattaa

SEQ ID NO: 112712 - DNA, 225 bp, Glycine max
  Peptide Sequence Number=SeqID_229490
atggagggcctaagggttttagccactgcataccaagtatcacatcaacgccacacagggaaagaacatgaaattcaacagggaaggaatgaccctgtatctgcaccgcaatgtcattacagagatggtgacattctagttcgtcaccatttccaactgttatgcgcaacaagtttgtgcttttcgtgtggaggcccaaagcttaaaccaaatggtgctgaatga

SEQ ID NO: 112713 - DNA, 129 bp, Glycine max
  Peptide Sequence Number=SeqID_229491
atggcatatgtgggatgtttcatgcaaaaatactgcttggtggttggtggatcactcaattatgaagttgagatgcggaaggcaaggtatgatgcactcaaattgtcaatctcaactttatttgattaa

SEQ ID NO: 112714 - DNA, 453 bp, Glycine max
  Peptide Sequence Number=SeqID_229492
atgatcgcaaagtttggctacgacaatagcttgagtgagggaaggtggttggaaggccagtacctcatggcgcaattctggtgtaaggccggaaatggagcaactcatcaggaatgttggagcaaggcccacaatgcgattagccaagtgttcgaattccgtgagtgttgcctgggtggaatcgagtttcaaattcagtgttatttgggcttaggagagggcagagtgaccttgggtaaggcgattaatcgcttcttccaaccactcagttatggcctggagggtattgtggccaggcatgttgggtggcaggtcggaccagttgttaggtccttgggctcaaaaaagacaaataaaagaagaagaacgaataaaagcttggataatggaattagtgagatggtggaatgcgttggtagtgggatttgttattggtgtctcggtctgaaatga

SEQ ID NO: 112715 - DNA, 315 bp, Glycine max
  Peptide Sequence Number=SeqID_229493
atgcttccactttatatgtacaaggttgaaatgattggtgaggcttctagcatgttcaccattaaagtgaagggacatagtgttgttcacgaggcttctggcctacaggtgagttcattgtgttttaacttcctattgatgaagaagatccaaggcctacaagctccaatggagctacatcagcgagaatttaaggatgcctttcccaaggagattccacatggactgccaccctcaagaggcatagaacgtcaaattagcctccttccaaaagcttcattgcctaacaggccaacttacaaaagcaatccctaa

SEQ ID NO: 112716 - DNA, 309 bp, Glycine max
  Peptide Sequence Number=SeqID_229494
atggtgtcacgatgtgatggcgatgacggtggaaatggtactcctatctctcttgataatgccacgaaaaatcacatgcttggtcattacgcaaaaattcttgttgatttggacttgttaggatcttttccaagtgacatcatggatcttaaccatatttccaatctttgggtagacatggtggatgaagatacagagtcgatctctcctgctcattacttggctattgatgatgttgggtccactacaattatctcccaatctcagcaaaagaaaacgagacagaagaaaaataaaactctagtgtag

SEQ ID NO: 112717 - DNA, 684 bp, Glycine max
  Peptide Sequence Number=SeqID_229495
atgaagaaggcctttagattgacaaaagtcagtggtgatcacaagggactagatgcggcaattgttaaggcaacaggttacgagcatttattgccaaaggaaaagcacattcgtaccatttttcaatcactttcgccatcaaaacctcgtagtgaggtcgtttactgtatacacggtctcaccacgcgttttagccaaactaataattgggctgttgctatgaaaacacttataatcatacatcgtgccataagggaacttgacacctcaattttggaagaacttgtcaattatagccaaaaatattcccaaaagcttgatacccaggacttgttggagcaattgccagtcttacaaaatcttctctctcgtcttctagattgcaaggtagccagcgaaagtgtcaaattgtatgttgcaataactatcagagtggtcgaattacttgacaagtttttcgagatgcatcataatgatgcttgtagttcacttcaaatttatcaaaaatcaatgagtcaggcagaaagattaactgagttctttgagacctgcaagggcctagaatttggaaagggacaaaaattcatcaatattaaaatgcctcctgcttcttttattattaccatggaagaatatattaaggaggctccaagctccttaatgcttgaatacaacatggtatga

SEQ ID NO: 112718 - DNA, 210 bp, Glycine max
  Peptide Sequence Number=SeqID_229496
atgaacaagaaaggcatagcatcaacaccagtcgacatgtttatggcaaaacgaaaggacgtacctcaatggataagtggcaaagatgatctccacaaacacgatctccacaatgtggttgcagtcacggaagcgcaggcgactttgacacaaggagaaagaagaagaacgatagggttcaagtgcaaggagaaagaagaagaacgatag

SEQ ID NO: 112719 - DNA, 347 bp, Glycine max
  Peptide Sequence Number=SeqID_229497
atgggtacaggctatggtcgtgaaagactgaaagcgaaacataaggtagaccataagtatgagaaccatcagaaagtaaatggaaaacaaagtgcatttggggctaaggtaaaggaaagaccgagtggcctcaaagtggccaaccagttgctagctacacttcctatggttgagaacaacattgctccaaagatgacttcatcagcaagagtgcctcaagttatcacggaagattgcaatggaaagattgaaatgcaacaacacactccggatgacacgatgatgtgcaatagaggcctaggaacctcgtgcaagggtggcgtgatggtggtggagctcatgccacg

SEQ ID NO: 112720 - DNA, 327 bp, Glycine max
  Peptide Sequence Number=SeqID_229498
atgcacgagacatcagggtttagcagttcaggagacaacatcgaacacagaaacattgttagatctcccacaggcaacatagtacctctagacttggagattgaagccaccttaagaaggaacagggccgagaggagaaggaagttgttgcaagataggaaaatagcttccattctagaagaagaagctcaatcttctgactctacatcatctgattcactatcatcaagggaatcagctatatacttacctgaagcttctgtcatggctgatgaacaccataaaagggttatccttgaggattactctagtagctcagtgtcgtaa

SEQ ID NO: 112721 - DNA, 345 bp, Glycine max
  Peptide Sequence Number=SeqID_229499
atgaacagtggttgttttggatgctgtgtgaaacccacaccaattattgccgtggatgagccagcaaagggactaagaattcaggggcagacagtaagaaaaccacacatatcagatggtttctggagttcaagcacttgtgatctggataacagcaacattcaatctcagagaagtatctcgtctgtcagtacatcaaatcaaattctctatcatagcggtggaacttctaccccaggggccaatcctgaatttgccttcttctctggaatgagagcaggcttcagtgggttggaagtggcaaatctaggaagcatggccaacaaaaaagagaacccagactaa

SEQ ID NO: 112722 - DNA, 402 bp, Glycine max
  Peptide Sequence Number=SeqID_229500
atggctagaacacgaggtttaggtcgtgccataggtagacttgtaggcagagatagacatgatgaccatgctgcagctgatgttcccgagaggcgtaggcctactgcctcagcccgtagacaacaggttcatcagatgactacagatgcacgttatttggctgaggaagttgctgacatgactgatgatgtccctgatctggctgaggaggcacctgagatgcttgcggacgtagagggtgctgatggtgctgaggggtcagatgctgatgatgctactgagggattccctggtaggccacgtgacccgtcagtgctgacatcatttgcggaccatgttgcacatgctgtttggagtggacatgaacgtcctgatttgaagttggtgttacatgggaggaag

SEQ ID NO: 112723 - DNA, 354 bp, Glycine max
  Peptide Sequence Number=SeqID_229501
atggctaaccggaaaaactctgcaatgaggaaacaaaactttcacaggggtgagttcctgtgttgcacgagatatgggaaggagcgcaggttccatctcaagagcaaactagacattaagaattaccatgatgctttaaacaataaatgttggacttgttctctttggccttatcaaaaaataacattcaatgatgatgatgagagatcaagtctgaaagcaagcaggggttgttctcgttcttcaacttgccaaggttgctcaacttgttactgtgaagggtgcatcgagtgccactttgaggattgcaattgccaagaatgcaaagactttatgctatatgttgaaccttaa

SEQ ID NO: 112724 - DNA, 471 bp, Glycine max
  Peptide Sequence Number=SeqID_229502
atgaggaaatgggcccttgcaaccgatcaggacggtgtcgaggacactgtctgtgacaaatacggcatcagcaaggaaaagtgggcccagttttgtcagacccgcagagacccttcttgggagaagctcctggctgagaagaccaagaagaagctgcaggaagctgcacagtcaggaagcgttgatggcgtcatcgaccctccatccccggttagacgccacgtgaagtggaagatggcccgcaccaagaagacaggggagatgacgactgaggccacaaaggaaatcgctgagaagattaattcgtttgaggagcagccacacagggatcgctcgtcccccatggacgtcaggatgttctggccgttgctattggacgtccagagcaccctggacgtgtccgtgccagctagaggagtccatcacagagaaagtgacgaggcaggtcatggcatccttcagccagcttaa

SEQ ID NO: 112725 - DNA, 1064 bp, Glycine max
  Peptide Sequence Number=SeqID_229503
acgcggatgaagtccgccccttcctgaacttcggagcccaacttgcgcagctccctggtcatggccgcgatgcgcgtggtaaaaccatcggcatacagggccatgacggccagcgtcatggcggcataggggatgtggttgcagtccaggttgatggccttgagcggccatgcgccacggcgtatgcgcagacagttcgggcctccctccaccttggcgcccatggcgcgcgcggattcgacaaagcggatatcgccctggatggagtccagtcccacgccgaggatgcggatgccttcggcgctgtccgaggcgatggcgcccagtgcgatgaagtagctggccgacgaggcgtctgcctcgacatggatatcgcccggcgagctgtagcgactgccggccgggatggtgaagcgctgccagttctcgttgtgcacggcaatgccgaagcgggccagcaattccagcgtgatgtggatgtagggcttggagatcagctcgccacgacttcgatggtgatgtcgcgcgtgttggccagcagcggcagcgccatcagcagcgagcggaggaaagccctcgttgcccagatagtcgatgcggcagccgagctggcgcagcgcatcgaccagatcgccgatggggcgctcatgcatgcgcggcacgccgctgagcttgaagtcgccgcccagcacggacagggctgccatcagcggccgcatggccgtgccggcgttgcccatgaacagttcggcgctggcgccggagggcaggacgccgcccaggccggtgatgcgcacgggctggccaagggtgatggtcgcgggctccaccgtgcagcccagttgctgcagggcccggagcatgacgcgcgtgtcgtccgagtcgagcaggtcgtggaccacggtcgtgccctggctcagtgccgcgagcagcagcacgcggttcgagatgctcttggagcccggcaggctcaccgtgccctgcgcgcgggaaagaggggggatgtcgagaaaggcggtactgaacatggcgattcggatgcaaacaggctgtcgagaggcatt

SEQ ID NO: 112726 - DNA, 475 bp, Glycine max
  Peptide Sequence Number=SeqID_229504
gtgtttctcattcacattggagcaacattctcctatggtggtgttctccttggagcactcctcacttgcacactcctcaagcttgatgcacatgacgccgcccacctccaccctgcgccggccggctcgtgtcagtgtggcgcgattgagacagcaacattagatactcgcattaaagtgtctaatccagaggatccagagccatcaatgaaactttatgtggaaaaccaggcagaccctgcaatgcgattagtctctgagatgatgatactttgcggtgaagctgttgccacatttggatctcggaatgacattcctttaccatacaggggacagccccaatcagatatgaatgtttctgaattttcccatctcccagaaggacctgttaggagctttgcactggtcagagtaatgcgtgctgctgaaatcgatttcaggaagccagcacgccatggtgttttggggattcctg

SEQ ID NO: 112727 - DNA, 156 bp, Glycine max
  Peptide Sequence Number=SeqID_229505
atgcgcatagacgaattctgtgccctttgtcattcagatttcacaagtcgagtgataaacgcgcaaagacagattctgcgccctttgtcattcggggacagttccgctggaagggaggttcactggccgaatggtgtttcgctcgaacgaaattag

SEQ ID NO: 112728 - DNA, 176 bp, Glycine max
  Peptide Sequence Number=SeqID_229506
aagttgtcatcatcaaaaagggggagattgtagaagcaaagcttcatggtgaatcaaaggggtttgcatcttggataggacaactcactggagggcacggtaagcaagtggcaccagacacgacgcgcatggaagcgtcgccatgccactttctttctctctgcaaccgtcactag

SEQ ID NO: 112729 - DNA, 207 bp, Glycine max
  Peptide Sequence Number=SeqID_229507
atggtgaaagcttcattgttgtttccttgctcgatagttttatttctcgtagtatctacaatcggttttgcgaatgcgaatgcatgtactaagtgcgacttagagcatgattgtggtcatttacattgctttggccctcgttgcttaaaggaatgcatcgatggatgttgcggttgcaattgtagaccacctagtaaaattgtttga

SEQ ID NO: 112730 - DNA, 363 bp, Glycine max
  Peptide Sequence Number=SeqID_229508
atggttgtgccgaatttcttgggtctcggattaaggctgtcattctcaatgcattgtggggccaaggagtcacgtgttggtattaaacgcaaagagactcgaattcttaaaggtgaataccttcttcatgtcaactcctcgttggtagggacaaccccatgtttttgctcgagtactattgggaatcataagcaagaatcacatgttgaactctcattcggctctgacatcgatgtggcagtgcaggaggcccctaactacttctactttgtggcaaagaccaacaaaattggtgatgtaaggattcatacgatggaaattcacctcaacgggacaaagattgtggtgaagaacaacaactaa

SEQ ID NO: 112731 - DNA, 491 bp, Glycine max
  Peptide Sequence Number=SeqID_229509
atgaggtcaaaaaaagaaacgctacgagagagaaaggaggagggaagcacccatggtggcgatttcacggtggaagcgttcaacgaggggagcgacggcgctgatccgaggacggggagtgagcggagaggcggaatggaggcggtggctccaccgcggaacggagcagaggagggaacgagcggtggcggagaaggaagaagtgcagggagtgaaagaagcgaagtttctagaaggagagggaaagaagagtttaggcctggttgctctgaggagcgaagaggcagaggaagaggccgttgttatatacatgttggccagccaggacaaggatgggtggagaaaagactaaagagtgaccaaaattgtaacggctttgttttgtggcgtcttttgctacgacgacaaagagagaaatggaagggtatggtgcgtgccttgatgatgatgactatgactattgattgcggcaccattgaggctgagctcac

SEQ ID NO: 112732 - DNA, 366 bp, Glycine max
  Peptide Sequence Number=SeqID_229510
atgatgcgcggaaacttgaccagtctcccaaagcctggtggcggcgagtttggaaagttctacagtcttccttctctcaatgatccgagaattgacaggttgccatactccatcaggattctccttgaatctgccattcgtaattgtgacaattttcaagtaaaaaaagaagatgttgagaagatccttgactgggaaaacaattctacaaagcaagttgagattccattcaagcccgcccgtgttctcttgcaggattttactggagttcctgctgttgttgacctggcttgcatgcgtgatgctatgaataagcttggaagtgattcaaataagatcaaccctctgatatttgagggagaatag

SEQ ID NO: 112733 - DNA, 1977 bp, Glycine max
  Peptide Sequence Number=SeqID_229511
atggttttgcccggtgttgttgggttcaagttatctggaaaactacgcaatggtgttacagcaacagacttagttctaactgtgactcaaattctcagaaagcatggtgttgtggggaaatttgttgaattttatggtgatggtatgggtgaattatctttggctgacagggccactattgccaatatgtctcctgaatatggtgccaccatgggcttcttccctgtggatcatgttacactacaatatctcaagttaacaggaagaagtgatgagattgtggccatgatagagtcttatctcagggaaaacaaactgtttgttgactataatgagccgcaacaagacagagtgtattcatcgtatcttgaattaaacctttccgatgttgaaccgtgtatttcaggaccaaagagaccccatgatcgggtacctttgaaagaaatgaaggccgattggcatgcttgtcttgataacaaagttgggtttaagggatttgctataccaaaagaggcacaaggaaaagttgcaaaatttgatttccatgggcagccagcggaactcaagcatggcagtgttgtgattgctgcaattacaagctgtacaaatacatcaaacccaagtgttatgcttggtgctggtcttgttgcaaaaaaggctcatgagcttggtttacaggtcaatccttgggttaaaacaagtcttgctccaggctctggagttgttacaaaatatctactccagagtggactgcaaaaatatctaaatgaacaaggttttcatattgttggatttggctgtactacatgtattggcaattctggagagctggaagagtccgttgcttctgccatctcagaaaatgacattgtagcagctgctgtgttgtctgggaatcgtaattttgagggccgagtacatgcattgacaagagctaactaccttgcctctcctcctctagttgttgcttatgctcttgctggcacggttgacattgactttgagaaggagccaattgggacagggaaggatggaaagaatgtctacttgagggatatttggccatctactgaagaaattgctaaggttgtccaatccagtgtgttgcctgagatgtttcgaagtacatatgaggctattaccaaagggaacccaatgtggaatcaactacaagttcctgctgacactctatactcatgggaccctgactcaacatatatccatgaacccccttacttcaagagcatgaccatggatcctcctggacctcatggtgtaaaagatgcttattgcctactgaattttggtgacagtataaccactgatcatatttctccagctggaagcattcacaaggacagtcctgctgccaaataccttgttgagcatggggtggaacgcaaggacttcaattcttatggaagtcgtcgaggcaatgatgaggtgatggcaagggggacttttgccaacattcgtcttgttaacaagcttttgaatggggaagttggcccgaagacaattcacattccaacaggggaaaaactttatgtgtttgatgcagctacgagatacaaggcttctgggcaagacaccattgtgctagctggagctgaatatggcagtggaagttctagagattgggctgccaagggtccaatgctactgggagtcaaagctgtgatagccaagagtttcgagagaattcatcgcagtaacttggtaggaatgggtatcattcctctttgcttcaaacccggtgaggatgcggacacattgggattaactggtcatgaacgttatacaattgaactaccaagtattatcaatgagattaggcctggccaagatgtgacagtcacaaccgataatggaaaatctttcacttgcacagcacgctttgacactgaggtcgaacttgcttacttcaaccacggaggcatacttccatatgtcataaggaacctcattaagcagtga

SEQ ID NO: 112734 - DNA, 366 bp, Glycine max
  Peptide Sequence Number=SeqID_229512
atgtcgtggctcctccgatccaccaagtcaaaactcctctcttcctcatcttcactttctagaaccttcccctctctctcacgctccggccccacacttgacctccctcagatcggagccatctctcccctccccgatctcttccaccgcaacaccgctaccatgcctttcgcgaaggaaaacgcttccggtggaaacttggccggtcttcccaaagttcctgcgaatacgcttggcagtgactctaatgcgatcaattctccgctgctgaaatgttctcaagttgatataagactaatgggttctggtcatgcatatgaagtatgttggagtcagaagttaaagctagttgctgttgttgtttag

SEQ ID NO: 112735 - DNA, 642 bp, Glycine max
  Peptide Sequence Number=SeqID_229513
atgacagttgctatcatgcctgaaataatgagttttcaacttttcatggcattagaatcagataataatcttaacagccagctggaaccagatttccacaccttttcttctgtgtttagtggtactggtacctcctcttttgaggacatatggaagaggtacaaagcttctggactggacacgaatgtgctggctggagctagatgtgtctctggagtttgggctgcacagggtccaatgcgattggtagtcaataccgtgatggctagaagttttgagagaagtatggaagctggcacattgggaatgattggtcataaacgttttatgagtgacatcccaagtaaaaccagtgagacaaacctatctggttttcgtccgctatctcctcatcttcctctttatcagccccaactttcttcgaccctctcaattttcaatagaattgctggagctttcctagccggtgtcattttgcttttttatatgatctatatgaaattgggtttggttagcctcacctatgactctttctaccagttcatattttattcatcaaaactcaacctgcttgtcatggagatttctgccttagccgtgtcctatcatctgtatagtgcaattcgtcatttattcttatga

SEQ ID NO: 112736 - DNA, 978 bp, Glycine max
  Peptide Sequence Number=SeqID_229514
atgaagttggaagagactctcactcaattcatgcaagtgtcgatgtctaatcaaaagagtacaaagtctgctatcaagaatctggaagttcaagtgggccggctcgcaatgcaattagcagaaaaatcatccaacagtcttacaacaaacacggagaagaatctgaaagaagagtgtaaggctgtgatgaccagaagcaaaatggcaattcaagctgagggagaaagagctgatcagaaggtggaaggactcaaacaacagctggctgctcagccagcactggacctagttgatacttttgttgaacttgaagaaattgatgaggaagctaaagttgataaagaagaagagacaccaataaaaattaaggaagaacaagaaaaagaaaaagaaatagaaaaagaagaaaaagaaaaagaaacagaaaaagaaaaaaatgtgaaaaatggaaaacaaaaagagaaggttggcgaggatgagaagaagaaaggcaagagtaaggccaatagagagaagaagaagaaaactactcccattgaaggcaaggaggtgccttatccattggtaccttcccgaaaagagaaagagcgtcatttggccagatttcttgacatttttaagaagctggaaattactttgccttttggagaagctctccaacaaatgccattctatgccaaattcttgaaggagatgctaacaaagaagaaccggtacattcatagtgacagaattgtagtggaaggaaattgtagtgcggtcattcaacgcttccttccacccaagcacaaggatcctggagttgtcacaataccgtattcaattggtgaggtagctgtggataaagctctcatggacttgggagctagtatcaacttaatgcttctttccatgtgccatcgacttggggagttagagataatgcccaaatgcatgaccttacagttagcagatcgctccattacaaggccgtattga

SEQ ID NO: 112737 - DNA, 840 bp, Glycine max
  Peptide Sequence Number=SeqID_229515
atgcccgcgtcggtgccgggctggcagcaaacggtggcacatttgacccatctggcgctctatttactgatgctggcgcaaccgctggtaggctgggcgatgctgtcggcaggcgggtttccggtgacaattggcgaggggctggtgctgccgccgctgctgccggttagcgtggaaagttatgccgtgctgcgcccgttacattcgctgctggcgtttagtctgttcgcgctgatcctggcccatctggctgccgcgctgctgcatggtctgattttacgtgatggcgtgctgagtagcatgaccggcctgcgccgggtgcgagagcaaaaaataatgtctgcattgagcgatgacgaaatccgcgcattattgccgcatttgcagcgttttgcgctggggctgacgcgtgagcgcatggccgctgaggatctggtacaaaacacgctggtcaaagcactggacgcggcgcgcgatgacacgcgcagtctgcgtgcctggctgttttccattctctggcatcagttcattgatggcgaacggcgccgcaagcgctggcaggcgattatgacgctgttcagccgcgccgaaccctttgccgagtcggctgagcatcacgccatcgccgatgagatgctggcgctgttcgcccgtctgccggctgacagtcgcgcattgctgctcctggttaacgtggaaggcatgcgttatcaggaagcggctgacacgctggacattccgctgggcaccgtgatgtcacggttgtcgcgggcgcgaaaacagttgcagcacatgaccgaaggcctgccggccccggtgacgttgaggagattaaaatga

SEQ ID NO: 112738 - DNA, 246 bp, Glycine max
  Peptide Sequence Number=SeqID_229516
atggacacccgtctccgtgtgattggtgatcccatgaatggagttcaacggtacaccaaaatgaaatttggcggagctgttccgtttctcattcctatgacgaggggtggggctcacaacccactctttgaggattcacctagtgagtgtggtggtggggccgccactgtgagatatgggctaatctctaagggacactcacgaaacaagatacaagctcaaggccatgtaacgcgctaccactga

SEQ ID NO: 112739 - DNA, 245 bp, Glycine max
  Peptide Sequence Number=SeqID_229517
aggaggaggtaggcgacacacagaaagcacaggtagctactgccactcctaagagatctagtgaggccatttcagagcccccaacactagcagtggatccatcttcacctcagcacgcagcagacccttccactactgtcttagagatacctaaggaccagaccacaccagtcctgactctggacacttctccttcagctactctagtgcttcatctgacagatgaggaggatgtgcagacatag

SEQ ID NO: 112740 - DNA, 423 bp, Glycine max
  Peptide Sequence Number=SeqID_229518
atgggaaactgtttgaggaacaacaaaatatcatcacaaaatcatgagaactatgatgatgccctagtaattgatgccaaggttgataaggtaaaggcactttcattgtccaagatggaagaaacaccaaggatggaacaaagcatcaagaagaaggtgaggttcaagacgcaaaattatgatagtgcttatgaaggtgagagaggaagtgatggcaattctagaagtgtgaggattagagtggtgatgactcaagaagagttgaaaaggatgttgaggttcaaggatgaacacacttcattggagcaattattacatgctgtgaagttgagaggaggaagagtttcagatgttggtgaatttgatgatgagggagtgaattcttggaagccatctttagacagtattccagaggatcagtag

SEQ ID NO: 112741 - DNA, 174 bp, Glycine max
  Peptide Sequence Number=SeqID_229519
atgcaagaaatacgggaccctacgtggttggctggtggctggtggcttcgtggaagatggaaaatgatcattaagaaaagaaaattaagagtggtgaaaagtggcataatcagcatctggggcacacatggagaaaggagaagaatcaaaatccataagggtcataggtggtga

SEQ ID NO: 112742 - DNA, 186 bp, Glycine max
  Peptide Sequence Number=SeqID_229520
atgctgaacatacaaagcaaaatatattattttcttgcggcttcgtctgtttcgatggtgctgttgattgtaactgttgttgccttgttctccctcctcaacactgctctatttcgagaagcaggcgtagaagctcaaacagatcgtgtatctgcaccaatcgtccagaagacctcgaagttgtga

SEQ ID NO: 112743 - DNA, 132 bp, Glycine max
  Peptide Sequence Number=SeqID_229521
atggccataattttgtctaaatccaaacgtatctgctttagtgggcctcgtgattatgattttcttaggagtcatgacaaaaggatgaatgggctggccagctctaccacggatcagctagcatcgagctaa

SEQ ID NO: 112744 - DNA, 253 bp, Glycine max
  Peptide Sequence Number=SeqID_229522
atggagcgtctggcaaattattaaccaagtgcatattctccactcagacgtgattaaggttcttggtcatcctaaacaagcgactactactaggctcgtgagttgggaacccctttctctaccctttgtgaagttgaacacaaacaacaacctaggagactcaggctttggagctttctttggcgcgtgtggcgtcactactagcctcaaggcagagctttatgctactttatatggtcttcgtaaggcgtaa

SEQ ID NO: 112745 - DNA, 1347 bp, Glycine max
  Peptide Sequence Number=SeqID_229523
atggtcgtaaatctctctccctctccacctttacattcaagttccataatcagattggcaaattcaaagtcacccatttcagaaccatggttgaggctcaaaacccacttcccaaaaccgctcctttccccttcttttgcctccccaagtgtgaacttcacttgcaagaagcaatttttgcatggtaacagcaggaacgtgttggatttcaggacttggtctattgctgggtttgattatgggaactttgaggggcctcagtctgtgcttgaggctgctgcagtgttgacagccatcattgttgtacatgagagtggccacttccttgctgcttctctccaaggaatccatgtgagtaagtttgctgtagggtttggtccaattttagcaaagtttaatgccaaaaatgttgaatattccatcagggcttttccccttggtggctttgtggggttccctgataatgatccagagagtgatattcctgttgatgatgaaaacctgcttaagaatagaccaatattggatagggtgattgtggtttcagctggtgttgttgctaacataatttttgcatttgctattatctttgcacaagtcctgtctgttggtttgcctgagcaagaggtctttcctggggtggttgtgccggatgttagagccttttctgctgcttcaagagatgggttggttcctggggatgtgatccttgaggtcaatggaagtgagttttcaaaaccaggtccaagtgcggtttctgaagttgttgatgttatcaagaggaaccccaagagatatgttttgctcaagattaaaaggggggagcagaattttgatataagggtcaccccagatgagaattttgatggaactgggaaaattggagttcagctagcccctaatgtgaagatagctaaggttaggccaaaaaatttggtgcaggctgtggagtttactgggcaagagttttggggtctggcctctaatgttttagatgggttaaagcagacttttttgaacttctcccagtcagctagtaaggtttcaggtcctgtagccattattgctgttggtgctgaagtggcacggtcgaatatcgatggtctcttccagtttgccgcgatactcaacattaaccttgcggttataaaccttctgcctttgcctgctttagatggaggcacattggcattgatcctaattgaggctgccaggggtgggagaaagctacctttggaagtggagcaaacgatcatgtcttctggaattatgcttgttataattctggggttattccttattgttcgtgataccctaaaccttgattttattaaagacttgttgtaa

SEQ ID NO: 112746 - DNA, 186 bp, Glycine max
  Peptide Sequence Number=SeqID_229524
atggctcagtgtgtgtgtctttgtgtgtgggtctctgtgtgtgtctgtggctcaggtagcaaaggatcattaaattgtaaacatcatgagccacatgatgagggaagcagtatcaaatcaatgctttacaagcttttggtcaatctaaggagtggtgtcttcatgctgcaaattgatggtttctga

SEQ ID NO: 112747 - DNA, 222 bp, Glycine max
  Peptide Sequence Number=SeqID_229525
atggctctaaaacttattgttgatttgacagaaaatcccacaccactggcatgggatgaagcaagggtcttggagccaataggtgattggcttggagcaggagattcatcaagagatctgtcaggattaaacactggtcatagcttccagaatgataatcatatgactagaaatacactagttgaacgtagtatacccatttggagaaagacgggaccataa

SEQ ID NO: 112748 - DNA, 225 bp, Glycine max
  Peptide Sequence Number=SeqID_229526
atgggatcaagtcaaaagccttcgcttaaaaagaggttttatcaagtcaaaatcaagagcttagaggtcaccagtttacgaaagttggggcaattaatgggtcaacttcaacggcaagccttccgcaaagcctatggaattagaccgccaaaggcaagtcgaaaatggggtggtcggaataccgagaaaatatttggaggtaaaagcaagaatcttggcagataa

SEQ ID NO: 112749 - DNA, 456 bp, Glycine max
  Peptide Sequence Number=SeqID_229527
atgccgtcgccgaggcacgctgccagccctgcgcagccgctgaacgcagcaccagcgcggtatcgaagccgggcgtcagccatacgcgacggcgcatcaattgtccgtcgccggacgatcccagtactgatatttgtaggccgaactcagatgccgctcaatggtgcctttggcaaacacttcggtctcatgcaaatagctcagcgtgcaattgcccacctcgtcccacaactggcactcatccaccgatcgcaaagtgctgaccggcgtggtcgaggtgccgtgcagccgcagttcgcgccactgattatcgtagctgtaagtatctttactgcgcgcgctggtggatgccaccaccagcccctgcggattccagcgccaggtattctcgccgttggtcagttcatcgctgccgcgcgcaatacttttttccagccggaagtgtttatcgtagcg

SEQ ID NO: 112750 - DNA, 819 bp, Glycine max
  Peptide Sequence Number=SeqID_229528
atgtggcgcatgattggtgccggcgcgcagctggtggtcggcatcgatccgatgcagctgttcctgtgccagttcgaagcggtgcgtaagctgctgggtgatgatcgccgtgcgcatctgctgccgctgggcattgagcagctgccggcgctgcaggcgttcgataccgtgttctccatgggcgtgctctatcaccggcgttcgccgctcgaccatctgttgcagctgaaaaatcagctggtcagcgacggcgaactggtactggaaacgctggtgattgaaggcgatgaaaacgcggtgctggtaccgggtgaacgctatgcgcagatgcgcaacgtttactttattccgtctgcggcggcgctgaaaaactggctggagaagtgcggttttgtcgatgtgcgcatcgccgattacgccatcacctcggtggaagagcagcgtcgcaccgactggatgaccagcgaatcgctggcggagttcctcgatccgcacgacagcagcaaaacgattgaaggctatcccgccccgctgcgtgccgtgctgcgtgcaccacagcgccaccgatccgccggccgggataaactgcggcaggaaagtgacgtaaaagaccccgactttgggattgagcaggttaccggtcaggccacgcgcaaagcaggtcagatagcgctcttcccgcttttgcccctcctgcccgctggccaccgtgctgcgcgggttaagcagcagtctgacgccgagatacagcaggtacacggcaccgatgcctttcagcaggttataagtcatttccgaagccagcagcagcgcgcctaa

SEQ ID NO: 112751 - DNA, 252 bp, Glycine max
  Peptide Sequence Number=SeqID_229529
atgtctaactctataactaggacaccggctatatcaacgctcggacatatcctcgaaatttccaatggtgggaatgctcagaattgggttacgaacgtggtgctcaaatttcatgacgatccaacggtggatgagtctgagatcgtcatttttctaagacaggttaggtggcatgcgggaaaaggagagggttttgggagaagagagaaaaaacgaaattgtaaggcagaggaggctgaggagttagtctaa

SEQ ID NO: 112752 - DNA, 732 bp, Glycine max
  Peptide Sequence Number=SeqID_229530
ggtggacccttaaggactacacgtcctcaccttcagaggactacacgtcctcaccttcagaggactacacgtcctcaccttcagaggactacatgtcctcgccttgagaactacatgccctcgccttcagaggactacatgtcctcaccttcaaaggactacatgtcctcacctttagaggaatacacgtcctcaccttcagagggctacacgtcctcgccttcagaggactggttgcacgccctcgccttcagaggactgcacgccctcgtcttcagagggctactcgccctcgccttcagaggactacacgtcctcgccatcagagggctgcacgccctcaccttcaaaggactacacatcctcgtcatcagtaggatgcatgccctcaccttcagaggactacacatcctcgcctttagcggactacccgtcctcgccttcaaagggccgcacgccctcgccttcagagtactacacgtcctcaccttcggaggactacacgtcctcgccttcagagggctacacgccctcgccttcaggggactacatgtcctcgccatcggaggactacatgtcctagccatcagagggctgcacgtcctcgccatcagaggactacacgccctcgccatcagaggactacatgtcctcgtcttcagagggttgcacgccctcgcttcagaggactatacatcctcaccttcagaggactatacgtcctcaccttga

SEQ ID NO: 112753 - DNA, 338 bp, Glycine max
  Peptide Sequence Number=SeqID_229531
ggctatacaccttcgccttcgtagggctacacgccctcaccttcagaggactacacgtcctcgccttcagagggctacacgccttttcctttagaggactacacgtcatcgcctttagagggctgcacgccctcgccttcatagggctccatgccctcgccttcataggactccatatctgcaccttcagagaactcgagggccctggggtttccagctttggttacgggcctctgtcagtcctacagggtgcccgtccccctagcaagggatcgcgcccgcaagacacccagtggacccggagaagtccaacagggtcctggggtttccagctctga

SEQ ID NO: 112754 - DNA, 553 bp, Glycine max
  Peptide Sequence Number=SeqID_229532
atggctttcgccgatgtgaataagctgatgctgcgcaatgaaacgccggcggccgatatttaccaacggaaagtcaatgcgcatacccatgaagatgatcaccattggccgtggtatctcgaggatttggacaaactcggttacaaccgctgtgtcgacacggtggcgcatctggaaacgctgtggagcgacagcactcaggcgaatcggttattgacctatcggctgtgcgcgctggtaagcggcctcggcggcctggagcggatcgtggtgatcgaggccatcgaagctaccggtaacgtgctatttgggctgacggcgccgctggccacgcgcatgcatcaggcgaccggcgtcgaactgcgctactgcggcgagtttcatctggcgctggagagcgggcatgcccagctgcaggatcatgcggaactggcggcgatcccattgacggatggcatcaggcgccgttgcatcgcccatgtcgaccacccaggcggcgaattttctcacgacctcatcgtcccgatcgcgcagcagcagggaataaacgccg

SEQ ID NO: 112755 - DNA, 701 bp, Glycine max
  Peptide Sequence Number=SeqID_229533
cggcgctgcgcaccgatccggccgaccgcagcacggtggccgaatggggccgccgcatggccatgagcgaacgcacgctggcgcgcctggtgcagcaggaggtcggcatgagctttggccgctggcgccagcagatgcatatcgtgatggcgctgcagcggctgtcgtccggcgtatcggtgcaacgcaccgccgaagacctgggctacgaatcggtcagcgccttcatcaccatgttccgcaagacgctggggcagacgccggcgcgctatttcgccgacaaggcgtaggctccgtttgcacgggaacccgcggcacgcgcctggcggcgcaccgcgtcagtcccgggggcccgccaccaggaacaggcgcgggaaaggcagcagcacggtgccatcggccagcgccggataggcgcgcgcgatctcgtcgtggtaacgcgccaggaaggccgcctgctcatcggcatccagcttgtcgtgcgccagacgtccagtcgaccgcaatgcggcttgagcagctcgtagtaccaggcggcgctgtggcgcggcggatgcttgacgccgccgatcttgccggcccaggggccgttggcggcgatctggcgcgccagcttgtgggccggctcttccaggttgtccggagtttgcaccgccaggctgccgcccggcgccagcttgcccaccaggcgcggatagagg

SEQ ID NO: 112756 - DNA, 1470 bp, Glycine max
  Peptide Sequence Number=SeqID_229534
ctgaaaaatccgttgtcgaaatgcgcgggcgatgagcgcggccttgcgggccggcgtggcgcgggcgccgccgggcacgggctgcacggccacgtcgatgcggcggccgcgcgtgtcataggcctcaacgctcttgagcttgccggccgcaaagttctccagctggccctcatggccgccgaactgcacggtgtaggcgccgtcggcgtcgggctccagccagatgttgtgggcctgggccagcggtgcgcaggccagcagcgcagcgaacgctgcggcggcgaagggatggcgggctgtcatcgtgcgcggcgcgccgggcgcgaacagcggcacgccgcggatgaccgaggccgacgtggcataggccttgtcccccaggttggagaccacggcgtagatgcggctgcgcgccgaaggcaggcgccagctcaggcccaggtcccaggtggcgtagccgccatagaagacgctgttgtcggcggtgacggcatagcggcccacgcggcgccaggtgagcgagccttcccactgcgccagcgggcgccaggccaggcccacggtggccgtctgccggggcacgccggccacctggttgccgaccagggccgggttgccgttctcggtcacgcgcgaatgggcgctgccccaggccacttgcaagtccaggttcttgcgcacgggccacagcgcgctggcctccacgcccgtgcggcgcgttgcgccgaagttctcatacacgccgggcgccacgttgcggatctcgcccgaggactgcagccgataggcggccacatccagcaccaggcccggcatgggcttgatctgcgcgcccacttcggtctgccggaagatattgggatcgagctgcgcggcgcccagcgcgtacttggcgaaatcgctggccagcgcaaatccttcggaccagctggcgcgcagcagcacgcccggcgccacctgcgagcgcaggcccagcttggggctggcatgcgaggtgcgcgccagcgggccgcaggggtcgctgcccgtctcggggccgttgggacggcaaccgcccgtgaagcggtcccagcgcaggccggcggacagctgcagcaggcggtggatgggcgcctccacctcggcaaaggccgagacggtgttgagcctggaaaaaaagtcgtcaatggctgcacccgtgcgctcgcgccattgcaggccgtcgtagaactggtagtcggtggattcgcgcacggcctccagcccggccacccagttgagcggggtcagcgccgtgacatggcggccattgaggctggtgccggcgccgtggacggcgcggtcatagctttcctcgcgctggcgccactgcagtgcgtcgatgggccggctgaaccagcgcgtgaagctttgctgcgtggtgtaggcatggcccagccaggtcagccggggcgagagcgcgtactgcacatcggcgcccagtggggcgaa

SEQ ID NO: 112757 - DNA, 651 bp, Glycine max
  Peptide Sequence Number=SeqID_229535
atgttcgtaggcctgcgagaagccgacttcctcgatctgcacgcccaccacttggaccggcgcgccttccatggtcttgagcacggcgttgttcacgtccaggcccagcttctggcgttcctggatggcgcgcacggcggtgtactgtccgaacacgttcttgaccgcgtccggcgtcttgcgttcgagcacgcgcatctgcaggttgctgatggtgccgtattcggaatacagctcggccacgtgctcgggcggcacgcggtaggtcaccgacacgcgcagcgtggccggttgctggtcatagctgtaggcttccagcttctcgaacacgaaagtgtggtcgcgcaccgacaccgtcatcacgttgtcgatgaagggcgtcttgaagtccaggccgggctcggacacgcgcaccagcttgccgttgcgcagcaccacgccgcgttcgccctggtccacctggaaccaggaaccgaacgcgaggcacaggatgagcacgaacaacacgcccgtgccgatggccagcttcaggctgcgcggcttgacggacttgacgatctggaggtcggtcggcttcacttggagtccctttctgatttattgcgtttgcggtccgagagcacggcggcgatgccgcgcgcgagcaaatag

SEQ ID NO: 112758 - DNA, 270 bp, Glycine max
  Peptide Sequence Number=SeqID_229536
atggagctcggcctcaggtgtgacgcgttgaaagacagtttgtccaacgtgcttttgggcatgacattcaacgacgagccattgtcgataagaaccttggctacgatgtggtccaaacacttgatggacacatgtgaggtaattgttggtggaaatattgttgatgatgcccccgaagccctcaacagagatgtcttgggctacatgggcttgttgatgatcctcacccccgtcgaagcaaatgatgcccgcctcaggcagcgcctttaa

SEQ ID NO: 112759 - DNA, 348 bp, Glycine max
  misc_feature (341)..(341): n is a, c, g, or t
  Peptide Sequence Number=SeqID_229537
atggaggttaaacagaattttgcacaagtgcagaaaaatgcttgtgtgtggttggctgtggaaagtctagtgcagaatgagttctggatgtttgctagtagatcccaacggtcaaaatgtaggcttatgcattatagacttccatttgtgctgtttgaatgttgtattactttgatgttggggaagcttgggaggattgatggggacccggtgttgagagaaacgaggatatgggctacgtgggagtacgtgagctcagttggaggtgggcaacaggggatggtgggtttatgcgcgcattgtggatgtggaaaacttgttgtgcaccatcgcccgaccgncacctag

SEQ ID NO: 112760 - DNA, 333 bp, Glycine max
  Peptide Sequence Number=SeqID_229538
atgagcactttccgtcagttgcggagtgcaatgctgatctggactacgacgaggtgttaccacgtgcgtgtcggtggatttccacaaagaagactctcaagaagatatctacaacaacgtaaaggcagcgcctggatcatctcaggattccagatgtctgctgaatgccatatgcggagcatcgaccagtccaagagtttcatccgatttcttgtttctcaggatagctccgctgggggcttgttgttgtggacgcactactcagaccatccagcgccagcaggtgacatatgtgttgtgccaggtcagtgtgtgcccgactacatcgactga

SEQ ID NO: 112761 - DNA, 312 bp, Glycine max
  Peptide Sequence Number=SeqID_229539
atgatacgcggagatacttatggttattcgcaccccttttgtcatccagaggcggcgggcccgatgacaagcagagaccaagtttggtcattctgcacccatgatacgcggagataccttacggttatccgcacccctttgccattcagacacagtcgtgtccgatggcacgcagagaccaagtttggggctgacacagtcttctgcaccttttgttcctccgggaacaacaaagtcatttacatgcggaaatttcatggtcgcccgcgactctcgtcaaccgagaggagcgaaattaatgtcatacactga

SEQ ID NO: 112762 - DNA, 195 bp, Glycine max
  Peptide Sequence Number=SeqID_229540
atgggggttcaaatagcaaccaggccgacttgggccttccaggatgttcctccagaaggcggttgcttctggaggaagcaacctagctcgcttgggcgagctggaaaatccaagccgaggcgcttccgtaacgtttccgttggtgatttcgcgaagattttcaaccgttcttcgacgttcttcggtcttcaaccg

SEQ ID NO: 112763 - DNA, 195 bp, Glycine max
  Peptide Sequence Number=SeqID_229541
atgaggtggtatacactttcaaagactttggccgaagatgctgcctggaaattcgtaaaagagaacaacattgacatggttactattaacccagcaatggtgataggacctctcttgcaaccagtccttaacacaagtgctgcttcaattttaaacataattaatggtaattactatttgtacattatgctgtaa

SEQ ID NO: 112764 - DNA, 231 bp, Glycine max
  Peptide Sequence Number=SeqID_229542
gctgaattgttagacccagctttgaaggggactctcaatgttctgaaatcgtgtgtaaacttgccgacgctggaacgcgttgttttaacctcttctgttgctgcagttgcgaacaacggaaagcctctaactccctatgtagtagttgatgagacttggttttccgacccagatttgtgtagggaagcaaagatgcaactaaacaaggtggctcagacagttagagagtag

SEQ ID NO: 112765 - DNA, 329 bp, Glycine max
  Peptide Sequence Number=SeqID_229543
ggatcgtgcccacaagacacccagtggacccggagaagcccaacagggccttggggtttccagctctggttatgggcctctatcagtcctacagggtgcccatccccccagcaaggtcatgccatcgtgacatagggatcgcgcccgcaagacaccaagtggactcggagaagtccaacagggtcttgggttctacggagtgcttgtcacccccagcaaggtcatcaggccccctaccaaccgagctttcattaagaagtattgcgccctcaggcaggcgcattgcgagacaccacatcagcccggggatggccgagagcgggcaatag

SEQ ID NO: 112766 - DNA, 786 bp, Glycine max
  Peptide Sequence Number=SeqID_229544
atgattgccttctttgaatccactcacattgacatgtgggacgttgtagaaaaaggcaatcacattcctttagatgctcggagaaatgagacccctagggacagatggatagatgaacataagtccaaatttcttctcaactctcatgcgagaaatgctttgttgtgcactctatctcaagaagagtattccaatgttcaaaacttcagaagtgtgaaacagatgtgggacaccttagccattatctatgaagggtcctttgaggtaaaacgtaacaagctgagccttctgatacaaaccaagcacttcaagttggaatgttctaaccttgaaaagccaaaggataagaaaaaattcttcaagcccaaaaagaagagcctcatgagcacttgggaggacctggacgattcctcatctgatgaggatagtgaggaagaagccaacctatgtctaatggctgatgtgtccaccagcaaagcagacccaacattggacacaagttcaaatgatgaggactctcagcctgatgacaatgtcaactcaggcaaagaggtagtgttcaaatccaaagaagaattaattaaaggatacaatacacttctatttgtctctgctcgcgtttctaaagcttatagaaaactaaataaatgttttcaacatcttgaaaaagagcatgaagatctcaagaaagctcatgaagttcacttagttgatttgtcttggaaaccacttcacttggtagtgtacaagatgcctttatttctgaggaagtcaaggcattactag

SEQ ID NO: 112767 - DNA, 315 bp, Glycine max
  Peptide Sequence Number=SeqID_229545
atggggatcgcgcccgcaagacacccagtggacccagagacgtccaacaaggccctggggttttcagctttggttacaggcctctgcaaatcctacagggcgcccgtccccccatcaagtttatgccatcgtgacctagggatcgtgcccacaaaacactctgtggacccgaagaaggccaataggttctacggagtgcccgttgcccccaacaaggtcattaggccccgcattaaccgggctttcatcaagaagtactgcgcccccaggcaggcacagggcgaaacaccacagcagcattgggatggccggtag

SEQ ID NO: 112768 - DNA, 573 bp, Glycine max
  Peptide Sequence Number=SeqID_229546
atgaaggttaagcaactctttacttgtcatcatacaagtgacgaaaggaaggttcctttggctacccttagcttccaagggtataccctctattggtggacttccctagttagggaaagaagaattcatggggatcctccagtaaagtattggaatgacttgaaaagtgcccttaggaagaggcacatctcctcctactatgaaagggagcttatggacaagctccaaaggcttagacaagggagtatgagtgttgaagagtataggcaacaaatgaaactactccttttgagagttgggcttatggaggaggaaagaacaagtattgctaggtttattagtggacttaatatggaagtaagggacaaggttgagctccttccctatagggacctaaatgacctagtccaactttgcataagggtagagcaacaacttaaaaggaagcctacttcaaaatcttatggctctcactctcatccaaagaaagatcaaggtcaaggcatcttaggggttgcaccttctaagcccaaagatgataaggggaagacaatagaaaagcaacccccttaa

SEQ ID NO: 112769 - DNA, 318 bp, Glycine max
  Peptide Sequence Number=SeqID_229547
atggtttatatcggtgtttattcccttataggttctataacggttatgagtgttaaggctcttggaattgtcataaagttaacaatgtctgggatgaatcagctaatttaccctcaaacttgggcattctctctagttgtaattgtttgtgttcttacccaaatgaattatttaaataaggcagtggatacttttaatgcggcagtggtatctcccatatattatgttatgttcacagcatttaccattgtggctagtgttattatgtttaagggatttattgcatatgcccttaattatggactcattacatggtga

SEQ ID NO: 112770 - DNA, 288 bp, Glycine max
  Peptide Sequence Number=SeqID_229548
atgagtgtggtggtaagcaaggaatggggtacactacttcatgtggtggcaggaacagaccaagttcactttgtggatctgctggttaaattactgaaccctaatgacctagaactgcaaaatttcaacagaaacatggcgttttgctattctgctgcatctggaaacctgtacattgcttctctgatgatcaagaaaaatgcaggcctaccgaaaattcagggaagtggaggttattcttacttgtatgagccgctttggtgggtgggaatgataacaagtgagtaa

SEQ ID NO: 112771 - DNA, 420 bp, Glycine max
  Peptide Sequence Number=SeqID_229549
atgacaatgatagtagacacattaccagtattctactatggaaaatggtgggctacgcaccttcaaagctttgaggatttggtctttgccaatgaaaggatcgatgtgggtctaaaaaaaggcaaatttagtcatcctgcttggacgaatgagaaaactggggcaaatgaagagggtgagaaagagggagaaacccatgctgtgactgccattcctatacggccaagtttcccaccaacccaacaatgtcattactcagccaataacaaacctcctccttacccaccgcccagttatccacaaaggccatccctaaatcaaccacaaagcctgtctaccgcacttccaatgacgaagaccacctttagcacaaaccaaaaaacaccaacaaaaaggaattttgcagcaaaaagcctgtag

SEQ ID NO: 112772 - DNA, 180 bp, Glycine max
  Peptide Sequence Number=SeqID_229550
atgaaaaaatcagttaatgcagcatttcagcgagtacaagttgacaagatacaatttgttgatgagaggcttcaggataactcttattgggcaaaggatggtgccgagaatggttatggtgctaaagcaacagaaatagtcgatcaagttagaggaaggtctgtgaattcatatgggtag

SEQ ID NO: 112773 - DNA, 339 bp, Glycine max
  Peptide Sequence Number=SeqID_229551
atggactcaaaaatctaccctaaggttcatgaaaaccctagggccttctttagtagctctagcccaagtctcttggagtcttctatccaatacccttgggggcaatctctgtctattactgctgatcatggtcggtcaaggcttggctccagtgagcctacagagtttgaatctcaatcagtgtctgttaccggggatcatgaccctcttctcaggattccattgacaccaactaagcgtgtatcttttgatgagttggataatgagcgaaaaaactttcagatttcacctgctgaagtttcctcgaacaaattagctaagctttctcagcctgaatga

SEQ ID NO: 112774 - DNA, 333 bp, Glycine max
  Peptide Sequence Number=SeqID_229552
atgaagaatgacactgcagaattgaagatggaagctgaagtcactaaagttgtgttacaagatgtcgaaacaacgcttagagtagcggtggaagaagtggaagcagctaatgcagcagaggcaagtgttgtcgataagattaaggtcttatgtatgagaactagtccttctcattcatcaccttctgaacctggtgcaagaattacaatttcaagggaggagtttgaatccttagtttataaggttaaggagtctgataaattagaagatatcaaagtggctgctgccacaaccactttgaagtttcaaagactacccaaaacaaagttgtaa

SEQ ID NO: 112775 - DNA, 189 bp, Glycine max
  Peptide Sequence Number=SeqID_229553
atggaatgtagatgtatgcgtctgtttttttcttttgtttccaaggctgatgttattggttgcggaatgaagggaagaatttggctgactaaagcgtctaggtttaggtcttcagtttggagagttggtggtaaacgtccaggttataatgcaagtgactctgagtctgacgaagaagaagattcttaa

SEQ ID NO: 112776 - DNA, 306 bp, Glycine max
  Peptide Sequence Number=SeqID_229554
atgggtcacaaacttctctttcaacacttggtgaagaccaaaggggatgctggtgaagaccaaaagggacgctgggtgaagagtggaaagggatggctagaagatgttgaaatattgctgaaaggctcgctcaatgagccagattggctaagcgagactcatccgcttagtaaggaagtctgcccgctaagcaaaaacaaaaccctagagaatgttgagccaaagagcagcgcgcttagtgcgcagctagtccatccagcgaggacgttgtctcttctcgcgcttagcgcatccaaacttgcttag

SEQ ID NO: 112777 - DNA, 813 bp, Glycine max
  Peptide Sequence Number=SeqID_229555
atggcttccccaactgttggagcaccaaagagagaaaaggatccaaaaaagcgggtagtaataacaggaatgggtcttgtgtcagtctttggtagtgacgttgatgccttttacaacaagcttcttgagggagaaagtgggataagcctaatagataggtttgatgcctcaaacttctcggtccgttttggaggtcagatacgtgatttctgttcagaaggctacattgatggcaagaatgaccggcgccttgacaattgctggcggtattgcattgttgcaggcaagagggcccttgatgatgccaaccttggaaagcaagtccttgacactagttggagttttaccttagtaatcaatgtaataaagatggacaaaacaagaataggagttctggtgggatcaggaatgggaggtataacgactttctcgaatggtgtggaagctcttgtacaaaagggatataagaaaattactccatttttcattccctactccatcaccaacatgggttctgccttgttggctatagacacaggcctaatgggtcccaattattcaatttccactgcttgtgcaatggcaaattactgcttttgtgcggctgctaatcacattagaaaaggtgaagcagatatcatggtggttggtggaactgaggcagcaatcatgcctagtggtcttggaggcttcattgcttgcagggctttgtctcacagaaacgaagaccccaagaaggcttcaagaccatgggacaaagatcatgatggttttgtgatgggtgaaggctctggtgtgctggtagaaacttga

SEQ ID NO: 112778 - DNA, 533 bp, Glycine max
  Peptide Sequence Number=SeqID_229556
cgcacccgtgagcctcgccctcgctcgcccgcgaagggcacgttgcgacactatcaaaccctcaagtcacgatagcaaaggtgagactttttcgcggtctcggccgaaagacgccgacatctctgagaaggttgacgaaggtgcggataacccttgggtatctccacatgtcatcagacttgcgataacccttgggtatctccgcatgtcatcagacttgcggtcttggatgactaagacttgccgtctttggatgacaaagacaaaggtgcggataacccttgggtatctccgcatgccacctgactcacagtctctaccggaagatgttgacatcttcggaaagggtgcagatgaccacattggcctttgcttgtcaatcggacttagggtgtgtgcgggttaccgtatatggcgtctccgcgtgccaccggactcacaggtcatgatagcaaaaggaggggtggttgacaaaaacggggcttttgctcctatgtatcctcaatttgtgatgaggaactcagacctacgta

SEQ ID NO: 112779 - DNA, 414 bp, Glycine max
  Peptide Sequence Number=SeqID_229557
atgaccagtcctctcaataagtcgatctcttgttttctcataagggtggacccttgggtaatagtaccctcaccgtcaaaggactacacgtccttgccttcagagggctacacaccctcaccttccgaggcctacacatcctcaccttcagaggactacacgccctcaccatcagaggactacatgtcctccccttcagagggctacacgccctcatctttagaggactatacgtccttgccttcagagggctgcacgccctcgccttcagaggactacatgtccttaccttcagaggactacacctcctcgccttcagagggctacgtgccctcgcctttagaggactacacctcctcgccttcagagggctacatgccctcgccttcagaggactatgtgtcctcgccttga

SEQ ID NO: 112780 - DNA, 264 bp, Glycine max
  Peptide Sequence Number=SeqID_229558
atgtcctttgctagatttgactcttcatctaatgacatcgaggccagtttctctactttgatgtctccccgatcactgttgcctgagtcttgggtaccactcgaggtgggattggtggatcttgtgtcagaggatgagggagaggatttggaggaggatacgtcttatgaggaggatccatctatggatgaggaggatcccgtcacgaagccgaagtttatggaggaggattcttcgcaggattcatctgaggattcttgttag

SEQ ID NO: 112781 - DNA, 234 bp, Glycine max
  Peptide Sequence Number=SeqID_229559
atgcagaaatgtcccaggtgtggggtatcatggtacaaagtgaaggatgatgacaagtgtagcagtaacaaaagcacaaagaaaggccccctattgaaggtgttatggtatcttccaatcattccaaggtttaaatgtttgtttgctaatggaaatgacacaaaagatcttacatggcatgcagatgggacaaactatgatggaatgctatgccatccagctgattcctcctag

SEQ ID NO: 112782 - DNA, 1101 bp, Glycine max
  Peptide Sequence Number=SeqID_229560
atgacgatgcggtgcatgcaagcactggtgagggtgcaggcacgagtacgggctcgccgattccaattgagtcacgcggatcaggaaagagagaagaaagaagagcccaagcccatacccgtgcccgtgcccatgagccccctgagaagaatagacgacattaatgactgggacaataggcgtcaaagtagctacaaaattaaggaaaacgatttgcggaaacatgaagctgtaatgaagagagagagagctcttgcatacgctttcaactatcaacagaaaaagcagcctcgggaacggcagtgtttgggaattaagagtttggacttaggaagcagatttatcaaacgatgggggtggagaaggcataatttggtggcattcagtggtgggcacgggagcagaaggaagcgtagatgtagtgtttgggaatccagaaatttgatgttgcatagtactactaaaagagagaggcaccaacaacaaaagcaatttttgcagccagactggaatggtaatgatgatgtaggaacaaactatgagcatgaaaaagcccaatggggttggaactggttggagcgttggatgtcatcccaaccatacaatgtcaggaacatggggccacatgagacctcttacatgactcttgcttctacaacatcaactaccactgataacatgtctgagaagaccgtagaaatggacatggttgcaactccaggcccaaccaacactagaaatgtcagtcccatgaaccaagactttgttgatttaagcccagtttctaataggcaccgtcacatacctcccagcccaaatagacctagctatatgaccccaactcagtctgcaaaggccaaggttcgagcccaaggcccatccaagcctcgagtttcagttgggcagtggaacttctcaacaaagggaggttcgactggtgactcatctagctcgggaggacgaattgtcgcttaccaatttccaaggagcccaggcccaaaaattaatggcattcggtcacagtctaaaaggattgtgggtagcagtccagattacactgaagattggacccttccactcggagcccatggctgggcataa

SEQ ID NO: 112783 - DNA, 1117 bp, Glycine max
  Peptide Sequence Number=SeqID_229561
atggggctaaaccacttggtctcgaaacaaggcctcactatgagccttccaaatttagaagatcataatcgggaacaccacactaaccttcctcatgtgctctctcagtcaatcaaaccagccccataccacaccttggacaagtatcttgtgcaagaatatgtctctgtaaaaggaacttcttgtgatatcaaaagccttaatgattctaggaatccaagatcaaggatgggtcaagatggtggcaatcttctggcaaatctaccgatcctcgatagcaagaattggcatcggtggtatgcacatatgaaggtgatacttgggtatcaagaagtccttgagatcgtggagaaagggtattcaccgtttgtagaagatgctacaaaagaacataaggtggcatataatgagaataagaagaacgactgcaaggccttatgtttgatttaccaaagtgtggacaaagcccattttgaaaagattgttggagcaaaaacctcatcgaaggcatggaagatcttggagaaaggaaatgaaggcgtggaacagttgaagaaggtgcatcttcaaacgatgcacagacaatttgaattgatgcagatggagggaaatgaaagagtagctgagttctttaatcgtgtctttaatctgaccaatgcaatgaagtcctgtggtgagaaggtcactgatctcaccatcatagagaaagtcctacgtaccttgaaccccaaatttgaccacattgtggtggccatagaagaatcaagaaatctagagatcctaaaagtagaagaactccaaggctcactcgaagcccataaacaacaacttcttgagcgctcaggaggaggacataaaggaaggggtcgtgataaggtagccaaagataatccagagagaaataatgaaactcaagaacatttcagaatcgagcaagatgtacctgaatcttcaacacaaaatttcgtgctcttctcttattcatctccttcttcctccaagctcttatccatggcctcctatggtgaagcaaaagattccattgatgaagaagatcctaggcctacaagctccaatggagtgtacatcatgtggtatcaagagcatcttcatgtag

SEQ ID NO: 112784 - DNA, 225 bp, Glycine max
  Peptide Sequence Number=SeqID_229562
atggttaaagcacgtcaaaaaggtggtacagaaaacaaacgaaatgaaaataaaagcacgcgaaacaagtggggaccactaagggcacatagaatgaattgcaaggggaaaagagggaggtggttgccgcccaactggcccaggcgagctgggttgcttccaccagaaggcaccgccttctgttggaacaccctggaaggctcaagtgggcccggacaaaattag

SEQ ID NO: 112785 - DNA, 465 bp, Glycine max
  Peptide Sequence Number=SeqID_229563
atgcctaaatatgaccctgaagttatcatggagttttatgcaaatgcttggcctattgaggaaggtgttatggataagcgctccaaagtgaggggccaatggattccttatgacacagatgccatcaaccaatttttagggaatccattgatcttagaaaaggggaaacaatgtgaatacacgacaagaagaggtcagactacaggttttgatgaagaggctattggtcagctgctttgcttcccaggacgtgattttgtacggagcatgacaaggaagcggttgcgaatcatgcacaccaacatgacgaccttgactcaaatctggatgactttccttcttagtaatatccttccgagcgaccaaaactatgatcttaccctacctaaatgtcagctggtctacagtattatggagcatatcagtgttcatgttgtccaactcattttagatgctatccattag

SEQ ID NO: 112786 - DNA, 177 bp, Glycine max
  Peptide Sequence Number=SeqID_229564
atgtgggttttttctggtcacgttgagttgcttagagccaatagtcgcgtaatccggggtgttcttcagccctgggcccatctaggccaatcaggaagcttctacatgaagcaaccagctcgcctgggtgagcatgttacttcaaacttaagccatcagcttgattgggcgagctga

SEQ ID NO: 112787 - DNA, 900 bp, Glycine max
  Peptide Sequence Number=SeqID_229565
atgcagcaggctaattatgatccaaagctagagagtgttcttagagacgcatctatgaaggataagacagtgataatcacaactttaaatgatgcatgggcagagccaggttccatgtttgacctcttccttgagagtttacaactagggaatgggacacaatggctttcaaatcacttggtggtaataacttgggaccaaaagacacttgctcgttgccttgttgtgcacaaacattgttaccaagtagaaactaaaggtggcaattacactggtgaagtattttacatgaccccaaactacctacacatgatgtggagaagaactgaattccttggttccatccttgagatgggatacaactttgtgttcacggatactgatataatgtggcttagagatcccttcaaacaattttacaaagatacagatttccaaatagcttgtgattctttcaatggcaattcctctgacttaaacaactttccaaatggaggatttaaatatgtgcaatcaaataaccgaactatttggttctataagttctggttcgactctaggaatttctaccctgggttgaatgagcaggatgtgctcaacaatatcaaaatgcatccattaatttccaaaatgaagctgaagattaggttccttagcactagttattttggagggttttgccagcctgcagaggacttcaacaaggtctcaacaatgcatgccaattgttgtgttggtatagaaaacaaagtcaatgatcttaaaattttgcttgaggattggaagaagtatatggcattgtctgaaattgagaaaaaagagtcacatccttcatggagcgtaccacaactttgcaggacgtcctttgaacgtgccaaagaaaggaatctgattaattaa

SEQ ID NO: 112788 - DNA, 228 bp, Glycine max
  Peptide Sequence Number=SeqID_229566
atgaagaagaacacctctgcgatggagaatgccggtggcatcaaggcatggagtttccgtcgccaccagcttttggttagaagggtgatgcaattaaccatgttcattgctggacttcctgtgttgtgggtgtttctctctaactctgcctcttccattgaattccataccttctcacattacttcactgctcaatcaacaaagtttatggaaaaattcaatgcataa

SEQ ID NO: 112789 - DNA, 303 bp, Glycine max
  Peptide Sequence Number=SeqID_229567
atgtcgaaaacattgttgaatccaaccaaaacactattgaaaataatcaaaataactagaaccatgatttcattgtcgaaaaaagctttgagagaaaaacatatcgtgagagcgagagtgaaatctgatttcaccatgagcgagagtgatttcaccgtgagcaaaaggtggtttcatcgtcgcgagagtgagagtgacatcatgagcgacagtggttttagcgccgtgagagtgagtgagactgacagaggagggttcgtgagggagacgaagcatgagggagagacgagtgaattgtcataa

SEQ ID NO: 112790 - DNA, 324 bp, Glycine max
  Peptide Sequence Number=SeqID_229568
atgagttatttactatggaggaaggcgaatgagtatgatgagttgccttcatctcaagaaagattcaaaaggtgtggaagaacaagagtgggtccagatggaagaacttctccaagaaggtgttcaatgaaaagaaagacagagaaaaaagctttgtatgaagcttatgacaccttggaaaaagggctttgtctggaaaatgaaaaagattccaaagaacgagatactctaatgaagggctttaacattttagaagctaaaattgaagttctacaaaaagagttaaaagaacttaatgaacttcaagatcaccttactaaatag

SEQ ID NO: 112791 - DNA, 210 bp, Glycine max
  Peptide Sequence Number=SeqID_229569
atggtcaatgacatctttgtcaaggtgaaactggaagtaacaaggatatcaacaatcctaaacgtgtttggcagtagacgaagcaatgataggaaaatgcaaggatcatgcatgaaaacaaaagatatgcagtttgtagaacaaaaagtatgtagaatgcatatgcatgatgattcaatgactcatgcaaaatgtgaggctggaatatga

SEQ ID NO: 112792 - DNA, 225 bp, Glycine max
  Peptide Sequence Number=SeqID_229570
atggttgtagatcgtggtagtggtaggcatcacaaatggatgatcaccatgaataatggcccatcatgtgttgctgacgcgtggatccattatttaggcgactgtcatttgaaggctggagatgaggtcatctttttctacaacattgaccaacatttatgggaggtcctctataggaagcaagttaaatgggatgacaaagaggatgaagttgactccccttga

SEQ ID NO: 112793 - DNA, 1743 bp, Glycine max
  Peptide Sequence Number=SeqID_229571
atgggtagcgaagaagagagggttcttgagaatcaactggaacttcaattgcaagagcaaagggattctctctctgctatcggtcaagctcttctctctgatccaactaaccctgaacttctggcggttttatgctggtctgtcgaattcggtcgtgttgttggccaaaaaggcagaatattgaggattgggattagcagcaagaagataagtattatgtacatgttacaggtttctgctatgacaactgtgcttggtttgaggcagttactatcacagaaattagctctcgatctctctctctattcttcttactcccactctcaagtttctacacaaattgtgttctacctgggatcagggccacagaaactggttcatgaggagcttgttcaggcaattaaggatgcagaagaaggacttcttcacctaaaacgtgcacgattgttacaggaagcagattcagtgctgcataacactaatatttttactgaagaagagaaagtggagccccttgattccacagatgttgaaccagagccattagaggacaagtgttattctgttggatctaaatgtagattccgtcacaaagatggacgttggtacaatggtcaagtggtgcagttggataatgcagtggcaaaagtttcatttcttactcctacttctgagaatatgttgaacgccaaagtgcagatgtgcaagttctttttacaacaacgatgtcgatttggtagtaactgtcgcctatcacatggacttgatgttcaattgtctgctcttaagaaatatgtgcctacaatctggaagcagtctcttgtggggtcaagtatatgggcagtctcaactgcaaatgcaggcacttggagagaagccgagctcgagtccttggacgaaaaagctggagttggacaagttgttttccgagacaacggaagttctgtgaaagttggtgctgaagaaatggcgctgtctgagcatgcagaaatgagtgacttggagagcgattccagcttagtacaatctgattccagtgactacgaggaagaggaaccacaaggtttaggatttctggagagtaccaacctacggagaggtattcagaccgaaactgcaacatttgccacgtgggagaaccacactagaggcatagcttccaagatgatggctaatatggggtacagagaaggaatgggtttaggtgtaaccggtcagggaatgctggaccctataccagtgaaggtgctaccaccaaagcagtccttagatcacgcactggagtctcataaaagggaagggaaggaaggcaagaagaaaaggagccgaggtggcaaaagaaaacgtgagaagaaatttgcagaagtgaatcgtgcagcaaaagaggaagaagaatcggcatcagatgtctttgcattaataaacaatcacctggcaatgcacagtgaggcttttggcagtggatcaatgaagaagcagcaaagtaaaggttctgaggaaggtaaaaaggtggatagacgggcattggttgcttatgaggaagaggtgaaggatttgaagatgagggttgaaaagcttgagcacattgtgaatgccaatagaaaagagaaggctgtgtatgagggtgctatgagaaaattaaatgaaacccgcaaggctttggcagatgctgaagcagttcatgcctctgcctcaaattcagtaacaagcaaagaaaaagagaagagatggctcaagttttag

SEQ ID NO: 112794 - DNA, 1908 bp, Glycine max
  Peptide Sequence Number=SeqID_229572
atggttacatatttggaaagtagtcctactttgttggaattggattacctccgaaaaattataagggaactagatgaagcagaagacaacccatcatggaaggcaattaactattgtggacctgatccagagttcaaatcacagttgaagaaccacttctttacaaaggaaagaggacaagaggaaaaagaagatgaagactatgatgatggtactgaagatgttagagggcctctttacaaaggtcttatatacataaattacccacgagacatcatcacagattctctaagacgagttggattctctgtctctgctactcccaaaaagactaaggcttctagcctctcatctccttctttggttatccaatgtgatgctgtggttgttggttctggctctggaggaggggtagtggctggggttctagcaaatgctggttataaagtgctggtgttggagaaaggaagttattctgctaggaacaatctttcccttcttgaaggaccaagcatggaccaaatgtacctctccaatggtttggttgccacaaaggatatgtctgtgctaatactagcaggttccacagttggtggagggtctgcaatcaactggtcagccagcatcagaactcctcaacatgtgtgcaaggagtggtgtgacggccacgagctcgaattgtttgagagtaagttgtacaaagaagccttggatgttgtgtgtgagaaaatgggagtgcaatctgagattgatgatgaaggattcaacaatgctgttttaagaagagggtgtctagaaatggggtatccagtgtgcgatattcctaggaatgcttcgtcggatcactactgtggctggtgttgtatggggtgcaaggatggaaggaagaaaggtacactagaaacatggctagtggacttggtgaaatcaggtaatggtgcaatcattccgagttgtgaggctattcaagtgttgcataagaaaaagaaaggaagagacagaaaaatagcaaggggagtggcttttgcaattgaatacaaggggaaaagggacatttgtgtagtagagtcaaaggtcacagttgtagcttgcggagcacttagtactccagcattgcttaaaagaagtggattgaagaatgaaaacatagggagaaacttgcaccttcatccagtggcaatggcttggggatacttccctgattcactttcacctgagttgtggccagagaagcataaaaagagctatgaaggagggattatgacggcaatgtccacagttgttgcacagtttgacaaatctggatatggtgcagtgatccagacacctgcattgcatcctggtatgttctcaattctaatgccatggacttctggcaaggatataaaagatcgaatgcgcaagttttctagaacggctcacgtgtttgcactggcaagggatcaaggatcaggaactgtgaattcgccttcccatataagttatcagttgaaagacgtcgacaaagagaatctaaagattggacttgagaaggtactgaggattcttgcagcagctggagctgaagaaattgggacccataacaacaagggaaggagcataaatgtgaagcaggtgagctatcatgagtttgagaaatttgtgaaagaagaaagttcaatgtctttgacagacatttctacaccattgtgttcagcacatcaaatgggaagctgcaagatgggtaccaacccaagggaatcagttgtgaaccaaatgggggagacatgggaagtggagggcctttatttggcagacacaagtgtctttcccactgctttgggtgtgaatccgatggtcactgttcaggctatttcttactgcacagcacaatatgttcttgaagttcttagaaggaaaagaaagtga

SEQ ID NO: 112795 - DNA, 231 bp, Glycine max
  Peptide Sequence Number=SeqID_229573
atggaaacacgactccatacgggcaaatatccatgtggaatgcgatttcgttatggtaaaggagtgcacagtgatggatgtgcaggacgacacagtgatagtagagaggagttgcacccacagagcctcaaagatgtagattgcatgggtggaggtcgcgctcgagcaggggctctatgcaacagtgatggtggggactggtggtggtgcaatgtggaggagattggatag

SEQ ID NO: 112796 - DNA, 195 bp, Glycine max
  Peptide Sequence Number=SeqID_229574
atggggaaaggaggttatggtggcgtcttccggaagaaccgtgatggcttcttccggaacttccgaaagaaggtgttccgaaaactttccggaagaacggttcttccgaaagtaaccaaaggtcatccggaagaacatttcttccggaaagcttccggaacaccttctttcggaaactttccggaagaaggttga

SEQ ID NO: 112797 - DNA, 934 bp, Glycine max
  Peptide Sequence Number=SeqID_229575
atgggtaaggtagaggaggtgcaagagcagatgaaggctgacatagaggccgtgatgagcataaaggagataatggaggtcaatgcggctgcaatagttgttactagcaccattgttgaggacgggtggccctcgtttagtgcaaaaaacaagcacgccttcccaccatatggcttgcctcccaactatacaccacccaatgtggcatacactcccagtgaggatgtcaataactccgcttccatactcattgaaagccgacaacctcaaactgatcatgcatatgtctctcaacccatgggggagacacatgaaattccctaccacaatctagccgacttcaagccttgcctcagatatgccactgaagggcaagcagttggtggtatacccgtgcaaaatactttggaggtccctcagtatcacccacaaccacaccccttgcattccacagcaggtaaaaaccctcatgctatgacaaaaatgggaaagttggatcatctagaggaaaggctcagggccattgaaggaggtgaagattatgcctttgctaacatagaagagttcttcctagtacccaatatcatcacccctcccatgttcaatgtgtcggactttgacaagtataagggaactactttccccaagaaccatctaaagatgtattgtcggaagatgggtgcatacgcaaaagataaggaactgctgatacatttcttccaagaaagtcttactgggatagctgttacctggtacactaacttggaaccttcccgagtccattcttggaaagacctaatggttgcctttgttaggcagtatcagtacaattctgatatggctccggataggatgcaactacagaacatatgcaaaaagggggcacgaatctttcaaagaaaattcataaaggtggagagatctggcagcccaa

SEQ ID NO: 112798 - DNA, 477 bp, Glycine max
  Peptide Sequence Number=SeqID_229576
atgcctgattatatcgtaaattcaaccccctatccgtggccgtttgacggcaactgcacggtgcaaaacaccgcgctgctggtgattgatatgcaaaccgacttttgcggcaagggcggttatgttgacactatgggttacgacatctccctgacacgcgcccccatcaaaccgctgcagcaggtgttagcgcgcatgcgcgaatccggcttcccgatcatccatacccgtgaaggccatcgtccggacctgagcgatctgccggctaacaagcgctggcgctcgcggcgcatgcaggcggagattggtgcacctgggccctgtggtcgcattctggtgcgcggtgagccaggctgggaaatcattcccgagctggcgccgctaccggatgaagtgattattgataaacccggcaagggctctttttacgccaccgaccttgagctgatctgcacagtcgcggtatccgcaacttaa

SEQ ID NO: 112799 - DNA, 950 bp, Glycine max
  Peptide Sequence Number=SeqID_229577
cgcactgtcgccgcgcattacgccataccggccgtcacgctgtgcggttattccgggctactgctgggcccggcgctgattggcttgagcgcccagcttacgtccctgaccaccacgctcagcgccggcatcgtgatgttgctgctggagtttctatgacaacctcaacgcaaccggtgttcagcctgcactacgtcgggctcaatctgaagaaaggcgttaatgccgcgaccttcgaagcctttctcaaggcgcgcggcacgcagattcctgcttatccgggctggcaatggtcgctgttaaaaggcctgcgcggcgaacgccaggaacaatacctgatgctgtatcaggctcccagccagcccgaatatgaccgctatatcacccccacaggagcactcacggctgaagccatcgccttctggcaacaacgacccgaggcgagcgcgctgcttgaggagtggaaaaactttgccacctatggggagttaccaacgctcttctccaccttctcgctgctggcagaaaaccgccacagttcactgccgcccggcccgaattttcagcccgatgctcaacctgcggtggcacgcgtggtcggttttcatcatctggcgctacgcacgggcgtgacggctgccgacttcgatcgctttatgattgagaacgtcgcgcgcattgatgactatcccggctggaagtttcacatactgaagggcaccggcggcaatcgaagtgagcaatatgcagtgatgctggtgatcgaaagtctcgactcgctcaacagcttccatccggcgatggacgtctcaaccgaaaaatcgctgacgtttgtgaaaaaccatcaggagagcgagcgtatgtatgatgaatggcgcaccatggcctcgttctccggcgcaccgcaaatgtataccgactatctgacgattgccggcaacgtcggctga

SEQ ID NO: 112800 - DNA, 240 bp, Glycine max
  Peptide Sequence Number=SeqID_229578
atggccaaaatacaaggcccaaaagaaggaaaacctattctaatatttacaaagaaaagtggatacaaccttgacccatgggctcaaaaatctaccctaaggttcatgagaaccctagggcaccctagggccttctttagtagctctagtccaatcctcttggagcctcttgctcatggctctggtacctggtcccttcctagagaggattgcatcatcatgatgacaatcctcgtgtag

SEQ ID NO: 112801 - DNA, 216 bp, Glycine max
  Peptide Sequence Number=SeqID_229579
atgggtacactagaagtgatatctaaaccttggaggtttacagtaggaagctggttgtgtgactcagatctagttaatcctactggaattgaacgggttctcaccgagaaaaaccttcctgctgattcatattctaacctagaggcttttattcttgatgagaaagaatttctcctgttgaaggtcgaggaacagacagtgtggccttatccatga

SEQ ID NO: 112802 - DNA, 1716 bp, Glycine max
  Peptide Sequence Number=SeqID_229580
atggctgatgctcatgggactgataagaacattgaggtgtggaaaatcaagaaattgatcaaagctcttgaggctgccagaggaaatgggacaagtatgatttcccttatcatgcctccacgtgatcaaatatctcgtgtcaccaagatgcttggtgatgagtttggaactgcatcaaacatcaaaagcagggtgaatcgacagtcagttcttggtgcaatcacttctgctcagcagaggcttaagctctataacaaggttcctccaaatggtcttgttctgtatactggcacaatcgtgactgatgatgggaaggaaaagaaggtgactattgattttgagcctttcagacctattaatgcatccctttatctttgtgacaataagtttcatactgaagctttgaatgaactcctagagtctgatgacaagtttggatttattgtcatggatggcaatggtactttgtttgggaccttgagtggtaatacgagagaagtgcttcataaattcagtgtggatctcccaaagaaacatggaagaggagggcaatcagctctgcgttttgcccgtcttcggatggagaagcgtcataactatgtgaggaagacagcggagcatgctacccaattctatatcaatgctgccaccagccaacccaatgtttctggattaatattggctggttcagctgatttcaaaactgagcttagtcagtcagatatgtttgatcctcgtcttcaggcaaaaatactgaatgttgttgacgtctcctatggaggtgagaatgggtttaatcaggctattgaactatctgctgaaattctgtccaatgtgaagtttatccaggaaaagcgactgattggaaaatactttgaggaaatcagccaggatactggaaagtatgtttttggagttgatgatactctaaaagctttggagatgggagctgtcgagacacttattgtctgggaaaatctggatatgaataggtatgtcttaaaaaatagtgctactggtgaggttgtcattaagcacttcaacaaggaacaggattccaaccaaagcaattttcgggatcctgagagcaatgctgattttgaggttcaggagaagttgtctctgctggagtggtttgcaaatgaatacaaacggtttggttgcactcttgagtttgttaccaataaatcacaagaaggttcacagttttgcagagcaatcactgaaaaacttcctaccactggtgcaggaaaggggagccaagatacctgcaccaatatgggaggtggaggtggttgcacctgctgcagctcctcctcctccatatgctctgcccccaaggtgctcctttctgatacgagttaccttgtccttctaacatgcacactctggcaccacaaattcctgcaaagcttctggcagcacctgctcccctgctctctactacttacacccagaaaagcaagaacaaaaacatgtttattagagaaacactatgcagaagcagtgatgctctccaaagtcttgatgaagatgctcacagtcaataggttattctgcttaaaggtgtggcggtttttttcccaactgccatgggaaattagtggggaggcccggcatgacagtgccataaagtgcaatggcatgtttatatggctgaattttggccttccaccgtgttctgccattgataacactggtgttaataacgattag

SEQ ID NO: 112803 - DNA, 867 bp, Glycine max
  Peptide Sequence Number=SeqID_229581
atggcaacgacgtcgtcttcaagcgaggaagcaccgaacactaagaagaacaagaaggagtgtttaggttggatagaatggttaagaggttggttctatgtggtctacgaaatgctctttcagcgcatcatggcgagtcatttgcacaaccccatgcctctccctcccgtcaacgacctcacctgcattgtcaccggctccaccagcggcattggcctcgaaatcgcaaggttcttaagtctaagaatcagttcttactcaaaatcatcattggaggaggctgatatgaattccaattgtttatacagcttgaaaactaacaaggatgctgacatttggtacttgttgagaagtttatccaaactgcctcttaggcaattagcacagtcaggggcccatgttgttatggctgtcaggaacacaaaggcagctcaggagttgatccagaagtggcaagttgactctgaaggattgagtattcctctcaatgttgaggtgatgcaagttgatcttctctcattggattctgtcacgaggtttgctgaagcatggaatgcacgctcagcacccttacatgttctcatcaataatgctgggattttttccattggagagccacaaaagttctccaaagatggttatgaacagcacttgcaagtgaatcatcttgctcctgccttgctttcaatacttcttttgccatcccttattaggggttctcctagtcgcattgttaatgtgaattccataatgcatcatgttggctttgtagacactgaagatatgaatctcacatctggaaaaaggaaattttctagtatggtaggatactcaagcagcaagttagcagaggtacacttcatttaa

SEQ ID NO: 112804 - DNA, 396 bp, Glycine max
  Peptide Sequence Number=SeqID_229582
atgtcgccttatcaggttgtctttggcaaggcatgccatcttcctatagagatagagcacaaagcctactgggctgtaaagacctgcaacttctctattgatcaggcaggagaggaaaggaagttgcaactaagtgagctagatgagatccgtttagaagcctatgagaattccaaattctacaaggagaagaccaagaagttccatggcagcttgatagctaagaaggacttcgtggttggacagaaagttttattgtataactctaggctcggactcatgagtgttgatatcaaaagtgaatccacaaataagagcttcaaggtcaatggacaccggctgaaaccattcctcacaaatccctcctttcttcaccctacttctcttttgccatga

SEQ ID NO: 112805 - DNA, 270 bp, Glycine max
  Peptide Sequence Number=SeqID_229583
atgactttcttagcgggccttctcaaaagaacacactatcgcttagcgaaagctacagaaattcagcttctgcataattggcttagctggcaagagcccgctaagcctaaaatcagccgcaaggatatgtgcttagctcctcataagcttcacttagcggcattaaacagagcaaaaatttcactaagttatgggagcttagcgaacagggtcactcagctcagaaaatgctacaacgaatttcgcttggcctatagaagctcgacttag

SEQ ID NO: 112806 - DNA, 393 bp, Glycine max
  Peptide Sequence Number=SeqID_229584
ttgtgtccgatggcacgcagagaccaagtttggtcattctgcacccatgatacgcggagataccttacggttatctgcacctctttgctatgcagacacagttgtgtccgatggcacgcagagaccaaagaccaagtttggtcattctgcacccatgatacgcggagataccttacggttatctgcacccctttgctatgcagacacagttgtgtccgatggcacgcagagaccaaagaccaagtttggtcattctgcacccatgatacgcggagataccttacggttatctgcacccctttgctatgcagacacagttgtgtccgatggcacgcagagaccaaagaccaagtttggtcattctgcacccatgatacgcggagataccttacg

SEQ ID NO: 112807 - DNA, 321 bp, Glycine max
  Peptide Sequence Number=SeqID_229585
atggtcgaactctttaaaacagtccgcagtggagttgccaactgtcgcaacctacccttcggcgagagggcgacgcgagactcatcggtgcgtcttccaagaaaggaaaatgcgcggagtcgccaccaatgtttattcgaggaaaaagttggaaaaatcggaaaggtgtggtctacgaacattaatcgtgaaaggaacttaccggttgaagaccgaagaacggtgaagaatctccacgaaatcgcttacggaaacatctcggaagcgttatggaagtgcctcggcttggagttttttcacgaaaacaatttttctcactaa

SEQ ID NO: 112808 - DNA, 111 bp, Glycine max
  Peptide Sequence Number=SeqID_229586
atgcacccgcgagtcacgcatcgcgctcccgccgaagggtgtaaggctccacttccagcaataaaagataagctaaaggtagatgccacaagggtgatggataacccctga

SEQ ID NO: 112809 - DNA, 159 bp, Glycine max
  Peptide Sequence Number=SeqID_229587
atgattcatgggaagcctccaaactggagaaagaaaggaggaagtgatggacttgcacttcaagctagtacgtctgaccaagagaagcaatctccctcaactccacttcctttgactaaggaacaattacaccaattgtacaaacttcttgagtcttaa

SEQ ID NO: 112810 - DNA, 126 bp, Glycine max
  Peptide Sequence Number=SeqID_229588
atggattcatcaagtgattcagaaaatgaaatcataaatctaggcctcatggccaaagactatgaaagcaaagaagagatgcattcaatgaattgcataaagaatctgtcaaacttgccaaattag

SEQ ID NO: 112811 - DNA, 336 bp, Glycine max
  Peptide Sequence Number=SeqID_229589
atgcatggtagtgatggagactactatggtggcaacaacaatagtagtgatggtggtggctgctacaatagtgtagtatgttttgatgatgtaaaaaagaatttacttgataatgattgtcatcatcaaaaaatgggggagaatgtgaatgtacgaatacagatcattcaaggagaggaatctttctgctcatctctaaaactcagttgtaatcaagagactggttgtctcttggattgtgagaatcttgaacacaaaggcgagggatcccaaggtgtgttgaaagtctgtaaaagatttacagagatagtagaaaatctcaagtgggttgcttga

SEQ ID NO: 112812 - DNA, 468 bp, Glycine max
  Peptide Sequence Number=SeqID_229590
atggcggcacagctaatccgtgatcgagtagagatggagtgcctagagggagcttgggagaccctcgaaggcaacacgaggtgccgatttcggggcaccattcgattcacggctacttctttggtgcatccagatgaacctgcacggacgcttcagcgcactgtggagtggatactacccacgcctacaccatatcgtctagtggagcccgctcaagtgatcgaggtaacgtcatccgaggaagaccctgaggaggacctggaggagctacctcctgagcctgctatggatgcccttgactttctagagggtgatgaggatccacttcttgaggtggattctcccgaggaagtcatgtcggcatctgaggcagactctacggaggatagcggccgagggagatggcgatcagcgggggctcttcatcctagtggacagctttttggattagttttgtatactttttga

SEQ ID NO: 112813 - DNA, 271 bp, Glycine max
  Peptide Sequence Number=SeqID_229591
atgggtctagcttctggttctacatccataccagaaagtattcgcacagagagtcttgaggtgtatttcggcaattacacaatgataaagatggaaaaaagttcagggtttccggtgttatttggtggtgaaaattcaaaccctcctgatgatggtggcaaagacaagattctggggctgcaacttagtgcaagacttcaaaacaatggtctcaaagataagatatttctagggttggaacttattgcaagacttcaacaccgcaccagag

SEQ ID NO: 112814 - DNA, 210 bp, Glycine max
  Peptide Sequence Number=SeqID_229592
atgaaagaaaaaggaaaaagaaagaaagaccgcgaaggtcgatgtgttatagttaagaagtataaatcattcgtaaagagcagacgtatcttctggaaacaagggattgatgctaagagtttattttccggaaaaaccgagataagaatggatgaattcattgaactgattaaagaacataattgggaaacgttgggtctgtttgtgtaa

SEQ ID NO: 112815 - DNA, 855 bp, Glycine max
  Peptide Sequence Number=SeqID_229593
atgtggattgcaaagcttgtgctcatgtccatgggggttatctccactcttgttttgttgaaagtggcaatagtcccatatacattccaccttcttctctcaactcttcctcagttttgtgtctcagttagaagctggctaacactcccattcctctacatcattgtcaacttcatcatcatcaccattgcagcttcctccaacttcccccccaaaaccttctctgactcaccagcaccctctgatcctaagcacacaaccaccgtcatttcagacactgccaaccacccaactgagtcagagaaccaaaccaatgaacctaaggaagaagaaaaggaggttgaagaagaagaagaagaactagaacaagaagaggtggttgaagaagagctagaacaagaagaggtgattgaagagtctggtttgacctatgacaaattcatgatccaaccttcacttgaaagttgcaccaatgattatgtcctgccggattcagatggtgatgacacactggaagctacatggagggctatcatggagggacaagggaaaacaatgaaaccacagctgaagaagagtgacacatggggtgcaaggattgccaaggcagagccatttcatcgcaatggggagggtggtggtggtgatgatgaccctgtggcttgggcacagaaggagctcaaaaagtctgacactttcaatgatagagcctccttgagaagggacaaatccatgagtccagaggaattgaatcgcagggcagaagccttcattaagaagatcaacaatcaaatgaagctgcagaggctggagtcttaccagcgtttcagggaaatggtaaaccgtggtgtttga

SEQ ID NO: 112816 - DNA, 741 bp, Glycine max
  Peptide Sequence Number=SeqID_229594
atgaccaccaatcttgttgagtcaattaatttggtactcaagaaaacacaaaatctaccaatgagtacactggtaaaatcaacctatacaaggtgtaatgcattgttcaaccaaagagggagagaagccacaacaatgattacatttggtcaaatttatacacaagtactaagcaagactatggaagacacacagagaaaggagacaattaacctgagagaggttcgacttgctagaaatttcatggtcaggctagatgaaaggtggtgtgactatctcaaattccaaaaagtgcacatgtcttgttctcatgttgttgttacttcaaagcgtattggtcaccgtgccatgagccaaaaatctgcctcgactcaaagaagaaaagaaattctaaaggcacgtttaaaaattggttcctgcccgggggattcagttctagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgat

SEQ ID NO: 112817 - DNA, 228 bp, Glycine max
  Peptide Sequence Number=SeqID_229595
atgacctattgtcgccaagcgcaattccttatggccataactgagctaagccatccagagtctggcttagcaagagttgcagctttcagatctgcaaacctcgctaagcggtctgatcctcacgctaagccaaaactcgctaagcgcgcttatcgcgctaagcgagttcatcttttgaggatgaacactcatcctcttgctaaactacctatggctaagcgaggctga

SEQ ID NO: 112818 - DNA, 464 bp, Glycine max
  Peptide Sequence Number=SeqID_229596
tgttctcatacacggcggcgcacgacgtgatggaagtgaaccaactagattacgacacgtgtaagatagccaacgctctggcaacgtacgataacggagagaccgtgatccacctgagcgacgccaaaacgcgctacttcgtatgcggccgaatgggccattgccaacagggccttaaactacaggtccaaattttagcccagtccaataacggaaccagcaatgatcaaaaccaaagccccggcggttctcctccgtctacttctcctcctcctccgccgccgccgccgccgccgcaggatgatgaacagccacctgcagacgagcccgtgccgtgcgattgttcccgtgcggaggagcgccatggggtggtgccgttgattacgctcgtaatcgtgctcgcgttcgctcgtacccatttcttcatcgcatttccacatctccgttttcacaacatccgttga

SEQ ID NO: 112819 - DNA, 582 bp, Glycine max
  Peptide Sequence Number=SeqID_229597
gcacctgcagcacctgctgtaaaaactactgaaaaggctcccaaaaaatcttctgataaagccactgaaaagaagggtaagacagtagaaccaataaaggaagaaccattagatcctgtggctgaaaaacttcgccaacaaagattaatcgaagaagcagattataaggccactaaagaattgttcagtgggggaaaagaaaaagatgaaaagaaccttgacactttcatacccaaatctgagagtgatttcttggagtatgcagagctcatctcacacaagctccgagcttttgagaaaagttatcattatattggcttgctgaaggcagtaatgagactatcaacgatatctctaaaaggggcagatgccaaagatattgcatcttcggtaactgccattgcaaacgagaagataaaggcagaaaaagaagccaatgctggtaaaaagaagatagatgttttcaaggtttttgctgtgactgcaggtgggaagaaaaagcaacttaatgtcgataaacctgatgaggattttgttcctgctgatcgatatgatgctctggatgattatgatttcatgtga

SEQ ID NO: 112820 - DNA, 174 bp, Glycine max
  Peptide Sequence Number=SeqID_229598
atggagctccttggagacggaggcttttccgctcatgtttgcaaaaccttaaccgtgctcgtggttgagtcacagcgaaggaagagcaaacagagaaagttcagaggggaacacggttggggatgtagtgacaacgagaaaaacacggatattccattcatccttgtatgctaa

SEQ ID NO: 112821 - DNA, 1302 bp, Glycine max
  Peptide Sequence Number=SeqID_229599
atgggtggggattctattgtttctcatggtacagacgaaggttcttgtttggaggagaattttcccttgctttcatctcactcctcacctgctctcagggataatttgggcttgcaggatgaagacaacagaatgaaagcggagaatgggttaacttgtagtgaaactgatgaagaaatcatacatccttctagagttgattttgaagtcaatgaaaggagaagggttattaactaccaagaaatccttcaatgttgtgatgaattgaagattcatagcaaggatttgaaaagggagaaacaaaaaattttgagatataagcctggagcatggattgagaaggctggtggcttaaagataagtgattatgatgtgccaaagacaacatgcctcttattggttggtccaagaggatctgggaaaagtagtctcataaatagaatctctaaggtggttgaggatgacagatttgcaccagcaagagcacaagaatcatataattcacttttaggggacggaacatccttcctccaggagtatatgattccaagatattcaaattctatctgtctgtatgatacacgtagtttgtcggataactcagaaaaagatgagaatattagaatgctgaagagttggatgacaaaaggtgttcaccatggagagcttgttgtcaggaaaacagataatcagagattgaggaaaagtttgaaggggaaagctcacaagaaaggttacttatccacaatggagaatgatggtgctttggagacacagtgtgttcaatcaattgtttctactttcaattgcccattcctgtcatttaaaggagaggaagagagagggaggcagaaactgagtgcgagttgggacctttggacagggaagacactggacccttatgacaaacctgtacttgttttcactcatggggatctcctttcgttctctgagcgtgctcttgttcgtgaacatttgggaacgttattgggaattccacccaccaagcaaatttttgatatcccagactgtgattgtccagcaactgagtctgccataattggaatgctaagatatagtcttgcacatgccgacagacattttccacagagaagcaaggttatggataaggttcataaaatgtctctgtcactgtacatgattttgctgattctaggaataggaatcgcgattggctgggcccaaaatactgaaaatagaagagttcaatttccacgtccaaaacagaaagttcccaagagcaagccaatagagtggcataaaattcgacacatatggtag

SEQ ID NO: 112822 - DNA, 243 bp, Glycine max
  Peptide Sequence Number=SeqID_229600
atggcagttgccacgagaggaggcagagagaaaggggagtggatctcagatctggaaaaaaaaaaccatgtcgagagtgaagctatatcttatggcggcgacatcgacatcgacatcgacatcgacatcgacatcgacatcgacaggaagaagatgaagtggttgtcttcggagtcccaatcgtcagagaataagtccttggctggagataggagaccatggagtggattggaacaagtctag

SEQ ID NO: 112823 - DNA, 1404 bp, Glycine max
  Peptide Sequence Number=SeqID_229601
atggggtgtgtgattgatgggcgtttcactgttgagattcaaaatggagtgagcaatggttgtggtgaagtgggtttgtggaatgatggtggtggtgccattgaggatgctgtgaaggttttgttggagggtctaggggaagatgtgaacagggaaggccttagaaagacaccacttcgtgtagccaaggcccttcatgaaggaaccagaggttacagacaaaaggtgaacgacattgttcaaggtgctttattccctgaagctggtctagataatagagttggtcatgcaggtggagcaggtggacttgtgattgttcgagatcttgacttgttttcctattgcgagtcctgcttgcttccattcccggtcaagtgtcatgtgggttatgtcccctctggtgaaagagttgttggtttaagcaagctctctcgtgttgctgatgtatttgcaaaacgacttcaagagcctcagcgtctggcagatgaggtgtgttctgctttacatcagggaataaggccagcaggtgttgctatcatacttcaatgttcacatatccactttccagacatagaatcagtctttcttgactcaaattatcaagggtgggtgaagatacttgtttcttcaggttctggggtttttgagaacaaaaatgcagatgtatgggctgatttctttggtcttcttaaatttagaggcatcaatatggataaaattcattttagaggatcatctgatccatgctggtgtccttctcagtcttctctctctgccaaagtttcctccaaaataggaccagtcaatcctgtaatggttactgcagtagcttcagttattgaatctttgggagaaaatcctttgaggaaggagcttatagggactccaactagatttgtgaaatggttgatgaactttcaaaagagtaactttaatatcaagttgaatggttttctttgtgatgggatagattctttaaatgtcaatgaggatgttaacatcaacaaaaaaataacctctgagttgaacatacctttttggtcacaatgtgagcatcatttgcttccttttcatggtgttgttcacataggataccttatgtctgacggattcaatcctatcttaaaatcgcttttacaatcaattgtacatttttatggtttcaagctccaagttcaggaaaggcttaccaggcagatagctgaaaccattgccccactgttaggtggagatgtgatagtagttgtagaggcaagccacacgtgtatgatttcgaggggaattgagaagtttggaagtagtacggctactattggtgtgttaggacatttttcaaccgaccctactgcaagggcatcattcttgaagagtattccatatcctacatcatctggggagcaatga

SEQ ID NO: 112824 - DNA, 408 bp, Glycine max
  Peptide Sequence Number=SeqID_229602
atggtgtcttttttcatgatgggccagaagcatcacatgacattagtagagtttaatgtcactctggtttttgagacagatgcctccatcctaactaacggagatcgtcaagcaaagttgagggcccatgaaggatatgcatgggctagcacttggaaaaagatcacaggccaaggccgttacaatgcacaactctcccaaggccaattagattcgagaccctattctttaagctactcacaggtggctttcaggctagcacgccacctaggttatgaccttgacactaatgatacccaacatgttcctatgtttgtctttcaccatactacacttctgagcattggttgcatttttcaagaaggcaatggttatgccttcattgagcatgcaccccatcaacagtag

SEQ ID NO: 112825 - DNA, 177 bp, Glycine max
  Peptide Sequence Number=SeqID_229603
atggctccaaagaagcttccagctaagagggcaaggaaagatgccactggagaaggttccagtgcagccccacaagtggacgtggagtttgacaaacatcggttccgaaaactagtcatggagttctatgtcaatgcatggcccacgaaggagggagtcaaagacaagtgctcctga

SEQ ID NO: 112826 - DNA, 729 bp, Glycine max
  Peptide Sequence Number=SeqID_229604
atggtcaataccctcgccttcagagggctgcacgccctcgccatcagaggactaaacatcctcgccttcagagggctacacgccttcgccttcagaggactacacatcctcgccttcagaggactacacatcctcgccgtcagaggactacacaccctcgcattcaaagggctacatgccatcaccttcagagggctacaagacctcgccttcagaggacaacacgtcctcgccttcagagggctacacgtcctcgccttcagagggctacacgtcctcgctttcagagaactacatgtcctcgccttcagagggctacacgtcctcgccttcagagggctacacatcctcgctttcagaggactacatgtcctcgccttcagagggctacacattctcgccttcagagggctacacgccctcgccttcagaggactacacttcctcgccttcagaggactacacttcctcgccttcagagggctacacgtcctcgccttgagagggctacacgccctcgctttcagaggactacatgtcctcgctttcagagggctacacgacctcgccttcaggggactacacatcctcgcattcaaaggactacacgtcttcgccttcagagggctacacgccctcgccttcaaaggactacacgccctcgtcttcagatcattacacgtcctcgccttcagaggactacacatcctcgcattcagaggactacac

SEQ ID NO: 112827 - DNA, 99 bp, Glycine max
  Peptide Sequence Number=SeqID_229605
atggaaaccactgcagcaggagcaactagcaatagtttgtatggggattttgaaccttacagcaaatggcttacaaaggctacttcctatccttattaa

SEQ ID NO: 112828 - DNA, 291 bp, Glycine max
  Peptide Sequence Number=SeqID_229606
atggtggtgcaagaagcaattgaagatctgaaatccatcatcaacggagaaggtaagaaagagaaggaaaggagaaagagcggggaggaaggaagagaaaaagacaaaatgctatatggtggttctgatggctccgtcgtaccagttatgcttgcagtgacactctcctcggcaaaacagagaaaagtaaggaatgataaaaaatataaaaaggggcaaaactggaatagagggggaaaaattaagtttcgcactgtgcaatgcaaaacaagtttgggttgcgcacgctag

SEQ ID NO: 112829 - DNA, 447 bp, Glycine max
  Peptide Sequence Number=SeqID_229607
atggcagaggaaggtgtgaagtgtgaaagaagaggcgacttcgacacagcaaagggagagacacaaattcaacacaggagaagagacatagactcactatttgttagccatttttggcaggccctgtttcgcgccagtggcacccaattgcggcttagctcggcgtatcaccctaagagtgatggccagacggaggtcttgaatcgagtggttgagcaatacctgagggcctttgttcatcgtcggccgggtcggtggggcaagcttctgccgtgggtagaatgttcgcacaattcttcttggaatgctagttcagggtctactccatttgagataacctttggccggaaaccgtttactttcccgaagtatattacaggctcttccaagctcgatgctgttgattccagcttggtcgaacgagatgccaccattcaagcaatttga

SEQ ID NO: 112830 - DNA, 885 bp, Glycine max
  Peptide Sequence Number=SeqID_229608
atggctgcaacaacacgttcacgtgcatccatctacgatgtgttcctcaacttcagaggggaagacacacgctatggtttcaccggcaatctctacagggctctttctgacaagggaattcgtaccttctttgacgaagagaagcttcacagcggagaggaaataacacctgcacttttgaaggcaattaaagattccagaattgccatcactgtgctctctgaagactttgcttcttcctcattttgcttagatgaacttacatccattgttcactgcgcccagtataatgggatgatgattataccagtgttttataaggtgtatccttctgatgtcagacaccagaagggtacttatggagaagcattggctaagcataagataagatttccagaaaagttccagaattgggagatggctctgcgtcaagttgctgacttgtctggctttcatttcaaatacagagatgaatatgagtacaagtttattgagagaattgttgcgtcggtctctgagaagattaatcctgctagaatacatgttgccgatctgcctgttgaacaagagtccaaagtgcaagatacccatcaagagcaagaatacagagaggctttcaaggtgtttgacaaggatcaaaatggctacatttcagcaagtgagaatttattagtattaactaagaactgcatatatgctcaaagacatacgtacacatgccctcacatattaaaatccttccgtgctatgcagttgaggcaagttctgatcaaactgggtcaaaacacaactgttggagaggtggaggagatgattgcaactgcagatttcgatggtgatggtcaaattagctatgatgaatttgttaagactatgaaaatttaa

SEQ ID NO: 112831 - DNA, 156 bp, Glycine max
  Peptide Sequence Number=SeqID_229609
atgcaaaggtatcatgcttgcagctgcactagtgcagttaataacaatgcaattggtgggccatccactagggacattagaagaactgattcatcttccttgcaagctaactttcctgtgagttcaagatgttgttactgtaatactcacaagtaa

SEQ ID NO: 112832 - DNA, 449 bp, Glycine max
  Peptide Sequence Number=SeqID_229610
atgaagatccttggtcaggcggtgaggaaggtcgtcatcgtcgcactttgctttcttgcaattggttcagcgaaagccaagaagtttcatgcaaggagtggctccactaacgggaacttggaacagtgtccatggcctccgaccggactaaacccttattgccacttctcgaggaggacatcaagtccccgtgcacaacgccatctgattccctttcttttgcgctttctcctaatgctaccaacgtgtgatccaacatcgctctttctccgtggagtggtggatcagattcaaaaaggggatgcggggcgtgcaacggacacgaaggggaatgaaaagctgaaaatgagaaatactcgagaagaagaacagacacgaggagaagagaggaaaggaatggagtgcgagagtgcttggaaccacgagataataaagatccactcacaatg

SEQ ID NO: 112833 - DNA, 1465 bp, Glycine max
  Peptide Sequence Number=SeqID_229611
agggttgcatgccctcagcttcagaggattacacgtccacgccattagaggactacgcgtcctcaccttcagaggactacacgtcctcgccttcagagggcctcacgccctcgccttcagaggattacacgtcctcgccatcagaggactacatgtcctctcctttagatggcttcatgccctcaccttcagaggacttcacgtcctctccttcagaggaccacacgtcctcgccattgtaggactacacgtcctcgccttcaatggactacacgtcctcgccttcagcgggctacacgtcctcgccttcagaggggtacacgccctcagcttcagaggacttcacgtcctcgccttcagaggactacacgtcctcgccttcaaaggactacacgtcctcgccatgagagggctacacgtcctcgctttcatagggctacacatcctcaccttcagagaactacacatcccccccattagagggctacacaccctgccttcagaggactacgcgtcctccctttcagaggactacacgtcctcgccttcagagggctacacgtcctcgccatcaaaggactacacgtcctcccctttagagaagtacacgtcctatccttcagaggactacacgtcctcggcttcagagggttacacaccctcgccttcagaggactacacatcctcaccatcagaggactacatgtgctaccctttcagtgggctacatgtcctcaccatcacagggctacacaccctcacctttggagggctacatgccatcaccttcagaggactgcacgtcctcgccaacaaagggctacatgccctcaccttaagaggacttcacgtcctctccttcagaggactacacatcgccgccttcataggactatacgtcctagccatcagaggactacacctcctcgccttcatagggctacatgccctcaccatcagaggactacacatcctcaccttcagagggctacacgtcctcgcctttagagggctacacaccctcgaattcagaggactacacgtcctcgcctttagtggggtacacgtcctccccttccaaggactacacatcctcgccttcagagggttacacgccctcacctccagaggattacacgtcctcgccatcagaggactacatgtcctcccctttagagtattgcacgtcctcctctttagagggctacacgccctcgccttcagaggactacacgtcctccctttcagaggactacacgtcctcaccttcagaggactacacgtcctcgccttcagagggctacatgcccacaaaggattacacgtccttgccttcaaaggattacacctcctcgccatcagaggactacacatcctcacctttagagggcgacgtgtcctagcctgcagagggctacatgccctcaacttcagaggactaaacgtcctcagcttcagagggtga

SEQ ID NO: 112834 - DNA, 195 bp, Glycine max
  Peptide Sequence Number=SeqID_229612
atggaaaggatccaaaagtccacttctagtgataaatcccaatggtggtttcatggactatcaacgacaatgcatcacaaaaataggaaaactctagatgaggcttcactattatcaagcgagtcgaagactcagcaagaccacagatcgacctccactccttatggctcacatagacctgggtataggtcctaa

SEQ ID NO: 112835 - DNA, 203 bp, Glycine max
  Peptide Sequence Number=SeqID_229613
agagaggagctggaagtggaatttatgaaggtgctggaggaatcattgggatctctgtggaggaagaggaaggaagtgtagaagaagaaggtgttggtgcctctgattgtgcagtggaaggggcctcagatctcttacctctggccttcttgggtcctctgaaagtgactgttgatcatcaagattccaacagttcttcttaa

SEQ ID NO: 112836 - DNA, 432 bp, Glycine max
  Peptide Sequence Number=SeqID_229614
atggagaaagccactctaccacaagaaaaagagggtcttactaaagacagccaagaggcaaacaaggagggtgagaaggaggtactaatacctcttcagaggttgggtgatgaggaggaagtgtttaaagattttggtctaacaattaattcctcctcttcctctacatgtaattttgtgcaagccaccaacaagatgaaaactactgtggctaagcctcacccaagtgtggagaaggaagaccctccaaggaagaaaatcattccaaaagaccctgaatggaataagaaaaagagagataacatcacaattcaagcttttggctatggagtggatgaccatactaaaggatcaatgcaaaaaaggaaaatcaccttgttcgagggtggtcggttttcttccctttttcatccattaggcttgagacgttaa

SEQ ID NO: 112837 - DNA, 276 bp, Glycine max
  Peptide Sequence Number=SeqID_229615
atggttagagaggtgtatggcagtttgcttatgaatgagaacttggagaatgaaaaatttcacaagcaaatattgcatctacctataccttctaatgttaaagaatctactagacaccttctgtttgactatagattctcttattacatttggtcaatatacctatggtttggtgacatgcaaaagatcaatggcagtggaatggagaaggaggaaaggtcattgaagatgccacttcaaggagaagatgagtcaagaacaagttcaccaccatag

SEQ ID NO: 112838 - DNA, 234 bp, Glycine max
  Peptide Sequence Number=SeqID_229616
atgattgattgctcgaaagagccgtacctagctaagggaagaagctatctagccggacagagaagacagggctattgcagtggctactatggagattccttctgccaccgaaacccagacgccaaagggatgtatcctatcctctattctaagcgcgatagacgagtacccggtcaagtgaagcttgatagtcactcaaagctcaagctcgagctaaagttcaacgaatcctag

SEQ ID NO: 112839 - DNA, 780 bp, Glycine max
  Peptide Sequence Number=SeqID_229617
atggcatatcctcctggtttgcatatatttaaggcaactgacatcaagatggttgctgatagggtccaccttctcttaccagtatgggtgctaccaagaagaggggatttgagttgtattgtaaggcataaatgccttcgtggtagacaaaggaagtattactttgatgacgcttgcatctacttaacaagagatgatgacaactactccttcatccaacgtcttcttcagcttccctccattccatatagaggagcctacaacttgaagaagatgatggaagctcaaatgatagcccataggagagttgatgttgttgagattgctgcgaaagaagttgccaccactgttcaagctaaagcatatgctaaagctatggatgacactattgtgtgtgggttcctcattgaccttacaaacactggtgtcatggacgagattgttggaacactaactccatatcctgagtccaagcagtcaacaacttcaaatgaagccacttctcaagataagggtgaccatgaagttgtaattgtttactcaacaagttcttgtcctacccctctcaattatgcacaacctaccactgtcactcatgatcagagcatccaacaagctcaattgtcaatgcttagaattgttgctgcacctgcacctgcatcggtatctcaacctgcgtctcttgaacctccaccacaacctttggctctgataccaccaccacctccatccttttcaccaccttcccgacctctaccatcatcaccctttcaagactga

SEQ ID NO: 112840 - DNA, 219 bp, Glycine max
  Peptide Sequence Number=SeqID_229618
atgaatgtttgggacatgcatcataaatgtgcatatgtttttaagatggagaatgagggcaagcttatcgaggagggcatgaatgagttaatgtatgactctatacttggggggtatccaatttggaatctccaagtggctcatgttgatcctgtgggttggagtacccttgcaaaattgggtaaccttgacgggccattggcagtctcgtctcagtga

SEQ ID NO: 112841 - DNA, 693 bp, Glycine max
  Peptide Sequence Number=SeqID_229619
atgtataaattcagcttccatgcaggtgctctagaatggagatgctctttgaccattttcaaccgtctagaggagttcgccaaggagacctcatttctccttatttgtttgtgctgtgcattgaaaggcttttccctcataaaaattgcagttgaccagaacctttggagccctatccagctgtctagaggtggcccccagctttcttatcttgcttttgctgatgatattttgttatttgtagaggctaccccttctcaagctgaagttttaaaaaaagtgttggatactttctataaaagttctggccagaaagttaatgcagataaaactaggatttattccagaaatgtgcattggaagacaaatgaccaagttgcaaatcatctgggtttccaaagaacagctgatcttggcaaatatcttggtgttccccttcatcatgagagagtttcaaagcaaaattatcagttccttcttgataaggtaaattccaggttgagtaattggaaggcctctaacctttctatggcgggaaggatgactttaacgaaggcaattttgcaagcgcttcccaactatgtgatgcaaacaacatatctcccagcatccgtgagtgatgagattgataagaagtgccggcaacttttgtgtggggagatacagcaaataacaagaaggttcatgggatga

SEQ ID NO: 112842 - DNA, 426 bp, Glycine max
  Peptide Sequence Number=SeqID_229620
atggtatcaaaattcgtaaattataataaactcccctcacctatcgtgagctctccgtcagttcctttttgcgtcagtcatagacctttttcgttcatgttcgtcagtccaaacacaatgttctatataccaaatcgaaggaaatttagtatagatttcaaaaacaaggttaataacaacatttggagtcaattacccttgtcaaaacataaagggctaaggagtgtttcagattctactaaaaggagacgtcatttcgaaattccgatcacgccaattttggcgggaagcaacgacggctcttggtggccaccggtggtcgtggatggtgaaggaggacgtgttagggcttggatctcgctttgcgagctcgtctcgctaagcgggagtccacttttggcgctaagtgcgacttttcgcgcttag

SEQ ID NO: 112843 - DNA, 123 bp, Glycine max
  Peptide Sequence Number=SeqID_229621
atgacgtgtactctaccaaatgtcgcatatgcttttagcatgatgagtagataccaatatgatcccaatgaaagtcgccggattgttgtcaagaacattataaagtacttgcgaaggaattaa

SEQ ID NO: 112844 - DNA, 435 bp, Glycine max
  Peptide Sequence Number=SeqID_229622
atgaacttaatcattgttatcaaaaagaaaagaacacgctttacagcgccccgaacccgtgctagatctagagtaatgggtgaagtagaggaggtgcaagagcagatgaaggccgacatggaggccatgaaagagaaaatggccacaatgatggaggccatgatgagcatgaagaagataatggaagccaatgcggttgtagttgccgctactagcgctgttgctaaggtgaacctgacgcccccatctggcctcaaccatatgaatcatccaacctcagatatggtaggcaaagatttgggaaatacgggcagcccctattatgtgcaaattcaaaacaagcacgccttcctgccatatggcttgcctcccaactatacaccacccaatgtggcgtacaccgatgcaatcctaccctgcaagggtattggatag

SEQ ID NO: 112845 - DNA, 519 bp, Glycine max
  Peptide Sequence Number=SeqID_229623
cttcactgactccccttctgttgttatggtgtcggcatcgcttttctcctcttcttctcgccctagtgtctccctggagcacgtctacacttctcatgatactgactcgatgaggagcatgggtctagcaattctgaaggagaatgggaaaaggcaccaagaggcactaagcaagatggcatacttagaggctaaggttgccaagtcgaaccaccagttgtcgcccaaggctagcaaggtggagagcactgttgtcgagaaggaagagcttgccaaggtggttgttgacctagaggcccggttgaaggaggcgaagtccaagctagaggagactgagctaagggcgtccaaggagagagaggccatcaaagagcttgaagaggagttgttggtgtataagaagaaggtcgtagagcaggatgaaaagggattttataaggtcatcaggcaggctgggtggagccgttcacttgaggctcatgcacggtgcccctcattgccccagtgtaaggctttgag

SEQ ID NO: 112846 - DNA, 151 bp, Glycine max
  Peptide Sequence Number=SeqID_229624
ttggagatgaatttgaagaaaactggttctgattttggaacccagccacaaggatcatgtccaaagattccacatgcttacaccattcgaaacaacaggaacattggccgaagtcccacatcgactataccagtagatgagactgacatag

SEQ ID NO: 112847 - DNA, 121 bp, Glycine max
  Peptide Sequence Number=SeqID_229625
tatggaacgagatcggggatacccgatacccaacgggtacccgacgagtacggggatgagataataaactgtaacccgtcgggtatcgggtacgggtatggggatatgttggggagtcggg

SEQ ID NO: 112848 - DNA, 126 bp, Glycine max
  Peptide Sequence Number=SeqID_229626
atggaaggattcagttctcaacatgagatggaagcatgtgcccagtggggatgtgccttgccagggcaacatgacgatggtcttatgatgataagttgcataaggaagccacccacgggagcatag

SEQ ID NO: 112849 - DNA, 458 bp, Glycine max
  Peptide Sequence Number=SeqID_229627
atgtcaggacttacacccgattctcctcaaatttcagccagcccacatcaattagaccatgcaccttatgcttcagggccctacaatgctcaatggaatgccccggggcttctccatgacaagcacactttgcgttcgagtcatatcctcggagaaatggaggttgaggaaccttggttagggttatggctaccattaaattatcgaatggatatgggagcaagtcaacataggacaccggaattggggcatgtggtaagcaggcaggccttgtggctgttttggggatggcctttgtggatgattggtcacaacaagggtttctccctcatcccttcatttgccccagttttcgcattttgcctcttttcaaacccacttcgatcctttcgccggcgaagaccaaatttgcaaaatttgaaggtgccacttgagctgccaggtctctccacctttag

SEQ ID NO: 112850 - DNA, 272 bp, Glycine max
  Peptide Sequence Number=SeqID_229628
ggatcacactcgcaagacacccagttgacccggagaagtccaacagggtcctgaggtttccagttctaattacgggcctctatcagttctacggagtgcccgttgcccccagcaagggtgagacaccacagcaactaggggatggccgacaatgggcaacagacgcaccaccgccttctccagagttcacctcagctcatccacaaaaaggctgcagcgttgcctatgacacatggccgaccagcaggcgaccaagtccaaagcaaaggtaa

SEQ ID NO: 112851 - DNA, 336 bp, Glycine max
  Peptide Sequence Number=SeqID_229629
atgaaggtggccttagaacaaaccctgaaggaggctccaaaagtgggcgtggaagccatcaacaagcgaaaacaaaatagattaggaaagtccattgctgatgatgaccttgaagaagatgaggagatgttggcaaaggagcaccagaccaaaagaaggcatgagtctgtcgtgtctactcttgcttgtccatctacagtaaatccagtcacacaaaggttgaaagacctaagtgagactgatgatgatggtgaaggactagtaagagtggcccttcaaaagcggaaagttgttgctctcgatgcacctgctcttaagaaagccaaaaaggcttaa

SEQ ID NO: 112852 - DNA, 312 bp, Glycine max
  Peptide Sequence Number=SeqID_229630
atggcctctacaaatacccccatcactaaagtcatcccaaccataaaaatcattaccatacacacaaataatgagccttccattcatgtagaacacttttttgacattcaagaactcaaaaagttcatcaacaagaagaccatagcctccaaggttttgggagtgaagatcatactatcaagagacaccattgctaaggcaacaaggtgtctacgcaagggcagtacctaccaagaaggttgggagaagaactacaactctcacatcatcagagctctctaccatgacaatgcagagaaggctagtgactag

SEQ ID NO: 112853 - DNA, 403 bp, Glycine max
  Peptide Sequence Number=SeqID_229631
atgaagttaggtggcaagcagagatacccaagtggttatccatataaacacgctttcgctatctgtcagactcagagtccgagatacccaagtggttatccgtataaacactctttcgctattcgtcaaactcagagtccggtgacaggcggagatacccaagcggttctccgtacaaacgattttcagtatccgtcagactcaaagtccggtagcatgcagagacaaatgtcgtcttttgcacttctgttaatccggacccgtgaaagatacccaagtggttatccgtataaacacgctttcgctatccgtcaggctcagagtccggcggagatacccaagcggttctccgtacaaacgatttctgttgaccctgacacgggaagtcaggtggcagacgggg

SEQ ID NO: 112854 - DNA, 375 bp, Glycine max
  Peptide Sequence Number=SeqID_229632
atgtcgacgagctatctcctcctgaaaatctttgtactcatcatccctgagctggacgcatctctctctgtggaacgaccatcctttgatggcctcgaagcgctactggtgctcggcgctcctgaaacggtggctatcaaactcgaaggcggcactggtcccttcagccgcggcgtccctcctatatctcttcgtggaaagctttttcggagccatttcttgttggagatgaataatagtgcaaaatggaatcaaaaactcggaaaaaatggttacctaagggatgcaaaactcgtgaatcccgtagctttcatttttttgaatgaggggggagagtttttgggtgcagaaaacttccccctcccccctttttaa

SEQ ID NO: 112855 - DNA, 279 bp, Glycine max
  Peptide Sequence Number=SeqID_229633
atggctaagtttgaccttgatatagtcctggagttttatgctaatgcttggcccacagaagagggagtgcgagacatacggtcatgggtgaggggtcagtggattcccttcgacgcagatgccctcagccaattcctgggtgacccgctagtgttaaaggaaggccaggagtgcgagtttagtcagaggaggccattgctcagctattatgcacaccgggtcaagatttcacccggaccgctgcagggaggcgagtgcggatcatgcacaccagtatga

SEQ ID NO: 112856 - DNA, 1231 bp, Glycine max
  Peptide Sequence Number=SeqID_229634
atgtcgtcgcttcccgtggaaccaaaacaacagcagttagaagcacattgtagaggttacattttgcggctaattgatgaggttttaatgccagacaagataggaaatcggtgtgtaggaccactgaccctgatgccaaaaccatgggcgactatgcgtcattgttgcaatcttgtgcatggaatgcccttcattgcagcaagagttaatcaaataccatcattttcgttggttacgagtggtagtggattaggctttactggtacaccacatggagatgtcatcgattatagaatgaggccaaaagaagagaaggttcaagtagctgatgactcgctcagtgaggcaaatccgctcagcgagtggcatccgctaagcgaggcatatagctcacttagcggcgcgcccagtctcgctaagccaaaattcacttactctcgcttagcgagccttcggaagctgaaaggttcaagagcctttaaaacactgaagttggcggagtcagatagagatcgcgctaaacgcgcccttcgcgctaaacacgccctgtgcgctaagcgtatcatgttaatttctgaaggcacgctaagcgagtctatctcgctaagcgcccaatggcctccagaaagaggaaatcttccacctctcgacctcaagagccctatgataccacgagattcatttccgaggtcacatgggagagccttgactaggaagcctgatggttgcatagatgtggccctagtcaaggaattttatgcaaatttgtatgacccagaagataaatcaccaagacaggtcagagtgagagggaagctgataaagtttgatggggagacgctcaacaccttcttggagaccctggtggttctggagccaggggagcgatacttagcttattccagattctatcacatgcatccagaccctcaggagcttgcaaccaagctctgtatcccagggcgaggtttcgtacttaatgctgagggaacaccccggaagctgctcaggaaggacctcaccacacttgcacagacatggagtgtcctctcctattccaaccttacccctacttctcacacgtccgatcttaatatgaacagggcgagggctcagggaccctctaatgcttctacctctactccaaactctacctctgcccttgctaccactccagctccaacatcagcaccagttcctatgacatcctggaatttctacccgaaatttt

SEQ ID NO: 112857 - DNA, 300 bp, Glycine max
  Peptide Sequence Number=SeqID_229635
atgactctaggtggggctcttgttaaggatgagtctgcctcttgctttcactataggtcacaaaaaagggctgcggaagaaggttcttccgcgggtacacggaagacagttcttccgtggatgacaaatcgggcctgcggaagaacgttcttctgcgggatatattgcctgcctgcggaagaaggttcttctgcgagtgaaagacgtttcgtttttaacgtgcggaagaaggttcttccactggatcacgcggaagaaacttcttccgcggatatccgcggaagaaacatcttctgctag

SEQ ID NO: 112858 - DNA, 285 bp, Glycine max
  Peptide Sequence Number=SeqID_229636
atggtcatgggtggtggagaagaaggtgttagggtttgggtgggcgtttggagaggaggagagggggaaatcgtgtttttcacgctgaagaatcttgtctcgctaagcgggagtccacttttcacgcttagcgcgacaattcacgctaagcacaactccctctgcactaattctcgctcagggcgccaattctcactcagcgcaattccttcttgggttggaattgcacttagcgcgctaattctcgctcagcgaaattccctctcgggttggaattacacttag

SEQ ID NO: 112859 - DNA, 396 bp, Glycine max
  Peptide Sequence Number=SeqID_229637
atggctcttgtaagatatttatatgttgcctctacgcaaataagtgcaacaatatcaccggatcaaagctccaatgctttcaaagaagtttccatcataaggcatcctcatgttggtgagtatgcacttgggttcatcacttcttcaatggttctaaggaacatagatgagaaagagattttttgtgtttacattcccaccaatcacttgtaccttggtgatatttatctcattagcctagaggatattctaagacctaatttgtctgttcgagaagcgatagacctagccacacacaacccagtcaaaagggccatgtattcaaccatagtacccacatcgaaggaaaacaaacacttcatggacaggggttcttacctacacagacacctttga

SEQ ID NO: 112860 - DNA, 336 bp, Glycine max
  Peptide Sequence Number=SeqID_229638
atggctaagcacatggacaattctggaagaaggatgagctgtatagaggcactaagcgaaagccaactcgctaagcgcatcttcatcaccttcaagctgagcgagttctttggctatcaagagattaagagagagttgagcttgaagaggaagccatcttggggaactttggatgagattttgagagattgtgaggaagcttccctgctatggagagctaaatcctcagttggttcttcctatggggtacttgattacttaattctagtgtgcctttgccttgatcacgcacttgcatgcttagttagggtcactcaacattgggaaatggtttga

SEQ ID NO: 112861 - DNA, 348 bp, Glycine max
  Peptide Sequence Number=SeqID_229639
atgtctttttcaaaagatttcctcgctggtaatcgattaccaaagtatgtaattgattaccagtgctcaaaaatgaattacacagtctttgcacattggaacctaatagttacactgtgtaatcgattacacataaatggtaatcgattactagtggcagaagctactgaacatcctgtttcaatttttaaaccccgtaatcgattacccacgaatggtaatcgattaccagagggtatttttcatataacacccaagataaatagctggccagcctccacacatgcctccctgcttcatggacttttgttcctttattggtttactgccaggagctcgcctgcttag

SEQ ID NO: 112862 - DNA, 2523 bp, Glycine max
  Peptide Sequence Number=SeqID_229640
atggcatcaaaggttacaaaaaaatatatcactaaaatttacactggaccaacaacaagaaacttcaatgtggctgagatgtgttcactgtcacttagagcatatgagatgtgtacatgtataacaggagttccgaaagcacctgaagtgaggagtggggtggggtggattgtatgccttcccatcaccaacacatcttctcacatgatcatggatgcctctgcctccaatgttaaattcttcttgatttgttcactatgtctaatcatgttcaactctgttatatgcagtttgaaggctcagtgcaatgagaaggacacgaacacactcctacacttcaaacaaggagtcactgatccctcaggcttgctctcttcatgtttccctgagctagattgttgtcactggacaggagttaagtgtgacaatatcacaggtagagttacacagcttaacctcccttgtcatataaaccatcctaaagttgttgattatggagagaaggatgacaaatcaaactgcctaacaggtgaattcagccttaatttgctggaacttgaatttttgagctacttgtcaagagctaacagaaattcaaattgctgtaacagaattatcactaccagcaaactagtggaatgctgtaacaaactcaggaagattctacaagcacttggagccttcgcgcaattggaactcaaacgaagtcctgcaagtagtcaaaatgagatacatagccaactacctaaaacattgccaaatcttagaagtgttaagtccttgattttatctcataattatctcaaaggatccattccaaattggttaggacaacttgaacaactacaagaacttgttctttctgataattttttttctggtccaatccctgcaagtttgggaaatctatcatccttgattgaattgatacttgacttaaatgagttgaatggaaatcttcccgacactcttgggcaactcttcaactcggagacacttcgagtcggaggaaattccttgacaggaattgtgtctgaaagaaatttactttcttttccaaaattacagcgcttgtacattggttcgcctgacctgatctttaattttgaccctggatgggtcccttcgtttcaacttctacgcattggattgggctatgtgagagaccaacttcctgcatggctattcacacagacttctctaaaatatctatccattctacactcaactgcttcatttgaacctcttgacaagttttggaactttgctactcaacttgaatatatcgatttgacaaacaacacaatccacggggacatgtcaaatgtgttgctaagctcaaaatttgtttggttagcttccaataatttaagtggtggcatgcctggtatatcaccacaagtgactgttttaaacttaggcaataactcattgtttggatccatttctcctctcttgtgtgacaatatgacagataaaagcaatttagtgcacttgagcttaggtcataatcatttatctggagaaattacaagttgctggaataattggaagtctttggttcttattggtttacaatccaacaacctaacaggtaagattcctcactcaatggggtccttgtcaaaccttcgttttttgtatctgggaagtaataaattcttcggagaggtacctttttcactaaaaaactgcaagaatcttagaatactcgatcttggtcacaataatctctctggagttataccaagctggttgggacagagtgttaaaggtcttctgttaagatccaatcaattcagtggcaacattccaacagagctatgccaaataaattccataatggtgatggattttgcaagtaatagattatcagggtccatccccaattgcttacaaaacatcacagccatgatttctagttatgcttcaacgcgtagagtcgtctttaccgttaacttaacaggtataccagtacacatttattgtaatatttggatgcttataaaaggcaacgagttagcatacgttgatttgatgaatgtgattgatctgtcaagtaacaacttgtctggaagtgtgcctttagagatgtatatgctaactggattacaatccttgaatttgtcccataatcaattaatgggaaccatattagaagagattgacaacttgaaacaattggaggctattgatctctcaagaaataatttatcaggcgaaattccagagtccatgtctgccttgcattatcttgctgtcttgaatctgtcatttaacaattttgtgggcaaaatcccaacagggacccaacttggttctacaaaccttagctatatcggcaatcctgacctttgtggagctccacttacaaagatatgcccacaagatgacgaatcccacgacacaaaaccgagggaagaagaagatgatgatgaaaaatccgaagtatattcgtggttctacatggggctgggaattggatttgccgttggattttggggagttttgggcaccacttag

SEQ ID NO: 112863 - DNA, 540 bp, Glycine max
  Peptide Sequence Number=SeqID_229641
atgttgatgttaattcaatgtgttggcttccccttcactctcccagtatatgtatggatttcaataaaatgcaaaaaagttgtaccagaagtcgaagcagaacccaatgggtgtgcgttggtttcattggtgggagtggaagctccaatccaatggccatttttgtctgtgactgtgatgcacactgaaacaattaaccctattcatcaatctccagtgtggcactgccatcaatgtccaccaccatttcttcccttcccttctctctcccacttcgccaaaattccagggttacccttttcaatccaccctcctcttctattccatcccaatcagcagtcacgtttcctaaaaaggcatggaaacacttcatcggaaactgatggttctgagctcaaagaagataaattgtctgaagatttggtgaagctcgaaggtgaccagtccaaaaacctgaagaaagattggcttgcaactatccttacgttgtggttttggttgctttgtgattatgttaggcactcctgtgctaaaccatga

SEQ ID NO: 112864 - DNA, 309 bp, Glycine max
  Peptide Sequence Number=SeqID_229642
atgagaggaacgaggataagggctacatgggggtacgtgagcttagttgaaagtgggcaactggtgatgtggtacctggagatatgtcgcggggctcatgagaccttggggacgctaggtggggtgctattgcccaaaaccaagcttgatcaatcccgacccaacccgggcatagcttgtgtggtggctggccagctatggatcttgagtgatatttgggatatggcctctggtaatcgattaccaagggaagttgagatggcctctggtaatcgattaccaaggggtgtaatcgattacaaggcttag

SEQ ID NO: 112865 - DNA, 3625 bp, Glycine max
  Peptide Sequence Number=SeqID_229643
agtggttgattctgtgtcccagagacattggttttttgatgccaggagatcaggattgaagataagatcagctctgatggtggcagtgtataaaaaacagctaaagctttctagctcggcaaggagaaggcactcaacaggtgaaattgtgaattacattgctgttgacacatatcgtatgggagaatttccatggtggtttcatatatcatggacttctgcagtacaacttgttctctctgttggtgtcctttttggtgttgttggtgttggtgctcttcctggtttagtcccacttgttatatgtggacttatcaatgtaccatttgctaagatcctacaacattgtatggcacagttcatgatttcacaggatgagcgtcttagatcaacttcagaaattctgaatagcatgaaaatcattaagttacaatcctgggaggacaaattcaagaatttggttgagaacctacgtgctaaagagttcatctggctgtctaagtcacagatgatgaaatcttatggaacatttctgtattggatgtcacctaccatcgtttctgctgttgttttcctcggttgtgctcttttcaatagtgccccgttgaatgctggaaccattttcacagtttttgcaacgttgaggaacttgtcagaacctgttcgaatgattccagaggctctatccatgatgatccaagttaaggtatcctttgatcgtctcaataccgttttgcttgatgaagagctagatagtagcaatgctaacagaagaaatataaaccaaagttcggttaatgctgtggaaatccaagccggaaatttcatttgggatcacgaatcagtatttccaactttaagagatgtgaatttacaaattgaacaaggacagaaaatcgcagtttgtgggcctgttggcgctggaaaatcatctcttttatttgcagtacttggagagtttccaaagatctcaggaaccgttaatgtgtctggcactgtagcctatgtttctcaaacttcttggatacaaagtgggacagttcgagataatatactctttggaaagccaatggacaaaacaagatatgatgatgccattaaagtttgtgctttagacaaggatattaatgattttagccatggtgatctgactgaaataggtcagcgagggattaacatgagtggaggacaaaagcaaaggattcaactagctcgtgcagtctacaatgacgctgacatctatctccttgatgaccctttcagtgcagttgatgctcacactgctgctatcctcttcaatgactgtgtaatgatggctctaagagagaaaacagtcattctagtcactcatcaagtggagtttctctcacaagtggatacaatcctggtaatggaaggtggaaaagttactcaagcaggtaattatgtgaatctcttgacatctgggacagcctttgaacaacttgtgagcgctcataaggaagcaatttcagagttggaacaaaataatgaaaacaaaactcatacagaagagtctcaaggtttttatctcactaaaaaccaaagtgagggggagatttcttacaagggtcaacttggggtacagcttacacaagaagaagaaaaagagattggtgatgctgcgtcaacgttttggcttgttcaagccattgaaattccaaaattaagtagtgtcaccttgattggagtttactcattaatttcatttggtggtactgtatttgcatttctaaggactagcattggtgcacacctcggattaaaagcttctacagccttcttctcaagtttcactacttctatcttcaatgctcctatgctgttctttgattcaacccctgtaggaaggattttaacccgcgcatcatcagatttaactattttggactttgatatacccttttccatcacttttgtagcttctgttccaattgaaattttgatgataattggtataatggtttacgtaacatggcaagttctcattgttgctgttccagcaatggttgcatcaaaatatgttcagggatattatcaagcctcagcaagggaattgataaggattaatggaaccacaaaagctcctgtcatgaattttgcagctgagacatcacttggattggttactgtaagagcatttaatatggcagacagattttttaaaaattacttaaaacttgtggacacagacgcagcactgttcttttattctaatgcggccatggaatggttagttttaaggattgaaactcttcaaaatttgacagtcatcactgcagctttgctgcttgttctagttcctcagggatacgtgtccccaggccttgtggggctgtctctctcttatacattcaccttgacaggaacccaaatatttttgactcgatggtattgcaacttattaaactatattatctctgttgagagaatcaagcaattcattcagcttccagaagagcctcctgccattgtggaggacaaccggcctccatcttcatggccttccaaaggcaggattgaccttcaagccttagaggcaaagttgcatcctttgcttaagggtatcacttgtacgtttaaggaaggaagtagagtgggagttgtaggaaggactggaagtggaaaaagtacgctcataagtgctctttttcgcttagttgagccagcaagtggtgatattcttatagatgggattaacatatgctcaatagggttgaaggatttgaaaataaagctaagcatcatccctcaagaaccaactcttttcaagggaagcattagaaccaacttggaccctctaggcctgtactcagatgatgatttatggaaggcattagaaaaatgtcagcttaaggaaactatcagccgtctaccaaatctcttggactctttggtgagtgatgaaggtggaaattggagcttgggacagcgccaactattttgtcttggaagagtactacttaagaggaacagaattctagttctggatgaagctaccgcatccattgactctgccacagatgccattctacaacaaataattagacaagaatttgccaaatgcacagttataacagtggctcacagggttccaactgtaatagatagtgacatggtcatggtcctctcctatgggaaacttgtggaatatgatgagccttcaaagctaatggacaccaactcctcgttctctaagctggagcttgaaacttcggattcaaaagcgaaatcttttagtgaattcttgtatagatactgcaagatggaaggggatcaaagctataccaactccatgaaagctgtttctggttatttgcagaagagaatgacttgcaagtctatactccagaatttgtgggaaattgaagattttgaacgcaagaatggttgttacagagtttgcctcaactattgtggttatataacccaaaggttcatagtaaatgctagtcaatctaacataataatatcaaataccttgaatgatgtgaatatcaggaagaccttcccaaacttggatgctttttctgcattcgtgtttgtcttaaaccctcataccactaagaaatgcactggttcaagcagtatggcacgagaaacacag

SEQ ID NO: 112866 - DNA, 723 bp, Glycine max
  Peptide Sequence Number=SeqID_229644
atgactacaccaaccaggtctcctcctccttctctccatcctcctactactgatgcagcatcacattcctctcctaccttgaagcaaacaagaaaagccacacgcctgagatcattggctactagaccagttaaggtagagagacccctggtccatgtggatcctacgaccgggaaagccgatggtccccacagcaagaagttaagaacatatttgaagattgttgctcgtgataaggtggatgtgacatacaagaattggaaacaagtccctgctgcccagaaggatttgatatgggaggatattcagagccgtagagacccttcatgggaggatgtgcaaaaaaagacacaggccatccagaaacaaaatattgcctctcacgtgttgtctcgtgggggttatgaatttctagaaaacaagttgatggaggagaagaaaaagaaacaactggaagaagctgctaaatctggaagcactgacactgtcattgatcctccatctcccatcagacaacacgtgaagtggaagatggctcacaccaagaaaactgggcaaatgacttttgaggcagcaaaggaaattgctgacaagattgatgtactgactactgccattgggcgacctgaacatcctggtcatgtgcgtactactggagctggtgtcacgattaaacaatactttggaccggctccaaggacctcccgcacatattcgtccatg

SEQ ID NO: 112867 - DNA, 900 bp, Glycine max
  Peptide Sequence Number=SeqID_229645
atggctgggattgtagtgatttttgactttgactcaacaatcattgagtgtgatagtgataattgggtgcttgatgagaccggtttaactgaaaagttctatcagcttcttcctagcacgcattggaaccctctaatggataagatgatgaatgaacttcattcacaagggaaaaccattcaagacattgtacaaattctgagtaggacaccaatgcatcctcgcattgtccctgctattgaggcagcttattctcttgggtgtgacctgaagattgtgagtgacgcaaatattttctttattgagacaattctgaagcatcatggagtgtggaactgtttctcagatgtcattgccaaccccatccatgttaatgaagggaggctcaatatttgtccataccatgattatcttaaatcttctcatggatgcaatctttgcccaccaaacatgtgcaaggcaataattgcattgattcccaagatctatttacttatggccaagcaattaattctcatatttattctaggattggtgatagaaaggatccaaaactccctcgctgcagcaggaaagaagaaactaatctatcttggagatggaaatggagatttttgcccaagtttgaggctcaaagatggtgactatgtgatgcctagaaaggactttccattgtgtgatttagtttctaaaaattctaataagataaaggcagaagtacatggttggagagatgggaaagagcttgaacatgttctgctccatgttatcaacaaagaaattggggaaggaaacaacattaataattctactcagaaagtctcagttgattgcaagatggggccaattgcaattgacactcgtcaacctttgcctaaagccctatcagttcctcaataa

SEQ ID NO: 112868 - DNA, 1238 bp, Glycine max
  Peptide Sequence Number=SeqID_229646
atggaaagtgttgttattgacgctatagaggaggatgctatcatttgggatgagaagtcctcaggagagtatacaaccaaatctgcctataagtgcctcattgacactcctccagaattattcattcatgatgttgatgagtggatttttcagaatcttagagctcctcaagaaacaactcatcacaatatctcaagtcttcctagtcgtatggtgtgttggtctcctccggttgattttgattacaaactcaacactgatagaagctccttaggcaatccgagtcaggctggaattgacagattgattcgtgataatttggggttgcagattgcgtgggataagggtgttacaagcatcatttgtgaatatgactccaagcttgttgtggacatgatttcccttggaggtaaagcttgtgcgaatcttcttgctaggaatggatcttcttcttttgataagttagttattttcgataaatgtccctttttcatcaatgtggctttgttgtcagatgtttgtgtcactcttcatgatggctacacccccttgtttggggaccataatttggccatccatagagatggcaaatcagttcacctttcacttgatgaaagaacaggttctggatttgtgtctcatgacctttaccttcacgggtatttcagtgcctcgatcaagctgcctgctgattacactgctggagttgtggttgcattttatatgtcaaatggtgaaatgttccagaacaaccatgatgagatagactttgagtttttggggaacattagaggcaaagactggaggattcagacaaatgtttatggcaatggaagcaccagcattggtagagaggaaagatatggcttatggtttgatcctgctgaggatttccatcagtacagtattctttggacagattctaagatcatattttatgtggataatgttcctattagggaagttaaaagaacagaatctatgggaggagatttcccctcaaagccaatgaccatgtatgctaccatatgggatgcatctgattgggcaaccaatggaggcaaatacagggtaaattacaagtatgcaccctatgttgctgagttctctgacctgatcctgcatggttgtgcagttgatcccatagagcatgtggccaagtgtgaaagtgcccaaggttctgagaaagttccctctggtgtcaccccagtacaaataaccaaaatgagaaacttcag

SEQ ID NO: 112869 - DNA, 417 bp, Glycine max
  Peptide Sequence Number=SeqID_229647
atgaataaaaaaccttatagaagaaccccaaactccaatgttcctccaccacagcctagaccacaactccaaaccccaacactcctctgccgtggcctagaccataaccccaaaccccaacgctccttttgccacaccccaaaccccaatcacaatggtgaaggggttaacaacttcgacgtcgacagcggcacgatggtgatgagaacaggatggcaatggctgcaccacgatgacaagagcaagaaaggtttaaggattttggcacgagagctcgagtgttttagacacatgagagctagagtgtttcactcgatccctaaaaccgtcattaatgcgtccacttatttacaaaaatggcattggcaattttttaaagatgattttggtagaatcatcgttgctccaacgtcgtaa

SEQ ID NO: 112870 - DNA, 192 bp, Glycine max
  Peptide Sequence Number=SeqID_229648
gtgcactcgtgcaagttcagcgagggagatcttgtcttaaagaaagtgtcacaggctcaaaaggactacagagggaagtgggcttcgaattatgaaggacctttcgttgtgaagaaggcgtttttgggaggagcgttattgcttgcaagcatggattatgaagaattgccctcacctatgaactccgatatc

SEQ ID NO: 112871 - DNA, 249 bp, Glycine max
  Peptide Sequence Number=SeqID_229649
atggatgacaccgttttgtccatactcacgttcgatcagaagttgtcgtccactaagtggtggtttgtccgtgtggaccgagttgatggctggcgatgttcacattcttcgagacattgcgttctcgacaaaggtgttgagtggcaagaggagcagacacgtgacgtgctggagatgtggtggtggagcatctacggcttgctggaggtgaaggccttgcagatgaagggttggaagggaaagagataa

SEQ ID NO: 112872 - DNA, 177 bp, Glycine max
  Peptide Sequence Number=SeqID_229650
atgtcggagaagattatagagattcaatcctacatcgagagggaagcgaacaaggtccctctgtaccccttttacttcaaaacaccaaagcttgaattttttcccaagtggcgatctgttcaccattggacatgtaaaggaaattatgatgctcataaggtgtttgataaaagctga

SEQ ID NO: 112873 - DNA, 679 bp, Glycine max
  Peptide Sequence Number=SeqID_229651
gtcgactctagaggatcccacgcgatgcgggatgaaccggaagctgggttacggtgcccaactgcgcgctaacctagaccccacaaagggtgttggtcgattaagacagcaggacggtggtcatggaagtcgaaatccgctaaggaggcgcggcggtcgctgcaaaacccagggcgcgagcccgggcggagcggtcgtcggtgcagatcttggtgggacgggggaagcccgtctgatagcgctctgtgcgcgtactccgaaagggaatcggcctgcccaccctggaaacggctcagccggaggtagggtccagcggctggaagagcaccgcacgtcgcgtgcctctggtcgatggaacaatgtaggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactgtgctctgaatgtcaaagtgaagaaattcaaccaagcgcgggtaaacggcgggagtaactatgactctcttaaggtagccaaatgcctcgtcatctaa

SEQ ID NO: 112874 - DNA, 177 bp, Glycine max
  Peptide Sequence Number=SeqID_229652
atggatgcttgcgaagcggtcacagaaaggttggagcgtgtactcaacctaaagatggtcactgcaggcacaaagttacatgacatcatggaagactgtttgaggatcactaggggtgtcacctcatatggaaatgtgtatgttagggcacaacgaagacaacgcatggatcagtga

SEQ ID NO: 112875 - DNA, 186 bp, Glycine max
  Peptide Sequence Number=SeqID_229653
atgttgtacatggaatgtgatccaattccaaaagctgttgagaatgaggatgatttagatgatgtacctgttgctggccatgaggaagatgttggtgctggtgagcatgttggtgctggagagcaaagagatgctggtgagcagagggatgctggtgagcagagggatgctgatgctggtgagtag

SEQ ID NO: 112876 - DNA, 396 bp, Glycine max
  Peptide Sequence Number=SeqID_229654
atgccttcgctttgctcaaagaaaagctcaccaagcttagtccaagaggtgatgaaccttttcaggtcttggagaggatcaataacaatgcctataggtggagataatactgaggaggaggaactaacagatttgaggtcaaatcctcttcaaggaagctttcttcctctagcttcccaaggaagcttcccatgtgctaggcactttcttggtggtgaagcttctctttccatggcttattctctagtggatggaacctcctctcacctcttctcctttatcttccattgcaactctatggctgaaaatcaccatcgaaggaccttattgaagctcaaagatccagcctccatagaagcttctcaagcaagcttccattattgttgtttttgttaa

SEQ ID NO: 112877 - DNA, 285 bp, Glycine max
  Peptide Sequence Number=SeqID_229655
atgacggcttacagcggtcaccagtggtcttgggtggtggaaaatgaggttttagggttagggtggcattttggagaagaggagagtgaaaaatcattgcacctctgggtgctcagcgcaattccctctctggttggaattgcacttagtgcgccattctcactttgtgagagaccaaaagttcttactttcaaaatcacaacggtcaaattgtgggaacatgtcttaggaggctcccaacaaaatttgaggaggatccaacggttaaagaatccgggattttga

SEQ ID NO: 112878 - DNA, 237 bp, Glycine max
  Peptide Sequence Number=SeqID_229656
atgaagaataagaaggttgcagtagctagtgtctcgctcaacgaggtatatgcgcttagcgagcaacatccactaagcaaggcattggctcgtttagcgagtgaggagaatctggtagaaaatctaccacgtatgcatgcgctcagcgcgccatcagctcgcccagagagtcatttgtctcttctggcacccagcgcgcttgactcgctcagccaaaaatcactaactcgcacttag

SEQ ID NO: 112879 - DNA, 254 bp, Glycine max
  Peptide Sequence Number=SeqID_229657
gagcttccatgggttagcaagcttctagagaagggtgaaagacaagaacatgccttcgctttgctcaaagaaaagctcaccaagcttagtccaagaggtgatgaaccttttcaggtcttggagaggatcaataacaatgcctataggtttgaccttccagaagagtatggagtcagcaccacttttaacatttatgatttaattccttttgcaggtggagataatactgaggaggaggaactaacagatttgag

SEQ ID NO: 112880 - DNA, 444 bp, Glycine max
  Peptide Sequence Number=SeqID_229658
atggctcctcctgtgctggtgcaggctcgtcctaaggtgaggagggagcatcctgggctagctgaggggtgtcctgagctgctgtgggccatggatcccaagcataagccatgttggaggctctgcaacatcgtcactagaacgtctgagctctgcatggaggtgtcagagggtgctgggactgatgctgatggtggtggagctggagcagaaggagctaaaggtgtagaagaagaaggagtagtaggaggagcctcaagtcctcgagcctgtgccttgcaggtccctggaaaagtgatcatgggatcatccaggttccaacaattcttctttatgtatgccaagtgtcgcaacctacccttcggcgggagggcgacgcgtgactcgcgggatgcgtgttccacgaaaggaatacgcgcggagtcgccaccaacgtttatttga

SEQ ID NO: 112881 - DNA, 432 bp, Glycine max
  Peptide Sequence Number=SeqID_229659
atgagtctagaagaagctcaccaccacaggaggccatggataagagcttggaggaagaaggagatgaatgaagggagaggaagagaagagcacgaaggacatgcacaaacccatggtcccgaaatctaccctaaggctcatgagaaccctagggccttctcttgcatctccggtccaatcttcttggaatcttctatccaatgtccttgcggggtaggattgaatcaagaaaggtccaagtttgatcctataggatattgtgataatgatgtagttggtgataaggtagaaaggaagaacacaattggtgcctctcaattccttggaaaaccattggtatcttggacatccaagaagcaaagtataattgtcttatcaacctcaaaagctaagtatgtcttagcaacttcttgttgttctcaaatcttatag

SEQ ID NO: 112882 - DNA, 176 bp, Glycine max
  Peptide Sequence Number=SeqID_229660
atggttggagcattttcgcaaaacactgtgaccctgactggtctccctatgatattacctagtgagagtgacttgacttactattgtgtgatgaataggtggatgactatgaagaacctcatgctagaggacacgggaacaccacgctctgataggagtgtgacattaggatatag

SEQ ID NO: 112883 - DNA, 339 bp, Glycine max
  Peptide Sequence Number=SeqID_229661
atggatgatgttggagatgatattaatgttgactatatgtttgaggagttggacaatatggatgatttagatcgggatgacaacataaagcctaaaaaattgttaagtatattgactcaatttaaggaggctattatggaaaatacggtgttaaatgctaaagagggaacttgccaatcattgcaaggcatggtggaaattagtgaacacagattctgccttacacatttgtacaacaactttagaaagcgattcggaggcggcataatgataaggggcctaatgatgggtgcattagaagcaacttaccactcagcatgggaggcgaagatgctctaa

SEQ ID NO: 112884 - DNA, 1257 bp, Glycine max
  Peptide Sequence Number=SeqID_229662
atgggggagggatgttgtacacagccttacccttgcatatgcaaagaggctgtttccggattcgaacccatgattaacaagtcaccaaggcacaactttaccgctgcaccagggctcgccctcaaaaacttcgtaccccattgcccagaggctcttcgctatgcgaagtattcgtttccttgtgtgtccactgagacaacacaaaaccttataaggctcagggttgtggaaagtgttgggaaggatgtaactgaagttacaaaaggtgatgtggtaattccagttatcctaccagaatgtggggagtgcatagattgcaaatcaaccaagagcaaccggtgcactaattttcctttcaaggtgtctccttggatgcctcgagatggcaccacaagattcactggccaaaatggagagatcatataccatttcttgtttatttcaagtttcagtgagtacactgtggtggacattgctaatctgataaagattgatccagaaattcctcctgacagagcatgccttctcggatgtggtgtttcaacaggcaatttcttaacaagggtaggtgctgcttggagaactgcaggtgtggaacccgggtcaacagtagctatttttgggttgggatctattggattagctgttgcagagggagctagactttgtggagcaactaggattataggtgtggacatcaacccagaaaagtttgaaattggaaagaagtttggagtcacagactttgtcaatgctggagaatgtgggggcaaacctgttggccaggttatcatagagataactgatgggggagcggattattgctttgaatgtgttggtatggcatcattggtgcatgaagcatatgcttcttgtagaaaggatgaaaatatctatcttgtatgcgctcgaggtcctcgacgaagactagttacagctttcggcggaagttacttcataccatatcaataccatggttggggaaaaacaattgttttaggagtggacaagcccggagctaggataaacctcagttcttacgaggtccttcatgatggaaagagcctcatgggatccttatttggaggtctcaaacccaagtctcatgtacccattctccttaaacgttacatggacaaggaattgcagttggataaatttgtcactcatgaggtggagtttaaggacatcaataaagcttttgatttattgagtaaaggagagtgtcttcgatgtgtgatttggatggataaatga

SEQ ID NO: 112885 - DNA, 354 bp, Glycine max
  Peptide Sequence Number=SeqID_229663
atgacaaaaaaaggatgtgcttataattttgcaaggagtaggtacccagatgaaatattaagcacaaaaatcataggtgaaaggcaattcaaaactgttgtggaactgtttgagtctacttcagaggaactgtcagggaagattgactacaaccatattaatccattctggaagaatgtgagggattttctgaaagaaccaagtcaacatcaagagcactgccaaaaaccaaagccagttctgttgagcaccggtgaaatgttttttccttatccttgggcgccagcaattcttccaatccaaatcataagattgggaaagtttatcattctttccgtaccaggaggtttgtaa

SEQ ID NO: 112886 - DNA, 273 bp, Glycine max
  Peptide Sequence Number=SeqID_229664
atggaaggaaaaacatcatacatagcgggtccaccacaaatttttggtggtgaggagtacaaattatgggctgcaaggatgaccactcatcttaaagtgtttgatctttgggaggcagtagaagaaaattatgatgtccaagaactacctttaaatccaacgatcaatgacaacgggtggaaaaggaggaaaggtgattggagacgccacttcaaggagaagatgagtcaagaacaagctcactaccataggaggccatggataagagcttga

SEQ ID NO: 112887 - DNA, 524 bp, Glycine max
  Peptide Sequence Number=SeqID_229665
atggagaagagggtattgcccgaggcatcaagcaagagtttcttctcattgggaatggaatggcaaggccacgttttggaagcaacaacagcaaacccatggaggaaaggtggcactcaaggaagttctgcgcatgaaggccaagccataattgagggattttctagccacattccttgtcttatcccatgcctccaccttactaaagaatcgtcctcctcctcttcctccactgctcatagccgtgacaagggagttcttgaaggcaagaaccaaagcgggagaagttggagtgagaagttggggaacacgtcatgcgtgatgacgatgacaaggtgcgagttctgcaccagtgagttcaatgtcaaatttttccaaggtgttgctcttgaggaggatgacaataaggctgaggctctcgattcgaggatgtgttcgacgaggatgccaccaaagccatcatatatgctatcaaagtcactagatctaaccttctctttcagctttgtacctccattgttgat

SEQ ID NO: 112888 - DNA, 378 bp, Glycine max
  Peptide Sequence Number=SeqID_229666
atggatatcgaaaattctcactatgcactctgcataatctttttgtttccatctgtgattgaacttggtatggatacatgggttattgactctccacaccaaagaacatttaatcatcaaattgacttaatgttgttcagaacatggattatgttgaaaagaattattgagaattgttccttacatgatatattaaaggttgagaaattccatgcagtatacagtcaaagatctactcaagcaaattataaaagcataggtagacaccaaatatttcatatcatattggaaaccatggcatttaaaagaatgttaaaaggatactgttttagtatgtaccagacactgatgaaagaaaaggttattgcaagatcctaa

SEQ ID NO: 112889 - DNA, 333 bp, Glycine max
  Peptide Sequence Number=SeqID_229667
atgtgtctatcggggaaggagagtatgctgatgaaatttctcataaccgtaaatgagattttggatgttagcatttcgtttctaaacgaccatttagaggaaacactgggtccaacaaagataggaaaaaatcactcaaagtgtatcaatctcacacagaacggctggtcacgatatatgtcagggtttggccagcggttcacggataaaggggacgtcccacattatttccatgatacacatgcaacgaagatgcttaagaaattttatgcaaaactggtcatgcatgcacccatgtggacactcaagcatcaagtttttatggtcatgtga

SEQ ID NO: 112890 - DNA, 278 bp, Glycine max
  Peptide Sequence Number=SeqID_229668
agcttccgttgtacaattttgagcgtctcgatatatcttgggcgtcaatcatacattggagtgaaaagttatgcccgtttgtatttgccgagtgtttctgtgttcaactttgtggctctctgatgcaagctccattggagcttgtaggcctaggatcttcttcatcaatggattcctttgcttcttggaagataaatggcagcggaatggagaaggaagagagagaggagacgccacttcaaggagaagatgagtctagaagaagctcacgaccatag

SEQ ID NO: 112891 - DNA, 240 bp, Glycine max
  Peptide Sequence Number=SeqID_229669
atgcaaaggataccaaaaagaaggggcaaaagggtctttttattgagtttcctggaccttagctcgcctaggctagcctctggctcgcctgggccatcaaaagacttcaatgttaagaaaccagttcgcttgggcgagctgcagctcacctgggcgggaagaggagttaaggaaggggttctaaggttcagacttgagggaattgagagaattaagagaaaagaagaagaaagaagatga

SEQ ID NO: 112892 - DNA, 633 bp, Glycine max
  Peptide Sequence Number=SeqID_229670
atgaagattggttgtttctttgttgtgttatttcttccttggtacttgactgttcagtttgtccgtttcttttggaagagggaatccaaccagaaggctaagattttgcggaaagtagattatcctctggagttggatgtttatgatttttgttctgacgaacttcgtaaaaaattggaagctcctagacagatcctaagaaatgaagaaggcaaaaagcttggtctgaaagtgaatgagaaaagctctgttcagaaggaaaatgatgtaaaaatgtctgatgctgagccattcattcctaaagctgccaaactgagaaataggaatggtcattttgttacaggagcaacaagtggaggaggggagccatctgtagttcccatggaggagggtgaaaaggaaacacagatgactggaatttatgatttggttgctgtattaacccacaagggtagaagtgctgattcaggacattatgttggttgggtcaagcaagaaaatgggaaatggatagagtttgatgatgacaatcccaaaccaaaactagaagaagacatcactagactatctggaggaggtgattggcacatggcgtatataatcatgtacaaggctcgtgttgtatctgtgtaa

SEQ ID NO: 112893 - DNA, 1080 bp, Glycine max
  Peptide Sequence Number=SeqID_229671
atgggagcataccgaaatcttaaagaagctgcaagaaagcatggaaaagttgcagcagcagcagcatcatcaaatgagccaccaccaccaccaccaccaggagaaaggttattgcgttgcaagtgttgcaatgccgagttcgattgtagcaacgccttgcgtgaacatgagaaattcctcgaggaagaaatggaagaagaatgcagaaattcttcaacattacctcagaatgaaagcatacagaggcaacttggccaagaaaccagcaattcttcaatattgtctcaggcggcacagaatattatcatgcatcagttccaaagtttaatggctcaagggatcagtggatcatctcatcaacctttggtttcttgttctgcagtgccagttacagtacaaggacttccaagttcaagctcacagcctaatgggaattttggccaagaaagcagttcttcaagaagacctcagaatgaaagcttagagaggcctcatttcaatgtcaatgagaggcaatttggccaagaaagaagcaattcttcaatattacctcagactcagaatattgacatgcatcctcagttccaaagtttaatggctcaagggagtactggaccatctcatcaacctttggtttcttcaataagacctcagattgcaagcatagggagtgcagcatctcatcaacaccacagctcatatcaacctttggtttcttcttcagttacatcaagttcaaggtcacatcctagtttatgttatgagggtagttctggccaggaaagcaattctttagtaaggcctcagaatgcaagcatagagaggaggagtgataagaggaaatttggccaagaaagcaccagttcttcaatcagagagaggagccctgctgattcgaatgtcaagcgactcaagccttcatgtgatgagaggaaatttgaccaatcaagcagttcttcagtaatagtacctcagaatacaatcactgaggtagaggggcctcaacaaatcagttcttcttcaacacctgtgaatggagctcaagaggaagagaagtttgatttgaatctcaagccttga

SEQ ID NO: 112894 - DNA, 360 bp, Glycine max
  Peptide Sequence Number=SeqID_229672
atggtgattcaagctgttggaatggtttcaccgttcaaaaagcacttaatcctatggagagcatgctatggaggatcatacatacaccagaatgtcactgaagcagcatcctttagatatttaaggggatttggggatgatatggggaaatctaaagtaccgcctttgaagttgtatcttgtttgtatcttatcaatggagaacctgacaactgacaccttgtttctttgctcttatgttccgtcctgtataagggatgttccgttggtatataattttgagtcaatatatggcttgccaagaatcaagatccctccaaagattgtacgaatttctatcttaatgtgctgccataactaa

SEQ ID NO: 112895 - DNA, 729 bp, Glycine max
  Peptide Sequence Number=SeqID_229673
atggaaagcaatgttgaagcagaaagcaatcatggaaaagtttctgcttctgcatcaacatcaaataagtcaccaccaatgaagaatgatttaatttgcaagtattgtaacaagaagttcagcaattaccaagccttgggtgggcatcagaatgcacacaaggaagagagagcagcagcacaaaaagagaagattcttaacatggcttctgcttataacaaaaattcatatgttggtgggtttgttaattcaaatcaatcttatggatttggtggcaaaacattaggggtgtcacctctatccatgacccgttttaagccccattattatagtaattggcctcatatgtcacacgttgcatggccaaggcaccagattttgaatagtgttcaacccaccattcatcagttgcaaactttgatgatggctgatcaagggagcggattttatcagcaccacaaatcatatcaacctttggcttttcctatacttagagaaggagcagtaataaattcagggtcacaatcacagttattattaaatcctagtttatgttataaggggaataattttggtcaagcaagcaattcttcaataatacctcagaataaaatcatagagggttctgatgatttgaatatcaagatttctggtgaagcaaaaaacagtttttcttcaatgccttccaatggagacgtgaaggagcttgatttgactctcaaaatttga

SEQ ID NO: 112896 - DNA, 585 bp, Glycine max
  Peptide Sequence Number=SeqID_229674
atggaaatcaatcatggaaaagttgttattgctgctgcatcaaataagtcagcatcattaatgaaggaagttttttgcaagtattgcaataagaagttcagtagttatcaagccttgggtgggcatcataattctcacaaggctgaaagagagcagaaaaacaaaacaaaattcttagcaaggcttctgcttattataaaaaatcatctgttaattcaaatcatgcttatgcttatgggaccaaattcagggtcacaaccacagccaaatcatatccacacttttatgactgatgggagtgcatctcatcaacaatacaaatcacatcaacctttgatttcttgtaccgttggagaaggaccaacaaattcagggtcaaagccacattcatcacatcctagtttatgtgataaaggcaattttgggcaagcaaccgattcttcaatgatacatcagaaggcaatcatagaagggtctgatttgaatgtcaagacttcatgtgatcatgagaattctgctccggaaaatagttcttcttcagtgaatggagcagtggagaatcttgatttgattctcaagctttga

SEQ ID NO: 112897 - DNA, 879 bp, Glycine max
  Peptide Sequence Number=SeqID_229675
atgcaggatgatgctgattggtcaacagtaggggtgaaagagggtcaaaagctaatgatgatgggtacagctgatgaagttgtaaagactcctgagaagggaactgtttttgttgaagatcttcctgaagaagaacaagtagttgctgtttcatttatagaacacagaaacagtgctataaaaactgggttgggccgtgtagttgaaccggaaaccagtgccagtccagcacatgaccagatcggttatgcatttgacctggggcatactgctggtcttttcaacttgggaaacacatgttatatgaattcaacattgcaatgcctccattctgtgcctgagttaaagtcagctttgactaattattcacattcaggacgaaacaatgatgttgatcaatcttctcatctgttgaccattgcaacccgtgacttgttcagcgagcttgataaaagtgtcaagcctgtggcgccaatgcaattttggatggtattgcggaaaaaatatcctcaatttggccagctgcataatggagtgttcatgcaacaggatgctgaagaatgttggacacaacttttatacacactctctcagtccctcagatcccctggatctagtgaaaatcccgatgctgtgaaggccctctttggcatagaacttattagcaggattcattgtcaagagagtaaggaagaaagctcagaagcagagtctgtttattcacttaaatgccacatatcgcaggaggtgaaccatttgcatgaagggataaaacatgggttaaaatccgagttagaaaaggcttcacttgtattgggccgtagtgctatacacttgaaggaatcacgcattaatgccctaccaagttggagtttttga

SEQ ID NO: 112898 - DNA, 693 bp, Glycine max
  Peptide Sequence Number=SeqID_229676
atggaatcccgtgcctccaattccaattctccataccattaccaccaccaccaccctcgtttcaaaccaagccaacctatttcagaccgaatagttcgtgccctccgccaccgcctgcgcctcctccaccgttctggctccaccttcttcatattaggcgccaccggaaacgtgtacacggtgaccttatcctcctcaccctcatgcacctgccctgaccgcacaaccccatgcaagcacattctattcgttttcattcgagttttgggcgtgtcactcgatgatgtctgtctgaggaggaggacccttcgtccctgccagctccaacgcctcctcggagcgcctacattgccggaggtggtggcggggggcaccctgaggcagaggtttcaccagctgttctttggtggagggtcaacagcagggccaaagatagagatggaggagggtgccacttgcccggtttgccttgaggaaatggggaaggagcaaaacctggtggcatgtggaacatgccgtaaccctatccatgaagagtgcttgataaagtggaagagaaccaagggaagaagtgctagttgtgtgatttgtagagcaaggtggagggatagggtggagcaagatgagtatctgaacctgtctgcttatgttggcgaagatgatatggaagaacctgatgtctgcacttgttaa

SEQ ID NO: 112899 - DNA, 291 bp, Glycine max
  Peptide Sequence Number=SeqID_229677
atggatggtcaacttggtattaatggagaggaatcacatgacaatgaatatgcaattggagaaaattctctggtgccctgcttacagaacaagtttcttgaattgcatccccctgattcttcttcaacgggtgggttagcacttgtaagcagtttcactccaagtccagtttgggattttcagggtcacactgttgtcaaggttgcatgtggaaatgaacatgttgtagctcggccgtggccaattaggcttgggggatcgagagagcagactgcatccggaagttgttag

SEQ ID NO: 112900 - DNA, 238 bp, Glycine max
  Peptide Sequence Number=SeqID_229678
ggatcagtttcagaaactaggcaacgatttagaacttgctaaaggcagggatatggatagatactatgacatcgtggagcagctgaaggaatcctatcgacgctgtggaccgcaacctgatatagcattggctgcaatgaggcacaagagattgaggaaaatatttgttgttcttcatacggaattggagaatctcaagcgaaggatcaaagactttgcaaactcgtataataaatga

SEQ ID NO: 112901 - DNA, 669 bp, Glycine max
  Peptide Sequence Number=SeqID_229679
atggagaagggtcttggcttatgccctgatgcgagtcgtgctggaacagattctggtgatgccctctctccccgtctcatgtcatgcaagccacaacagcctaaatttccagatccagttaaagttgcatgtggggctgcacatactgttattgttgcgcgagagggatatagaatgtggtcttggggtaggggaaggagtggagctcttggagatggtaaagggttagattgttacactcccatggtcatgctatggccttctacgatggaggattttgaggaagaggaagtaaaaagctccggtgagcaagataaggctagagaaaaggatactgaagtggcaacagaaacagaagagaaattatcctcagcattgaatgagctgaggctacttcaaacaaagctatctataatggaaaaatatgctagtatacttcatggttctgtttttggaaaaccttttgatgaacaagatatccctgtttcgttgcgcaattcaggttcatttgacattgcaaaagaatgggaggcagcggatcaaaggaagctaagtaggttggaaatgttttgccgtcacatgcttactggagtgaaagatgaactaatgaagagaaggatcaaggaaattgtaaaagagtgtctccaatcttcagaggtgaaaaaatag

SEQ ID NO: 112902 - DNA, 825 bp, Glycine max
  Peptide Sequence Number=SeqID_229680
atggagggtgggatgtggagacaaaatcagattttgggaggacaaatggactgttggggacagaccactaatgaaaaaatttcctactctgtaccaaatttccaatcaacaacagcaaactatcagcctcatggaagtcacaaagatgaagctacaacggctgcagaatttctagaggaaatcggattgtcaacaatacaacagcatgaagcagactcatggacttggaaggcagatccgagtggaaactattcaacaaaaactgcgtacgagctactgcaggaggcaataaggggggacaatgaggatggaatttttgtgcaattgtggaaacttaagataccgcctaaggcaccggtgtttacatggagactcatcaacgatcgattaccaacgaaggtgaatttgagaaggagacaagtggagataagtgattcgttgtgcccattgtgcaacaactcggaggaggatgcagcacacctattcttcaactgcaacaagaccctccccttttggtgggagtcactgtcatgggtgaaaacagtgggtgctttcccaaaagaccagagggaacatttcctgcaacacaacagtgggaacgctgctgggactaaagctacaagatggaggtgttggtggatagcccttacacggaccatatggcaacatagaaataagctggtgtttgaaaaccaaacattcagtgcaagcaaagtgatggatgatgcacttctcctaatctggtcatggcttacagttatggagaaagattttgaattacattttaatcactggtcttctaatttgaaagatgcttttgggtaa

SEQ ID NO: 112903 - DNA, 1395 bp, Glycine max
  Peptide Sequence Number=SeqID_229681
atgaggccacaggctccaacggaactggaaacagcaaaccacaataacgaaggacaaaatatcccaatggactcaggcccaagggagctcaagacacacccagaaaaaagaaagacatcacaaagcaggattcaatgtaacacccacatacgcgatgaggccatagctcaatgggaagtggctaaagacctggggatgacatccgggaaagagcaatcagaaatcattgacaaaatcacatcaatggagatcagaggcaggaaggaagcagaagagaccaagcgagaacagatagacaaggctatatgtcaagctttgtggggggacactgacttgagctggaaatacagccggcaacaaatacagctggcggactgctgtgtatatggaatgagaaggtatttaaagtggagaggagggtcactgctagcactatgggaatctatcaggcagcttaagaatcttcaacctggtggattttggtgtatcttgagagacattaacagcattaggcatccatccgagagagtgtgcacgactcagagggagggggatctcaatagcatcttagagtttaatgattggctatcagacttagcagtagaagaagcatctaaatggccagacagcacacaattcattttggacagagatttttcggaccattgtcccatcctgcttagagccaaaaccgtcaattggggacccaaaccttttagggttcttgattgctggttgaaggacaagacattccaaaatttagtcaaggaaacctggacaaacacacaaccaaggggttgggggggctactcgctgaaagaaaagatcaagacactcaagcaaaggatgaagcattggaacaaagagcactttggagacacgtttaacagggtacaacagattcagaacgagctaaataacctggaaacaggcagcaatgacagacaaatgtcaccccaagaattggcagcccgtaagaagctacaggaggacttgtggacagctacacaagcacatgagtccttgctgagacaaaaggcaagaacaaaatggatcaaggagggggattgcaattcaagatactttcacaagctcatgaactataactgtaggaataatgcagtcaaaggtgtgctgattgaagggtcacgggttgaggaaccaaccagagtgaaagaggaagtctgcaacttcttccagatcagattcagcgaacccgattatggcagaccaaaaattaatgggaccagatttcgaggtatcggacagcagcaaaatgaatggttggtgggacgtttccaggaggatgaaataaagtcagctgtatgggattgtgggagtgagaaaagcccaggacctgacggtttaaatttcaaattcatcaagcacttttag

SEQ ID NO: 112904 - DNA, 1146 bp, Glycine max
  Peptide Sequence Number=SeqID_229682
atgtttgaaagagttgaagatgaaatcttttggaccttagggtcagatgtgatgcccaagtacttaggagatgacatggtcatcctactgggcctgtcggacatgaaagcagaagtgatgatcaaggaagaaatcgacaagggctcatctctattttactccctagagaaatggaagccgaagatgagaccggaaaataggctggtatggattcattgttggggcataccattagctgcatgggaaatcgggtacattcgaaagattgtggcagcaatgggcgatttggtggatgtcgatgatgatgtagaagaaatgcggagactcgatagggctagggttcttatcagaaccccatggaaactggtaattcatcactcagtagcagtacatattggagacgagacccacacagtgtacttggtggaagagaatgcgaacaaagaaggaatgtacgtgcgccatcgccggagcacaatcgggtcatctgaagaaattttgtctgatgacagcgaccccgatacaccattctcaagattgagcgtcctctcgccggggataatcgccgacgaacacactggcggtcactcagtccgctggatcgagaaggtacccaatgacggtcaagggagcgaagatccaacggttaaagaccagggcagcagggcacactactcaattactgagttgtgcatgccagacagagtacggcgcaaccaattagagagcgcagctgagcctaggccggaagtatctgtaggttacgacaaaatgaaaatgagtaacgatcaaaaaactaacaagctcgaaaccgagaagaaacttgttgtcaaaaagtcaaaggggagcatggagagtaaagtggaggaacagacaaaggacatagcccagggccaaaaggaggtaggcatcaaatgcctcaacaggaaacagcaacacccgctcaaacttaaacttcctcttgacccaaatgtggaacctgctggacccaataacaaaatgggccttgctaacaacgcacccgtagaagactcacaaggcccttgcactgagtatacgggcctcactagcaacacacatggacaaaagtcacaagacctttgcactaactatcaccagcacctagtggaaaacggaagcgcttag

SEQ ID NO: 112905 - DNA, 300 bp, Glycine max
  Peptide Sequence Number=SeqID_229683
atgaagaagaaaaatgttacgacgaaaccaaaaccaaaaccaaaaccagacctgcggtttggaatcggaagaagacgaagcagaggaattatggaggcggttgtcggtggagcggtcgaggtggagaacggatttgacggcggaatgacggagcggcgacgacaagggaaacgccgtgagtctgcgagtgcggcgcttgggtttgcggcggagaggtgcgaggtcgaggagcacgtgagcgttgtggagggaagggaatggctcggcgaggcgcagcacgtgcgaaacggaagacactga

SEQ ID NO: 112906 - DNA, 525 bp, Glycine max
  Peptide Sequence Number=SeqID_229684
atgtgggaagaaggcaccagtgcagctgccagggtttctgtggcccgatgcacaagattctcaccattgtggggcctgagttattttagagcattgtttctcaaatgctttgctaatcagctgttcaatattgtggcatgtaatctacatgtaacattccagtcacttgttgcccaggttgcaaacttggaggacataatatcagaaagaggagcctgtggggttggattcattgccaatttggagaataaggaatcacatgagattgtcaaggatgctttaaatgctttaagttgtatggaacatcgtggtggctgtggagcagataatgactctggtgatggttcagggctgatgaccggagttccgtgggaactatttgacaattgggccaacacgcaagggattgcttcctttgataagttgcacactggtgttggaatggttttcttacccaaagaggcacaacttctcaatgaggcgaagaaaggtaatagtgttcttgttttgaatgttgaggattag

SEQ ID NO: 112907 - DNA, 297 bp, Glycine max
  Peptide Sequence Number=SeqID_229685
atgcacttgataaggacgaatgatggaagcattgatattgttgtcactaacttgtcggtgaggaataaagagcatgatgaaggagaaaataagacaaagaggcacaatgatgtgacttatgaggaggatgcacaatgctttgactttatcaaggggaggatcacaatatccaatctcgcccccgtcctagattttctcaagcaggaaaaatttgaatttgatcccaaccccaatcataatcaacccgattgtttccaatcaaactcaggacgagtgcagattaatccctatggatga

SEQ ID NO: 112908 - DNA, 549 bp, Glycine max
  Peptide Sequence Number=SeqID_229686
ggaagctttacagggccaaggatattttggtctggctccagtcttcgacctgaagctactggctatgggctggttttctttgcccagctcatgcttgctgacatgaataaagaacttaaaggattaagatgtgctgtgagtggttctggaaagattgcaatgcatgtcttagagaagctaattgcttatggtgctcttcccatttcagtatcagagactattcaaagacctatgctcggtccaaatattatgatgaagcaaaaccatggagtgaaaggttgtcgtatactagtagaaggttcaaacatgccttgtacccctgaggcagttcagattcttaggaaagctagtgttctcattgctcctgcaatggctgccggtgctggaggggttgtggctggagaacttgaactgaatcatgaatgcagtttgatgcactggtcaccggaggactttgaatctaaattgcaggaagctatgaagcagacttatcagagggctatgaaagctgcaactgactttggttatcaaaaagaaagtcctgagtaa

SEQ ID NO: 112909 - DNA, 258 bp, Glycine max
  Peptide Sequence Number=SeqID_229687
atgcctccaaagtcgttaggaccaaaaagtgtgcttgacttctatcatggaagggagagtaaacgaggcaaggtgcaacaactaatcgagtcccaaaaagaaagaaagtctttattacatatggccctatccagtcgtaggacaatagaaaattgcccttttcttccgtttaaccaagtggaaaaagctccacttgtaggaatatgcgtcaaggagcaggaatctatccacactctaaattcattgcaagaactttaa

SEQ ID NO: 112910 - DNA, 217 bp, Glycine max
  Peptide Sequence Number=SeqID_229688
atggatccgaggttggagattggattttcataccgaatgatcaaaaggttatgctatatccgttacgaagacaccgttggtggcagtcacaagtggcgtgaaaaggcagcgagatattgtgataacggatttagggaacgtgtgaagcttataattgcaggagaacgacgcaagaagagggaagctggtggtctaaatgctgttgacattgatggag

SEQ ID NO: 112911 - DNA, 1260 bp, Glycine max
  Peptide Sequence Number=SeqID_229689
atgagttccattgatgcagggtggccccctttcaatggaacacggggcacacgccggctcggtgagctcgatcttgcattccttacttcctactccattggcatgtatttggctggccatgttggagataggattgatttgaggttgttccttgtatttgggatgatgggtagtggcctttttactgtactttttgggttagggtattggttggatgttcatgtgttggggttttatgttggtgttcagattttttgtggagtgtttcagtcaattgggtggccttgtgtggttgcaattgtggggaattggctaggggaatcaaagaggggattgataatgggggtatggaactcgcatacctcagttgggaatatcattggttcggttgtggcttcgggggttttggagtttggctggggttggtcatttgtggtgcctggaatcctgatcattttggtagggattttggtgtttttgtttcttgttgtgaaccctgaggatatgggatttgtgcatcctgggatggacatcgaaatgagtgttgaaacggatagtgcagagaatcggcagaaagttgaatcggaggaagcaaagctgattgcgtctgaaatttcagattcttcatctgcaattggatttttggaagcatggaagttgccaggagtggctccgtttgctttctgtctctttttctcgaagctcgtggcttacacttttctgtattggttgcccttctacataaggcacacaggtgtgcatatgtctcacaaaactgctgggttactttcaaccatatttgacattgggggagtcctaggtggaatcacagctggtttcatttctgacctaatagaagcacgggctattacttcaattctgttcttgtttctatcaattccagctcttgctttgtatcgcatttttgggagcctctccatgttgatcaacatcattttaatgtttctgtcgggatttttggtgaatggtccatactcacttatcacaactgctgtggctgctgatcttggtacacaaagcatgaatgatcggaattctcgggcgctggctactgttactgcaatcatagacggcactggttctgttggagctgcccttggtccccttttggcaggatatatttcaactaggggatggaacagtgtcttttttatgctcattctgtctattttctttgctggtttattcctgattcgtatagcaagaactgagataagagagaagctttcaggaaagtga

SEQ ID NO: 112912 - DNA, 294 bp, Glycine max
  Peptide Sequence Number=SeqID_229690
atgtatggcaggaggaagacaggaaaaaagagagtaggggtgggaagattgctaatgccagagtctgtgctcacagctcctaaggaaaagaagctcagtggtagacagtggtttgaaagtggaagagtgaaaggtgtggctgctgtcgctgaggaatctgatgtggaggatgaggaagatattgactttgatgaagatgattttgaagcagatgatgaagaagaggatatgcttgagcattatctggccgaaaaatcagatttatccacacattcttctatgagggctagttaa

SEQ ID NO: 112913 - DNA, 263 bp, Glycine max
  Peptide Sequence Number=SeqID_229691
gtattgttaggcaccaaatccctaaaataggtggtgtgatgaatgctttgggtggtgcaacactcttttgtaaaatcactcgtgcacccaacatcttcatgatttgtgtacatagggactcattaggtaggaataatcaacatgaaaatacagaaaaaggggttcccatgaaccctaagagaataaaggtcattcctgagtggcccgcaccaccaagtgtgttgaggaaaaaagcccagagtttcaagaacctcgggatttga

SEQ ID NO: 112914 - DNA, 117 bp, Glycine max
  Peptide Sequence Number=SeqID_229692
atggcaactgtagattcttgtgagtgtagtttccttgcaatggctttggtacatggagcagtcatctctgcctttctaaccattgctcaagccatgactgatcaaggctctatatag

SEQ ID NO: 112915 - DNA, 441 bp, Glycine max
  Peptide Sequence Number=SeqID_229693
atggattatagtttgctattgggcatttatttcaaagatatatcgccagatggggaaattattcctttacaatctcatactcctactggtgattcggaaaatgaaggaactccccatacttcaagtgaagatacagatcaatctcattatgatccttccagtatcatattgggtatgaatatgccagcaaaggttgaaagaacaataagaagaagcggttgcgaattacagcttgtaggagaaccaattggagagttctataatggtgtgttgacttttggtatcattgacatacttcaagactatgacattagcaagaagcttgagcatgcctacaaatccattcaatatgatccgacctcaatatcagcggttgatcctatacaatattcaaggcgttttcgtgatttcatatttagaatattcactgaagactcttga

SEQ ID NO: 112916 - DNA, 382 bp, Glycine max
  Peptide Sequence Number=SeqID_229694
cacgtgaagatgagtgttgcggaagcggagccatttggcggtgtcgatagtggcatagaagggaaggaaggggacgcttggggcttcctgttatcggggaggtggacggcagcaatggtaagtggagccggtaaaggtacggggttttacgacatgagtgtggggcgtggcggcggagttggcatggtcgtgggtgcggaagaagatggaggtggaatcggcataggcggcggtggtgactgcacggaggaaggaggcgacaacgagtttaaccaagacggcctcaaggcggtcctcagtagcaggagaaaattcaaggtggtttggcgggtgttgtgggtggtagtggaaggtggtttggcagccatggaagcttcgtttg

SEQ ID NO: 112917 - DNA, 204 bp, Glycine max
  Peptide Sequence Number=SeqID_229695
atgagaagaagaccaggaattggagggttggagacgcacactgctgcaagagatcaattccgtttgctgggtcaaaatgtcgcaaagatcaaaactaatttgatgaaggagcagcttggcacctttcactctcaactcgaagatttctctcgcaaacatagctcgaagaaagttagagcgagaaagcaagagaaaggctgcttt

SEQ ID NO: 112918 - DNA, 2298 bp, Glycine max
  Peptide Sequence Number=SeqID_229696
atgggtagctccggggagtcgaacctgaacgtaatcgatgcgtcggtgggtgggttggtttgggtccgacggagaaacgggtcgtggtggccgggtcggataatgggtcttcacgaattatcggagagttgcttggtttctccgagatcgggtactcccgtcaagctcttaggtcgtgaagatgcaagcgtggattggtataatcttgaaaaatcaaagcgggtaaaagcttttcgctgtggagagtatgatgaatgcattgagaaggcgaaggcatctgctgctaattcaagcaagaaggcagtgaagtatgctcgcagggaagatgctattcttcatgctcttgagctagagagtgctcacctggacaaggaatcattaagcttatgctccagattagataaacctggtagtgaacatggaggatcagctggcgaattaccactcatgtctaattctggtgaagacaatgaagatgtggtggatgatctgagtgactctgatgacaattctaatgcagctccagaattgtcacaatctggtatatcttttgaagagcctaatcactatggtactttaaagatgcaatctgtgcaaggaaggaggagaagaacacctaatgattcagaagatgatggatttgaaggagtcaagcgaatgagaggacttgaggacctaggcattggtgtagtgtcaaagagacaggtccaaggtacaagtgcaactgagatagttcatcacattagtgcttcactcaacaattcaactgcagggaactgtctggcaaatggaacttctgtaaatggtggtaaaggttattcttcaacactgaaaaggaagagatcacaagtggcaaatgctcatgaattattgaaaaggaaaaatcgacgccggcccttgactaaggttttggagagtacagccatggtgtcagttcctgtcatttgtaatcagcttcccagttcaagcagttctccactgtgtggggtaactgatggaaggatttcaggattagattctaatggttcaaagaaaacttttccaactacaacacataattcagatagtactgaggctgcttgtgagaatgggacttcattaattgttcatgaccatggtagtgatgatgcttcccaaatcaatcacgaggtcaaggagaatgaaacttttggcataccggggctagttggcaaagattctcctgatgaactatttgatgtgccatttgttggggttctaggggaggagaaacacactacggatttctcacccatacaggtttcttgttcatctggcaagcctcaagttagtgcattgggagaacagtcttgtaatgctagtcaatgtgaagctgtgtccttgagaaatgagagcaagaatgaacctggttgtaccagttcagctgctggtcacattattgttggccatagagcagacaaaggtagttcaaagtggcagtcaaaaggaaagaggaattcaagacatacgagtaaaaatataaaacatgcctcaagaaaatatgtggacacagacccccaatccagtgcttatttgtcaggaatagggatctcggatggaatctatcagggtgcttgtcagaaagttgattggaatggcatgggtgcaccgaatacttcatacaaatgtacttctcaagttaagtgcaaacctgttgctgtgggccaactggaaggattccgggacttgaacaagcatatcaaggggacaacaacagaggcaaagctattgcctgatggatctctcacacctcagagattgcttccttatcgccattcacgcttcactgttaactccagatatcaaacggcagatttccctggaagaaattattattctgatgcttcattatatgacgttaagctagaagttaaatccagctaccggccacaacacgtccctttggtttctcttgtgagtaaactgaatggcaaagcctttattggacaccctttggcggttgaggtcttggttgaaggtcattgtgataaaatgttgagtgacattggatgtgacttggaagttggtgatgtctattgtgcagccaagccaaactcggtgaccagaagaatacattccaagaatttaacgcgattttcgcctagtaaatcctccaagatgaagaaaactgggctcttgaataaaaagattcggaaattgtcatcattgacaggtcacaagcagttagaagaggaaagaaaaccagtggtagataagctcaagggtcctgttatagcttgtattcccctcaaagtagtattcagtaggataaatgaagca

SEQ ID NO: 112919 - DNA, 918 bp, Glycine max
  Peptide Sequence Number=SeqID_229697
atgtcagtggatgggagggtgagtgttggcttggagaggccaagtgataggttgcaaatatgggatggtggggagagtgatgctagaactccaactatggggagtgatttggatgaagatttgatggctttacgtgtagatgatggtagtgaaagtttgactcaactccaacctctgaaagcacccaagaaatcaaagaggcagggagagaccatatgcaaaggacacaaaaattatgagcttatgcttaatttgcagctgggaatcaggcattctgttgcaaggcctgctccaacagcatcacttgatctcaagccttcagcttttgaccctaaggagaaagtgtggacaagatttccacccgaaggatccaaatacactccaccacatccatcatgtgactttaagtggaaggactactgcccggtagtttttagaactcttaggaagctattcaaggtggatccagctgattacatgttatccatatgtggaaatgatgcccttcgtgaactttcctctcctggaaaaagtggtagcttcttttacttaacccatgacgaccgttacatgattaagacaatgaagaaagctgaagtgaaagttctattgagaatgcttccagcctattacaataattttcgagaccaacaaaacactcttttgacaaagtattatggcctgcattgtgtaaagttaaatggacctattcagaagaaggttcggtttatcataatgggcaacctcttctgttctgagtatatcacccacagacgctacgatttgaagggttcttcacttggacgcttctctgataagcctgagacagagattagtgaaaccacaatccttaaagatcttgatcttaattttatatttcgactagaaaagtcccggtttgaagaattttgcaggtga

SEQ ID NO: 112920 - DNA, 543 bp, Glycine max
  Peptide Sequence Number=SeqID_229698
atggcagctactaatgtgattattagcttacaaaaccttgtttctcgcgaggctgatcctcgagagaaaaggatgagcaagaggaacacaacttcaccacaagcttttaatgaccatagaggcatatatatgggatctagacctttaggatcgatgtatatgaaaggttcgattcctgaaggacttaatttacttcttatgctgagaatcttctgtgtcttctttacgtatgtccctacagtttcaaagctccaaggaggtgctgcattcaatgttattccagattatgtcatcattgatggcaccttccgagctctttctagagaaacattgaagcaccttaaacagcgcattgagcaggttatcattggtcaagctgctgtgcagaggtgcaatgcaaatgtcaatttccatgatgaagagaaacctttatatcctccaactataaataatgatgacttgcacaagttttttgttgatgtagctgggaatttgcttggtatcaataaagctaatactgacgcaaatagacttggccgctga

SEQ ID NO: 112921 - DNA, 312 bp, Glycine max
  Peptide Sequence Number=SeqID_229699
atgtctgtaaagaaatctgtgtctctcaatggtggcaattcggttgccaagcttaaaggccagaaaccttcaaaacggaggcgtctcaatcgttgtttctcttcggttgaattgtctatggagccagggaagcagctgaaggacatggattccaacaagttgaagggtgagatcaagaggtgggctaaggctgttgttgcatatgcacgccaaaaatgttggtggagtttgaaaatgagctttacatcaactggttttagccttgagaattggtgcatagatgttaaagtggtggttgtatatttgttgtga

SEQ ID NO: 112922 - DNA, 1064 bp, Glycine max
  Peptide Sequence Number=SeqID_229700
atggctaagaatgagtacaaggaaagagattctgagtttttcatgaataagatcaatgagaacgaagaagaacaggacatagaagctatcgggtaccatagtgatattaatgatcagtgtggcagtgacaatgaggggaatcgtagaacagaacctgattcttcctcttctcagatatggcctcaaagttacagagaagccactgattcttattcaatttctgctgctccaaatcttgaatcaattatacgagcaccgagtgtgatttattcaagctttattggtggcggtggttttggtggtgctggttttggttcaaagagttacttagaacacgacgaaaggacttcttttttatctggtgaggaactcgctaatcaagggatcacaagaaggcaatcaacatggtgggagaaagcttcaattcaaatgcaaattcctgaagaattacctgttggttatggatgtagcctcactcaaacaatatttaatgggattaatgtgatggctggagttggccttctatctacaccttatacagtgaaacaagctgggtgggctgcagaccttatgaaacactgctttgaaagcagagaagggatcattagctatccagatataggacaagctgcatttggaagatatggcagacttattgtatcatcatattgtgtggagtttatcatcttggaaggagataacctcaccaggctgtttcctggaacatccttacactggggaagtttccagttagactccaaacacttgtttggaattttaacagcacttgtcattcttccaacagtttggttgagggatcttcgcataatctcctatctctcagctggaggggttgttgctacagcattgattactatatgtgtgtttttggttgggacaacagattctgttggattccatctcactggtccattggtgaaatggagtggcatgccctttgcttttggtatctacggattttgctttgcaggacattcagtttttccaaacatttatcagtctatggctgacaaaagagaatttaccaaggcagtgattgcaag

SEQ ID NO: 112923 - DNA, 201 bp, Glycine max
  Peptide Sequence Number=SeqID_229701
atgattggaaaagatagcggtgttatgaaggcatgggaggcaacgatgagaaagacacacgcagttgccaagaagcgtgcaaacagcatatttgggacgatatctttggcacatgttgcggatgaagaagaaaacaatgatggttatgatgacgacgaagagaatgagaacgaggcatttgaggtatacattgaagagaag

SEQ ID NO: 112924 - DNA, 468 bp, Glycine max
  Peptide Sequence Number=SeqID_229702
atggtggatgcagagaatgctggtgctgacaaaaaaaagcacgaagaacttgtcccaattatagaggaaatctataaagagaaagtcaaaaacgccaaagagttttcagaattctaccatgcagtatgcgagatagtcgagcaactcaatgaaaagcttggaaacacgcagatcaaactcccagagacaaaggctattgagaaggagtacaggcgtcgtggagataatgacactgacaaaaagccactgacaaaagcagaattccaggagatcatgcaaaatttggtgaagacatcaggattcactggtataggagcaaaggaagcaatcttgtgcatctttggtgttccattggctgctctgttcataaagcaaagagtgatgcctgaggcagttcgtgatgagttcttcatcccaggagtaacttctgcaacggttttcacccttgctgctcttaacaagatttga

SEQ ID NO: 112925 - DNA, 1371 bp, Glycine max
  Peptide Sequence Number=SeqID_229703
atgtgtttcttcaaatggttcaatttgttcatcattttccatgtcttggctgcaacacccatcttctcattaacagattcctcaaatcaagtctccactaactttctggacaataccaataagcctgaagtgtttgattggatggtcaaaatcagaaggaaaattcatgagaatccagaattgcgttatgaggaagttgagaccagtaaactgattagagaggaattggataaactgggtatcccatataaatacccagttgcaatcactggtgttattggttacatagggacaggaagctcaccttttgttgcaataagagctgatatggatgcacttcccatccaggaaatggtggagtgggaccacaagagtaaggtacccggaaagatgcacgcgtgtggtcacgatgctcatgtcactatgcttcttggtgcagcaaatattctcaaacagcacgaaaaagagatacagggaactgttgttcttgttttccaaccagcggaggagggaggcgcaggggctaagaaaattttagatgctggagccttagaaaatgttactgctatctttgcattacatgtgatgcctgacattccactaggtgaagcagcctctaggtctggtccaatattggcaggaagtggtaccttcgaagcaataataagtggaaagggaggtcatgcagccattccccaacattctatagaccctgtattggcagcttctaatgtcattattagcttacagcaccttgtctctcgtgaggctgatcctctggatccccagatgatgaaaggcttggttcctcaaggactttacttgtttatggttgtgacagttgctaagttccaaggaggtggtgcattcaatgttattccagattatgtcacaattggtggcacctttcgagctttttctagagaaaaattggaccaacttaaacagcgcattaagcaggttgtcattggtcaagctgctgtgcagaggtgtaatgcaactgtcaacttccttgatgaaacaagaccttcatatcctccaactgtaaataatggtgacttgcacaagctttttgttgatgtagctggcaatttgcttggcaccaataatgttaatattgagaagacacctatcatggccgctgaagactttgcattctatcaagaggtcatacctggctacttcatcatgcttggagtgaagagtgcttcgcctgaaccgcaccagtcattacactcaccctatctcaaaatcagtgaagatgcacttccttatggggctgcacttcatgcatcattggctactagttatcttctgaggtaccagcaggacgtagccaaggtagttgggaaatatcatgatgaattataa

SEQ ID NO: 112926 - DNA, 204 bp, Glycine max
  Peptide Sequence Number=SeqID_229704
atggagtcgaggcacaatgagagatcatggtgggtctgggtgaggcggagaacagcctcttccaaatggtcggtcatcttggagtgtgtgttatgctcagccattgaggatggtcgacagatacgtgggtgtgtgggtctctctcctagatcgtgggtagggctacacatagtcatgctccctatcaaagagccacttatatga

SEQ ID NO: 112927 - DNA, 696 bp, Glycine max
  Peptide Sequence Number=SeqID_229705
atgcagagaatgctcaacacaagaagaaccgccacagccccaacggcgattcccaccaccacaccggtcgaaatactcgacgaggaagacgacggagtggtcggtctcgatccggacggaggagagggcgagctccgggacggtggactcggagtgctgccgcctccgccgccactgggaggcgacggcggcgagtgcgatggcggcgacggcggagaagtcgatggcggcgaagttgacggcgtggttggagtggacggtggaggagaagcagaaggagtggacggtggagaagcggagggagtcgccggagggggcgaggaaggagttgacggaggtggcgaagaaggtgtcgccggcggaggagacgacggagttgccggcggaggtgacgacggagttgcaggcggaggtgacgagggggtcgagggaggcggagcggaaggtgtggcgggaggcggtgcggagggagttgacggaggaggcgcggtgccgttggtcggcggcggcgaagacggcgcgggggcagttgacattaccgagaatgattacagaaagaaaaatgtgagattgaaaaagaaagagaaaaccttaagaaagcgaagaataagccaaccagccaagacaaaacgggtaccgtgggacccacaccaatgcccctcggacacttcttcttacaattcatttaattactaa

SEQ ID NO: 112928 - DNA, 436 bp, Glycine max
  Peptide Sequence Number=SeqID_229706
gggagatggttgccgcccagctcgcccaggcgagccaggttgcttcctccagaagcaacagccttctagaggaatcttctggagggcccaaggatgttggagtgaacgtgggtggttctacctcatttgatgacccttctgaactcactagaagacctttgtcaagatggggacttaagaacaacatgtcaatcttgagtgtggagatgctacatagatcaaggatgaatccctaccagaaactattggtgatgccttcaagcgcaagactggcgctaagcccaaacccacttactcgggctaagcgtgagggaggcgctaagcgcaataactttgagaaggccagggcacagatttccacagcacaccacagtgcctatttcgggaatagagcactggaggcagcaagaggagcagcttttgcagagatacatag

SEQ ID NO: 112929 - DNA, 1311 bp, Glycine max
  Peptide Sequence Number=SeqID_229707
atgcctccaaagccatcgccaccacctgctccaccggcttatgctgctcagcctcccccaccaccgcctcctttcatcatcagcagtggtgggtctggatcaaactattcaggtggtgaatttcttcctcctccttcgccaggaattgcattgggattctctaagagcacgttcacgtacgaggagttggcacgtgcaactgatggcttttctgatgccaacctccttggacaaggaggatttggatatgtgcacaggggaattcttcccaatggcaaggaggtggcagtgaagcaattgaaggctggaactttctatcacaagattcctttcaaaattctgtttagttggtccatcttttctgctgaaagtgggctaggcaccaactaccaatattattgtggcataatgcttttggtggaagcggttttgatggttatttgcactgcaggaagagggcgacctaccatggattggcccacaagattaagaattgctttaggatctgctaagggactggcgtatcttcatgaagattgtcatcctaagatcatccatcgtgatatcaaagctgccaacatccttctggattttaagtttgaagcaaaggttgcagatttcggtcttgcaaagttttcttctgatgtcaatactcatgtttctactcgagtgatggggacttttgggtatttggctccagaatatgcttctagtggaaaactgacagacaaatcagatgttttctcctacggagtcatgctcctcgagttaataaccggacgacggcctgtcgataaaaatcaaactttcatggaggatagtttggtagactgggctaggcctttgctcacacgagctttggaagaggatgattttgattctattattgacccaaggctccagaatgactatgatcctaatgagatggcacgaatggtggcttctgctgcagcttgcattcgtcattcggcaaagcgtcgaccaaggatgagccaggttgttcgcgctctggaaggagatgtctctctagcagatcttaacgaaggaattagacctggacacagcacaatgtacagttctcatgaaagctcagattatgacactgcacagtacaaggaagacatgaaaaagttcagaaaaatggcattgggaactcaggaatatggtgcaagcagtgagtacagtgcagctacaagtgagtatggtttaaacccatctggctcaagcagtgaagcacagagccgccaaacgacaagggaaatggaaatgagaaagatgaagaacagtcaaggtttcagtggaagctcttga

SEQ ID NO: 112930 - DNA, 618 bp, Glycine max
  Peptide Sequence Number=SeqID_229708
atggcgcgagggctaattctatcttcgccaacactcactgcaacaacttgtctctttgcttccatctccaaaaccccgccaaaaagtttcaatctttcattcggtcttaaacttattcatcaccactatcatcttattccatcgccttgctccttcagcgtggattcttccccttcccaatgttcaatcgacatttccaagtacacagaaacattttccaggcgaatggccatggctggtctcaaaccccatcaccgaattggtcagcttctctttgtgtcactcatcttcccagcagaaaaattgaatcttttttgcaaaatgcaaatatttgctcaacttgctctgggagtgtctggtggccctgacagtatggcactctgtgtgttaactgctggatggaaaactgctggtgctgatgctgtcacatctgagaatggtggtttcatagatggactactggcaataattgttgatcatggtctacgagcagagagcaaagaggaggcaaatattgtttctcaccgagtttcaaaaatgggtgtgtccaaatttggctgctttatctgtattgcaggaatggaacctggatcttctcgtgttaaatttttcgcatga

SEQ ID NO: 112931 - DNA, 639 bp, Glycine max
  Peptide Sequence Number=SeqID_229709
atgattatattgggcatgctccatttccttgccatctacacagctccaaaatctgctgccatcgacttatccacacatgtgaataacaagtacgatggtggagcattcttgcaatgctggactgtgttatacactgtagatggatcaacttgtgagctcagcttagtaaaatatgttgacaaagacggcaacataaattacttatcttgccaatgcataatcttgcgcaaaagaagaactgaaaccgatattggcctttctatgaattatagttctttgaagtggatgaagagaaacacgaccactgatgcacagggtggcgctacggaaaccaaggtttactcttatgggagtggaaactgggtgggtcttcttgttgaggtgtgccagaaaaacagtaccgataatgaagaggttaatgcagtagtaattttggcacactattttgctaacagtagcgggacaacttttaacagatcaactgaatcagatattggcctctctaatgcaattagtattgccaatgatggaagattccgggggcatgctaatggtagttccattagatgcaaaaaaatttatgctaagggaacatatcctaacatgtcatgtaccccaacatttgtagggacaaattaa

SEQ ID NO: 112932 - DNA, 1419 bp, Glycine max
  Peptide Sequence Number=SeqID_229710
atgcaggccgagttatttattttaaggctttctcgaaatagtggtgtgcttggacttgcaggcatgcctttcacctcccagattttccctacatatacacagtcctacagggaagttcaagcaaaccagggtatccttcttgtgcggcctcttctggaattttcaaaggaagatatgtacaagatatgccaaggaggtagtgagaattgggtagaagacccaactaatcaaagtccattatatgcacgtaataggataagaatggtgctgaataatttgtcatcttctgcgttcaagtttgaactccaagcactgatttctgcatgccgaataacacgcacatatgttgatcaaattgcctatagcttgatacgtgatgctgtggttatcaaggatcatgggtatgttgttattgatttacagattctttgtcctttgaaagttgaggacatatgcctgatgaagtttctttccttgatactgcagtttgtatcacaaaggcagaggcaaatcagaggtagtgctttgaaattgctaatggactacattcgtacttttccgtgcaagaattctgttacagcagcaggttgttacctttgcccggatcctggttctagagggtccagagtcttggtctgctgttgttctaatggttgtgcttttcctttaaagattgaatattttgagtcacaatctcaaggacaacaagggtgttgtgttgccaatgagttagaaaagattatagaggctgagaagtcatatgcaaatcacttggttctggatgcatcagatgtccactttttggatgtgaatcctgagttagttttgactgaagccaaaaggctaaacataattggtgaatcaacctacaatagcatttttgcattgcagaagcaagaaaccgctcacttcaggtctaaaactgaggtcatttctgactctgcttcaaagcatggggttaccccttttagcaaatcacttcagccagggcagttctgttacttcatggatcgattcattctcacatggaaattgaaaaataatattgataatgataaactttctggtttagttgattatgaaatggatttgggtgaagaaaccagaagcttgtgttgcacatcttgtgtagctggtaataataaagtacctgaggtgcgacacatgatagaatctgattggctgtatcttgctgaattatcaaaatatccactttccaaaaacttccctcaatacgaggttaaatcagtgaatggaaccaagcagataatggacagaacatctccatgtttgcactatgccagtgtatcagcaaaacaagctctccgcttgttaaaatctatcccagttgctgcaaggagaagcctgcctgttctgatcaatcaacaaggacaattactaagcattccagtaagttga

SEQ ID NO: 112933 - DNA, 1050 bp, Glycine max
  Peptide Sequence Number=SeqID_229711
atgatgggaaaagagtacaagactttctttgtgtcaatggaagctgcaatcagagatcattcactgtggactactgcctccgaagaagacattgattgtgcaatgcagggtttagagaaatatataatgactaaattgttctctcgaacattctctgcttctgctgaggatgcaaagattgacaacgaaatctcatcgaaaatatgcttgctccaaacctttctaaagcctgaacatttggatataccaccaattctccaaaatgaagccttatggctgcttgcagagaaagaattgctgaaaatcaatgccttcaaagctcctcatgagaaactcttgagcattatgaattgctgcaggatcatcaacaatctgttgctcaatgctgcaatgtctgagtatgttccagctggggcagatggctttctccctgtgctcatatatgttacaatcaaggcaagccccccttggcctatagaatccactttacactaccctttgacacgggcaaatcctccaaagttgcattctaacctcaaattcatcaagttgtacacaaggcaagcaaaactcatctccgaagctgaatattatttcacaaatcttgtgtcggctaagacatttatagttgacttaaatgccaaatcactttcaatggacgaaatcaaatataaggagagcatgcaagcagccaagttgaccaataaagtcacaagtgaattatccgctgcatgtcaaatgagccagcaagagacggacgatagcagttgttcaaagaaaatgcacaacaaacttgatgatactggagttttgctacatggatcaaactatccttacatggaagcaaagagcaaagagctaacagttggagatgtggacatgttattaagtgattacaaggatttagttgctaagtacacaatcctgtgcaaagctattggttgcctttccaccgcagagagagaacccctccttcgtcatctagaaatgcaaggaccagaaactctacttaatttcacagcaccgtcggatcatcacagacacaagtga

SEQ ID NO: 112934 - DNA, 1689 bp, Glycine max
  Peptide Sequence Number=SeqID_229712
atggttcgagcttttcatcgccaaattagcatgcagaagtctaagtcttttcatttcaggaagatgtttgagatcccagggaaacatatccacggtttatttgataaagatcatgatgaagcaggtgaaagtgatagtaagatttactcaaaaagctttgagtctagaagctcacttgatcagcaatttgaaattcagctcaatagtgatcatagtccagcagcaagcttgggtattgaagcacctagaatgcctcccaagccaccaactgaagctgacttgatgaaggaaaggtttgctaagctgcttttaggagaagacatgtctggtgcagggaatggtgtttcttcagcattggctttgtcaaatgccataacaaacctggctgcatctgttttcggagaacaatcaaagctggagccaatgtcctcagaaagaaaggccaggtggagaaaagaaattgagtggcttctatctgtaactgattatattgttgaatttgctccatcacaacagatagctaaggatggaacaagcatggagatcatgactacacggcaacgaactgatctgctcatgaacatccccgccttgcgaaagcttgatgcaatgctcattgacacgttagacaactttagagatcaaaatgagttctggtatgtctctaaaaatgatgagaattctgaggataacactaacagccaaaggaagagtgacaaatggtggctaccaacagttaaagttcccccaacagggatgtcagaaccggccggaaaatggatacagttccagaaggacaatgtcaaccaagtgcttaaagcagccatggcaataaatgctcaaatactatcagaaatggagatccctgaaaattacattgaatctctccccaagaatggtagagaaagccttggtgaatcagtctataagagcattacagtggaatactttgatcctgggcaatttctctcaacaatggacatgtccacagagcataaggtgcttgacctcaagaataggattgaagcttccatagtgatatggagaaggaagatgaccaataaggatagtaagtctgcgtggagttcggcagtgagcattgagaagagggaactctttgaggagagagctgagacaatattgctgatgctcaaacatcagttcccaggacttccacaatcttcacttgacattagcaaaatccaatacaacaaggatgttggacaagctattctagagagctactcaagagtaatagaaagcctggcttacacagttatgtcaaggattgatgatgtcttgtacgctgattcggtgacaaagaacccttcattggcagtgagcagcagaagatattcattggattcttcaccggcggcaactgagcagacgtccccaaactctgaggatgagaatagctacttacaatcttcagagacacctccttcaatgactctctcagatttcatgggttggagttctaccaagggggggagtgacataaagaatactaattccacaagagacatagaagatactaattccacaggagacatagaagagtacgtgaaagaaaaagatgaaaagagtataactaaatctccaaaacttacaaccccatcgaaatcttactatttggagaagcttgagtacttgaatgctttaaaaagtcccatagctcgacattaa

SEQ ID NO: 112935 - DNA, 1980 bp, Glycine max
  Peptide Sequence Number=SeqID_229713
atggggttgaagaacagatttgatgaggcagctaggaggaatgatgtgaaagctatagttttgactggcaaaggtggcagattttctggtggctttgatatcagtgttatgcagaaggttcaccagactggggattcctcgcatctccctgatgtctccgtggaactagtagtcaattcaattgaagattcgaagaaacctgttgttgcagcagtagaggggcttgctcttggaggtggcttagaactggcgatgggatgccatgcgcgtgttgcagctccaagagctcaactgggtctaccagagctgactcttggtattattcccggatttggaggaactcagcgtcttccaaggcttattgggctgtctaaagctgttgaaatgatgctgacatctaaaccaatcacgtcggaagaagggaggaaatttggacttattgatgctattgtgtcttctgaggagttactaaaggcatctaggttgtgggcacttgaaattggagagaggcgcaaaccttggattcgttcacttcataggacagacaaaattggttctctgtctgaagcacgtgcggtgttgaaaactgccaggcaacaagtcaagaagactgctccacatttgcctcagcagcaggcttgtgtagatgtgattgaacatggaatagtccatggaggctacagtggtgttctaaaggaggcagaagtattcaagcaattggtcatatctgacacctcaaaaggtttaattaatgtcttctttgcacagcgggcgatatcaaaggtgcctggtgtaactgatatcggccttaagccaagaaatgtgaaaaaagctgctgttattggaggaggtctaatgggttctggcattgctacagctcttatactaggcaacattcgtgttatactcaaggaaatcaattctgaatttcttctgaagggaataaaaacaatagaagcaaatgttaatggcttagtaagaagaggaaagttgacgaaacagaaggcagatgctgcactgtcactgcttaaaggtgttctggattactcagaatttaaagatgtggacttggtcattgaggctgtaattgaaaatatcagtctcaaacaaactatatttggtgatcttgagaagatttgtcctccacactgcattttagcatcaaacacatcaactattgaccttgatgttgttggtaaaacgaccagctctcaagatcgcattgcgggtgcccattttttcagtcctgcccacattatgccacttttggagattatacgaactgataaaacttctgcacaagtgattgttgatctgataacagttggcaaaatcataaagaaggcacctgttgtggtgggtaattgcactggctttgcagtgaataaaacattcttcccatattcacaaggtgcccatttgttggtcaacttgggtgtggatgttttcagaatcgacagattgatatgcaactttggctttccgattggacctttccagcttcaagacttggctggctatggagttgccgttgctacttcaaaagtatttgctgatgcattttctgatcgcatatttaaatctccactgcttgatcttctgatcaaatctgggcgaaatgggaacattttgtgtgaatataatcaattatttctgaccttggctatctctgccctaccaggcaaaaacaatgggaaagggtactacatttatgaaaagggtggcaagccaaaacctgatccttcaatactaccaatcatcgaggagtctagaagactttgcaatattatgcccaatggaaagcctatatctattactgaccaagagattgtggagatgatactattcccagtagttaatgaggcatgccgtgttctagaagatggagttgttatacgagcatcagaccttgacattgcatctgttcttggaatgagcttcccaaattaccggttggatttcctttttttcactctttaa

SEQ ID NO: 112936 - DNA, 348 bp, Glycine max
  Peptide Sequence Number=SeqID_229714
ctccctctcctcgcgtaccttgtttggatccacgcgccgctcaatttcgcaacagtcgcagcaatcccgagctgcgcaatccacgcgcgcggtattccaattccagctgcgttttcggattttgtgtttgtttcgcgtgccatgggggaaggtgaaggaggaggtgattgcgttcagaagaatgcatcgttgtcggaagttgttgctccgtcggcagcgtcgttggaagttccggcgaagaagctggcgcggcagcttgattttaccggcgcgccggagcatccaccacagctaccggtggctgtgttgccgttgccgctgcaggcgccacctgcgagggttgggtga

SEQ ID NO: 112937 - DNA, 2694 bp, Glycine max
  Peptide Sequence Number=SeqID_229715
atgagtttctcatctgggtttgggattggtgctgctgatagtgatgaacagttgaaacaaaatcaaggaatattactagcctcccagtttgttgatgaaatttctgtgacagaatatccccctcaagactcagtcatgtatagaccattcatgacatgtgatgatccaaaaggggttgttgagtgtggggcaataaggaaatacagaaccagttctcagaaaatgaaggaaaagacaaaaaataggaggccggctgagacatccttggcaaacaaacaagacaaagaagagaaggtttcaaaaggatctacagaaaggtcttttgatccatcatccttgcagctcatggaggtatccagaggggctcaaaggttgaacaacatgattgattcatggtctaggggtcttaggtatgatggaaggtctgaagatatagcaaaagatttgctaaaaggggctcttgacctgcaagagtctctactaatgcttcggaaggtgcaagaggcttcacaacacatggctagtttgaagagaagacaaaatgaaaaaccggaaagaggcaaatttgatgccaaggtgattgatagaactacacattgtgatcattttggtgaacagagttatccaatggggttccaaaggcgttggccttcagctgatggttcttcaagtagttgcaatgaggagcttaagaaagtgatcaaagagagcctggttaggcaaaatttgttcacaaccactgaagggttggattcagcatccacattccgctctacaaactcaagccagtcttctgtggcttggaatgataggctttctgattcttcttcgttctcaccaacaacttcaaggagagaaagaggatccaatctggttgccaagctgatgggtttggaagaagcctcttcaagatcatttccagctgttatacagaaacagttggagagtccaaagattctgaatcacaagaggcctgtatctgacatagatatgcctaaggtaagaaaaaatgtcgggaaggttaatctagaacataagatgaccttgacggaaattcttgagactactcatttcaatggacttttaaagagtcctgtcagagagcctaaggttcaggtccatcattccattgatccacattacaaacattttggtgatttacctcccattgtacttatgaaacctcggtgtactccatatcgagaatgtgtgaaaagttatgagcatgttgttcctccagaagagttatcccttagaaatctaaaagcaaaatttgtcccttccaaagtattccaacacagagaaggctcaaccaccaacatgggaaagaaaatggaagaacatgtatccaaaaggcttgccaaagaggaaagaactaagctcctcagcgaggttgtggagctgaaggaaaaagaaatcaagcctattgaaaatgagaaagctccaggaggtaaggtaaaactgcatagtcatgtcagtcacaaatcacatgtaaatgaaactgttgataaaaaagctaaggtaaagaccattaccactagtaaaaagctatcagaaaaggaggcttcaaaacccaaacaacaacaacaacaaagccttatcccacgcggtgaggttccaaaactcaaagttgtgacgaaatctcaagatcaaggagaaattagctctacaagtacaaagttgaggaagccacaaagtgggtccagaattgacaagaatgagattcccaacaggaagaccactgcttcaaattcaaacaccatctcaaaaccaaagagtcaaaagatcagtaataccaattccaaggagcagaaaaagaatcagatgaagaagcaaaagcctgctgttgctgagcctgaagcggctaaaccagttttaggaccagaagaagcagatagtcttgatgtttcttgtaaagatgattgccctgagattagaataatcactacaataacagatgatcttgcggtggagcatgaagaagtagatgcatctgcaaataagattagagaaatttgtgagcaaagccagggttcttcaagtgatgatattttgatgcttaagtctgaacatgaaaatgattctatccctgctgaggaagctcatagcatcaccaatatcagtgaaaccgatcgtgagcctgacaaagacagttctgagctaaaatatttgcttctaactagtcagtcatttattggacatgcagaagagctcctcaatcttgatgttgactgtcccaagatcctaccaagaagtaaaactaaggaaatagccaatctcagactttatttagattgtgcaaatgaactcactgagcgaaaaagccttcaggggacacaagcagttcaccctttgttgctaacttgtgcagggcattcaagatatcacatctctttagggaggttggttgatgaagtctatagtgccattgagcatctaacatcttacagtgaaaaactagcttcagataatatctatgcaatgatggagagagatataaagagcaacaatggactgataaacggaatatggaactggggttggaggcatggattttccgcagatgaagctgagcaagttgtcaatgaagtagagaacctagttttaggtgaattgattgaggagcctttagatatcagcatcttcaccttgtatataaggagtcattcaattgataaaagaaagaagagttga

SEQ ID NO: 112938 - DNA, 570 bp, Glycine max
  Peptide Sequence Number=SeqID_229716
atggaggtggatttcaagtctccttcccttgaaaagacagaagctgctgagactgaagtagaagaaaacatgcactttcacaagtctcttcaggagctaagagaattgcagtctcagttgcaccatgccgcagattattgtgaaacaactttcttgaaaagtgaagctaagagagatttgctatcaggttcaggattcattttccctatggtggtccatgaagcacccatccttgagagaccaagcagcgaggaattaagagattctaaaactgaagacccctctaaattagatgataaacacatactagaaaaacatgaggatttgccactctttttgtacacccaaaaaccacatggagataagaatttgaagccaaccagttttactacattgaaggagcataatttgaccatggtggtacctgttcgggacggtttgtcagtcttaaccaaagtttcaaatcctacatttcatttccaaggttccccgaaggttgcacgccatagaagatccttgcatggcagtaacatcttatggctcatacggcgtactaaaagaatccaatga

SEQ ID NO: 112939 - DNA, 726 bp, Glycine max
  Peptide Sequence Number=SeqID_229717
atgtatttgcaagaagttggacttttcatggcatatttttatggaaagacgggagcttaccatcaaatgacttggcaagaggatgctggggaagttttaatattaggaaaacataacaaggggtgtcattgtaaaaagtctgggtgcctcaagaagtattgtgaatgcttccaagccaacattctttgttctgaaaattgtaaatgcatggactgcaagaattttgagggaagtgaagagagacaggctttgtttcatggagatcaaaataacatggcatatattcagcaagcggcaaatgcagccataactggagctattggttcctctggctattcatcgcctccagtatccaagaaaagaaaaggtcaagaactcttcttttggcctacaaccaaggatccatccattagcaagttgggacaacaggtaaaccatgtcagaggtccagcaccttcctcatccttgtcacctgtctcaggtgctcgtgttggaactgcaacattaggtccttcaaaatttatgtacaggtctcttttagcagacattatacaaccacagcacctcaaggagctatgctcagttctggttctagtatcaggacaagctgcaaagacacttacagaaaagggggatagaggttgcataaggactcatgatatggctcggtggttagtgtcagtgagactaggtttttcttcagcgaatgattatttcaaccggtaa

SEQ ID NO: 112940 - DNA, 609 bp, Glycine max
  Peptide Sequence Number=SeqID_229718
atggaaaagcaagcagaagatcagacggaaacttcccttgcttcttcaagtcaagagcaattaccaagtcaaaaggaaggtcacattgagaagactgtggcagatgattgttcgagtgcaaaccaaacagataaaatcagcccagataattccagttcagatggtgctgatgtcccaaaagggaggccaatgtctcctgggactttagccttgatgtgtgatgagcaagatacaatgttcatgacaaccgcctctcccattgcgccaatggcccatgcttgcaatacatcttcacaatttccttatggacaaggaatgacagaggtttatcctgagcaagaaaggattgtattaacaaagtttagagattttctcaatcgggttatcaccatgggagaaataaacggcaaaaatgaattagagagtcaaaaggacccaatcatcaatggcattggaaatgccagttctgagatagtgctacagcagggagccactagcaatggtgttactaaaccaggttcacctttggttacaacttcgacatctatgatccctggtaatattgccgaaaatggggagactaaggtgaagatcgaaaaagagatatga

SEQ ID NO: 112941 - DNA, 222 bp, Glycine max
  Peptide Sequence Number=SeqID_229719
atggtgagtccaactctatctgctggatggacagaacttagagagttctatgggcacactggaaatcataaggatgtgtcgagtaccatgtactcgtttatgaaagctgcaagattcatgcatctgaacttggaagagactacgaagtgtaagatagtttataatcatcataggaagactgcaaattggaaatggatggaggaattttgcacaatcacataa

SEQ ID NO: 112942 - DNA, 1110 bp, Glycine max
  Peptide Sequence Number=SeqID_229720
atggcgcacgcgaagaccgattccgacgtcacgagcatggacacgtcatcgtcgccaaaacgcgccgtttactacgtgcagagcccctcgcgcgactctcacgacggcgacaagtcgtcgacggcgacgcacgcgacgccggcgtgcaacagccccgtggactcgccctcgcaccattcctacgggcaccactctagggcttcttcttcgagcagggtctccggcgggtcctacaacatcgcctcttgggggaggaaagtgacccgcaaaaacaaattagggtggcctcatgagtgcaaggtcattgaggaagaagaggaagggtattatggggaaagacaaggcttttctaggaagactcagatcttcgttggggtccttggctttgccttcattttcaccctcttttgtttcatcattgctgcggctgccaggccttataatgttcggatcagtgttaagttagaaggaatcgataatttatatgtatttgtggagatagttgtgcctatatatattatcagaggttgggttggaggtgttcacatttattgtgtcaacgtgcctcaaacaggattatctgagtctcttggatttaggatgatgaatgagacaggaaggaatgtggaatcaggcactaatgtgagtttcacagtacacaacttcttattcggagaagggtcggatatgacaggagttccaaccaagatgctgacggtaaattgttcggcgagaatgacagtgcataaccctgcaaccttcttcggaattcatgtcagctctaaagcagtgaatcttatgtattctgagatgacagttgcaactggtgagctgaagaagcattatctatcgagaaagagtacccgtacagtgtctgtgaacctgcaaggaagcaaggtttctctatatggtgctgatgcaagcttaactggcttggtggacaatggaaaaataccaatgactcttgtctttgaagttggatcgctagggaatattgttgggaggttggtgaggtccaaacatcgaaggcgtgtctcttgctcagtggctattgattcccacaacatcgaacccatcaaacttaaagagaatgcatgcacatacaattga

SEQ ID NO: 112943 - DNA, 1338 bp, Glycine max
  Peptide Sequence Number=SeqID_229721
atgtggatggggcattcatctatgtacaagcgcactccttcgagagataattcaaacatggaggacgtggaagaaaactcagatcttttagacatcggcctggacaagggaacctcaaatccttcattgatgctttctttaccgcatgtacttgtggcgaccatttcttcattcctttttggataccatcttggagttgttaatgaaccacttgagagcatttctgtggatcttggtttccgtggaaatacattggcagaaggtctggtggtgagcatatgtcttggtggtgccttgattggatgtctactaagtggttggattgctgatggggtggggcgtcgtagggctttccaattgtgtgctctgccaatgataattggtgcttctatgagtgcggcaacaaacaacttgtttggcatgcttgtaggaaggttgtttgttgggactggcttgggcctgggccctcctgttgcctctctgtatgtgacagaggtttctcctgcttttgtgcggggcacctttggagctttcatccagattgccacatgccttggtctaatgggagctttatttattggaatccctgtcaaagaaatatctggatggtggcgggtttgtttttgggtatctaccattccagctgctatacttgccacagctatggtcttctgcgcagagagtccacattggttatacaaggtgtggagaggcatggcgcaaattccatggcagtttttcttttgcaattcaaaaccgctagaaaatcaaggaagaactgctgaagcagaagctgagtttgagaggcttcttggtgtatcagaagcaaaatttgcaatgtcagagttatccaaggcagatagaggagacgatagtgatagtgtgaagctgtcggaattgcttcatggtcgtcattctaaagttgtttttattggatcaaccctatttgctttacaacagctatctggtataaatgctgtgttttatttctcttcaactgtttttaaaagtgctggagtgccatcagacattgcaaatgtctgcataggaattgccaatttggcaggatctatcgtttcaatgggtttgatggataagcttggaaggaaggttctacttttctggagtttctttggcatgatgttctattatgtagcatatcattatagggtgattatcatgcacttaaaaatctgggacacatgtggtagttgtactattttaaatcctgacttggtgtttgtggcaatagcaatgatccttcaagccacaggagcaacttcacttgtatcaaacatgggagctcagtacttttctgttggtggcatgttcctgtga

SEQ ID NO: 112944 - DNA, 432 bp, Glycine max
  Peptide Sequence Number=SeqID_229722
atgttgaaattatttgctaatatttggtcaggtcttggattcataacttccataactttcatcttcttggtcggggttttcatgtcatcatggttgggtgcttctgtcctgggccttggggagtggtttatcaagcgaatgccacttgttcgtcatatttataatgcctccaagcagattagtgctgctatctctccagatcaaaatacacaagccttcaaagaagtagccatcattcggcatccacgtattggagaatatgcatttggattcatcacctcatctgttacccttcagaactattctggagatgaggagttatgctgtgtctatgttcctacaaatcatctttatattggtgatatatttcttgtcaacaccaaggatgtcattaggccaaacttatcaattcgtgaaggaattggtgagtag

SEQ ID NO: 112945 - DNA, 483 bp, Glycine max
  Peptide Sequence Number=SeqID_229723
atgcaaacttggaacaattccttcttccctcctatctctacttacctgagtcaactgaatgcagcaattggagtaatattttcagcaacagattttgtttgcacgttgcaggttcttaatcaagatgagactcccttactatatagcctggtctttggggagggggtagtaaatgatgctacctccgtagttctcttcaaagcaattcagaattttgacctctctcacattgacttaaccactgccttacaattattagcgaattttttgtatttattcattgcaagcactgtgttgggaatctttataagaaaatcatatactatcacaaaacaaagagagaggtggacagatgaagaacataagaagttccttgaagccttaaagctatatggaaggcctggcgacggattgaaggagttgcatgcttctttctggtcactaatgttttacaaacctgatctctctcctctcaaaaagtaa

SEQ ID NO: 112946 - DNA, 1050 bp, Glycine max
  Peptide Sequence Number=SeqID_229724
atggttgtagagcttctgctgaatcctgatatttttcacgctgatgcattggctggcatactaacagagattgttccaaaaagagtcaaacaagtggttgattggggtattaaagtttgggaagatggaaagaattggcatcaaggatatgaaggaggatatagaattcgtgcaggttcctcatctccagttcaccgaagagatgcagatcgccgttttgcttctgattataataacttgtcacgaagccgtggttatggtggtgggagagatccaggaagatatcgagacccttcacctccgtatggacgaggtagagtagggggcaggccaatgggtagtggacttgctagaggggaaggcaacaatagaaataatcccaatgtgcgtcctagggagggagattggatttgtcctgatcccttgtgtaataatcttaactttgctaggcgggaccattgtaacagctgtaataggtctcgtaatgcacctgctagaagtcctcggaggtcttttcctgcacctccaccacttcatgctcctcctagacgctttcctggacctctgattgatcgctctcctgaaaggactttgaatggctatagatctcctcgtgggttggcaagagatggccctagagagtatggatctgctgctctgccgccactcaggcatgaaggcaggtttccagatccccatgtacgtagagagcgtatggatttcatagaagatgcttacagggggagaaacaagtttgatagaccacccccactggactgggataatagagatcgtggaagagatggcttctctgatgaaaggaaaggatttgaaaggaggccactgtcaccccctgtgccttttttgccatcacttcctcaccatcgaggtggtcggtgggctcgtgatgttagagagagaagccgctctccaataagaggtggcccaccaccaaaagaatatcgtcgggatacgttcatgcatcgtgcaagagatgataggcatgataggcatggaatgggacgagatagaattggaggaatgtattag

SEQ ID NO: 112947 - DNA, 570 bp, Glycine max
  Peptide Sequence Number=SeqID_229725
atggcttccattccacacacagtcttcacccatttctcttccttcattcctttctatacctatgcggttcctaatgctagcaggcatcgaaacgacaacaccaacaattgttccactcataaaatccctcttttgcctaaggagaaacatcccaatgaacaaaaattgaagctcgaccatcaaaaccaaaacctgttgaatgtggacttcgcggccctgtgtgaagagggtaaccttgatcaagtattggaactcaagggtcaaggtgtagttgctgattatcgcgtttatctcacgctcttgaattttgagaagaatgcatgtcgagtgttagatcaaatgttggacagaaacatcgcttcatggcatttgatgattgctgggtacacaagcagaggaggaggaggactggtcggtgtcaaagggggagtggtggtgggtggaaccacagtcacaaaggaggttgaaggggttattgatgatgtggcattggcacgtgcaatcccatgtggtgggtggaatcgcagtcacacgagggatatggtggctgctatcaactacaacatgtaa

SEQ ID NO: 112948 - DNA, 757 bp, Glycine max
  Peptide Sequence Number=SeqID_229726
gccagatccacaggaactagcagcccgactatgcatccctgggaggggatttgagcttaatgctgatgggctgccattgaagatcttgcggaataatttgaccacgctcgctcagacatggagtgttttatcattctccaacccgacccctacttctcacacatctgacatcacattggatagggccaggttgggtttccctgccctcatcattgctttatgcaaagcccgaggagtcacttttgattcattgacttttgagagtctcagtctaaccattaatttggcttatgtgaagaaaaattgctggaaccttgatgaccccacggtcacttttcgagggcccattaaggctaagcacaagagatctaaggctccgtcttctgatattccccctacttcaactccttcgacttctatagcagcactttctgcgccagcttcatccactcctttgccaattccgactccaagctcaggcctgcagcctatcatgagcgtggaagagttcattagccaagacgagctcatccctcctgagccatttgtttatgagactgatctagctagtgctcaggaggaggtagcatcactagagcccgttcctcagtcatctccagctgcagttcttgatgatccacaaccatctgctccagcatcggtgcctgatcagcccattgttcaagatccaccagttgcaccggtgttggacttgaatgagcatgcacaggatcactcacatgatcaggatttttaa

SEQ ID NO: 112949 - DNA, 246 bp, Glycine max
  Peptide Sequence Number=SeqID_229727
atggaagatgtcacagaggatgagaaggaactagcaaagaagatgatcatagttgcactttggtgtatacagttaaaacccaatgatcgtccctctatgaacaaagtagtggagatgctggaaggagacattgagagcctagaaatacctctaaatttaaatccttctctatatccacttgaaacaatggtttcatatgatatggagataggagtggttttgggtttaacggcaatgggtctttga

SEQ ID NO: 112950 - DNA, 267 bp, Glycine max
  Peptide Sequence Number=SeqID_229728
atgtccttcatcatcctcagatcatgcacttattccataattcaaagattcatgcaaaagtcattacctaataaatttaaaaatcctgatcatgtgagtgatcctgtgcatgctcattcaagtccaacaccggtgcaactggtggatcttgaacaatgggctgatcaggcaccgatgctggagcagatggttgtggatcatcaagaactgcagctggagatgactgaggaacgggctctagtgatgctacctcctcctgagcactag

SEQ ID NO: 112951 - DNA, 126 bp, Glycine max
  Peptide Sequence Number=SeqID_229729
atggttgaccttaacagtacaaggggaagctcaacgcaggaactatgcattgttttgctgcaatatttgtacgaaagaggtttagagtttatcgatgggcgaaagcttcgtgagcttaagaaatag

SEQ ID NO: 112952 - DNA, 920 bp, Glycine max
  Peptide Sequence Number=SeqID_229730
ccgtcgacgacacagggagtagcatccacatgcttaccattgtcagttactggatggttacaattcatgaaaactacatgctggaaaagaaggcgtcgccaactgaaatatggacgttgaccggcaaggtatggatccgtcacgttacgatgagttttgctaaaattcaatcgggacaagaagatgcgtggggggaggagcaatttggttctggaactccgggatcagccacttggaaagcttcttcaactggaaatcgacaactgagaaacatggagcaagcagatccatattcagaagatacgatctcctgtccgatttacatgtttgattcagacaacagtgtcctcaaattggatttaacatcctgtaccaagatgtttgacattgttgcgccagtcaaggaattcaaccaacaggataattggttggctttgagatggtccaaaccaaattgtactgagtgtgaagcgaaaggtaagagatgcaaatggaagaacaacaacacaggagacattgaatgttttgactgcaagggcaaacaaaatggaatccagattcccagatcattgatttttgctgctacagattacaggacagaaaagcctgcaagatttacctacgctgatgttaaaagaatcatgggtggtttcaaagaaaagttgggggaaggagctcatggagctgtattcagaggaaaactttcaaacaagattttggtggctgtgaagatcctcaataatacagacaaagaagggaatgagttaatcaatgaagtggaaattatgggcaaaatccaccacatcaacgttgttcgtttgcttggcttctgtgtagaaggacatcatcgtgctcttgtctattgtctatttccaaaaggatccctacaaagctttatatttccaccggaggactgttag

SEQ ID NO: 112953 - DNA, 337 bp, Glycine max
  Peptide Sequence Number=SeqID_229731
ggacctctgtcggttctacggggtgcctgttgtccccagcaaggtcatcaggccccctactaatcaagctttcatcaagaagtattgtgcccccaggcaggcgcagggtgaaacacaccaacagcttggggacggccggcagtgggcaacagacgcactgctatcacctctagagttcacctcaactcatccacaaaaaagtaggacacacctagttgctcatgatcctaggaatttaaataaaacaagcacaagctcggaaggacatcccctttatccccgacccgctggccaaaaccctgacatatatcatgaccagccattctacaagccttga

SEQ ID NO: 112954 - DNA, 294 bp, Glycine max
  Peptide Sequence Number=SeqID_229732
atgtcatcatggttagaaacttcaattcttaccctagctgaatggttctataagaaaatgcctcttgtaagctatttatatgttgtgtctaagcaaataagtgcggcaatatcaccagatcaaagctccaatgctttcaaagaagttgccattagcatccctgtgttggtgagtatgcacttgggttcatcactacttcagtggttctatagaacagagatgacaaatagcctttttgtgtttacattcccaccaatcacttgtaccttggtcatatttatctcattagcctag

SEQ ID NO: 112955 - DNA, 267 bp, Glycine max
  Peptide Sequence Number=SeqID_229733
atgttgcaaaacactgaaaccagtttgaaaaccatcttggtcactggtaatcaattaccaccaaatggtaatcgattaccagagagtaaaaactctggtaagaacccatgtctatcaagtgtttgttttccttcgatgtgggtactatggttgaattcagtttgttctcagtcgaaagggtgtctgtttgttgttttctgcaaccgagttaagcttaatgggaatgtgaggtatgtttcttttgttagggcaggacctagtttgtag

SEQ ID NO: 112956 - DNA, 688 bp, Glycine max
  Peptide Sequence Number=SeqID_229734
atgacaatgggtatcaaggctccatctgaagatggttcttcagtggtagtaaaagtaagccctacatcagacagacttcagttattagaagaattccctgcatgggatggtaaaaatattacaggagctaaagttttaatcaaggcttttggaaaatgtacaaccgaccacatttctatggctggaccatggttaaaatatagaggacaccttgataatatttccaataacatgttaatcggagcagtaaatgcttataatatggaaacaaaccatgttaaaaacgaattaacgggtgaatacggggaagttccggctgttcaaagagcttataaagcggcaggtattcctaccatcgttgtgggtgaccagaattatggtgaaggatcatcaagagaacacgcagcaatggagccgagacatcttggtgtaaaagcagtattggtaaaatcatttgcaagaatccacgaaaccaaccttaaaaaacaagggatgctgggattaactttcgctaatgaggcagattatgataaaatccaggaagacgacactgttaacttcttagatttagatcagtttgctcccggaaaacaattaacactggaatttgtacatgctgacggaaccaaggatattattatggctaaccacacctataatgatcaacaaatcgactggttcaaagctg

SEQ ID NO: 112957 - DNA, 282 bp, Glycine max
  Peptide Sequence Number=SeqID_229735
atggcattgaagggtggattagagagggaagaaaaacaagaaacaataagcagagaagcttcaatcaatggcaaagaaagaagtttgaggaacaaagtggaggatcccttcacacttttctcccttactcttgaattgcgccagatttcaatggaagtgggtattgctttgaatgaagccccagttaaaggaaagttgagacgggtactccaaggagagagagagagagagagaagtagcatgattggtattattaacctaagattgagtttcatttcatag

SEQ ID NO: 112958 - DNA, 504 bp, Glycine max
  Peptide Sequence Number=SeqID_229736
atgcagtctaggttggaggaagggaaggaccctgctggatttaggactactccctctaggcccttccctttgagacttctgcagttcttcttggcctttttggttattggcctaggtgcttcgtttcttagcatgtacatgattaggcattttggtattcataatgtggctttggttcagtcttcgtttaagccttgctttgagcagccggcaaccttagaaagttggattaggcctcgatccagtttgctgcataccatgaatgacaccgaactcttctggcgagcttcttttgttccaaggatcaagagttatccttttaaaagaactcccaagattgccttcatgttcttgaccaagggacccttgccaatggcaccactctgggagaagttctttagagggcatgaggggctttattcaatctatgttcattcgctgccatcttataatgctgatttttcaccatcatcagtcttttacaggagacagatcccaagccag

SEQ ID NO: 112959 - DNA, 2130 bp, Glycine max
  Peptide Sequence Number=SeqID_229737
atgatgaataggatgagtgggggaattgaagaggacaaggagattagcccaatgtttccaaggttgcatgttaaggatgcagagagaggagggccaaaagcacccccaaggaataagatggcactctatgaacaattcagcctcccttctcaaaattttgcaccaggatcagcatccttgtttccacttccgctcagaaactacacaggccctacatcatctagccacatcagtagcaatcaaagcatccaattttgcacctctagcatgccttctattctggctgagaagagtcaaacctataattccagaaagactaacttaaccaaattcatgcaagatgatttcattaatagtaagaattctctgagaacacttgatggcgaagatacttttataacttgtggttctgcacatagaaaaaactcatcctgtagcatcatccaaaattttaaagatgaagacaaactttctcatagtaatttgagcggttcgcttaaaagtccaaattcatttagaaaggtgaattcacctggtgctgtagacctgaagtcagcacaatatgggaagaaccggatggaggatcatactgaagtgagtcaaaatggtcagaagccagaggaagtgcttcctcactcattagatggttttggtgacatgacagatgcatcattaatctcattggtgaaaggtaagaattctaaatcaatgaataaagagcatagatctttgaaggaagaaaagagaagtattttaatagatagcttgaaaacatcgcaaggtagcagtgtccgtacacatgaagagcttgcagtttttgaggaccaagtaaactcaagggaccatcacattgagaagccaacagctaatgatgtacacaaatgtgctggtgagttagaaattggtagaaggtgcttcctggacaaggtagacatgaatgaagatgaggagacatataggcattctgatgctgtaagtaaagttaactcagaatgtacattggctatggatatttcccctgacaatgttgtaggagctataggtgaacaacaattttggaaagtcagaagaactatcattaatcaacagaaaatctttgtcaagcaagtgtttgagttgcatagactgataaaggtgcaaagattaatagcaggctcaccccatgtattgcttgaagataaccttttacttaacaagccaccaccaaaaacatccacaagcaagaagtttcaatctgactttgccagccaaaaaccatcatcagttgttaaacttgacaataaatctgtgaaggtcaatactgctgagaaggctacaaacagcgcagttgggaagattcccattccttgtatcagcaacacaaccaaaggtcatgctaatcagctgccaaactatggccatcatttaggaaaccctgcattagcctctgcagattcaaattccaaacagtcgccaagctatgtctaccccccacctgggaaccagtggctagttcctgtcatgtccccatctgaaggcctagtatacaaaccaatcatatggccatgccctccaaatgcaggcttcatggcacccatatatggttcttgtggcacagtgagcttcaatcctctaagcaaggatgcttcttcagatgcagctcttgctccaagttctcaccaaaagcttggaatcctttctggttcatctttaccccagttcttaccaccatcattcatgaatcatccatcttctatatcagcttcagctgttgagcaaatggggcaatctaatggtcctgaaaatcaccactcatggggtgaagtcaattctgccatactgttccaaagctcatctaacatgtcaagccccacaagtcaagtgatgccaagaaacatttcaacttatcatcactcactgcaagataaagaactgcatagaagcacagctagcagtccctccaagagggtaagtggagaagcgcttcctttgtttcctttggcaccaacatgttggcaatcagaagatacaaacacacaggttgaacaacaaccacgagtaatcaaagctatgcctcacaatccaaaaacagcaagtgaaacagctgccaagatattcaggtcaatacaagaagaaaggaaacatttgtaa

SEQ ID NO: 112960 - DNA, 306 bp, Glycine max
  Peptide Sequence Number=SeqID_229738
atggagtttgggcttaacagtgtttatgattttttgttggttcagcatagagtgagattggggaagtacaagagagattcagattcatcgcagagggaaggagaaaacttgcaggccgcgtggagccctgatgccaaattaatcgctattcttacatttgcattctttcttcacattttcaaggtccagctctcagataaaagaatacatactggtgggaagcaaccctctgctttgtgcctagctactatttctcttctgcttacggaacaagttccttttgcagtaaaggatttgtcagtgtag

SEQ ID NO: 112961 - DNA, 309 bp, Glycine max
  Peptide Sequence Number=SeqID_229739
atggaggcgacgatgtgcagcaagggaggtgtttggttcgcttgcgggaaacgacaaggagatgacgaagaagaagttgagttgtctgcgcccacttgttgggttgcgtccaatcgcgcgtgcccgactgtccaaccgtgtccggtgacggcggaaacacccgacaccgtgtcacaccggagccgggtccacattcgtgttcggtgcaagtccgatgcgggacacaccgctgaagtgccgcgtccatgcttcttaggtcgcgacagcatgacgatgaagaagcaggacaaaaaaaatcggaaaagatag

SEQ ID NO: 112962 - DNA, 216 bp, Glycine max
  Peptide Sequence Number=SeqID_229740
atgagagatgataaactctttgatgaggagaaaacattgtttttgttgacctcactaccaaggtccttcaaagttttagttcaaatgttgcttgtgggaagttcaactttgaatttggatgaggtggtcgccgctcttaaagaaaataagagaatgatgagaattggaaatgttgattatgaagaccatgcaatagctgtggtggagtctgagtga

SEQ ID NO: 112963 - DNA, 387 bp, Glycine max
  Peptide Sequence Number=SeqID_229741
atgctactgatgttccgcactctggaattggtgtttgtcaaagcttgtgtcggcttgtggggccgcactggaaccctcttcaatggttcccttcctggactgcttcgcggggagcttcttttacctgctcgtacctgccccgatggttggccacctgctggtcggccacgtgtcgtaggcaacgctccagcttttgtagatgagctgaggtggactttggaggtggtggcgggctatggtgatgggaggtctgatgaccttgctgggggcgacagacaccctgtaggactgacagaggcccgtaaccagagctggaaaccccagaacccttttggacttctccgggtccactggatgtcttgcgggcgcgatccctgcaaacagtag

SEQ ID NO: 112964 - DNA, 1296 bp, Glycine max
  Peptide Sequence Number=SeqID_229742
atggatggtcttagttgggatgcctcacaactgtggggtactattcagcaaccaccagtctttggaggaggttactccatgcccctcaatgttctcaatcaaatacaagagatgcagaaagctcaaacaggtcatgtattctcaaattctgaaagagcgatttatcagtccgcaggtgctaccaccacttcctcagagataatggatgtgatgcaaaaacaagacaaaaatctatcacagcatgtgtctaccatgccggtgaaaccaggagctggagccagttggggagaaactttaacatcccaatcatacccatccctatcagtcaatggacctcacagtatgaacctgattagcaactacacgccagatttcaacatggcccaccaccaacaacttgtcaatggctcacaaaatgggaagggtggttgctctcttgagccttttgactgcttgatttcagctaccaacagcaacacagacacttctgttgaagatgatgatgggatctcaatgattttatctgactgtggaaacctgtggaacaacttcagctatggcagtgtagcttccactggtgaatctgagagcaatgcttccaatggtagaaacaaagacatgcagtgtccagtcaatgaagttgatgaaacagtttctcaaacagtagaatcagaggctaattgttcaaagaggagtcatgatcaatctaaaatgatccaagttggtgattcctgcttcagtattgttcagaattcttctccaattgaagaaggtggtttcagacttatctcagataatccaccagaatgcaagaaacccagatgggatatgagttcctcctcaaataatatcaatttccagcaaccaaattcatccatttcttcttccattgaagagcctgatccagaggcaattgcacaaatgaaggaaatgatatatagggctgcagcttttaggccagtgaactttggcttggaggtggttgaaaagctaaagaggaagaatgtgaagatatcaactgatccacaaactgtggctgcaaggcacagaagggagagaataagtgagaagattagggttttgcagaagcttgtgcctgggggaagcaagatggacacagcatcaatgcttgatgaggctgcaaactacctcaagtttctcaggtcacaggtgaaggcactggaaagtctagggaacaaagttgatgcaatgaattgtcctcctactagcattgccttctctttcaacccttcttttcccatgcaaacacccctcagtcacatccatcattcctag

SEQ ID NO: 112965 - DNA, 303 bp, Glycine max
  Peptide Sequence Number=SeqID_229743
atgctgagtttggagtatccatcaactcgggtttcttctctcaaggctgaggatatcgatgccaaatgtccccatgttattactttcgatgtggacacttatgtgcttcaattgacagctggaacgaagcttgtatgttctttcctattcctgtcagttccttctaaatcttcaaattctttgggagaacaaccctccagtctggctagcagaacattgcctgactacgttgagcatgggatagttcagaagcttctcttagttggttgcagtggatctggaacgagcattatttttaaacag

SEQ ID NO: 112966 - DNA, 180 bp, Glycine max
  Peptide Sequence Number=SeqID_229744
atggaagtagcacaggctgtgcacatgaaagggggccctggagatgcaagctatggaaatcaagatgtacacttatctcaacaaacattccgccacaaagactatgagtgtccccaacatattaggtcaaagactaatccgctggtggtgcgtgatactggtccaagaaattttacatag

SEQ ID NO: 112967 - DNA, 213 bp, Glycine max
  Peptide Sequence Number=SeqID_229745
atggtattggagcttctagtttccagcactctcgaacttccccccaaatcggacaaatcgctggagttgtcatttcgggtggagaacttgaacgcgccagagctgcttagctcgtcgacgttgctctgtgaagctcagtgctcaaacgcgatcacggaggtgggagagactgttgtttcggacgctagcttggaaaccctagcttcggtttga

SEQ ID NO: 112968 - DNA, 471 bp, Glycine max
  Peptide Sequence Number=SeqID_229746
atgggggctcttatatgtccactgttgtttgctggaactcccggttatttggatcctgagtacagcatatcaagcaggttgacagagaaaagtgatgtttacagcttcggagttgttcttttggagatggtcacaggtaaaccagctattgcaaaaacacctgagaagactcacataagtcagtgggttaaattcatgcttcctaatggggatataaagaatattgctgactcaaggttacaagaagattttgacacaagctcagtctggagagttgttgaaataggaatggcttctgtgtccattagtcctgtcaaaagaccaagtatgagcaatatagtgaacgaactaaaggagtgtctgactacagaattagctcgaaaatatagtggtcgtgacactgaaaacaatgactccattgagttggtcactctgaatttcacaactgaacttggtcccccagctaggtag

SEQ ID NO: 112969 - DNA, 1962 bp, Glycine max
  Peptide Sequence Number=SeqID_229747
atgatgggaatgttattgcagtttctttatgcattgtttggggtacttactgctgttgttcttgttcaagcacaggatcaatcaggattcactagcattgattgtggtctacctgaagcttcaagctataatgagaagaccacaggcatattttacatttcagatgccaaatttatagatgctggtgtaagcaagagtatttcacctgcacagaagagtactcatctacaacagctagcatatgtgaggagttttcctagtggggagagaaactgttacagaataaatgtaacaagtggtactaagtatttgatcagagctactttcttttatggaaactatgatggtctcaatcagcccccacaatttgatcttcatcttggagctaatatatgggacacagtgaacttccccaatgcttcactcagtgaaatcagtgagatcattcacactccatcactagattacatacaaccatgtctggttaacacaggcaaagggactccattcatttcagctatagaattgaggactttgaacaatgctttctatgtcactgcctcagctgaatcattggcatactatcagcgatatgatttaggttccatcaccaacttaggatacaggtacaactatgatgtttatgaccgcatctgggtgcctcacggattgaaccagtggacacaattaagcagcacactccatcttcttgatatattccagaatgattataaactaccagaagttgtcatgagcactgctgctacaccaataaatgctagtgctccttttcagttctattggggtccagataatgtggatgataaattctacatctacatgcactttagtgaggttgaaattctggcagaaaatgaaactagaacattcaatatcttcatgaatggaaagttattctatggacctctaactcctggatatctgacgacaaataccatatatgcaaaatcagctttgactggagctacaaggtacctattttctcttgctaagacagggacttctactcttccacccatcattaatgccatggagatttataaagtgatagattttccacaatcagaaactgaacaagatgatgttgatgctatcacaaacattaaaaacgcttatggggtggatagaaattggcaaggagatccatgtggcccagtagcatacatttgggaaggtctaaattgtagttatgataacaccccaagaatcacatccttgaatttatcttcaagtggactgaccgggcagatatcatctttcatctccgagctcactatgttacagtacttggatttatccaacaatagtttaagcgggtcattacctgattttctgacacaactgcaatcacttaaagtcttaaacttggtaaataacaaccttactggtccagttcctggaggacttgttgaaagatcaaaggaaggttcactatcattgagcctggggcaaaatccaaatctatgtgaatctgatccatgcatccagcagtcaaataacaagcagccagatgctgctaatcagaataagaacaaaaataatatagttattccggcagcaacatccgttgctggaattttggtgctcgtaataattgtagtaacagctataatctgcggccttaaaaagagaaaaccacaagcatctgtgaacattgatgttcagaccaatactccaagtggatcacaatttgcatcgaagcaacggcaatattcattcaatgagcttgttaagatcaccgatgactttaccagaattcttggtagaggtgcatttggaaaagtttatcacggaattattgacgacactcaagtagctgtaaagatgctttctccatcagcagtacgaggatatgaacaatttctagcagaggcaagtggtcattacttgcaccaaagtttctttgtgaactcaacccaatctgcggttgtcacgacataa

SEQ ID NO: 112970 - DNA, 516 bp, Glycine max
  Peptide Sequence Number=SeqID_229748
atgatgggcatggttttgagtcctaatgttgtgtcattcaatactttaatttctgggtattgtaacaaggggctgtttggattggcgttaaaggttaagtctttgatgggcgagaacggagtgcagcctaatgtggttacttttaacactcttattaatgggttttgtaaggagaggaagcggcatgaggcaaatagggttttcaatgagatgaaggttggggaccgtgagatggtgaggaatggggttaaggctgatatattgactattaatgctttgattttggggctgtgtaaggatgggaagacaaagaaggctgcagggtttgttagggagcttgacaaggagaacttggtctccaatggagtaccttttctgcacttattactgggctgtgtgggaaaaatcagttggcattggcgctgtgtagtgtggtggaagaggcgtctattgcctgaggggtttgacaaagaaaaaatagccatcacccatccagaaaatgagacaagtaactga

SEQ ID NO: 112971 - DNA, 213 bp, Glycine max
  Peptide Sequence Number=SeqID_229749
atgctaaagctatgtcggctctgcgaaggattcgacggtgggggaaaagccgtgttctttcatgagggtataagcgagggtggcgtggcggaacttgttggtgtgggcgagggtgttgaagagggcgtcaaagacgagaggggaggaagagctgcagagacggtaggagaacaacgacgattcgaagagggtgtgaagagagggtttgcgtga

SEQ ID NO: 112972 - DNA, 1473 bp, Glycine max
  Peptide Sequence Number=SeqID_229750
atgacttcaggtttagctggaagttcattggccaaagaagatggcaagccccaaccacttgaaggaccatttccctttccagattcagaatataccggatccaaccttagtataactgttgttggagcttctggagaccttgctaaaaagaagatttttccagcactctttgctcttttttatgaagattggctacctgagaattttcttgtgttcggatttgctcggactaaaatgaccgatgaagaattaaggaacatgattagcaagacactaacatgcagaattgataagagggaaaattgcgaagataaaatggatcagttcttaaaaagatgcttttaccattctggtcaatacaattctgaggaccacttttcagaattggatagcaagctgagagagaaagagggtggaaaactgtcaaacagattgttttatttgtcaatacctccaaacatatttgtggatgtggtgagatgtgctagtcttaaagcttcttcaaaagatggatggacaagggttattgttgaaaagccatttggtcgtgactcagaatcatctagtgagctaacaaagagtttgaagcagtacctcactgaagaccaaatattcaggattgaccattacttgggtaaggagcttgtggagaatctatcagtgcttcgcttttcaaatcttgtttttgagcctctgtggtcccgaaattacattcgcaatgtgcagataatattttctgaagattttggaactgaaggaagagggggttattttgatcactatggaatcattcgtgatataatgcaaaatcatcttctgcaaatactagcattgtttgcaatggaaacacctgtaagcttggctgctgaggacatcagaaatgaaaaggtgaaggttctgagatcaatgagaccactggagcttgaaaatgttgttgttggtcaatataagggccacagcaagggtggtaaatcacatcctgcttatacagatgatccaactgttccaaagggtagtcttactccaacatttgcagcagcagctctttttattgacaatgccagatgggatgggaggaattttggaactgatctggacaaagccacaaatgagcttgtgcttcgtgtacaacctgatgaagctatatatttgaagatcaacaataaagttcctggtcttggaatgagattagacagaagtgacctgaatttgcttttccgagcaaggtatccaagagaaataccagatgcatatgagaggttactcttagatgccattgaaggtgagcgaaggctgttcattagaagcgatgagcttgatgcagcttgggcactattcactcctttgctaaaggaaattgaaaacaagaagattgctccagagctctacccctatggtagcagaggaccggttggagcacattacctttctgcaaagcacaatgtaagatggggagatcttggcgaagactaa

SEQ ID NO: 112973 - DNA, 210 bp, Glycine max
  Peptide Sequence Number=SeqID_229751
atgatggttagggttcatggtggcactagggtcatggtggtggtatggaggcgaggtggtgaggggggttgggttcatggtgacaacgaggtgatggtggtttggattcgtggtaaaggtgagctggtggtggagccatggggttgtggtggtagtaggggtcaaggtggaggtgatgtggtcatagaggttttgggtttgtggcggtga

SEQ ID NO: 112974 - DNA, 756 bp, Glycine max
  Peptide Sequence Number=SeqID_229752
atggaagtagcaaaggtactgcacatgaacggtggcgttggagacgcaagctatgcaaacaactcctttgttcagcaaaagttgatttgtttgacaaagcccttaagagaagaagccataaaaagcctctattgcggcacactccccagaaggttggcaatggcagatttgggttgctcttctgggcaacatgctttaattgtcgtgtcagacttcatcaaaactgtggagaagctttgcctagaattgaaccataaatctccggaatacaaggttttttttaacgatcttcctgggaatgacttcaacaacatatttaagtcccttgacagcttcaaacagaagttgtgtgaagaaatggaaagtgggattggtccatgctacttctttggtgctccaggttctttctatggcaggattttctcaaaccaaagtgtgcattttatccattcctcttatagccttcaatggctatctaagagatatataaaggttcccgagtgtatagacaacaataagagcaatatttacctaggcagaacaagcccatcaaatgttgtgagagcttactatgagcaatatcaaagagatttctctctttttctcaagtgtcgtgcagaggaactagttgaaggaggtcgaatgattttgacaattatgggaagaagaagtgatgatccatctagcaaagatggttgctacatttgggaaattatggctacggctcttaatgatatggtattgcagaaaatttaa

SEQ ID NO: 112975 - DNA, 363 bp, Glycine max
  Peptide Sequence Number=SeqID_229753
atgaagcacattgaaattgatcgccactttataaagaagaaattggatgctagagttatttgcttgtcgtttgtgccttccaatcagaaaacatctgacatcttgaccaagagcctaacaagactcattcttgagcctttagcaagcaagttaggcatgaaagtgtttgtggaagcaatgttttccaagtttattttgatgatgccaaagactcaagtcaagaatcaagagtcaggcaagtttcaagaatcacagagttgttcaatcaaagcaagtttcaagaatcaaagagtcgttcaatcaaatcaagtttcaagaatcaagattaaagtgaagattcaagagaagactcaattaggataa

SEQ ID NO: 112976 - DNA, 498 bp, Glycine max
  Peptide Sequence Number=SeqID_229754
atggcggtgtgccacggtgatcaagtccagatcctgacctcgaggttcgggatcgtgtttgtatttgttcccaaccgagtgaaagaaaaggctgtgttcgttagttacttgggagtggaagatggcaacggtgccgggaaatcaaatgtctttatcaatagtcaaggacttcataaacatctacacttaaatgataatctctatacagcttatggagctgggtcagttgattctgaaaacgggactgctttgctggagtcaaagactgctaaggagacaatcgacataaaggaagctaagcgagtggatcatattcttacatccttgcaacgcaggttaccaccagctcctcctccaccaccatttccagaagggtatgtttcacctctaacagcagaaactgagaaaggcactgaaactcaggaagcagcagaaacgcaagctcctactgctgatcccataattgatcaaggaccagcaaaaagaatgaaattttga

SEQ ID NO: 112977 - DNA, 1521 bp, Glycine max
  Peptide Sequence Number=SeqID_229755
tgcactggagcgcttgggatgaatggagtgttcttgactttgtatctgaaaagcggatacaatttgacacagagcatgagggctgtggcagaatctatgctggttagccactttggtgaagctatcattgatgagcttttcagccgttaccaagaaatcttggctgatcgtatgtccaaggagaaaactaagttcatcaataaaagttcggagtgtcttggtggtgttatcggtgttggggggagtggagggacgtcactcttgtcgtctcccttcgcctctctcccaattggggttggtggcagggcgatggagaatttggttagagaggggtttatacagggtgtttttgacatttcaacaacagaggtagcagattacatagttggaggtgtaatggcttgtgaaagttctcgttttgatgccgtcatagagaataaagtccccttagtcttgagtgtgggagcattagacatgccgtatcctcatcatattaatgaccttgaatttgcaaatgcattggttgatgcatttttagagattaatgagaaaactagtaaagattctactcagcaacaagtagctagtcctgaatctgttgaacaatttcacgaggataatgtttcaaatgcgtcaagcattgcaacaattgtctatacacctagtgaattcccagaagcaaggagaggagctggtgcttggactggtatatctgctaagtttgaagaagctggaggagttgatctaatagtattgtacaattcagggcgcttccgaatggctggaagaggttcattagctggattattacctttttccgatgctaatgctgtcgttcttgacatggccaatgaagttttgccagatgttcagggtaaaggtccaatggctaaagcagaaagcaatttgggtctgggtcatcatcacaacttactggtagtaaagaaggttccagttcttgctggtgtatgtgcaactggtctcttccgtagaatggattatttccttaaacaggtggagtctactggattctctgggttacaaaattttcctacagttggattatttgatggaaattttagactaaatcttgaagaaacgggaatgggatatagcttggaagttgagatgatccagaaagcccataaaatgggtctctttacaaccccatatgctttcaatcaatatgaagctattgaaatggctaaagttggcgccgatattatagtggcccatatgggtctaactacaacaggctccataggtgcaaaaacatctgtttcacttaaagaaagtgtagttcatgtacaagctattgcagatgcagcacataggatcaatcctggtgtcatcgtgttgtgccatggaggtccaatatctggtccaaaagaggcagcatttgtattgaagagaaccaaaggagttcatgggttttatggggcttcaagtatggaaagacttccagtggagcaggctattacaaatacagtcaaacagtacaagtcaatttctattcattaa

SEQ ID NO: 112978 - DNA, 1140 bp, Glycine max
  Peptide Sequence Number=SeqID_229756
atggcagatgccgtgggacagaaaagcttgttatgtgtacccgttgagagtcacaaaagaataaggggtcttctatctgaaccattttccatgacttccctatcagcatttgtcaccaaatttgacaaaatgttatgtggaaggctgcaaaagctagaagaaagcgggaaaagtttcaaagtgttggacctctgtatgaagatgacatttgatgcaatgtgtgacatgctgatgagcataacggaggattcattactacgacagatcgaggaagactgcactgccgtctctgatgccatgttatccattcctataatgattcctcgcaccagatactataaaggcatcacggctcgtaaaagggtcatggaaactttcggagagatcattgccagacgtaggaggggggaagaaactccagaggacttccttcagtccatgttgcagagagactcactcccagccagcgaaaaacttgatgactcggagattatggataatctgttgacattgataattgctggacaaaccaccacagcagcagcaatgatgtggagtgtaaagtttctacatgacaacagagaaacacaggacattctcagggaagaacaattatctataaccaaaatgaagccagaaggagcttcaattaaccatgaagatctcaacagcatgcgttatggtttgaaggtagtcaaggaaacattgagaatgtccaatgtcctgttatggtttcctcgtgttgcacttgaagactgcacgattgaagggtatgatataaagaaaggttggcatgttaacatcgatgcaactcacatacatcacgactccgatttgtacaaggatccattgaaattcaacccacaaagatttgatgaaatgcaaaagccatacagtttcataccttttggatcagggcctaggacatgccttgggatcaatatggcgaaagtgacaatgttggtctttttacacagactcactggtggttacacatacttgcttagaaaagaaggcacacatacccaggctaaggaatggctgcccaataactttgaagtccttaagcaaaagcatgccagaggcataaaagaaggtcgtggagatttacaagacaagtatttcattttcactgcatga

SEQ ID NO: 112979 - DNA, 750 bp, Glycine max
  Peptide Sequence Number=SeqID_229757
gtcgactctagaggatcccaccggctcgatctcggccagcgccgggggacggccctcgcgaaaatcctcccagggcaggtagcggtaccagttgcgccacgcggcctcggcgagacccgccgggcgcagctcgcgcaccagggcgagataggccaccgagagcaggtgcacgccgtgctgcccgtcctcgcggtcgcggtcgccgaaggtgtagagctgctcgacatagccgaggcgctggtgggtctgctgctcgacccaggcccgcaggccgcgctccagggtggcgtgctcgggcaccaacggtccggcgggcagggcgctctcgcggcccttggcctggccctcgacctgcacggtcagcgcgcgcggctcaccgtccgtcgccgcgacgatcacggccacgagccccacggaggaggcattggaggcggcgctgtccgtgcgcgtccccttgtccgccgcggcggcaatcacacccggttgggccgtgctcatgcgttcgtcggccttgcgtccctcgtccccgggcatctcccgccccttcaccgctcttgccggatcggccccggcaccgtcaacggaacgtccggcctcatccgcaggagtcattcgcagagtttccgccggcgcttgcggtcacggtcgccgcggcgggccgatcctgctagaccggacggatcagcgaagggaccaccatggcggccggaccggacggaggacaggcatgagcatcggaacggggtttcg

SEQ ID NO: 112980 - DNA, 480 bp, Glycine max
  Peptide Sequence Number=SeqID_229758
atgagtctacccatggggattatcctttacatgtctttttgggcttctttgtcaaaggtatcagatggaggtctcccaaaacatcatgggttcctcaacttatcccacaaagatcccatgttcttttctatcatagtggttagcatcatggttccctctaccacaagcatatcattcaatacagtcgaagctcgcacacgacctcttcaactcacctcctcgaccttccatcatatgggagctagcaatgacttgtttggtatcaaagctcaacctctaagggttaagcacttgactatgtttagaggaaaagatcttaatggcacaaatgatgtcaaactaagaaagcctgaaactctaactcttcactgtgagagattctccatgaaggaagaagagtttattgataatatgtttggaagactacaagttcttatgaacaatctgaaggctcttggccaaacatatcccaaagcctag

SEQ ID NO: 112981 - DNA, 381 bp, Glycine max
  Peptide Sequence Number=SeqID_229759
atggctagaaccatgctctatgaggactcacttcttaaacacttatgggcagaaatggataaaggaatcttcctagagtatcttgatacatctaaagcctacaaaattttcaatacagggactttagttgtagaagaatccatccatgttaaattcaatgatggcttaacacctaataggaagctattagatcttgaggattatgttgcaaatatgcagattggtccatttgttacaccgaaacaagatgaaaccgaagcaatcaaaaccaaatcatcatccaaagatcttatgacttgtgcccatgtaatagaaataaagcctaagtcagtagatgaagcactgacagatgatggttggatcattgcaatggaagaataa

SEQ ID NO: 112982 - DNA, 423 bp, Glycine max
  Peptide Sequence Number=SeqID_229760
atgtggatagaagaagagggatggatagaggaggaggggataatgaagatagaaaaaggatttctcctattagagatactcagacttaggatgtattcattagataactctgagtctcggccttctggacttagcaggtatggtggtgatcacgcgcttagtgtgggattcacgctaagcacgcctttgggcttctttatgggccttcttcgagctaagcgtgagatgaccgctaagcgaggagacgcactgagtctatcttgtgcgctaagcgagctgtcccaatctccaacttttcttcaatgtagcctctccttcgctctgctgaatactcatgcacctgagatctcagcaagaaatgtcaagcagacgatcctttggctcagtaaattcttcggcacagcaagagacccttcgacataa

SEQ ID NO: 112983 - DNA, 591 bp, Glycine max
  Peptide Sequence Number=SeqID_229761
atgaaggttctggtgcccgtcaagcgggtcgtcgattacaacgtgaagatccgcgtcaaggccgacgggtcgggcgtcgagcttgccaacgtcaagatgtcgatgaaccccttcgacgagatcgccgtcgaggaggcgatcccaggcgcaggagaccctgcgcaccgccctggccatgggcgccgaccgggcgatcctggtcaagaccgatgtgaactgcgagccgcttgccgtcgccaaggtgctgaaggcggtggtcgagaattagagcccgaacctcgtcatcctcggcaagcaggcgatcgacgacgactcgaaccagaccggccagatgctggcggcgctcctcggctggccgcagggcaccttcgccttcaagctcgaattcggcgagggcgcgatcgacgtgacccgcgaggtcgatggcggcctccagacggtctcgctgaagctgccggcgatcgtcacgaccgacctgcgcctcaacgagccgcgctacgcgagcctgcccaacatcatgaaggcgaagaagaagccgctggaggagctgtctccggaggggctcggggatcgacgtcacgcccaaactga

SEQ ID NO: 112984 - DNA, 318 bp, Glycine max
  Peptide Sequence Number=SeqID_229762
gtcgactctagaggatcccaccacggagccctggagcatcggcgaggcggtctcctcgggatgcatccgcatgctgaaccaggacgtgatcgacctgcaccggcgcgtgcccaccggaacgaaggtcgtggtgctcgggtcacgaggtaccagccacgccgcacggcaaggcgcgccggagacgaccggcagcctcggaagcggcgcgtcgaccggaccggagccagacgacggcctcgaccatgcgcggctcgacagcctgtccgcccgcgcctcggaggcgccggagccattcaccgacgacggagagccggatga

SEQ ID NO: 112985 - DNA, 411 bp, Glycine max
  Peptide Sequence Number=SeqID_229763
atgggagccgcccacgccggctcggaagccccggccgggcactacgccaaccagaaggtggtctatcataacggcggcggccccgacggagccgcctacttcaagcgcctgctcggcaacctgcggaaccacgtcgacgccgtgggcaaggatcacgtcgagatccgcgtggtgagcctcggcgacgggttggctctgttccaggccgccgcggaggacggggaactcgccggacgcatcgacgccctcaaggccgcgggcgttagattcctggtctgcgccaataccttgagggagcggaagatcgaccgcggcgctctctatgcggtgggcgaggacgacatcgtgccgagcggcgtcgccgagttggcgcgcctgcagggcatggggttcgcttacatccacccgtag

SEQ ID NO: 112986 - DNA, 1026 bp, Glycine max
  Peptide Sequence Number=SeqID_229764
atgaagttattaggtttacttgtgttggtattgggcagtacaatcagtgccaatggtgcagtttctgaagtttcttggagagaaatcagcaaaatcaatagggaaggaccatacgttggtatagtggttccaaatgcctttgagctgaatcctcttcttcgttcacctagctttgtgccacataacaagtttccttactttgattttgccggaaaacactttcgcattggtgtattggaaaaaaagagggttatagttgtgatgacaggattgagtatgctaaatgcaggcatttctacccaactgttgcttactctgttcgatatagaaggagttgtccattatggaattgcaggaaacgcaaatcctaaactccaaattggagatgttactattccccagtattgggctcacacgggactttggaattggcagagatttggagatggtcctaaggatgcactagctttagaagccagtggagattatagcagaagatttggttatcttaagtttgccgattacaataacaacacaaaacattccaagtccgcgacaaatcttctgaacaacgtctggtttcaagcagaggaaattttccccgtgaatggaactgctgaagttaggcaacatgctttttgggtttcagttgacaaaacttactttgagattgcaagagagctcaagaatgttaaattaagtaattgtgtcaatacaacttgcttgccaagaaggcctattgtggtgagagtagagaaaggggttagtgctaatgtgtttgttgacaacaaagcttacagagagtttttgcactctaaatttgatgtcactgctattgacatggaaagtgccgccgttgctttaatctgtctccaacaaaagaaacccttcattgccattagatcactatctgatttagctggtgacagttctactttgtctaatgaagtggatgtgtttgcctcgttagcatcgcaaaacgctctagatgttgttgtcagatttatctccttattaaatcagtag

SEQ ID NO: 112987 - DNA, 882 bp, Glycine max
  Peptide Sequence Number=SeqID_229765
atggtgaccttcattttgagaaccaccattgccattgacgtttcgaagtttgtcaagggcttgagacagtggcgttgtccaaggcccatcggagcagaggtgattcatgatggtgatctatcgtatcttctcatcaatagagggcttagccatgaagtggaactcgttgacaacagagataacttcggaaaaaaggggctaataagcttaaagggtagcgtgtgtgttcccattccctgtggtgaaaggctaaggaggaagatggtgctttcggaggaggaaatgggtcgtctgtaccgaataaggaagacggtgatgcaaatgcttcgggacaggggttttctggtgggtgacttcgagatcaacatgtcgaagcatgagttcaagtccaagtacggcgagcacatgaagcgcgaggacctggtcatcaacaagtccaagaaggacaactccggcgaccagatctacgtcttcttccccgacgagcccaaggtcggcgtcaagaccatgaagacctacaccaaccgcatgaactccgaaaacgtctatagagccatcctcgtcacccagaccaacctcacccccttcgcccgcacctgcatcagcgaaatctcctccaaattccacctcgaggtctttcaggaggccgaacttctcgttaacattaaagagcatgagcttgtccccgaacatcaggttctcactgacgccgagaagaaaaccttgcttgagagatacactgtcaaggaaactcagctacctaggattcaggtcacagatcctgttgcaagatattatggattgaagcgtggacaagttgtcaagattatccggccaagtgaaactgctggcagatatgtgacataccgatttgttgtataa

SEQ ID NO: 112988 - DNA, 456 bp, Glycine max
  Peptide Sequence Number=SeqID_229766
atgttagctgctaggggaaccttgggatacattgcacctgaagttttctccaagaaccttggtaatgtgtcttataagtatgatatttacagttacggaatgttgttgctagaaatggttggaggaaggaagaatgtagacatctcacctacacagaatttccatgttctctacccagattggatccacgacttggttgatggagatatacatattcatgttgaggatgaaggtgatgttaaaatttcaaagcaattagcaattgctggactttggtgcattcaatggcagccagtaaaccgtccatccataaaattagttatagaaatgctagaaactagagagaaagaccagttaactgtgcctcctaatccatttcaatcaacaacggccaccaatattagtggactcactttggcaagacgacctttaaagttggaagcaattcaagaatga

SEQ ID NO: 112989 - DNA, 873 bp, Glycine max
  Peptide Sequence Number=SeqID_229767
atggcttccaatggtcattttccctcaaatcttccaattctagccggcaagaacttcaacatatggagtgtgcaaatgaaagccttgcttggatttcaagatttgaccgatgtgattgagaatggaatagaaattccaaaagaaggagcctcagattcacagaagactgaattcaaggatctgaagaagaaaggctgcaaagccttggtgatcttgcatcaatgtgtcaatgattctcactttgagaaaatcgcaaatgctaaatccgcaaataaagcatgggacattctgaacaaggcttatgcaggagctgataagatcaagaaggtgagacttcagactcttcgaaggcaatttgaattgctgcagatggaagagactgagaacattgaagattactttggaagattgcaggttcttgcaaattcaatcactagttgtggtgatacaattactaatctgacgttagttgagaaagttttgaggaccttgaatccaagattcgatcacattgtggttgcaattgaggaatcaaaggacttggaatcattatttgttgatgaattacaaggatcacttgaggcacatgaacaaagattgcaagaaagagcaaatgataaggctacagaacaagccctgcaagcacaccatcagtcaagaaatggtggttctaataatcacaaaggcaagaaaggaagagggagattccaaaacacaagaggtagaggaggttactccaaagataaaggcaaacctcaacctgatcaaagaagtggagatagctgcagtaaaagaagtggtagttctagtactcgtggaagaggaggcaaaaagaaatgggataaaagaaatgctgaatgctttaattgttga

SEQ ID NO: 112990 - DNA, 570 bp, Glycine max
  Peptide Sequence Number=SeqID_229768
atgtgcaaaatgcttgtgttggtattcgctgaattgctatcattacccaccgcttcaaaacaaccttgtcctcaagtaagcgagtgtgtgacccgtgccacgaaactgaacggccaaggagaggagtgggtgtgtgacccgcgccgtggagcaatcaagggaggtgttaaagacggtggcggagatgatggtggaggaggtggtgatggatgtggcggcgaacggaatcttgcggtaacggcgggtgttggtgcggagcggcagaggccacggctggatggactggaagtggcggttgatgttggcacggtggaggcacgtgagagcaaggcggaggagctggcgatgtcggtggtggttacgctgaaggagggaacagtggtggcggcggtagcggtagtgatggtggtggtggttgcgctgaaggatgaaacaatggtgacggtggcggtggtgattgcaccggagaaggtgagatgcatggagatcgaaacccattgcgacgaggttggtcatggctgcctcgagccggtccaggctagcgtcgagagggtcggcatctgccattga

SEQ ID NO: 112991 - DNA, 738 bp, Glycine max
  Peptide Sequence Number=SeqID_229769
atgggaaatagtattcgtgatgctttcaataattctcgaattccttgtgatatagagctcgggagatctgccaccatggagttgtccacaaagacgaggaagaagttcggtgatgatggaggattttgggaagattggtatgtcacatacaccgtacatggccaaacttgttccctctgcttagtaagagattatgacaaacacgataatctcaataaggtatccttcattctcctagaccttggacttggatttaggactttatgcttgcacatagaaacaacaagtgaaacaggttttcttcggataaactcgacacaatccatcccgtggacgaagacaaacagaacggttgatgcacgggacgatgttgtggacaccaaggtttacttggatggcaatgcaaaccagaggaatgatcttattgttttggagtgcaagaaaaatagcacggatcatgatgaagagactaatgtggtcactgtggcacactattttgctgatagtagaggaagagcttttaacatagatgatgaattaggtattggcctttcggttgtggcaaaggttcgtgtatccaatggccaattagatataacggtggagggtcctgagcaacaccctgcatctgcattattttgcatgtttgatcaagtcaatagaacagggatttggaagcctaccatgtgccctcattgtgcacaacccagatcttctgcctctgctcctgcagcatga

SEQ ID NO: 112992 - DNA, 1005 bp, Glycine max
  Peptide Sequence Number=SeqID_229770
atggagttactgggtttacttgtgttgttattgggtagtagcatcatggcaaatggtgcagtttctgaagtttcttggagagaaatcagcaatatcaatagtgaagggccttaccttggtatagtggtgccaaattcctttgagcttggtcctcttcttcgttcatctagctttgtgcctcataacaagtttccttactttgattttgccggaaaacattttcgcattggtgtattggaaaagaaaagggttattgttgttatgtgcggattgggaatgctaaatgcaggtctttccacccaattgctgcttaccttatttaatgtgaatggagttctccattacggaattgcagggaatgcaaatcctaaactccagattggagatgttactattcctcaatattgggcccacacaggactttggcattggcagaggttaggagaagtaaatgtatccggagatttcagcagagactttggctatcttgagtttgccaattacaataactgctcaaaagatttcaagtcaaatacaaatcttttgaacaaagtgtggtatcaaccagaggaaatttatcccgtgaatggaattcctgaagctaggcacgagattttctgggttccagttgacaagacttactttaaaatcgcaagcaagctcaagaatgttaagttggaaagttgtgtcaacacaacttgtttgccaaggaagcctattgtgacaagagtagagaaaggggttactgccaatgtgtttgttgacaacaaagcttatagagaatttttgtattccaaatttgatgcaactcctgttgagatggaaactgctgctgttgctttagtatgtctccaacaaaagaaacccttcattgccattagatcactatctgatttagctggtggaggttctgcattgtccaacgaagtagatgtgttttcctcattagcatcccaaaatgcatttgaagttcttgtcaaattcatctccctgttaactcagtag

SEQ ID NO: 112993 - DNA, 741 bp, Glycine max
  Peptide Sequence Number=SeqID_229771
atggagggtgtccccggtggtgcagtcgcaggcggcgagcgcggcgacggccggggcgcacacctcggggtggccctggcagcagtcacgcatgaggaactggacgaggtcggacaggccggcgtaggcggcgctgtagatgaccgacttgccctcgcgccgggaggtgatcagcccggcgtgcgagagctccttcaggtggaaggacaggttgttgccggcgacgttcaccgtctcggcgaggacgcccgcggcgaggccgcccggaccggcggtgaccagggcgcgcacgacccggagcctatgctcctggccgagggcggcgaaggcggcgagggcttgccaggagttaagcgccttggacaagccccagcagccgttcgccgacggggtgccgaacctctccgaggcgcatttcgaggtgccgaccgaggaacggatggcgccgccgacgccgctcgaccatgcgcctcgattcctcgtcctctacgggtcgctccgggatcggtccttcagccggttcctggcctacgaggcggcacggctgctggaggcgatgggcggggaggtccgcatattccacgcggacgggctaccgctgcccgacgacgcgcccgtcgaacatccgaaggtgcaggaactccggcagctctcgatctggtcggaggggcaggtctgggtcagcccggagcggcacggcaacatgaccggggtgatgaaggcccaggtgggatcctctag

SEQ ID NO: 112994 - DNA, 616 bp, Glycine max
  Peptide Sequence Number=SeqID_229772
atgctcaaaaaggagggcggcgggcgcttccgcgccttctcggccggcagccgaccgaagggcgagccgcactcgctggcgctgcaggtcctgcgggaaagcgactacccgacggagggcctgcgctcgaagtcgtgggacgagttcgccggtcccgaagtccccgtcatggatttcgtcttcaccgtctgtgacaacgccgtttttttttacgtgcccgtactggccgggccagccggtgacggcccactggggcatcgaggaccccgccgcggcggagggctcggagatggagcgcaagcgcgccttcgtcaccgcccagcgctacctcaagaatcggatcgcggccttcgtcgccctgccgctcggcagcctcgaccaggtcgccctgtcgtcgaaggtccgcgagatcggccagatggccggcgcgacctcggcccgcccggaggtcgcgtgatggacgtcgtcatctaccacaaccccgcctgcggcacgtcccgcaacaccctggcgatgatccgcaacgccggcatcgagccgcacgtggtcgagtacctgaagacgccaccgaaccgggcgctcctcaagcagatgctcgcccgcgcgggcctctcgg

SEQ ID NO: 112995 - DNA, 351 bp, Glycine max
  Peptide Sequence Number=SeqID_229773
atgggcaatggttcaaagatgaaggaatggggatcacctatcaagatgaaagagaacacatgcaaaggttcagagaagaaggaaggagaacatgaggacggaggaaaaggctttcttagcacctccacgaaagagaacacggggtatccatggatacctatgaatatttcttataatataaaaaaactaaaggaatatcacttccaaatagtgcgacatttcttgaagatggacccaacaaaatggaatctggaagtgaagtttggcatgttggagcagtggcttttcaataaggcgagtgcaaatatcactaccatggagacttcgtcattcataacctaccatcattag

SEQ ID NO: 112996 - DNA, 393 bp, Glycine max
  Peptide Sequence Number=SeqID_229774
atgagtgggaataacgttgtggtgtggcatatttcacttttgcagactgacacggcctctgtcttgttagaagctattgggtatatcagattccttcagagtcaaattgaggctcttagcttaccatacttgagcggtggatcagggaacacgaggcagcaacattctgttcaaggagagaagacttgtatattccctgaagaccccggtcagctgctggatgaaaactgcttgaagaggaaagcagctggagagccggatactcaagaagaaccaaagaaggggctgaggagtagagggttgtgtctggtgccagtgtcatgcacactgcaagttggaagtgacaatggagcagattattgggctccagccctaggagggggctttcgttag

SEQ ID NO: 112997 - DNA, 324 bp, Glycine max
  Peptide Sequence Number=SeqID_229775
atggtggaggaggtgaaggaaaaaaaggaagaaaaggctcaaaaagtgcgtgcacaggttgatcatgttgtagattcactcttaaaggtgcaactcttgaatgaagatgcaattggcgagtcatctacaaaaacaaatgataaagggtcaatgaaagtagtcaatagtaagggagtgaagaagggtatgagggagataattaaggaaggtctagacctaaaagaagttaaggagagggctctttcaaatcataaggagcctattaaaaaggcgaagaagggaagaaaaacaaaagcagaagacactatagtgcaacgaaaatag

SEQ ID NO: 112998 - DNA, 939 bp, Glycine max
  Peptide Sequence Number=SeqID_229776
atgttgtctcatgggggttgtgaatatttagaaaacaagttgatcgatgagaagagaaagaaaaaattagaggaagctgctcaatccggaaacactgacactgtgattgatcctccatctcccatcagacgacacgtgaagtggaagatgacccgcaccaagaaaattgggcaaatgatgtctaaggcatcaaaggaaattgctgagaagaatgatgtactgactgttgctattgggcgaccagaacaccctggtcttgtgcgtgctgctagagctggtgtcacgatcaagcaatactttagaccgactccaaggacctctcacacgtcttccttcattgctcccgaagagctggagcagctgacgcaaaaaatcagagaccaactagaggagtcgatcacagaaaaaatgcaatcacagggacttgcattgcctcctgagcctgaggttggtccttcatctgctcgtgtcagtacaaaggagagttatgttgatccctcagggaacgatccagagacgggtgactcagaaaaatatgggttgttatatgagggatccacaatcgttcacaaaattcatttgttgcatgatcaagtcaaggttggtgttgaggaggttagagatgcagattttcccattcctgtacccactgaagaggttaagttagtggggcaggcacttaacaccttccttgcttggccgacacatcttatcaagcgtttatcagaacatggagctgtgggaccggtgaaacctgcagatagaccggatcatgatgtagatgatcccctatatctgatgacattgatcatcccacaactttttctgaagtcattgcaggctatgactgagacaaatatgcgagtggggaattccaatgtgtatggattcctcgagccacagtccatccaaagatatgggcaatcacaatttgaataa

SEQ ID NO: 112999 - DNA, 423 bp, Glycine max
  Peptide Sequence Number=SeqID_229777
atggctgccaatttctggacatcatctcattacaagcatcttctggatcaggaagatgtggatatggtgaatccacttgacaaggaaaagggtatcacactggaggattttaagcttattaagatgcacatggctaattgtaagatctttgttatgtcttctttcaatctctaccatacttgtatttatgcaccttatgccactgctttgttctctaaccttgcgcttttttggttgttgcttgtaactatcatttgtatgcttgttgatgtggtgtcaggttctgaatttgtagttgctactgacatccttagatattttgaaattggctcaacaagtaaaagtgaggcagagtccgcaatgcatgaagggaaaagaaaggaattgccacacttcttgaggccaaaggcgcctggtggataa

SEQ ID NO: 113000 - DNA, 213 bp, Glycine max
  Peptide Sequence Number=SeqID_229778
atggaaaagaggattctaaggaggatacgtctagcaagaaggatccatcaatggaggaggacctatctatggatgagagggcctagtgacggagctggagctgatggaggaagactctacataggattcttcttatggatcttgttagaaggccgtgtacatcttactatacttattttgagtacagttgacttgagcttgggtataggatga

SEQ ID NO: 113001 - DNA, 654 bp, Glycine max
  Peptide Sequence Number=SeqID_229779
atggcaaatccttctccaaaaatatcttcaaaccttgaacttccaaaaacaccaaaaaattctgaccttccaaaaataccaaccataagtggaggtctagccttgttttggaaggaccctttcaattgtcatcttcttaacttctcctccaacttcatcaatgtccaagttcatcatattggtcacccatcttggagacgcgctggggatttcaatgatctcctatcaaatgatgaaaaaattggccttcttgatcatccaaattggctacttaaaggcttcaaagaaaccctcttagattgcaatcttcatgatctccccatggaaggataccagtttacatgggctaagcgcaaagggactccctctgatgaggacatgaccaagagcaagggcaaggatccacttaaaggacttggagggcctatgacaagggctagagcaaggaaagccaaggaagctcttcaacaagtgttgtccatactatttgaatacaagcccaagtttcaaggagaaaagtccaaggaaaaatgggcaagattggtgaagtgtagaatttatgaactcgctaagccacgccatgtgttgggcgagccatccgctaagcgcactatcctccagctaagcgcgcagaaaaatctggaagaaggatga

SEQ ID NO: 113002 - DNA, 243 bp, Glycine max
  Peptide Sequence Number=SeqID_229780
atgggtttatccctcatagagatagcaaccctcataggaaaattcaaaaacatgcaaggctatccaacaaaccttcacacgctcttctccacctttggccatatcgcacatgtcactatcacagagccacgtgcggagccgcggggctcacagtcgagcggcgggaggatggagttggggacaaaggcttgtagtggccgcgaaggtggggccgaagttgacgacatcgaggaagcagggtga

SEQ ID NO: 113003 - DNA, 444 bp, Glycine max
  Peptide Sequence Number=SeqID_229781
atggagcaacaaaaactcagatttttgctaaacttcaaggctcggaatgtcatgttgtgtgctctttcagaaaaaggaatacaccaaggtacactgtttcagaggtgccaaacatatgtgggacactctggttgtaacatacaaagagaacaaatcttgagaagttcatccaaagcacttaaagttgatgattcatctaatgatgaatttgaagaagagttagatgaatatgagcttgcctttatctctcgtaaaatccataagatgtggagaaaaagagtaggtccaagtggagaaacttctcaagaagaatgcccagtgaaaaaaaaggatagagacaaaagctccatagttttctatgagtgcaaaaagcctagacatttcaagtttgaatgcccaaatctggagaaaagtcaagataagaagaaatacttcaagacttaa

SEQ ID NO: 113004 - DNA, 225 bp, Glycine max
  Peptide Sequence Number=SeqID_229782
atggctattccttcttgtgtcaacctcgactcctttttttctgtgcaaattaggcttaaaaagggcattatgaccttgaaggcgtgcttagcgccattctcgcgcttagcgcgaaagagacaaccgccttgcttagcgagctacatacgcgctaagcgcatgctggcatggacgaactctcttcaggcttatccatatgcgctaagccactgctgtctcacttag

SEQ ID NO: 113005 - DNA, 663 bp, Glycine max
  Peptide Sequence Number=SeqID_229783
atggctccctgtaagagaaaagccacagcttcattgtcccaggccagttatgaatcatttgtatcaagggatgcctgggaccgttacgcagataacatccttggccggaacattctttcggagaggaatgacaaagaaccaaagcatgttagggttcgagggcacttgattaagttcgatgcggactccctcaacaccttcttgaagactccagtggtcttggagcaaggggagagcttaccttcttactctaggttctacaggttgaggccagaccctcaagagctggcagcccgactgtgtatccttggaagaggatttgttcttaacattgagggcttgccatggaagctcttgagcaaggatcttacaactctggcgcagacttggagtgttttatcttattctaacctagccctgacttcacatacctctgatcttaatcttgacagggctagctccaacagccccagttcttccaggtccctccactcagagctcagagcctttcatgtctatgctgcagagcctgcaccagggccagctcctgattatgcagagcttgcaagatgtggtccagcagtgactagttatgagtgtggaggagtttctgcagaaggttgtctggctaggagtccagccttctcctttggaagggggtga

SEQ ID NO: 113006 - DNA, 909 bp, Glycine max
  Peptide Sequence Number=SeqID_229784
atgaaacgcaaaaattttccagttggatttaacgtttatttgagtttcaagaaaaagctacctgtcattttatctcatgacttagctcctctgaagtgtgttgagggtactgagataattgtagctcttgtttgtaacttttcgggttctcggaatccatcagctgtaaggctcaatcattgggaagtagaaactctatttcatgagtttggacatgctcttcattcactgctttcaagaacgaattggactggtcatcgaaccggtggttcaagagtcaatggttcaactgaggactaccagcatttttcgggcaccagaacggttcttgattttgcagaaataccatccaacctctttgaatactatgcatgggattatcgagttttgaaaaaatttgcgagacaccattcaactggtgaagaaataccacagaagttggttgagtcaatgcagggtgccagagatatgtttgctgcaacagatctgcaacgtcagatcttctatgctcttgttgaccagacactctttggagagcagccattccctcatggtgatattagttctgttgttgcaaaactgaaaagagagcacactagttgtgaacatgtggaaggcacacattgggaggcccgatttagtcatctacttaattatggtgcaggttattatagctatttgtatgcaaagtgttttgctgcaaccatatggaagaagctgtgccaggaggatccactttcacccactacaggatttgctttaagaacaaaattcttacagcatggaggagccagagaacctgctgcattgttgaatgatctagcaggagacgggatatataggtattgtgatggagggataatgcctgatatttcatgcctatgtgatgaaatgaagctgtttgaataa

SEQ ID NO: 113007 - DNA, 201 bp, Glycine max
  Peptide Sequence Number=SeqID_229785
atggtgatgacaacggtgacaataatagtagtgaatggtggtgacagcaacaataacaatgtgatggtgacaataaagaaaattcatcaccatcccatacagaacgtaagcgaaaaccttttttccccaaaacctgcatttaaaaaagataagacgttcctcattggattcctcttatcacacggattagcatactgttaa

SEQ ID NO: 113008 - DNA, 429 bp, Glycine max
  Peptide Sequence Number=SeqID_229786
atggtgggaatcgttatcttggctaaacacagcaggtgtcttcctggaattatcgagagaaaacttccttcaacactcctattgcaatctcaatggtatcagactataatgaaagcaaacttgatggatttctttgatctgatgatgtggtaccataggaatagggtagtcttctcaaacgaaagcttcaacgcttcactggccacctccctggcttgctcactgaggtggtctactagctgccttacttctgtggaagaagttgcctgttccccgatttgcgttgcctccaccagctactgtaactcagggattcttgggggtgtctgtgctagacagtcccaccatatcgcgcacccaagatatagcgctggtaagattaagctgaaaacttccatgacttgttgcccttgccccgaccccgcctaa

SEQ ID NO: 113009 - DNA, 418 bp, Glycine max
  Peptide Sequence Number=SeqID_229787
gagttggggccgacccgacccaaccctacccggttattcattaaataaaaagactccatccctacctgcgtcgacccaaccctacctgcgtccctccaaaagagcttacccagccgcacgcacgaacgaaccgtcgcgacgagctccgacaccacccaacagcctacctgccttcagcctacccagccgccgccgcgacaccacccccggcagcacgcacgaatggcggcgacgagctccgacgacgagccccgacaacgcacgaagaagaagacccgcgaaggaagaagacgaagtcacgaagaagaagaagacgcggacctcttttaaatggctgaaccatcatccgatgctgctactgcaagtgcaacgaggaaaaataaggcagacccaggctggaaatattgtcattcactag

SEQ ID NO: 113010 - DNA, 342 bp, Glycine max
  Peptide Sequence Number=SeqID_229788
atggccaactgctgctctaacaatttgaggactaccaggaaaaacgccagatatgcagaagtctttcgatataaaggagatgagattaaatcaatatatggttgtattatgtgtttccaacagataccaaaaaacattttattagaggtgcttggaccttccaaagttttcaatgaagttatcaagaaaataatcaactcaactgtagctgaatacgtggagaaggagtgtttgatagttagcaaggaccttagagttgagcaaagctttgaagatcttgaaactacttttgaggaaggagaaaaattcagctttgatgttgtacttgagcttcaaaaataa

SEQ ID NO: 113011 - DNA, 537 bp, Glycine max
  Peptide Sequence Number=SeqID_229789
atggcttcccataagagaaaagccacaactttagtgtctcaggacgattatgatagatcaagatttatatcacaggaggcctgggaccgttactcagataatgtgcttgccaagaacattatgccagaaagaaatggaagcattgatgtggcaattgtgaaggaattctatacaaatctatatgtccttgaggacaagtctcccaagcaagttagagttcaagggcacctgataaaatttgatgctaattccctcaacacctttttggagactccaatggtcgtggagaaaggggagagcttgccctcttactccaggtttgctagactgaggcctgatcctcaggagcttgcaacccagctgtgtatccctcgtaggggatttgttcttgatgccgaggttctgctgtggaagctcttgaggaaagatcttaccaccctggcccaaacctggagtgttctatcttattctaacttggccccgacatcccatacttcttatcttaatctggatagggccaagttagtctacgggctt

SEQ ID NO: 113012 - DNA, 339 bp, Glycine max
  Peptide Sequence Number=SeqID_229790
atggatgggttgtccctgtgtggttcagactttgtaaaaggattttacaaagagaatggaaaatctcaaataactgaggccatttgtctaacatcagagcctattccacctgagcctttcatctttgaggatctggtcattgcacaggaggatgttgcagcagctaccccacaggtgactccacagcctctaccagagccttccatttcagtgttggacatgtctttcgctcagactgagccatctgcaccagtgttagacctgccctttcctcaggattcatcagcaggcactcctacactggacctgaatgagcatgctatggaccaggatcactga

SEQ ID NO: 113013 - DNA, 921 bp, Glycine max
  Peptide Sequence Number=SeqID_229791
atggcttccgttcccggatctcgatccgccggcaaaattgtccgcacgcgccggagcgcagccgcaaggagtcgcaccccctacgaccgccccgcgccgccgccgccgccgccggagcctccgagccctaattggatctctcgtttcgttatctctccctcgcgtttcattgcttctggcgccggaaaaatcttctcctctgttttggatctcgataattctccttctgattcttcctctgctacgtcttctcattcctcttccgctaacgattccgatgctgaggaagttggtactttcgatgatgaaaatgataacccttctgaaggtgatgtggcattgagcaaggggctccagccatgtgttgggaatagcaaaagcaagcatatgattgagcaactacttatgaaggagtcattctcaagggaagaatgtgataggctgataaaaataataagatcaagagtggtagatcctgcaaatgatgatgatggggataagaggccaacggatatacccaacaagatttttggaagtggtactctctacagacttaactcagttttaacatattactgtttcctgaccatggagtctaattatttcttagatacagattcacctgagctccatagtgctgccattatggaggcaaagaaatggctgcgggaaaagaagtcaggtttagatacaaattcagatataggttatggaagtcctagtttgaatttggttgcattaccacaagaccccaaagatgaaggatcaccagtggatgtggctaagttgtatatgcgcacacgccctccatgggcatcaccttccatagaccatactaaacctcaaacaccatctggaattcagctatttaaagaagaaacaccatatctatttggcaacaattctacaccaccctccaag

SEQ ID NO: 113014 - DNA, 639 bp, Glycine max
  Peptide Sequence Number=SeqID_229792
atggcaaatagtgagtcagtggtatctgattgtcaatacaagctgagttgtccgttgtgtagaggtgatgtttttgggtggattattgttgataaagctcgtgtgcatcttgatgagaagaagcgttgctgtgaagaggagcaatgtgcatttattggaagttactccgagctacaaaaacatgctcaactggaacaccctcatgcttgtccatcgaaaattgatcctgtccgacagcttgattggaaaaattttcagcagtcatctgagatcatagatgttttgagcactattcattcagaaattccacggggagtggtcttgggagattatgtgattgaatatggggatgatgacagtgcagatgagtttgaggacttccctggagatgaaggtaactgggttaatcgccatttaagttctgatacttcaaattctgatgaaggttctgtagcatctgtagagtatggcgagtataggctagatgagattgatgatgattttgttagtacaattggccacttgagaggtggaagtggttttcgcaggaagcagaatgagaggaagagatacactcaacatagaaaccagtgtgatcttgatgcagctggtgtgacaactcgcaaaggttacatttag

SEQ ID NO: 113015 - DNA, 516 bp, Glycine max
  Peptide Sequence Number=SeqID_229793
atgaatggtgtagttgaggctgccaataagaaaatcaagaagatcattcaaaagatgacagtgacttatagagactggcatgaaatgctattgttcgcattgcacgattatcgaacttatgtgtgcacttctactggggaaaccatgttttcgttggtgtacaggatggaagctgtcattactttcgaagtaaagattccttctttgagggttctttcggaagcggagttggaggaagtggaatgggcccatgcatgttttgaccaattgaatcttattgagggaaagagattggatgctatcaatcatgggaaggtgtgctcgaataaattcaacaagggaaaccttgttttgaagaaggtgtcacatgttcagaaagatcttcgagggaaatatgaaggaccttttatggtgaagaaggctttctcggatggaacattgatactcacaaaaatgaattgtgaaaagctacctccgcttgtgaattctgatgacgtcaagcgatactatgcatga

SEQ ID NO: 113016 - DNA, 669 bp, Glycine max
  Peptide Sequence Number=SeqID_229794
atggctgataatcctgatctttgcgtgtcagactcatgcaaaaagaactttgttacaccactggttgcatcactttcatcagcacaaggttataaggaattccgatcagaggcacaacttctagtgattgttcatcatagaaatttagtatctctcattggatactgtggtgaaggtgaaagtaaagcattgatttatgaatacatggccaatggaaatctccaccagcacttatcagatttgaagccttccaacatattactagatcaaagcatgcatgccaagattgctgattttggtctatatagagcttttggcagccatattgattctcatatatctacactaacagctggtccactaggttatgttgatccagactttgggataattctgttcgagttaatcactggccaacatgcaatatcaaggacgcctgaaaaaaatattcacatccttgaatgggttattcccatagttgaaagaggagatattcataacattgttgatccgaagttaaaggaagcattcaatgtcaattctgcatggaaagctgtagagattgccttgtcttgcattttaccaactgcagctgaaaagaccagacataagccaaatattgccagagctaaaggaatgcctatcttcataaatggatcagacacatga

SEQ ID NO: 113017 - DNA, 318 bp, Glycine max
  Peptide Sequence Number=SeqID_229795
atggcaattcatcatcaaatacttaagaaggattttattgtttttcctctatctggtggcatgaatgtgtgtgtcgcatgcaccgtagatggtgttggagttggtgaagaaattaaaattaaaagtttagaagaaggagctgcaaatgagaccatcccatgcatattgctttggaacacatgggtctccttgccaattcaatctagagatctggcgtgtggcactgatgatgtcaaacttaacagagcctggacttgtttgctgaggagtaatggtgactggtttgaggtattgaagaaccaaagggttcatagttaa

SEQ ID NO: 113018 - DNA, 423 bp, Glycine max
  Peptide Sequence Number=SeqID_229796
atgtatgggattgttgtgttgggtatttataggggttctgtgggatcaattgaagatcaagcatgccgatatcttgaccaattttcaccatcgcatgcatcaagcaacgtttccagcaaaaggaaagaagaaggtccaagtttgcgttggagctctgacaagtcggcgatcacagatgagagtgctttggcagtaaatttcgaagaaagagacaaagatggtggggaagagggcggcggagataagggacctgtcccgctgcttgcgattgtgaaccctgaccaatttcataactcgccggaagactgccatgatctacagtggtgtgtggttactgattttgtcaacggaggcaacacggagagagacggtgcatccaggagcagcgacagaaaccaaaccaaaaaaatgctgacttgttga

SEQ ID NO: 113019 - DNA, 1170 bp, Glycine max
  Peptide Sequence Number=SeqID_229797
atgtccaattctgaacacaacatcatcactggacatgctggctatgtccttgaagatgtccctcatctatctgactacatccctcacctcactgtagttgtacataagaatagcccaagagagactcattttcgccgtgctgggccgcgtcagaagggagggtatagaggtttttattcttgcaatactattccattgacgccaaaggttgtgaatgacatccacaaacgtggtggaaccatccttggtacctctcaaggagaaggaggcaatgatacgttaaagattgttgatagcatccaggatcggggaattaatcaggtttacatacttggaggagatggaactcagagaggggcttctgtgatttttgaggaaattagaagacgtggcttgaaagtttcagtggttggaattccagaatcggttgataatgacatcccggttattgataagtcatttggttttgacactgctgttgaagaggcacaacgagccataaatgctgctcatgtggaagcagaaagcactgagaatggtattggtgttgtcaagttaatgggtcgtcacagtgggtttatatctatgtatgcaactctcgccagccgagatgtggattgttgcttaattccagagtcacctttttacctcgagggtccaggtggactctttgagttcattaggaaaagactcgcagaaaacgggcacatggttatagtaatttctgaaggtgcaggtcatgagcttatttcagaaagcctatctgctacaaataagcaggaagcttctggcaacaagttacttcaagatgttggtctgtggttatcccagaagattaaggatcacttcacaaaaagtcaaaagatggatataactctgaagtacattgatcccacctacatgatccgtgctgttccaagtattgcatctgataatgtacattgcactctccttgctcaaagtgctgttcatggtgcaatggctggatacacaggcttcgcagttggcacggtcaatggcaaacatgcttatattccattttatcggataaatgaaattgagaagaaggttgttataactgaccgcatgtgggcaaggttactgtcttcaaccaatcaacctagcttcttgaatcctaaagatatcactacacatcaaacgggaaattaa

SEQ ID NO: 113020 - DNA, 495 bp, Glycine max
  Peptide Sequence Number=SeqID_229798
atggatgggtcccagacattccttattgaaattcaggcactttgtctttctggttcaacaggttcaaggcaagttcatgggatccaactaaaaagagctgatatgatcatatctgttcttataaagcaagcaggtcttcctctccaagaacatgctgtattttttaattttgttagtggattggcactggctgaaactgcaggagatcttgctatagctgcagcaatttgcagctgttgcttggaaatccctattctaaatgacattgcattcattggtgaaattgaccttggtggtgagcttcgcatggttcctagaatggagaaaagggtatataccgtcacgaaattgggtttcagaatgtgtatagtacccaaggtggctgaaaaagctttgggaactgaaggttttgaaaagatggaagttgttggttgcaggaatctgaaagacattattaatactgtatttcccaatctaatgagaagaagccagtga

SEQ ID NO: 113021 - DNA, 948 bp, Glycine max
  Peptide Sequence Number=SeqID_229799
atgaatcttaaacaaaaagttgccaagttgcaagatcacgaatacaaagcttctgctaacgaccaagagattcagataaggctgaaaaggctaaaggatcttgagtgtgagtcagaacagttgaggaaatctaatttgagactgcagatggacaattctgacttagctcgaagattggattctactcagatccttgcaaatgctgttctagaagaccctgagagtttagatcctgaagagttagtttatttgcggtggataaatgcttgcttgagacatgaactacgaagttatcaacctccacctggtaaaacagttgcaagggacttgagtaaaagcttaagtcctacatctgagaagaaagccaagcaacttatacctgaatatgctagcaatgaagggcgagggagcgtttctgatatggactctgaccaatggtcctcttcccaggcttcttttctcacagaccccggagagcgtgaagactattctcctcttgataatgcatctgaggtcaaagctaacaacacaagaaagtcaaggatttttagcaagcttatgaggttgatacgaggcaaagacagcaatagcaactcttcacatttcagcttgagtatatcaactggaaatgatgctggaactgagggtcctaggagtgagtatgcaactccctctgccacatctagaacttcttttgattttaaccggacaatgagtttgaaggaagaaagtgggagaaattcagatagccataccccaggaagctccaagaatttcagtgcaaggagaagaagatcagtagatttcaaaaactgccttgattctttctcagaatcttctggcacggagaaatctaatttggtgaaatatgctgaagctataaaagattccagtggaaccctcaaacatagaacacatagaagatcagcatcatatagttcattttaa

SEQ ID NO: 113022 - DNA, 306 bp, Glycine max
  Peptide Sequence Number=SeqID_229800
atggtgaggaaaacttcatcaccgtataaattgaattccaatgacctgagaattggacaaggaaaatccatgtcgttagcattttgctccggcacctgctggtacgttgttgatgatgatgatgaagaggttgaggaagacacagattcgaatttggcgaatgtgttcaatgctaggaacaaccgaattctcgttgttggtgggtttgtcagtgttgaggttaacgtggttctcagagaaagaaatgggagtggcgtgcaggggagaatggccatgtataacgttggtgttgttgggttttgctga

SEQ ID NO: 113023 - DNA, 1296 bp, Glycine max
  Peptide Sequence Number=SeqID_229801
atggctttcaaaagcacaacaaaccgtagtcactttcgtattgtaagggaagtagaagcaattggtggaaatataggagcctcagcctctcgggagcaaatgggttatacatttgatgcattaaagacctatgctccacaaatggttgaattactggttgactgtgtaaggaacccagccttcttggattgggaagtcaatgaagagcttcggaaggtgaaagcagagcttggagaactctctaacaatccccaaggcttgcttttggaagcaattcactctgctggttattctggtgcattggcttttcctcttttggctcctgaagcagcactgaacagattggacggccccaatttagaggaatttgttgttgagaattacacagcacctagaatggtacttgcagcatctggggttgagcacgaagagcttctatctattgctgagccacttctctctgatctaccaaaggttccccgtcctgaagaaccaaagtctatctatgttgggggtgattttcgccgtcatggtgaagggggtacacatgttgctattgcttttgaagtgcctggtggctggcaaaaagagaaagatgctatagctttaactgttttacagatgcttatgggaggaggtggatcattctcagcaggggggcctggaaaagggatgcactcaaggctatatcttaatgtgctgaatgaatatcaacagattcaatctttttctgcattcaacagtatcttcaataatacaggactgtttggcatctatgcaagcactagccctgattttgtgccaaaaactgttgatatagcagccaaagaactaatagcaattgcttcccctggacaagcatttctttcgatgacagttacacaggaactgatgttattagactcagtacttagtgaaaagcttacatttacctcatcccaaagagatgtgtggggcctaaaacctacagcatgcgagaccccacttgaccaaccccttgggttcacagttccctttatacacatcctcatagtgttaggaggagtgtgttgccagcacttctctgctgaactctgtctgatgattgcatcagaagatataggaaggcagattttgacttatggagaaaggaagcctgtggaacagttcttgaaggccgtagatgaaatcacgttgaatgatatcactaaaattgctcagaagattatttcctcacctttgacgatggcatcatatggggatgtcatgaatgtgccaagttatgaatctgttaacagcaagttccatgcaaaatga

SEQ ID NO: 113024 - DNA, 1005 bp, Glycine max
  Peptide Sequence Number=SeqID_229802
atgagggcaatccgggtttcgccaatgtttcttttgcctgcactagcagctgctgcctatacaacatttgtcagcttcacaaggatgtcctgcaaatgcggatatcaatgctggatcagtgatcgcagggataagaaaattcttgaaaggcttcgagctgaaaggcaagaaaaaattgatgagctcaaagaaaggacaaattattacactacacaacagctcattcagctatacccatgtatatactttataaagtgcattactgaaagagcagctcttgatggcaactgtttgcgactgagatatgatccagacccagctgcaaaagcagctgctgcaagtgttttagcatctaagttgggtgcagattctggtttgaaagtgtacctgggagatgaatccagtcccagtgctccactggggaggagcaatgacattgaaattgtgcagtcctctggacttcgaaatcggagacaacttcaatctagatccactagtccagggacaaccacaccaaattttgctgatcaacaactagttggtccaggaggaatcgatcaaactcagacttttgagctcaataagcctgttgttgttgaacatcacttacctcaaagttcaaccacacaagatggaggatggattgcacgaattgcagctttacttgtgggcgaagacccaacacagtcatatgcgctcatatgcggtaactgctatatgcataatggtctggctcggaaggaggatttcccagttatcacatactactgcccgcattgtcatgccctgaacaaaccgaagcaatcagatgagcatatctctggtcttacttctccaaacacgggggggactccaaacacagatgatggtgtgacggatgcagttaagaatgctagggcttctgcagccgagagtgtaatcacaagcagtagtcccggaagtgcttctagctctgagattgaggaagtatcagaaagggcaagcgtggatgagaaaattgattaa

SEQ ID NO: 113025 - DNA, 612 bp, Glycine max
  Peptide Sequence Number=SeqID_229803
atggttgtgggggcagggcgtgggcctcttgtgcgggcttcattacaggctgctgaagaaactgggcggaagctcaaagtttatgctgttgaaaagaatccgaatgctgttgttaccctacatgcattagtcaagttagaaggatgggagtatactgtgaccatagtctcaagtgacatgcgtcattggaatgcccctgaaaaagctgacatattggttagtgaattgctaggttcttttggcgacaacgaactgtctcctgagtgccttgatggagcccagagatttctaaagcaagatggaatttcaataccatcttcgtatgttaaggctcataaagaccttgtacactttgaaactgcttatgttgtgaaaatgcacaatgtagccagacttgcaccaacccaacctgtttttacatttactcatccaaagcaccctgataaagaaagcaatcagcgccataaaaagttgaattttgtgatacctaatgacactgggtcagcaatggtacacggatttgctggttattttgatgcaactctttacaaggatgtgcatcttggaattgaaccttcaacggcaacgccaaacatgttcagttggtattga

SEQ ID NO: 113026 - DNA, 3371 bp, Glycine max
  Peptide Sequence Number=SeqID_229804
gctgccgtgtcaataataaagataacccaaattgcttatgtgcattggttccacctccaaatggagcccggaagtctggcttatggcaaaagatgtcagatattgttgagagtcttggccatgacccaaccaaggatcttcgagcttctgctgattctcctgcaggtctcacgaatcttggtgcaacatgctatgccaacagtatactccagtgcttgtacatgaataaatctttccgagaaggcatgttttctgtagaacgagatgttttacatcaacagcctgtgctagatcagctggctcgactgtttgtgcagttgcatattagcaaaatggctttcatagattcttctccatttgtaaaaactctggaattagataatggagttcagcaggatagccatgagttcctgacattgcttctctctttgcttgagcgttgtctgagccactccaaagtgcccaaggcaagaacaatagttcaagatcttttccggggaagtgtttctcatgtgacgacgtgctcaaaatgtggaagagactctgaagcttcttccaaaatggaagatttctatgaattggagttgaatgtcaaaggattgaaaagtttagatgggagcctagatgaatatctcactgttgaagagcttaatggagacaatcaatatttttgtgagtcttgtaaaacaagagttgatgctactcgcagcatcaagctgtgtacattacccaaagtacttaattttcagcttaaacgttatgtcttccttcctaaggataaggctgtgtacagtaaccctttcccataccttctcactgcaaggagccaaggagcctttggcattgggggaggtgtcactgttggaaatataccgaaccctgtggctcttcaaaaaggagagactacaacaaagaagaaaattacttctgcattttcatttcctgctgaacttgatatgcggcatagaatgtctgagttgtctcagttcaacttggtatatgacttgtcagctgtactgattcacaagggaactggtgctaatagtggccattacattgctcacatcaaggatgtaaacactggacaatggtgggaatttgatgatgagcatgttactaatttgggttttcatccatttggtgaagagtcttcaagttctactactaaatccatcaagactgatgcaattcattttgataattctgaagcaatggtagctgacagcaatggaaatggtttaagtgctactcattcacaatcttcaaaagtggagacatttttgtctagtgatgcgtacatgttgatgtaccatcttaaacatacaaaaagtgttggtaaaagtgggggtgtaatttgtggtgttaaccataaagaaagagagggtgttgtagttgctgtgcaaaatggtgttcctcttccatctcatatttatgatgagattcaaagtttcaacacctcatatgatgatgcttgtcagcagtacaataacaggaaagagttacaattgagtcgtattagtgagaggagacaggaagttcgatctgttttagctgaagctcctgtgcaatcattggagcaaccattttattggatttctagtgaatggcttcgtcaatgggccgacaacattattccaattcctcttgacaacacgtcagtccaatgctcacatgggaaagtcccagtttcaaatgttacctcaatgaagcggttgtctgctaaagcgtgggatatgttgttctccaagtatggtggaggaccagcattgtctcatgataaccactgtcgggattgcctgattcatggggctatgacagtggtgtcagctgacacctatcgggatagaagagaatcaatgaagtcacttgcacgggatattctagatggaaactgcctagatggaaagtattacatatccagaccatggttgcagcagtggtggaaaagaaaagtccttgatgctccatctgaagctgatgctggaccaacagcagccattagttgtccacatggtcaattgatgcctgagcaagctcctggtgctaagcgggtgcttattcctgagagcttttggctcttcttatatgaagatgctgtttctgtaacgcctgatgatcctttgggtggcccaactttttcttcagattctgaagagtgttcccaatgcagtaatgaattatctgaagtagcatgcttggaggactccttgagattagttaaacaaaaacaacgtcagaatcatgagaaattattccaggctaaaagtatgccactttctatgcacagcaagtatttcttggtgccttcgtcatggatttcaaaatggagaaattacattagtccaaccctgaagaattcagataaacctgaaactttagatggggtaattgattcaatgttgtgtgaaaagcactcacagctgattgaaagacctcctgaattggttttcagacgtggtgctataatccagagggaatcttctgaaggttgcttaaccattgtatctgagaatgattggaaatgcttctgtgaagaatggggtagtattgagaccaaaggaatatcagcaacaattgatcatgttaatgattcagagaatgtattgactggatccagtgaggagatgctagtatgcaaggatcagttgagcacagcagataaaatgaattttgaaaatgggactggacaaattttaattaagacatgtcctgaggtttgtgagagttgcatcggagaaagaaagagctgtgagctaatgcagaagcttaactattgcaatgaggacatatgtgtaattcttgttcgtggtaaggaggtacctagatcaatattggaggcttcaaagggattcgttgaaacagatcggcgagtttccaagcgttcccgcaagactaaaaatgggagttcaattagtctaaaagtttctgcttcaacatctttatatcagctgaaaatgatgatatgggaatcctttggggttgtcaaggaaaaccagatactacataaaggtgataggataattgatagcgataatgaatttgctaccctcgcagatgtgaacatatttgctggagatcaggttatagtgagggactctgagatccatgaaaatcgagatattgctgatgagctttgcgatgataaaatggatctgcagcataccgaggaagggttccgaggaacacttctcacagcaaatgtttcatcccagaaaaatcagttggatgaagtagtccggtacaataccaccacgggtattgaactgttaaaagtttctaaatccaacgtttatgacttcatgaactataggagcctccaccgaaccatcgattccagcctctactggatcttaacacctgctagtacgtga

SEQ ID NO: 113027 - DNA, 696 bp, Glycine max
  Peptide Sequence Number=SeqID_229805
gacggccgcttcgtgctggtgccgacctcgcccgagacgcacgggcaccagtcgctgcgcttcgccagcctgtggaagggctacctcgccgagttttagaagcagccggaggcggccacggagcaggcgaggcagccggtagcggccggacagccgccggccccgtcgcatccgcacctccggcgcctcgcgcggcggaagtgcgggtgcaggcccgtgccgggactatgcactttcttgcagaaatcgagaaaaccttaagtattccggtggagattggcgaccctgagcgtccccacgatcgtaccggatccatcatgcgcatatccctcaaggctgccctggcgggctcgttcagccttctggccgtggttgctgcggttcagggcggtcttagtgtcgtcaagctctcgaccatcgaccggaatgtccgcgagatcgccgacaattggctgccctcggtcgggctgctcggcgacatcagcacggcgacgcgcgacgagcgggtgaagacgtatcgcttcgtcgccgcctcgccgacggaccagctcctcgccgagaacgagaagagcgtgcggacgagccaggccgccctcgacgccctgcggcgtgcctacgagccgctgatcgcctcgcccgaggagcgggcgctctaccagcgcttctccgagacctggggcggcctatacggggcgg

SEQ ID NO: 113028 - DNA, 918 bp, Glycine max
  Peptide Sequence Number=SeqID_229806
atggcctccagcttctgcgactgtgctcagcgcctcctccgcctcgtgcagggcgaccgcgcgctccttctcggcggtgacagcgcgtccgtaggcgtagacgatgtcgccctcggtggcggtgtgccacgagatccagcgcggcgtcccgtcctcgtgccggtagcggttctcgaaggcggtgaggtcgtcgtccgtggcggcgtaggacagcgccgtgcgcgtcacgacgtcgtcttcgggccagacgaattcttggaagctgcggcccaccacctccgctgggtcgtggcccaggatcgtcctccaggccgggttgaccgcgcggaagacgccgtcgacgccgaccacgacgagcaggtcgcgcgagttgcgccagacccggtcgcgctcggccgtgcgctcggcgatgcgccgctccagcgcctcctcgcgggcgtgctcctcggtgacgtcctgcgcgatgccgcccagatgccggaggcagccctccgcgtcgcggatcgggaagccggtgtcgcggatgtggcgcacggccccgtcctcgggccgcacgatgcggtactcgaccgtgtgtgtctcgccggaaagcaggcgcggcatggccgcgaaggcgcgcgcacggtcgtcagggtgcaccagcgaggcccagcgtccgaggtcgcccatcaccagctcgcgccggtcgccccagacccgctcgtaggccgggctcagccactccagccggccgcccgcttggagcggaagcactcctcgccctcgatcaacccggccgcggcgcgcacccgcgcggtcgtctcctgcgccacgttgaggatgcctgttttcgcgcccgtccgcacccaggaccgggttgaggctgtatgtgaagaagacctcgtcgggcgtgccgtctcggtcgagcaccatccgctg

SEQ ID NO: 113029 - DNA, 1017 bp, Glycine max
  Peptide Sequence Number=SeqID_229807
gacaacgatgcggacggggaaggcctcgcggactccccttgccgcgagggccgcggagcggacggagcgcagccgagaggcgccgcggtcttggagaggcgcttggtgagagcgaggtgggtcattgaggatctccagaaacgacgaaggcccccggagtgggggccttctggcaggtacggcagtgagggaggaacggctggatatggcgaatcctacgcgcgagcggccgggtccgcggtcgtcgtggtcgccgatgcattggacctctcctcgtccttgttgcgaccattccgtcctgatcggttgcgatcgtctctggccggacgcgtcggtcccctgcgtcatttgtcgaccctgctccgtttcgcatggtcgaccagcccggcgctcacgcttttcagcctcggcctgcgcatcgtccaagaggacgtgccggcatggatgctctacgtcgccaagctcttcgtcgatgcggtggtcgcagggcgttctgatcccgcatccggacttgcggtgatggactggctcgccgatccgtgtttgcgctacatcggactgctggtcggcctggagttcatcttggcgctcgcttccgacttgattgggcgcgcggcgaatcccgttgattgcatacttggcgaacggaccggtaatgcaacgtcgctgcgccttatggcgcaacccgccgcgctcgatcttactcgattcgaggaaccggccgtgcgggatggcctggagcgcgcccgccgacacatcgcttggcacgccaacccactgggtcaattgctggtccaggcgcaggacaggctcgctgcgatctcgctggcagcgggcgtggccgtgttccagcagtggctcgtcgtccttctggtactggccctgatcccgaccttcctcaacgagctgcgcttcaaccacaaggcataccggcgctccccgaaccagcgggcgagcgactatagcaccatcctgtcccaccgctttgcggcgctcgccggacgtgtgatgcgttag

SEQ ID NO: 113030 - DNA, 550 bp, Glycine max
  Peptide Sequence Number=SeqID_229808
gatcgccgcctgccgggcgacgggggcgcaggccgttcatcccggctacggcttcctgtcggagaatgtcggcttcgccgagcggctggcggccgagggcatccgcttcatcggcccgcgtccggagcatctgcgcgccttcggcctcaagcacaccgctcgcgaactcgcgaaagtcagcggcgtgccgcttctgcccggcaccgacctgctgcccgatgtcgagaccgcgctgagggcggccgaggccatcggctatcccgtgatgctcaagagcacggcgggcggcggcggcatcgggatgcagctctgccattcggcggaagagctggccgagggcttcgccgcggtcgagcgcacggcccgcgccagcttcggcgatgcccgcgtctatctcgaacgcttcgtggcgcaggcgcgccatgtcgaggtgcatatcttcggcgacgggcggggccgcgtcgtggctttgggcgagcgcgactgctcgctccagcgccggaaccagaaggtgatcgaggagacgccggtccccggcctctccgagtcg

SEQ ID NO: 113031 - DNA, 1349 bp, Glycine max
  Peptide Sequence Number=SeqID_229809
atggcttcaaaatttgagactcaaactcatttacaagcctttgtttcctatgttaagaggcaatttaatacaaaagtgaaagccattcgatcagataatggtgctgagtttatcatgaaacagttttatcacagtactgtctttggttgcttgtgctacaccaacactctcactaataacaggaaaaagcttgatcctagagcttttgcttctgttttcttgggcttcaagcctcacactaaagggtatattacctttgatctttcctctatagtcataatggtatctagacatgtcattttccatgaagattgtttcccttatgcttatcctaacacttcttctgatccatcaaattcaccaattattgttgctcctagaagatctaacaaggaaagaaccagaccaaagaagtttcaagactttcacactacattcacatcaactgttgctgatcaatcctcagacaaatggatcaaagcaatgaatgctgaaattgaggctttagaggctaatcatacttggattttgactgacctccctcctaacaaatctgttattggatgcaaatgggtttataaagttaaacacaaggcttatgatgggttagtagaaagatataaggctaggttagtagccaaggggtatactcagattgagggtcaagactaccttgatactttttccccagtgggtaagataactactatgagattgttacgtgctatagctgctgttaacaactggcatttaaagcaattagatgtgaataatgtctttttgcctggagaccttaatgaagaagtttacatgactttgccttctgatgatattgtcttgttaggcaatgatcttctagagattaagtccatcactcaacttctggatgaagtttttaatatcaaagaccttggtgacttaaatttttttcttggatttgaagtggctcgcagtaaacaagggatcaatatttgtcaaagaaaagatgttcttgatatattgcatgatgcatgcatgttaaggagcaaacctgtctctactccaattgattatgttgtaagacaacaccaacaatctagtagtccacttgatgatacaaaagcttcatcatattgcaggctcattggtcgccttatttacctcaccaatacaaggctcgatgttacatatgcagtgcaacacttaagtcaatttgtagctcatccttcttcaactcatcaacaagcagcctataggattcttagatacttgaaagcagcactaggttctggtgtatttttctttgcttctagcatattccaactcaaagcatttagtgactctgactgggcaggatgcatttataccag

SEQ ID NO: 113032 - DNA, 762 bp, Glycine max
  Peptide Sequence Number=SeqID_229810
atgagtgaaaaacaagatgaatctctcagtgttcatagcccttactacctgcaccctagtgaaaatccagcaatcgcattagtttcacctcttttggatccaacgaattacaattcttggagcagatcatccttcacgaccctgagtgcgaagaataaagtagaatttgctgatggttgccttcctcgatcaacctcgaatcatagattgtacgcagcttggaaaaaagcgaataacatggtggtttcatggcttgtacacttagttgcaacttccattcatcaaagcatcttatggatggacaacgcgattgatatctggaaagatttgaaagcacgatactcacaaggtgatttgcttcgaatttctaatttacaacacaaattagcttcaattaaacaaggagacatgaatattactgattattttacaaagctgggaacaatttgggatgagcttgagagttatcaacccaatcctatgtgtagagataatcacacagtagaaacatgttataagaaaaatggttttccacctaacttcttctccaatagaggaggtggaggtagaggttttggtagaggggggacaagaggcaaaaacaccaatggtaaagtttgcacccactgtggtatcattaatcatacagtggatgagtgttataagaagcatggttatccacctggtcacaaattctataaacctcaaggagcttcagttaataacactattaaggaagaagaaaatgtttcaagttcatag

SEQ ID NO: 113033 - DNA, 1209 bp, Glycine max
  Peptide Sequence Number=SeqID_229811
atgtcttcaggaggagaagctcatagactctcaccgtgccgttcagggtcgcgcacctccttttccttccaggataaccgctacaaccccacccccatctctttgccgcctcctccactattatcttcctcgacaaaaccttcctcctctgttcctctcaaacacttgacatcagaagaactggcttcacgccctgagcgagacctttgtttcaattgtgaggaaaggtatcatcgtggccatcattgcagctctagggttttccttttgattgcagacgaggatgatcgttgtgctgaagattatatccccttgggctttgaacccgaaccgcccgacccggttgatctgaatgcagcccaactcaatttacactccctcacgggcctgattgctgcccagaaggtgttgatcctggttgatgggggtagtacccacaactttatccaggacaccttggtctcgcgtttgggcctttctccttgcgacaccacccctctcaaggttatggtgggcaacggtcagtatctccattgtcaacaattatgtccaactgtgccgggttgtactattgaattcaagggtaaggatacctccacacttcagcccctttctcccacccaggcacttccgtcttcccgacccacagaccaccatatacacttagccccaaactcagaccctatcaatgttcgaccctattgttacccgtattacccaaaagtcgaaatcgaatcccaggttgattctatgctacagagaggcataattcgacctagtacaagccctttttcctcccttgttctcttggttcgtaaacatgatggcacttggaggttttgtgttcattacagagcattgaacgcacttacgatcaaggatcattttccgattcccataattgatgagttgttagatgagttagtcggtgcttcctggttttctaagttggatttgttgcaaggttatcatcagatcctcatgtctgaagatgatatttgtaaaactacttttctcacacaccatggtcactttgagtttagggtgatgtcattcgggttgtgtagtgcaccttcatcgttccaggccacaatgaacactatctttcgcccattcctccgtcaatttattatcgttttctttgatgacattctcatatacagttcaaccttggaggatcatataattcacttggagaaaaccttttga

SEQ ID NO: 113034 - DNA, 144 bp, Glycine max
  Peptide Sequence Number=SeqID_229812
atggttcagagccatcaaagcgaggcacgtcaagcttcatacggtgaggctgggcagaaggggaagatggtgggatggtggtggacgagaacctataccctaatgtcacatcctatcagagcattgtgttcccatgtcctctag

SEQ ID NO: 113035 - DNA, 516 bp, Glycine max
  Peptide Sequence Number=SeqID_229813
atgtctattatgctcggtaccagttccctgtcggccatgggaggacttgtctctcgacttcataactggattacccgcatttcgtggctataccaccattcttgtggtcatcgaccgcttttcaaaagggattcatctgggccacactggcagacctccgtttcgggtcaacccattgggtactccaagctcgccaaaagattttatgggtcattccgggtcatcaaaaagattgggctatcagcctacaaacttcaattacttgtagaagcttttatattgaacacacaccagacagctgactccaagctagaagtccttgttcaatggcaaggattatcatcggatgatacttcatggaaagactggacccaacttcaaactgattaccaccttgaggacaaggtgcttttggaaggcatagggaatgatagcaacacagaaaaaccagaagcaacaaaagcacgaccacaaaggatgagcagggccccaacttaccttaaagatttcctataa

SEQ ID NO: 113036 - DNA, 432 bp, Glycine max
  Peptide Sequence Number=SeqID_229814
atggagatactgaccgttgcccaccataaccttgagaggggtggtgtcgcaaggagaaaggcccaaacgcgagaccaaggtgtcctggataaagttgtggatcaaccgggtcgggcggttcgggttcaaagcccaaggggatataatcttcagcacaacgatcatcctcggcgtgaagccagttcttctgatgtcaagtgtttgagaggaacagaggaggaaggttttgtcgaggaagataatagtggaggaggcggcaaagagatggggggcttgtacatcgtgatgaatgtcgggactcagacccgagatacagcaactgagaaggaaggcatagaggaaaataggccaggaggtgagctgaccgttgctggccatccattggaactaggccaaagcacgaccatccatataaaaagaggtgatggttag

SEQ ID NO: 113037 - DNA, 234 bp, Glycine max
  Peptide Sequence Number=SeqID_229815
atggtgatgaagcctctgtgtccaaattattggtggttgattttgctagagggaagaagaagaagaataagaaaggcaaaggtagcaagaagagccaaggatgatccaaaggacatttgtaattactacaaagaacctagtcattggaagaaagattttgttcttgtcgttgttcagaaagattcctcatctgaaaatgatttggttctggctgttggagaacaaccacaatag

SEQ ID NO: 113038 - DNA, 192 bp, Glycine max
  Peptide Sequence Number=SeqID_229816
atggagaagtctagtggtaatgttttgatgggtaacagtacctcttgcaaatcaattgccgatgttcatcatgttccagagcttaagaaaaatctagtctctgtgggtgtcatggattcaaaaggtttttcttcttgggttgatggtggagttatgcaaattagaggaaaagagaagtatgtggtgatgtag

SEQ ID NO: 113039 - DNA, 147 bp, Glycine max
  Peptide Sequence Number=SeqID_229817
atggatggtaaagtcgatgatgaagatattcaagaagtgttatctgacgatccaaagcagttagctattgtgaaagcctttccaatttatgaaaagacagattgttttaacacatcttgcaaaatgatacttggttattgtgaatag

SEQ ID NO: 113040 - DNA, 102 bp, Glycine max
  Peptide Sequence Number=SeqID_229818
atggttaaaattaattaccatacctacatggttttatcaccagttcaatatagtgttactttctccgtcatgcattccaataggatagcgtgtattaattaa

SEQ ID NO: 113041 - DNA, 339 bp, Glycine max
  Peptide Sequence Number=SeqID_229819
atggcttggaattcagttctacagaattcaatgaattttataaagaggaaggcattgcaagataacatattagttagtttttgggctaaggcaatcaacacaacatgctatctcgtgaattactcaccgtccaccgccatagactttagaaccactattgagaagattcagacaaatgctaaggatgtcactaagcatgtggagtttaagagcctcataatcataaattttagtgatttgaagcacctgatgagactgatcaagatcttcaaatgcaacctcaacctcataattcaacaccaattgaggagtctaagtggaccaattagaataatctaa

SEQ ID NO: 113042 - DNA, 396 bp, Glycine max
  Peptide Sequence Number=SeqID_229820
atgttctttggagttttccacaggatatggaaccatgaggaggctacactgcttaacacttttggtaatcatgattttcccgacagaggaatttctaagctctgccttgtaaatgagcttgatgatagcttgcttcttgatgcttcatttgatggaaacattcagatttggaaggactatctcctgaagggtaaacaaaaacttgtcattgcattctcttcaattcatgcacataaaccaggtgtgaggagtctgagtgcagttgttgattggcaacaacaatgtgattatccatatgcatcgggtgagatatcatctattatgctatgggatgttgataaagagcagcttgttaattctaaatcttcatcatcagattgcagtgtctcagtgttg

SEQ ID NO: 113043 - DNA, 1092 bp, Glycine max
  Peptide Sequence Number=SeqID_229821
atggatccttcttataggccaagtttagtgcaaaatgatgctttggggtctggtcttctgccatttgctgggtcagacttggtcttgagtccatcccaatggagcagtcatgtagtaggaaaaattagctcatggatagatttggattcagaggatgaaaccctcagggtagattctgaaaccactcttagacaagaaattgcttgggcttctcatctctctttacaggtttgctttggttgcatggatatggttatggttcctgcgctgtaccagtatgagtatggatgccaaaacactgcctttgatgaattttcatgcctaagatgtactggcttggagagccaaattgtattggctggcatgcaaaccattaaggggataaaagcctgccttcttcctgcccccaagggaacttcttgtgctaattatgctagatgtgtgaatcagattttacagggttcaaataatatgcagttgtggcttaggcttccattggtgaagcctgatgatgactctatggatgcaaagtctgttgctttggttgactactgggaaacttggaattcatttcgtctgctgtgtgagcatcatagtcaactttcagttgcacttgatattctgagtactcttccttccccaaattcactaggacgttggtttggggagcctcttagagcagctatattacatactgattgctttctaactaattctcatggctctccatgcctctccaagcgtcaccagagtttaattactggtgtttttaatcattctattcagatcattatatctggaaattcagttcatacaaaagcaagtatggatgcaaatgataattctggtacaaattcacaaagacatcccttgcggccatatctggactacgttggatatctttaccaaagaatggatcctcttcctgagcaagaacgttttgagcctttgatggataatttagaggctcagacttacgagacttttgagagagatgcaatgaaatacattcagttgatagttggcagagtccccatggcatgtgattcttcaacaattgagctgcctagagtactgattgaagttgattag

SEQ ID NO: 113044 - DNA, 2300 bp, Glycine max
  Peptide Sequence Number=SeqID_229822
atgggcagacaccaaacaggagctaaaaaattatggtcatattccatagcagatttaagggcaaggagacaccctcatgcgtgttgtgctccaaccagttgcactaattctgccaagacatttataattaaccaacaaaaattgcttatacgcagtgatcataataaccacaaagagattgttcaaaactgtaagcttgataggcaggatacccccttcccaaatcattggtctgttgatgatgtggtgtcccttgtacaggatctagatttttcctctttatgctcccagttgggtctcttggctacaattcttctttgtattgatgttgctgcaacttctgctaagtcagcaaagatgtctctgcaattacttaaacaggccgaaaatatgttatctgatatatatccaggaggatctcccaaagttggctccacgtattgggatcagatccttgaagtgggagtcatctctgtgtcagggcgtcttctgaagcgcttacagaagttcttggagcaggaaaatcctccaacacttcaggaaatcctatctggggaaattgtcatcacatcatcgaaagagtcccaccggcaagagcagagggagcgtgctcttgctttgctacatctgatgattgaagatgctcatatgggcaagcggcagtttttgagtggtaagctccataaccttgcaagagctgttgccgatgaagaaactgaaccaagtactactagaggtgaaggattgtatgctgatcagggtgttatttccaacagtgacaaggacattgtacttgggcttgggttaagagttgttaaacaaataccgttaagttctactggaggagagtctaccctgcagtccactggttatgacattaaagattctgggaagagaatatttgctcccttgagtggcaaacccatgacttatctgtcacagttcattcttcatgttgctgcaattggtgatatagttgatgggactgatactactcatgattttaactttttctccattgtttatgagtggcctaaggatcttttgacccgtcttgtttttgaaagaggcagtactgatgcagctgggaaggtagctgaaattatgtatgctgattttgtacacgaggtgatttctgcatgtgtgcctccagtttatcctcctcggtctggacatggatgggcatgcattccagttgttcctacattccctaaaagtagctctgacaataaagtgttgtctccctcatcaaaagatgcaaagcctaattgctattgccgctcttcagcaacgcctggagtggctttgtaccctctccagttggatgtggtgaaacatttggcaaaaatatccccagtgagggctgttttagcgtgtgtatttgggagtagtatactgtacaacagcagtagctcatcaatttcaagttccttgagtgatggattactacaggctcctgatgcagatcggttgttttatgagtttgctcttgatcaatctgaaaggttcccaactctgaacagatggatacagatgcaaactaacctccatcgagtgtcagaatttgctgtaactgctaatcaaacagtcgatgacggcaatgttgaagcaagaacttctgttaagagagttcgtgaacatgacactgagacagagtcagacgctgatgacattgttagtagcagtacaatccctgtagctctgacagacctaaatagccatgggattgaagccacagatttctggcttgattcctcaaaatctgaaactgctcaaattgacaccacagttttcctttcttttgattgggataatgaacaaccatatgaaaaggcagtggaacgactaattgatgaaggaaagctaatggatgctcttgcactttcggatcgctttctgcggaatggggcctctgatcagcttcttcagttagtcattgaacgaacagaagaaatccattcaaattctgcacagcgtcaaggatttggaggacgtaatatttggagcaatagttggcagtattgcctaaggttgaaagacaaacagctagctgctagattagcactgaggtatgtgcactcatgggaattagatgctgctttggatgttctcacaatgtgcagctgccatcttcctgagaatgattctacaaggaaagaggttttgcaaatgaaacaagctttgcagaggtacagccacatattgagtgcagatgatcattatgcaagctggcaggagcttaaattagaactgcctgttgaagcagattgcaaggaagatccagaggggctggcacttag

SEQ ID NO: 113045 - DNA, 576 bp, Glycine max
  Peptide Sequence Number=SeqID_229823
atggtaatagtggtgatcaacagtagcggcgacgataaagatgtcagtggtggtcgcggtgacagtggaggtgacattggtggtgccaatggtggcgacattggtgttggtggtggtggtggtggtggtattagtgatgatagtggcggcgacattggaggtggtattagtggtggtggtagtagtgtcgggggtgttagtggcgatggtggtggcaatgaaggtggtggggtggcggtggcagcaatgttggtggtggttgtagtggcggtgatagagatggtattgttggtagtgctggtggtaatgaaggtggtttgttgggtggtggtggtagcaatgctaatgatgatggtgatgtcaatggcaacgatggtggcagtgacagtggtgttggtggtgacaccaagtggtggcggtgataaaggtaggcgtggtggtgtttatagaaatgctggtgactatggtagtggtggcaataacgaaggtagtattgctggtggtagcgttgatagtggcaatggtggtgacaacgatagcggtggtaacaacacaaaatgtcattgtcaaatgtga

SEQ ID NO: 113046 - DNA, 2136 bp, Glycine max
  Peptide Sequence Number=SeqID_229824
atggggagagaaacggaaatcctctctcgcctcgtcgcgaaccacctccacctcgcccaattcgagcccctgcgcggcgtcctcctcgccctccgagcgcgaaaccgcgacctcgcccgcgatatcctccaaaccatcgtcgcgcgatcgggtcgggttcccaacgtcgcttggtcgagttcgtgtccctctcccgcgcttctcactttcttatccacgctcgaattgctgcaaatggacaacgcctcctccgcgtggaacttcgacgaggaaacgctgcgtttgcgcgccgagtttctgcttctagttcaggatttgatcgatttagtgtccgagtgtgatggagaatgggggaattgtaggagtgttttggatagggttttggaattgggcgtgaagaggttgagagtggacgcggatggtgaaaatgaaattgacgggatcggaagtgggaatgggaatgctgctactgtggttgaagaagcagagtttacgagtctgaggaagttgattttggaacacgcgcgtgtttttgacgcgctctgtgtgaatgtacacaggcaaattaggcactgggagagtgaggattcgggtgagggaagtgaggagttggaagaggaggatgttaaggtgcttcgcgggatacagaggacggttcaggtcgttcatttggatgctatgagagagagtcttgaatcgggtgatgcagaaggggctgtttctcatatacggtttctgcattttgattatggaattgaggagcaatctgagtaccgcattcatgacgagttattgtctgaagagattgaaatggatagagttcaaactgaaaacttcattccacatcctcttgtacgtcttcaaagatatttggaagaagtgaagtctggtaagaattcagatgataaggcattattcctgaatgaggtaatcagatattgcaagacagatatgtatcattatgctcgtgtttctggactacatgttcttgagtgtattatggatactgccctgtctgctgtgaagagggagcagctggatgtagctggcaatgtcctccaattgtttccactacttcagcctttggtagcgaccatgggttgggattttttggctggtaaaatagcagcacggaggaaattaatgcaacttctctggacaagtaagtcacaagttattcggcttgaagaatcttctccttatggtaataaaacagatgagatgacttgtgtggagcatttatgtgataccttgtgttatcagcttgatcttgcctcttttgttgcctgtgtgaattctggccagccttggaattcaaaattctcattaatgctttctggaaaagagcaactggaatttagagacgaagatacttattctgatccttttgttgagaattttgtgctggaacgactttcggtccagagtcctcttcgggtactatttgatgttgttccaggcataaaattccaggaagccattgatttgatcagtatgcagccaattgcttctactgtagaagccaggaagaggaagcaagatatagaactcatgcatatgcgttatgctttagaatcaactgttcttgctttaggagcaatggaaaggagtgtgtctggcgaagttgaaacccaccaagatttgccattatttcatttaaaggacttgcagaaccatttggatgcaattagtaatcttccgcgcaagattttgatggtgaacgtcatcatttcaatgctgcatatggataatatctctgttaacttgatgcattgtggattaccaggaagcaattttaaattatccaatgcatggtcttcagaagatagttgttcaactggaagtgaaagggggaataaaatggttatatcttttactggtttgctacttgatatattgcgtcataatattccatcctctatgattgaattagaaaacacactagatgatggtgtaagcacaaccagcagacaggcccttgagtggagaatctcaatctcaaagcgtttcattgaagaatgggaatggcgtttgtcaattttgcagcatctactaccattatctgaacgccaatggagatggaaagaggcactaacagtgttacgtgcagctccctccaagctactcaacctgtga

SEQ ID NO: 113047 - DNA, 1260 bp, Glycine max
  Peptide Sequence Number=SeqID_229825
atgcaggccgtggaagaaggtggcggcgaggagcgaaacgcgcgtttcgaagaaagcgatttggactcggagatttcgaagttgcgcgggcgatgggaactcgcttctgttctcaattttttggacgtgtttggtccgatacttggtaaagatttgaagctttctgctgaagatattgagattgggcttgttaagcctgatacttcgctttctcggcttcacattcaacttttgaagggaataccacctgtgagtaaaacattggaggattctgataaatgggttactgcaccctgtaagaatctgactgcttggtggctatgtgttgctgagggggagattccacttgtaccatctaaagggtatgatgcaacttcaaaaggccagagtcacagattgtacagggagattatcacatcagactcaattccaaatgataaggatgaaggatgtttatcactccccaccattcaatgggaaacacttgcttccaatcttgaagatttttcaaaagtagctgaaaaatttgcattcagcaagtgtgctgcagaagttgctgttagcctgaagcttcaagatgatgctattcctgctcttgaaaagctaaggaagaagaaagaaagagcaataaagcaaaagcaaaggcaggatatgctgttaaaaaaggattttcagaatcctcattattctggaaatacacgctcttgtcatgctcgaaggcctattagttatacatttgtgagggtgggtcttgtcaatgtagcagaagcttatgatcgaacaatgaaggaggccatacagctaacaaagtatgttttacatgatattgtacctttaaaaggacaaagtttcctgttgctgaacaagataaatccggaggatctgaaaataaatccaacacaagatatttcaacagacagtgattcggaaagggttatgtctccaatatatgatagtgatgacactggttacaaagttgagaatcatggtagcagtgaggaggatgctgctgttgatggtgagttgggcaacttggaaacaccctcaagccatgcagttttttatccaaaagggtttcgctgctgcaagcagttagctggagttcctagccacactattttagaaagccaaggcaaagacccacccgcaattctgctatggaatctgtcatcgtatctgattcagaggacgaagcacgtgaagggaagagagatttgtccgagtctacttaggcctggtattaacctgtattttggctaa

SEQ ID NO: 113048 - DNA, 357 bp, Glycine max
  Peptide Sequence Number=SeqID_229826
atggcaggagaaataggcgtgatgtttaatattccacaaccttttacagtgagaagtagagggctctcccaggtcaaacgaatcaatcatcgtcatttcaagcatatggtgcaaccatttagtgatgatgtgaaggcaatcaactacaactttattaagtattttaagggcctcaaaggcaaggtgctagaagaaatatcatatataacagaattgatgggtgaccttcatgatgagttagcgtatgagagagtgatggctgccagcctaccacaatgcagaattttgagtgaaagtcccaaatatcttcaatctcctgctttggaccatgtttctgagaaaggagacggtggataa

SEQ ID NO: 113049 - DNA, 312 bp, Glycine max
  Peptide Sequence Number=SeqID_229827
atggtggctctaagaatgtccatgtcattgtcatctctagttagaagacgctcaagcgacgaaataaccaactcggcctcggtttccagtagcctctttccagcatttggcaccaccatctttgatgttgaaggttactcgaagtcgaacctaagaaaatatgtcattgctccctatgaccgtagatatcaattgtggcaaacgttccttgcggcattggtagtgtactctgcatgggcatctccattcgagctagctttccgggaactgttagttgggtcgctgttgcccgttgaacttctttgcggttga

SEQ ID NO: 113050 - DNA, 2980 bp, Glycine max
  Peptide Sequence Number=SeqID_229828
tggcagaagtgcaggattatcagttgatttacggagagaattgcaggggcggcagcttgtgaagcttctgacagctgatcctcttaatggaggagggccagctgaagcctcacgctttctttcttcgttaagggacacagatgatgctttgccagttgctatgggtgcaatgcagcttttacccaatttgcggtcaaagcaacttcttgttcacttcttccttaagcgaagagaagggaatctgtctgatgttgagatttcccggcttaattcatgggctttaggacttcgtgtgctggctatcttgcccttgccatggcagcaaaggtgctcttccctgcatgagcatcctcatctgattttggaagtgctactgatgagaaagcaattgcaatctgctacactggtaacctccaaagaggccacaaccaagatattaaaggagtttccttctctacgagacaaccatgtaattactacatatgcaactaaggctattgctgtcagtatcagctcgcctcctagggaacatcgcatatctgtttcaggatcccgaccaaagcagaagacaagatcaggtgccccacagagatcatcttttacaagcagtctaagtaacttacaaaaagaggctcggagagctttttcatgggctccaaaaaatactgtggacaaaaatgctccaaaagatgtttataggaaaagaaaaagttctggattgtctccctctgatagagttgcttgggaagcaatgactggaatacaagaggaccatatttcatctttctcaacagatgggcaagagcggcttccttccgtttcaattgctgaggaatggatgcttacaggtgacccactaaaagatgaaagcattcgttcatctcacagatatgaaagtgcccctgacattacactgttcaaggcactgcttggtctttgttctgatgaatcagtctctgccaaaattgcccttgacttgtgcattaatcaaatgaagaatgtcttgagctctcagcagttgcctgagaatgcatctatggaaacaattgggcgagcatatcatgctacagaaacatttgtccagggtctagtttatgctaaatccctgctaagaaagctcacgggtggtagtgaattgccaagtaattgggatagaaatagagatactgatgatgcatcatctgatgctggtagctccagtgtgggtagtcaatccacagatgagctatctgaaatcttgtcacaggcagatgtctggctgggtcgtgcagagcttctccaaagccttttgggatcagggattgctgcttctcttgatgacatcgctgatggacagtcatccgcccgtctgcgtgacaggctggttgcagatgaacggtatagcatggctgtgtacacctgcaaaaagtgtaagattgatgtcttcccagtgtggaatgcatggggtcatgcattaattcggatggagcgctacggacatgctcgtgtgaaatttaagcaagctcttcaattgcacaagggtgatcctggacctgtgattcttgagattattaatacaatagaaggtggcccaccagttgatgtttcagctgttcgttctatgtatgaacacctggctaaaagtgcacccacaatcttggatgattctctttctgctgattcatatctcaacatcttatacatgccatcaacatttccccgttcagagaggtcaagacgatcacaagtgtctgcaaataataattctgtgtatagtcgagattttgaagatggtcctcggagtaacctggacaatgttagatatactgaatgtgttacttacttgaaagagtatgcacgccagcagttgcttgcttttatgtttaggcatggtcattaccatgatgcttgctccttgttctttcctcctgatgaggtcccaccgccaccacaaccatcaatcacgagtggagtgtcttcttcatcaccccaaagactagattctttggcaactgattatggaacaattgatgatctgtgtgaattatgcattgtttatggtgctatgcctattttggaggaagtcctttcaactagaatgtcatcaactcaatcccaggatgcagtaaatcagtatacagtgacagcccttgctcgtatttgcctctattgtgaaactcacaagcatttcaattatttatacaggtttcaggtaataaaaaatgaccatgttgctgctggactctgctgcattcagttgtttgtgaattcttcttcacaagaggaagccattagacatttggaacatgccaagatgcactttgatgaaggattgtctgcaaggcacaaaggtggggaatctactaaggttgtcacaaaaggacttagaggaaaaagtgcctctgaaaagcttacagaagaaggtcttgtaaaattttctgctcgggtatcaatccaggttgaagttgttaaatcctttaatgactcagagggaccacaatggaaacattcactttttgggaatccaaatgatccagaaacttttagacgaaggtgtaaaattgcagaggttcttgttgagaagaattttgatttggcattccaattgatctatgaattcaatcttcctgctgttgatatatatgccggtgttgctgcatctcttgctgagagaaaaagaggcagccaattgacagaattctttagaaacatcaagggcacaatagatgacgatgactgggatcagttccttacactagaggtgttctctaacaaaaccctaaaagacactgcaagacatacaggggaaaatagaagcaaaaaggaacatggaaaacaggaatcaacactggacacagtgccactcctcctgctcaaaggttttgtctttcctaaattctttgatgattccctcatatttcagctccttccctacatcattcttctcatcgttctgcccatgattctccaattccctcttgccagccttccatattattag

SEQ ID NO: 113051 - DNA, 276 bp, Glycine max
  Peptide Sequence Number=SeqID_229829
atgagtgtcatcatcaaaaagggggagaatgtggatcattcttgttttgatgatgtcgaaaagaaatcacttgattgtcatcatcaaaaaggggagaatgtgaatattgcttcaacaaacaaagccttgattcaagatctcttcaagaccaagccctgcctcaaaacaaagggtttcaaagtcatgcaaggctctggtaatcgattaccaggaagtgtaatcgattaccagaagggaagttcgagaatagctgttgaaaagggttttgaattttga

SEQ ID NO: 113052 - DNA, 558 bp, Glycine max
  Peptide Sequence Number=SeqID_229830
atggtactaaaaatagcaattctatcctcaaatggcatcatagttattactggtttatatattgtgcttgtgggtaaagccaaagagttagctgagaataagccaaaggcggcaccacaatcatcaaacttacaagatgatcatgatataagtagtaggatagatttggaacaaccccttctatcagagaaattatccgaacatgtaacacaagcagatagcaagacctgtgacatctttgtaaggaagccaatgagccaccaatccaacttcatcacaacacaaggaagagatgaccccaacaacaacacaggaatttcaatccaaagctacagggttaggccagattctgagtttctcacactcaaggaatctttcaagacatgtcttgggtggggtgaatggagtggaaaatttgcaccctcaactttgtactatggagagtacttgaacacaggttatggtgcctttacacagaatagggtgaattggcctggttttcatgtgctgaggagtgcttttgaggccacacccttcactgtgaaccagtttctgtaa

SEQ ID NO: 113053 - DNA, 351 bp, Glycine max
  Peptide Sequence Number=SeqID_229831
atggagaccatttcttataacaaatccacatctccacaagggtctctagggtatcttgaccctcaatatttccaattatacatgctcaaggacaagagtgatgtctataggtttgggcatttccctccctacgaactaaccaatccagcaacaaaacgaactcaggaacatgattttaacattctaaaaggagaaaggtttgagcaagatgaaggtttgcggcaatcacatgaacttgaggttttagggtacggtgaggaggagacgacaagtcgaggggtaatgagcgatgaggaagaaagggagaaagggtttggggttttaccagcaatggtagtgacgatggcctga

SEQ ID NO: 113054 - DNA, 1659 bp, Glycine max
  Peptide Sequence Number=SeqID_229832
atggcgtttcaactccgccagcccctgcggcgccgaaggcatgtctttggtctgggtagggaagatgtgccccagcgcgatgtaggaaggtttcaccgccagcgcgcgtgccagctcggcgtcgtcatgggtggacacgcccagccgcagcccggcgcggtgaatggccgccagatcggtagtatcgagatcctcctggcccagatgcacgccgtaagcgccgtgcttgatcgccagccgccagtagtcgttgatgaacagccgcgcctgataacgctggcccagcgcgatggcggcggcgatatccgcttcgacctgctcgtcaggcaggtccttgatgcgcagctggatggtggtgacgccggcctccagcaggcgagcgatccattccacgctgtcgacgaccggggtgccggcgctgtgatacagctcgctgccgcgggcgcggaactcggcggacattttctccatgccggtcagctgcacttcgatcggcttggcggcttcctgggccgcggcgtagtcgcgcacctcctgcgaaattttcatcgagcagaatttcggcccgcacatcgagcagaagtgggcgaccttgccggactcctgcggcagggtttcgtcgtgataggcgcgggcggtggccggatcgagcgccagattgaactgatcttcccagcggaattcgaaacgcgccttggacatggcgttatcgcggatctgcgcacccggatggcctttggccagatcggcggcgtgagcggcgatcttgtaggtgatcaggccctgcttgacgtcctctttgttcggcaggccgaggtgttctttcggcgtgacataacacaacatggcgcagccgaaccagccgatcattgccgcgccgatgccggaggtgaaatggtcatagcccggggcgatatcggtggtcagcgggccgagggtgtagaacggcgcttcgtggcagtgttccagctcttcggtcatgttgcggcggatcatctgcatcggcacgtggcccgggccttcgatcatcacctgcacgtcgtattcccaagcgattttggtcagctcgcccagcgtatgcagctcggcgaactgggcttcgtcgttggcgtcctgaatcgagccggggcgcaggccgtcgccgagcgacagcgaaacgtcgtaggcggcgcagatctcacagatttcacggaaatgctgatagagaaagttttcctgatggtgcgacagacaccatttggccatgatcgagccgccgcgcgacacgatgccggtcaggcgtttggcggtcattggcacgtagcgcagcagcacgccggcgtggatggtgaagtagtcgactccttgctccgcctgttccagcagcgtatcgcggaacatctcccaggtgaggttttccgccacgccgttgaccttctccagcgcctggtagatcggcacggtgccgatgggcaccgggctgttgcgcaggatccactcgcgggtttcgtgaatatagcggccggtagagagatccatcacggtgtccgcgccccagcgggtggaccacaccagcttctccacctcttcttcgatcgacgacgtgaccgccgagttgccgatattggcgttcaccttcaccaggaaattgcggccgatgatcatcggctccgcctccgg

SEQ ID NO: 113055 - DNA, 147 bp, Glycine max
  Peptide Sequence Number=SeqID_229833
atggcaattttgatcgccaatacttcaacaacatttcatagggatgaaagactcgggaatacgcatgctatggaaaatatgtgggtttatgatcccaacatggttggctcatggtacctaacacatgcaactaagaatgcatcatga

SEQ ID NO: 113056 - DNA, 264 bp, Glycine max
  Peptide Sequence Number=SeqID_229834
atggctttctccggaggggcccttgtgcttgccaacatggatgacgaggaactaccttcacccgtgaactccaacgttgtcaagcgatactacgcttatgatctggggcaattaaggaagtcgctgcatggacaggatcgttttaagcaaatggtcaaataccgcgccaaatccaagacagagatgagtcgaggtacttggggacgggcacgaatggatgctaggcccatgatcaatagatcgttgtcctgcgtccaactctga

SEQ ID NO: 113057 - DNA, 551 bp, Glycine max
  Peptide Sequence Number=SeqID_229835
ggccgggccgggaggcgggcggtcttgcgccgcacgaggaagcgcggacggcgtccgctgagcgcggcgtggcggcggcgctgccggcccttgccgagcacgaccgggccgagttgctgcgagaccggaacgatggcgccgtcctcgcgcagcagcatgcgggcgagaccgccggtggtcgcgatgtcgcgccacagcgccacgacctcctcctcggggaacggcccgagctgcatcgtcacctcgccctcgccgtcgacgaggagcagggagaaacggtcttcgccgcaggcatcggccgcatcgtcggcgaaggacaaggccacgccgacggccgcaccgctgccgagtcgcgcaccgaaggccggcagcggggtggccgcgtaggcgaggccggtcgcgcgcgccgcgtcgttgctgccgggccgacagttctgattcgtgatctcgaaagtcatcatcggttcgacgccctatcccgtgtcgcggtctctgtcggacgcgctgatctgacaagctcagtgccggtcgtctcccccaaggcgccttaa

SEQ ID NO: 113058 - DNA, 592 bp, Glycine max
  Peptide Sequence Number=SeqID_229836
atgctcgaagccggccgtcggctcggcctcaaccacgccacggtggcgcgccggctcgacgcgctggaagcggcgctcggcactccgctgttccatcgccggccgaacggctccgcgctgacggaggcgggcgagcaactcgtcccggtggcggagcggatcgaggccgaggtgctggcggtcgccgcgcggatgcgggcgcaggaggcggagccgagcggcacggtgcggatcggtgctccggacggcctcggcaccctgttcctggcgcgggaactcggcctgttcgcgagccgatacgccaacctcgtgatcgaactcgtgccgcttccgcgctcgttctcgctctcgcgccgggaggcggacctcgcgatcgggctcgaccggccggcgcatggccggctgatcctctcgaagctgtcggattacagcctcggtttctacgcggttaaggcctatctcgaccgagccgggatgtttgtagagcgtggcggatctcggaagccatgccgcggtgatcggcgtcgacgactacgcctacgcctcggcgttggactataccgtcttttctgtaggatcgcgtggccagggt

SEQ ID NO: 113059 - DNA, 405 bp, Glycine max
  Peptide Sequence Number=SeqID_229837
gtcgactctagaggatcccacatccgcctgtcgtacggggtggtcaacctcgtcggcaacgccctcgacgcggtgaagggccgccccggggccgaggtcgcggtgcgcgcctgggccggggaggggcgggtcgttctcagcgtcgaggacaacgggccgggtctcgatcgcgcggcactggcgcgcttgttcgagccgttcttcaccaccaagccggcgggggaggggctcggcctcggcctgccgatctcgctcgccattgcccgcgagttcggcgcgagcctccagcctcggccgatgcccggcggcgggctcgccttcgatctcgtgatggacgaggccgggaaggcagctaaggagaccgccgacacgccccggccggagaggatgcgccatgtttcctga

SEQ ID NO: 113060 - DNA, 408 bp, Glycine max
  Peptide Sequence Number=SeqID_229838
atggacactgttgcatcaacaccatcacaaaatgtccttctgatacgatctcccaactcaatggatgtgaacgtgttgattagtagaccatttgcaatggtagatgagatagcagatgcatcaccagcagtagaggatggtttacaacttggggatcaaattttgaaatttggcaatgttgaagcaggtgataatttgctccaaaggctttcttctgaggctcagtcaaatctgggttgtgcagtaccagttgttattatgaggcaaggcacagtgatcaacttaactattacacctagaccttggcaaggcagaggactattgggtaagttaaatgctaagaaattgaaaatggaggaatgcaaaggaagcatttggagaattgcaagactaggatttcttgactag

SEQ ID NO: 113061 - DNA, 567 bp, Glycine max
  Peptide Sequence Number=SeqID_229839
atgcgcgagttgctggcgcccttcggtgtcgaggcggtctcggccggcgaactcggcctgcccgagcccgacgagaccggcacgatgttctccgagaacgcggcgatcaaggcgcatgccgcggccaaggcctcaggcctgccggccttcgccgacgattccggcctctgcgtcgatgcgctggacggcgcgccgggcctgttctccgcccgctgggccggcccggccaaggatttttccggcgccatggcccggatcgccgacgaactcgaccgccgcggtgccacgaatcgccgcgcgcatttcgtctcggctctcgtcctcgcttggcccgacggccataccgagttgttcgagggccgcgtcttcggcgatctcgtcgcgccgcggggccagctcggcttcggctacgatccgatgttccgccccgagggcatggaccgcaccttcggcgagatctcgtccgaggagaagcacggtgtcgactggcagagcggcaacgccctgtcgcaccgggcgcgggccttcgtcgagctcgcacgggcgtgcctgcgccggtcggtctga

SEQ ID NO: 113062 - DNA, 585 bp, Glycine max
  Peptide Sequence Number=SeqID_229840
atggcgcgtgccccgaacccggggatcgcctcgaacccgacggcctccgccagtcggaccccgcgccgctgcgcggccgcgacgatggccgccgcgacgggatgttccgagcgcgcctccatcgaggccaggagccgcagcaccgtgtcctcgtcgaagccaggcaggactgcgatgtcggtcagctcgggcgtgcccttggtcagcgtcccggtcttgtcgagcgcgatcacccgggcgtcccgcagcgcctggagcgcctccccgcgtcggaacaggatgccgaactcggccgccttgccggttccgaccatgatcgaggtcggcgtcgcgaggcccatcgcgcaggggcaggcgatgatcagcaccgcgaccgcgttggcgagcgcgaaggccagggcgggagacgggccgaaggcgagccagatcccgagcgtgacggccgcggcgccgagcacggcgggcacccccccaagtcgtcacccggtcgacgagggcctggatcggcagcttcaaaccttgcgccgcctcgacggtgcgcacgatctgcgccagcaacgtgtcggacccgaccttggtggcccg

SEQ ID NO: 113063 - DNA, 204 bp, Glycine max
  Peptide Sequence Number=SeqID_229841
atggcggcagatatcttggaatccaacaagttgtttttgtatttgaaaaatagacaagaagagcaagagagtaaagcagcagaaggggtgaagatagggatggcgggcatgtttggatgtagttgctgttggcagtgggcggaggcgaaatccatgggaatgggctgttggttctatacccatccatgcagtgaggcattttag

SEQ ID NO: 113064 - DNA, 828 bp, Glycine max
  Peptide Sequence Number=SeqID_229842
atggagaagagggtcatctcaattaattgcttttcccttgagggtcaacttgcaaaattagaattaattggattagggacatttcaacttcttcaaaaagtattgcatgctgttggaagagaactattggcaattgaagaaacatgtgccagaaattcatccatactgagaaatgaggattatttttcttcatgtgctatgctatctcttaatgtcaaggatcctcgagaattgccatggaagaagactgttgttccagtggagtccatttcaactaagactccgactgatgcacaagaaaagaaatacaaagagcttgctgaattgggaggaatattggaagagaatagagatttatcttcattatcaagagggttgaggcctccagtggaagacagttttctttctaaggagatacaccatgaacgtatggttaatttctgccttgatgatatacattctggagaggccaactcttcaactaaggtgcagtgctcgagatcttgccctattcttcttttaaaaaatgatatgaaggaattgactataggatggtctgttatacttcccttaagctgggtcaaagccttctggattcctctcatctctaatgggggtttgggggatggggggtttaggatttggggtgcattcctctcatctctaatgggggttgggggtgcattcctctcatctctaatgggggttgggggtttaggattgggggtggcgggatgggggtggggggatggggattggggattggggtatagggattggggattggggattagggtttggggtttggggtttgttggggtttattag

SEQ ID NO: 113065 - DNA, 669 bp, Glycine max
  Peptide Sequence Number=SeqID_229843
atggttactgatggaaccaaaaagcctcaagtttcagtacctacaccaccaccaccttggaaaatcaatttgcagaaatatgctgaatcctgtgctctcaaactccatagtcttcaatctatcatagaaaatagagtaaacagtgattataggtctcaaaagaacaagagaaggacaactgtgtttgataaccaaattgcaagaaaagggtgcagaagaaagaggcagaaactgggaataattgataaagcccttgccaaatcaggtttggaggagaatcaccaaaagaagcttcctcggtgtgttcatcggagatatgaactaaagaaaaacccagagaatggtttttgctatgaccaagctttggggttaccaccttcctttgtgtctacaaggaagggcgctcttgaaaaaggctcaaacaagaggtgcttgtacatgatgcaagctattatactgccctccaattggagggtccagaggctctcctgtatacaggattcattaatgtctgtattaagaatggtgctggaaccctatccggcaacaacaccacatcctggaaatcatgatgactctgttctttacagtgtaacctatggaagagcaatgctgcatcaatgtggagcaccagtttctcagccaattgctcctgtaacctacatgtag

SEQ ID NO: 113066 - DNA, 393 bp, Glycine max
  Peptide Sequence Number=SeqID_229844
atggagataaccaaatcacttgtctccaacaacaataataaaaagaacaaatgcacaccttccaggttagtagggcctgatggtgttggactattggtactgcctcgcaaagttgaacttaaggatgactcaagcttgctagttgcaacctatcaaccactaccagcagcattcacaaagcaaagcagctactacaccaaatcaaatagtttctatataacatgctcaaaactaaagtactcaaatcaaaactggagaaacaatgttgggcttggttggaaaaggatgaaagagaggctgagggacaggaaaatgcagagggtacagagaccaacaaagcatgaacaagtgtttggctactggaaacttgagagagcaaagtgcagagagtga

SEQ ID NO: 113067 - DNA, 561 bp, Glycine max
  Peptide Sequence Number=SeqID_229845
atgatagaggcagaatccccatcattttaccaggtggcaatgaggagtaaagctctaaacttggttcatgtccttgatagtgctgctgctgctactacaactgcacctgaaatacaacagaaaagcctcatggatgggttttcccaaataacgggagttcaatacaagttcattttgtttggagatggacacaagaacccaagctactgtgatcttgtcaacatgattacttctgatgtttttgatgctgccgtagtggtgtggattcttgaacatagaacaaacgatgagtttcgagggtcaccgagggaacatatagttacagttctttggtttagtttgtcaaccatgttgtttgcgcacaaaaaaacacacttagtccacttggttgagttgtgtccatccatgtcctgcatttacatactcacttccctcacatgcatctcacccccaaaagtgacagacatgttgaattgggccacatttgtcgttgatccccctcttcgtcgctctaccgacaccactctcacactcgatgtgtttaacatgcaatttccttaa

SEQ ID NO: 113068 - DNA, 807 bp, Glycine max
  Peptide Sequence Number=SeqID_229846
atggcttttatttttttcgaagcgccacggcgcgctcggcgtcgaggagtaccgcgaccgcggctacctgccggcggccctacgcaactacctcgtgcggctcggctggagccacggcgaccaggaggtcttctccaccgaggagatgatcgccgccttcgatctgaaggcgatcggccgctcggcggcgcggttcgacttcaccaagctggagagcctcaacgggctctatatccgcaacagcgccgattcggtcctggtcgatgcgatcgaggtgatcctgccggcccgcggacccgagcgcggcctgccgacgtcgctgacgcccgacctgcgcgaaaagctcctgtcggcgatgcccggcctgaaggagcgcgccaagacgctcgtcgagctcctcgacagcgcctactacctctacgccccgcgcccgctggccctcgacgcgaaggccgaaggcctgctcgccggcgaggcgccggagcggctacgcgcccttctccccgccttggaagccctgcccgagtggagtgccgcatcgacggaggcggcggtgcgcggtttcgcggaaagccagggcgtcaagctcggccaggtcgcccagcctctgcgggcggccctcaccggccgtgccacctcaccgccggtcttcgacgtgatggcggtgctcggccgcgacgaggcgctcgcccgcctgcaggatcgactggcggcctgaaccatcgaccgcgcggcggatcaacgcatcccggccgagccggcacgatccgggcgggctcccgacccgttcgggatcgctccacgtga

SEQ ID NO: 113069 - DNA, 450 bp, Glycine max
  Peptide Sequence Number=SeqID_229847
atgtgtcctccaccttcgagtttggagccatccgtagtgattgctttgtgcaattctccattcataaccccttttcggagccccgtgaattgcgttttcgttcatgtgtcctccaccttcgagtttggagccatgcgtagtgattgcttagtgcaattctccattctcaacctttttcggagccccatgaattgcgttttcgttcatgtgtcctccaccttcgagtttggagccatgcgtagtgattgcttagtgaaattctccattctcaaccccttttcggagccctatgaattgcgtttttcattcatgtgtcctcccaccttcgagtttggagctatgcgtagtgattgcttaagtgcaattctccattctcaacctttttcggagccccatgaattgcgttttcgttcatgtgtcctccaccttcgagtttggagccatgcatag

SEQ ID NO: 113070 - DNA, 306 bp, Glycine max
  Peptide Sequence Number=SeqID_229848
atgcttatcgcaattttaactcgagcagaaaattcacatagcgagatcagcccgctcagcacaattctagccagtagagaaattgcactcagcgtgaaatgttacgctcaatgcgaaatgtcatggtcaacgccaaaatttgaacttcacttagcgagatttgcatattataaatatgttcttcaccgtgaaaaacttgattttttgctcttcttctctccaaacattcactcaaaccctaacacattcttctccaccacccaaggccaccagtggcaaccacaagtggtcgttgcttgccactaa

SEQ ID NO: 113071 - DNA, 420 bp, Glycine max
  Peptide Sequence Number=SeqID_229849
atgactctaagacaacatggattaaatgaagaacaaggaattaacgagaattcaccgaacaaaaagatagaggaagcaaaagaacatcacctagatgaagatgctctgataccacatgatgtaagctccgttggagcttgtaggcctaggatcttcttcatcaatggattcctttgctttttagaagacaaatggcaacggaatggagaaaggaagagagagaggagacgccacttcaaggagaagatgagtctagaagaagctcaccaccataggaagccatggataagagcttggaggaagaaggagatgaatgaagggagagggagagaagagcacgaaattttgtgctctaaaagagctctgaaatctgaagttaatattcaaatgatcaaagttttaaaaaatgcacacacatga

SEQ ID NO: 113072 - DNA, 1275 bp, Glycine max
  Peptide Sequence Number=SeqID_229850
atggagaacttgttgcgcctagtagaccacgaagacttcttctctcgtcgttgcatttgggtgaatggccctataatcataggggcaggaccctcagggctagccacagcagcatgccttagagaacaaggggtacccttcatggttctcgaacgtgcagattgcatagcctcactgtggcaaaaacgaacctacgacagactcaaacttcaccttccaaaacaattctgccagctcccgaaactacccttccctgaagacttccctgaataccccacaaagaaacagttcattgagtacttagaatcatatgctaagcacttcgagatcaatcctcagttcaacgagtgtgtgcagtccgcaaggtacgatgagacaagcggcttgtggcgggttaagaccgtttcttcgagtggcgccgccgcccgcggcgagattgagtacatttgcaggtggctcgtggtggccaccggggagaatgcggagtgtgttatgcccgatattgaagggttgagtgagttcaaaggtgatgtgatccatgcttgtgattacaagtcaggggagagcttcaggggaaagaaggttcttgttgttggttgtggcaattccggcatggaactctcacttgacctttgcaaccaccatgcctctccatccatggttgttcgtagctcggttcacgtgttgcctagagaagtgtttgggatatcaacttttgaattggcagttatgttgctgcaatggctgcccctttggcttgttgacaagattctcttgatcttggcatggtttgttttggggaacattgagaagttggggctcaaaaggccttcaatgggtcctttggagcttaagaacacaaaggggaagaccccagttttggatattggtgccttggagaagattagatccggtgacatagaagttgtgccaggaatcaagaggttcaacaatggggaagttgagtttgttaatggtgaaaagcttgatattgatgcaatagtgcttgcaaccggttaccgcagcaatgtcccttcttggcttcaggaaggtgaatttttctcaaagaatggatacccaaagatgccattccctcacagttggaagggaaatgctgggctttatgctgtggggttcacaaagagagggctctctggtgcttcttctgatgctgtgaaaattgctcaagatattggccaagtttggaaaaatgagactaagcaaaagaaacagcgcactaccgcttgtcatagacgttgcatttcacagttctaa

SEQ ID NO: 113073 - DNA, 162 bp, Glycine max
  Peptide Sequence Number=SeqID_229851
atgtgggggacccatagccccatgcaaggggacaaaattttcaagatgcaagtgcaagtgttgcaacaatgttattctgacttaacgacagtcataggagacgacgtcatggtcgtgcacgtggcgaaggacaaagatcgcacgacagtgaaaccagtttag

SEQ ID NO: 113074 - DNA, 213 bp, Glycine max
  Peptide Sequence Number=SeqID_229852
atgcagagttcgtcaagaccacccggttgtgcacgtaactgcccccctcccataggtgatcagcctgggagcccaaaggagttccctaaggtgacaagccccctcagtacaaagtacactctgccacaactactctatttcctgtgtcgtataagctatgaacatggccaaaaaagtaggaatagcgggggcaagatacgcgggtttgactaa

SEQ ID NO: 113075 - DNA, 651 bp, Glycine max
  Peptide Sequence Number=SeqID_229853
atgtcggccagccgcggcacgttgatgagctccagcgtctccccggtcagaaggctcgcgatcatcagcggcagggccgcgttcttggctcccgagatcgggatcgtgccgttgagcggcgtgccgccggtgatgtggatgcggtccatcgggatcctcggagcacctccgttccggtcgcggaggtcgccttgcgtgccgggcgcgtgggcgccccttgttcagggtggaggtataggcggtatccggcaaaaagaagaagcgtggccgttcggttccaccccgcgtgccgcgcatcgctccgacgatgggggcgaagagggacgaatcgggcgcgaggaggcagccgtgcagtccgcgtcacccgttctcgggcgggggctcgggcgggcgttccttcggcgcgggctcgaatccggcgtccggtgcgaggtcgggtgtggcgtccggcgcgtcgtcggcccggccccgggcctgcgccttgcggcggcgcaggttgtcgcgcagggccgccttgagccgggcggcgcgctcgtcgtccttggttcccatcgcgcgcgttccgacaacgatcccagacacgatccgacggacccggcctgtccggtccgccggtgcgggcactggccgtcgggcgaaggccctatcccg

SEQ ID NO: 113076 - DNA, 634 bp, Glycine max
  Peptide Sequence Number=SeqID_229854
atggtcgtcggcaagcgtccgggccagaccgccgagaccggccagaccgtccggctcaccgcctcgaacgtcatcgataccacagcgccctacgaactcgtctcgaccatgcgggcgagcttctgggtcatcgcgccgttgctcgcccgcttcggcgaggccaaggtatcgctgcccggcggctgcgccatcggcacccgtccggtcgacctgctgatcatggcactggaaaagctcggggccgagatcgagatcgacggcggctacgtcgtcgccaagaccaagaacggcctgcgcggcgccgagatcacgtttcccaccgtcacggtcggcggcacccatgtcgccctgatggcggcggcgctggcctacggcaccacggtgatcgacaacgccgcccgcgagccggaggtggtcgatctcgccgagtgcttatccaagatgggcgcacgcatcgagggcgccggcacctcgcgcatcgtcgtggagggcgtggcgcgcctcggcggcgcccgccacgaggtgctgccggaccggatcgagaccggcacctacgccatggcggtggcgatgaccgggggcgacgtctccctcgtcaacacccgcaccgagctgctggcctccgtccttcgac

SEQ ID NO: 113077 - DNA, 924 bp, Glycine max
  Peptide Sequence Number=SeqID_229855
ggctacgtcctgcccgccctcgcccgtgcccgacgctcccgggcggtcgcgctcgtctcgggcaaccccgagaaggcgaagcgcgtggccgcccgctacggcgtgggggagaacgcgctctacggctacgacacgatggggcggctcgccgggaacgacgctgtcggcgtcgtctacatcgtcaccgctaatgcgacccatgccgaactgacggtgaaggcgttcgaggcgggcaagcacgtcttctgcgagaagccgatggcgaattcgccggccgagtgccagcggatgatcgacgccgccaaggccgccggccgcaagctgatgatcgcgtaccgggcgcattgggagccgcacaatctccgcgccaaggcgatcctcgattcgggggcgttgggacaggtctggttcgcatcctccgaccatcaccggcccctcgatccgtcgctgccccgcgaccagtggcggatgaagcgggacgtggccggcggcggctccctcgtcgatatcggcatctacagcctcaacgggctgcaatggttcctgggcgagagcccgaacgccgtcgcggcgacgatgcaggcgccccccggcgatccgcgcttcgccgaagtcgagaacgtgttcagcgccgaactcgccttcccctcgggccggcgggcgacgatctcctcgggctacaccgccagcaagaagcgcatcgacctgtggggcgaccggctcgtcgcgaccctcgatccggccacagcctatcagggcaaccgcctcgtggtctcgaatgcgaagaaggccgaggagatcctgaccgaggagaccagcgccgcccagttcaccggcgagatcgaccacttctcgcaggccgtgaccgagggcaccgaggtgcgcacgcccggcgagatggggtctgcgccaacatgcgcctga

SEQ ID NO: 113078 - DNA, 811 bp, Glycine max
  Peptide Sequence Number=SeqID_229856
gtcgactctagaggatcccaccctcgcggcacgcgacgccaacgacatgagcgccatcgacgccggccaggcgccgacggaggtccgccccttggcggatgccctcaacgggctgttcctcaaggtcgaggcggcgcggcggcacgaacgggaggtgacggcgttcgccgcgcacgagctgcgcaccccgctcgccggtttgaagacgcaggcccaggtcgccatggccgcgaccgaccctgacatcacgagagccgcacttcgccagattctcgcagccgtggatcgtacgacacgcctcgtccgccagctcctcgacgctgcccggctcgacgccgccgaggagacccggcctctgacggagatcgacgtgggcgcgctggtggccgagaccgtggcgggcatgcgagtgccagcggaaatccgaaccgtcgtcgatccagagctgcatggctacacgatgcgggccgaccccgagagcctgcgtctcgccgtccgcaacctgcacgagaatgccgtgcagcacatgcaggccgggctcgtggaatgggccgcgcggccgggcggtcacgaagcgcttcttccgaggacgccacaagagcgcgacgggaagcgggctcggactggccatcgcggagatggcctctcgtcggagcggattgagcctgcacctccgcaatcgatcggaccggcgagggctagaggcggagatcctgcgaggctgacgccgccccggctatccgaccgacaaagggctattgcagacccggttctcggggtcgaacagccggcagccggcatagcgcttcag

SEQ ID NO: 113079 - DNA, 168 bp, Glycine max
  Peptide Sequence Number=SeqID_229857
atgggaggtggaagaagggctggaagtttgggggtaggttgtggattcgagtatgataactccagtgacggtcctccaatttatcttcctggagtttggccaacaaaatcacttgaggtaaggaaagaggttgcagtacctgtacctcccatcaaagttctggtgtaa

SEQ ID NO: 113080 - DNA, 489 bp, Glycine max
  Peptide Sequence Number=SeqID_229858
atggatgacggcgggaggccgtgtgggatccgcgttgtcgagtaccgcccgcatggacatcgccgagctcgtccagagtcgctccgcccggcccgtcgtccgccgtcggcgcgggccgccgctcgcggccctcgcgctcaccgccctcggagggctcgcgctcgccgggatgctgcaaccggaggagagccccgcccctgccccggcgccgtccgcacagatctcgagcgaggccgaggcgccggagaccgggcaggccgtcccgaacgcgctggcctggatgctcgatccggctcccgtcctcgacaccgcgtcccgcggcttcgtccggcaggccccccaggcctccgccttccgggcgccgcccgcgccggagcgggtcgcacagattccagtcgcgcagaagccggtcacgcaagaggccgccccgaccctcgccgccttgcccgtgccggcggccgacgcggcgccctccgtgggatcctctag

SEQ ID NO: 113081 - DNA, 810 bp, Glycine max
  Peptide Sequence Number=SeqID_229859
ggcaacgtagaagaaggcggtgccgacggcgttccacaccgcgtcgcccgcggtcgattcgacccgctccgggcggtcctcgccggtgtcgaggtcgcgtacgcggatggtgtgaagttccgaacccttggtgtcgacgccccaggccagcaggcggtggtcgtcggaatgagccgcgccggcgatctcgaagaaggcgaggccctcgccctccttatcgccgtcgagcaggatctgctcgccgatctcgccgtcctcgggctcctcggcgatgcggtgaacggtgcgcggccggcggcagatcagcggatgctggccaccctcgcgatggcgggagtagtaggcgaacggcccgtcgggctcgggcaccgaggcgtcgtcctcgcggatgcgtccgcgcatctcggcgaccagggtcttgcgcagggcggcggcgccgctcagcgccgcctcggcataggcgttctcggcgtcgagataggcgcggatgtcgggggcgagcgccgaggggtccttcagcacggcccgccagttctcggccttgagccacgcgaacggatcctcgacgcgccggccgaagagttcgaaggcggggctcgaaggtcatcgccgaactccggttggaacgcgttggaacgcttggaacaagcgggtgtgatggcagcgggtgtgccgcgccgcgacgcgggccgcaaggcgggccgatgtccgatctccgcggcaaacgccgcccgtcagttgctcggcgggaagccctgtggagcattcatgacagattgcgcacgtcccggatcgccgccgaggcgttga

SEQ ID NO: 113082 - DNA, 588 bp, Glycine max
  Peptide Sequence Number=SeqID_229860
atgggggattggtggagaccatttaagtctgatttgacatcgaaatgggcacatgcagccgacaaggacggtgtcgatgacactgtttgcgaaaagtatgacattagcaaagaacccaattttgttagagccgcagagacccttcctgggagaaagaagttgatgaagaagaagaaaaagaagcaattggaggaagatgctaaatctggaagcactgacactgtcattgattctccatctcccattagacaacacgtgaagtggaagatggcccgcaccaagaaaattggccaaatgacgtctgaggcagtaaaggaaattgctgacaagatggcctcacagggttcctttgttacccatggacgtcatgatgtgttgactgccaccattgggcgaccaaaacaccctggtcgagtacgtgttgctggagccggtgtcacaatcaaacaatactttggaccggctccaaggacctcctacacatctttgtccatggctcttgaagacctggagcagttaacgcaaaaaattaaggacaaactagaggagtcgatcacagaaaaagtgacgtttggggcatgcacttaa

SEQ ID NO: 113083 - DNA, 550 bp, Glycine max
  Peptide Sequence Number=SeqID_229861
atggcggcgagcccgagcagcgtgggcaagctgcggctcggcagcacccggtcgtacaaaaaccagcatgaacagcgagccggtgagatagagcaggttcaccagggcgctcagcaagccgacgccgaggagcgcgcccccgatgccgggacgcacctcggccgtcgtgaaagacggttcgtcatccttagccgccgcggcgttgttcgcgagcgcggttggctgcatgtcgttctgcctcatgcgacgggactcgcgcgcgagggcgcggcggccttcaggtgccggccgggcagcgcgaagcgcccggccgctcggccccgcggattggcgcggggccgcacccggtcaggcgagcatgtagtcgtgctccgggctggcggaggcctttgcggtctcctggaagatcagcctggagccgtcccccctgatcgccgggtcgttaacgaaggcgccccgcgtcgcgtcgtaggcgttccacatgaagtcgtcctgggccatctggctcctcgtcaggccctggaggaggatcgagccgtctccctggccc

SEQ ID NO: 113084 - DNA, 312 bp, Glycine max
  Peptide Sequence Number=SeqID_229862
atggtcaatttccgcaggcggatattacaaccagaacaggtggccgatgcattgacgcgcatcaatccaatgccggatagcgcctcacagagaccgtcaggatcaggacggcgaggttgccgcgtctgcggcctgatgcgttcctcgcccggccgcgcgccctcaccacgcgatcgtgtaggcaacctccagcgagcgggggcgccccagcagccacgcggtgccgaagccgttcacggcgctgccatcgacggcgtagatcttgtcgaacaggttgaacacgcgcagcgacaggcgcgagctgggccgtga

SEQ ID NO: 113085 - DNA, 323 bp, Glycine max
  Peptide Sequence Number=SeqID_229863
atgccatcaccgaccgaaacccggcagatcttcgaaaccggtacacacttgatgccggcgatccataaagagcaagattggccttacgaggttccgcacatccggtacgaggcctatatttggcccactcatgatgtcggaggacaaccctgcgcacctcaaatcttcgaagaaaaagaggatgaggagtgggagaacaacgtctatatcacctgcgaagttcttggtttcagaggcttgtggaacgccgaagaaaggcgacgccgctatgccaacgatataggtatgacgctctattacggcttctatgacaacgcgcgctg

SEQ ID NO: 113086 - DNA, 786 bp, Glycine max
  Peptide Sequence Number=SeqID_229864
atgaaaatcgcatttggcgaaataagatcgttattacaaagtcagcgtattttcctcggcgggcagaggctggtttgcgaccatccgttttatcgtgatgagcaaccaattgaagtaccagaaaatttatgcactgaaccgtataccacctattgggggcgctgtggcgagcggttggcttcgctgggggctttcagttacacccgtacgttgttgccggcgtttattcaggttgggcgctacacctcaatcgctgatagattacaggtattaggcgatcgtcatcccttagagtgggcaagctccagcccggttttttacgcccgtcattcagcgctaatggaaaccctggcagcggataacggacgggaaaaccatttttacgcttttgaaaaacagacgcgccccatcgtgattggcaatgatgtctggattggacaaaacgtgacgttggcgcaggggattaccattggcgatggcgcggttatcgccgccaacgcgctggtggtgaaagatgttgccccgtataccatggttggcgggaacccggcgaagctcatcaaataccgttttgccgaaccgattgttgagcaactgttagcgctgcgctggtggcaatattctgcgcaggatattgctatgtttccggtgaacgaggtggcgcgcttttgtgaattactgcgtcatgcgcaggagcaaggtgaactcacgccgcttgcgctaccaaagctgacggcaacggtggtgaaaaccgtggtcgctggcggcatgaagatgaaatcataa

SEQ ID NO: 113087 - DNA, 1383 bp, Glycine max
  Peptide Sequence Number=SeqID_229865
atgcacgtcacgtcgtcacaaagccacatgaaagccgagctaaagggcacgacgtccatttcctttcaaaaccctaccaccactctcttcaacaaccctctctcgggagcactcaaagggtgcctcggaagcctcgatggggcatgtattgagaagctcttgctccactgtgccagtgctttggagagcaatgacgtcaccttggctcaacaagtcatgtgggtgctcaacaacgttgcttcccctgtgggggacactaaccaaaggctcacctcgtggttcctaagggccttaatctccagggcttcaagaatttgccccactgccatgagtttcaaaggaagcaacaccattcaaaggaggttgatgagcgtcaccgagcttgccgggtatgtggatctaattccttggcataggtttggttattgtgcatccaacaatgagatttacaaagcaataacggggttccaaagggtgcatattgtagattttagcataactcattgtatgcaatggcctacttttatagatgctttagcaaaaaggcccgaaggacccccttcacttagaatcacggttccatcttgtagaccacatgtaccccccttggtcaatatatcaatacatgaagttgggttacgtttaggaaattttgctaagttcagagatgtcccttttgaattcaatgttataggaaatacaggaccattaacaacagcggaattgagtgatgaatcaactaattttcactttgaagcaatgttaagtctcttgaatcctaccatgctaaaccttagggaagatgaggctttggtcataaactgccaaaattggctacgctatttgtctgatgatagaaagggaattagccgccaaagtctgtcgcttagggatgcttttttgaatataatcaaaggtcttaacccccggattgtgctcttggttgatgaagattgtgatcttagtgcatcaagtctcacatcaagaataaccacctgttttaaccatatgtggataccctttgatgcattggagacttttttgcccaaagatagttgtcagaggtcagagtttgaatccgacataggccagaagattgagaacatcataagctacgaagggcaccaaagaatagagaggtcggaatctggggtgcaaatgtcccaaagaatgaaaaatgtgggctacctcagtgttccattttgtgatgaaactgttagggaaataaaaggtttgctagatgagcatgctagtgggtgggggatgaaaagagaagaaggtatgttagttctcacgtggaaaggaaacagctgtgtgtttgcgacagcttgggtcccttgtgaaatgagggatcatatcggcattgatgcaggcctgtcttaa

SEQ ID NO: 113088 - DNA, 169 bp, Glycine max
  Peptide Sequence Number=SeqID_229866
atgtgaaaaagggaggtactataagcaaaaaggggcaaaaataaagaaaaaagaagtaaatcagaagaagcccaagtccagcaaggcgctaagcgcaagacacgcgctgagcgagaggtttcgcgctcagcgagactacgaaggcccaagcccaagtttgcacctataa

SEQ ID NO: 113089 - DNA, 631 bp, Glycine max
  Peptide Sequence Number=SeqID_229867
atgtcaatgtcttcgcgctttttgagaatgaatgataatataactttagtattgcaccatggaggaagattcactccacgtgccagtgatggaaaggttgaatatataggcggagaatttgacgtttgggaggatatatctgcagattgcctgaatgcatttatcttatatgatctggtgaaagcttgtaagaagtatagtaatataggagaatgtttttggttgattgataaggacttagattttaatcatgggttaaggagttgtacaactgatggagatatattacacttagttagggatgcttttgaaaatgagaatgagataaatgtttattttcatcatgaagtagatccaattttagaagaagtcccacaaatgttgtacttggaatgttatccaattcgaaaagctgttgagaatgtggatgatttagatgatgtacctgttgctggccatgaggaagatgttggtgctggagagcagacagatgctggtgagcagatggatgctgatggtagtgagcagagggatactgatgctggtgagcaaagagatggtagtgagcagagggatgctgaagctggtgaggagagagatgctgatggtgaagagagagatgttgctgata

SEQ ID NO: 113090 - DNA, 827 bp, Glycine max
  Peptide Sequence Number=SeqID_229868
ggcgacctcgccgggactcgcccggccgtgccaccacagccagagcgccgtggcgacgatggcggtgcggaaggccagcagcagtccgagctgcgccgtgccgctccacgtcacgatcatccaggtgcgccgggtgcgccgccgccacttcgacaggacgcgcgccaagcgggcgtcctcccgcgcctcggcgccgaaggccttcaccacggcgttgttgccgatcgtgtcgctgagcgccccgccgagccgcgtgtcgagggcgttcgagagcgtcgccgcgggcgcgatcacccgcgtcgccaggacgatcgcggtgccgacataggcgagcgccccgagcccgatcaccgcccccatcgccggccagtgcaggccgagcaccaccgtcgtgcccgcgagcacgacgacggagggcaggatcgagagcagcagcacgtcgttgagtccgtcgagcgcccacatgccgcgggagatcttgcgcacggtcgagcccgagaaggtgttggcatgccactccgtcgagaagcgctgcacgcgggcgaagctgcggctcgcgatgtcggacatcgtgccgagcgtcagcgggacaacgaggctccaggcgacgtggcgcagaaccaccgtcgcgagactcaacagggtcatcgcgaggaaggccggcatcgccgcctcaagcgccgcctcccgctccgcgcccgccagcgcgtcgacgaggcggccggcatagagcggcagcatgacgtcggccagggtggcgagcgtgatcgcggccacgagggcccgacacgagaccgaggcgttggcgccagccgcggacgacgaag

SEQ ID NO: 113091 - DNA, 570 bp, Glycine max
  Peptide Sequence Number=SeqID_229869
cgcctccagctccttgcctttcggccggcccgtggccggcatgccgagctggcgctcgacgtccttgatcgcctcgcgggtcttggagccgaccttgccgtccggctcgccgacatcgtagccgcgggcgatcaggcggctctggaggtcgcggcgctcggcgcgcgacagcggcgggtcgtcggtcggccagtcggcctggacgccggggcgcccgcgcaggcggtcggacaggacggcgatggccagcccgtaggattcggcggcgttgtaggagtagatcgcgtcgaagttcttggtgacgaggaaggcggggccgttgacgccggccggcacgaggatgccggcgggtccctctcccgtcagcggcttgccgtcgacgcgggtgacgccgagcgaggcccagtggccgacggcgtgcttgttcttgcggccggcggccccggcgttgaagccgcgcggcagccgcacctcgtagccccagggatgcccgttcgaccacttggcgacgcgcaggaagttggcggtggaggcgaccgcgtcggccaccgaatcgaccacgtcgcgccg

SEQ ID NO: 113092 - DNA, 273 bp, Glycine max
  Peptide Sequence Number=SeqID_229870
atggatgtgaaaacaacctttcttaattgtgatttagaagaacaggtttatataaaacaacctgaaggcttcttctctagcagtggtgagcatttggtttgtaaacttaagaaatctatatatggtttaaaacaagcctcccgtcaatggtaccttaagcttcatgggacaatttcttcatttgattttgatgaaaaccccatggatcaatgcatataccacaagatgatattttacttgcaaccaatggtcagggtttgctatatgaggtga

SEQ ID NO: 113093 - DNA, 440 bp, Glycine max
  Peptide Sequence Number=SeqID_229871
atgcttgcgcgaccgcctcacgccatgaccggcagcccaaccagccgcatcgaggctgccgacgtcgcagccgggcttaagcttgctcgcgccaaggatcatgccgcagttcgtgcgttggcacgggcaagcgaggtgggaagctggcagtctctgctcgccctatccgtcggcaccttggcctggggtacgatcacgcacgatcgccggcttgccgaggcgggtcggcacatgctgcgggctggcctcctggccagcctcgtcaagacaagtctgaagcggacggtgcatcggacccgcccgaatgttctcatggatgaggggatctacgcgcgcggtcggccagggacgaacgttgggccgtggcagtccttcccctcgggtcattccgccctgagtgctgccgtcgcctgtgccacggctcgtgcctacccggagat

SEQ ID NO: 113094 - DNA, 574 bp, Glycine max
  Peptide Sequence Number=SeqID_229872
gatcccaccggacgactgcgcggagcgcgtcccagccccgacgcgcagaggccgcccgccgcgcggcgcatccggccgttcggtccgatgtcctgccgggtgtcatgcgggtctcgccgtggcggttgcggggcgccggtccccgccgtcgcggggttccgggccgggcaggatcggccggcgagccgttcccccgagaacggccataagagccgcaacgagagccgccatgagagccgcaacgcgaaaaagcccggcacgcggccgggcttttcgttcgggaaatccggcggtccggccggcgcggacgacggcgaactcggtgtcgcggacctgctggccaccgctgacgagcacggtgccggggctgccgatggagaccgtgcggccctggttgtcgacggcgaaggcgccacggccgccggtgccgcgatcgaggttcacgtacaggccttcgaccttcagcgtcacggccgacgacttgaagaagttcaggaacgagtcggtcgggagagcgtactcgataccaccacccgcggcccagccggtctggaagtcgtcgctcgacacgccg

SEQ ID NO: 113095 - DNA, 909 bp, Glycine max
  Peptide Sequence Number=SeqID_229873
atgccctcacctttagagggactacatgtcctcaccgtcagaggactatatgtcctcgccttcaaaggactacacgtcctggccttcagagggctgcacgccctcgccatcggaggactacacgtcctcgccatcagagggctgcacgccctcaccttcagaggactacacatcctcgccatcagagggctgcacgccctcacctttagagggctacacgtcctcgccaacaaaggactagacgtccttgcctttagagggctacacgtcctcgccttcagaggactagacgtcctcacctttagagagctacacgtcctcgccatcataggactagacgtcgtcgccttcagaggactacatgtcctaacaatcagagggctgcacgccctaaccttcagaggattacacgtcctcgtcttcagggggctgcacgccctcgcctttaaaggactacacgtcctcgacatcagagggctgaacaccctcaccttcagaggactacacatcctcgccatcagagagctgcacgccctcaccttcagaggactacacgtcctcgccatcagaggacttcacgccctcaccttcagaggactacacatcctcgccatcagatggctggacgccttctccttcagaggactacacgtcctcctctttagaggactggatgtcctcaccttcagagggttacacaccctccccttgagagaactacatgtcctcgccttcagaggcctacacgctgtcgccttcagcgacctgcacgccgtcatcttcaaagggcgacacgtcctcgagttcgaagggctgcacgccccctcacctttagggggctacacgccctcgccttcagaggactataagtcctcgccttcagaggactatacgcccttgccttcatag

SEQ ID NO: 113096 - DNA, 225 bp, Glycine max
  Peptide Sequence Number=SeqID_229874
atgcctaaaattattacacataaatggaagtttggtaacctattggaggctcccaacacacttccaatgaaaggcctttttgttacaaaacttgaaagcaatgaagctcttaaggtggttggcccctttcttcttgactcaaatttttcaagggatggcaccaatcctccttccaattccttatatggcaacccacaaacaaggaaacaaagagacaagcaataa

SEQ ID NO: 113097 - DNA, 842 bp, Glycine max
  Peptide Sequence Number=SeqID_229875
gggagggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggtagcttcgcgccactggcttttcaaccaagcgcgatgaccaattctcacgttccctattggtgggtgaacaatccaacacttggtgaattctgcttcacaatgataggaagagccgacatcgaaggatcaaaaagcaacgtcgctatgaacgcttggctgccacaagccagttatccctgtgaatcaacgagcttttacccttttgttccacacgagatttctgttctcgttgagctcatcttaggacacctgcgttatcttttaacagatgtgccgccccagccaaactccccacctgacaatgtcttccgcccggatcgaccggccgaagccgaccttgggtccaaaaagaggggcagtgccccgcttccgattcacggaataactcccacttatcctacacctctcaagtcatttcacaaagtcggactagagtcaagctcaacagggtcttctttccccgctgattccgccaagcccgttcccttggctgtggtttcgctggatagtagacagggacagtgggaatctcgttaa

SEQ ID NO: 113098 - DNA, 712 bp, Glycine max
  Peptide Sequence Number=SeqID_229876
gttaccatcagaccacagagagattgaggctgctctttgcataccagggatggggtttattttaaatgttgagggccatccgaggaggattctcaagaaggatctgactaccttggcccaggtgtggagtgttctctcgtactccaacctgacccctacatctcatacatcagaccttattgtggacagagtcagacttgggtttcctactttgcttaccaccttatgccgagcccgaggggttgtctctaacaacctcacatttgagcgcctgagcccggctattaacttggcatacatcaggaagaactgttggaacattgatgatctaacagttgctttcccgggggctaggagggcgagggtgaggccagttgatattccatctacttttgcaactccatcacctactccaacatctacttttgcagctccttcagtcccagctcatatggtatcttctccagaatccatcctatcagtggatcagttcttagagaaggtagcttggcttggggcccatccttctcttgatagggaaggtggaggtcccacagcccaggtagcccaacaggtacaggatgcttcatttgagaccaccattccagagccattcactcttcatcatgaggtaggtgaagaacaggtgagaccaaagattgatgttacttctgagagatcacttgagggcacatcagagcctcctactccc

SEQ ID NO: 113099 - DNA, 417 bp, Glycine max
  Peptide Sequence Number=SeqID_229877
atgccatccagtactcaatggcttatgcaatcgtgggatgctatagtgatgggaatattatctgggagcattccatgggtgactatgatgattttgcctaaaaagtcaaccttgctacaaaagatggattgggtacaaatggaccgttgtcgtgtagcagcattgttgccttcgatcaaggagaaacaactagagagtcatagtaattgtgttagacatgatcgagaaaaccaaggtcttgataaagggaatatggctgaaattgatggctatcaaaacttgtttggtttgatgaaacagaggtttctgagtttcaagaaccaaaaatatataaaagagttggagcattttcaagcccttgctgaagctcaatttccaaaggtgataatagatttacctagtccatttagcatttaa

SEQ ID NO: 113100 - DNA, 165 bp, Glycine max
  Peptide Sequence Number=SeqID_229878
atgttagccctgcctcatgagcatggacgttccacgcttagtaggcgggttcccaaactgacaggtccccccacttgtccttttaacaaaggctactctcagtctgacgtgcgagatcttagagcctaccttggccacgtccaccctgacgagggacaactctag

SEQ ID NO: 113101 - DNA, 291 bp, Glycine max
  Peptide Sequence Number=SeqID_229879
atgggatttccaaagtttttaatagaggaatttatagctggacaattaaagaatagagtttcgtttcgtaaagcaatgaaaaaagctattgaattaactgaacaggcgggtacaaaaggagttcaagtacaaattgcaggacgtatcgacggaaaagaaattgcacgtgttgaatggatcagagaaggtagagttcctctacaaaccattcgagcgaaaatcgattattgttgctatacagttcgaactatttatggggttttagggatcaaaagtttggatattttctaa

SEQ ID NO: 113102 - DNA, 384 bp, Glycine max
  Peptide Sequence Number=SeqID_229880
atgaaggcccaagtggagaaggatgaaggcccagaggcagagacactatcaagactattaattgttgctgaaggcccaagtaatccttgtggcgtctacccagacttatcttccttcactggaagtggcgtctacccagacttatcttccttaaccggaagtggcgtctacacagacttatcttccttcattggaagtggcgtctaccctgacttatcttccttcaccggaagtggcgtcatccaaatcttcgtaacctgtatcaagcgatccgccccaaaaacatcagcccacctcggcaaaaaaacattattcaccgatactgataaaaaacatgatagtcgatgccggccaggaaagatgaccgatccaggtcaaaaatag

SEQ ID NO: 113103 - DNA, 309 bp, Glycine max
  Peptide Sequence Number=SeqID_229881
atggtaaggaatgcacatagatcaaaatgtcctaactctcttaaaacagttcccagtggagtcgccaactctcgcaacctaccctttggcaggagggcgacgggaggcacacgggtgcgtcttccaaggaaggaaggcgcgcggagtcgccaccaacgtttattcgaggaaaatgtcagaaaaagcaaaacgtgtgatctacgaactttaattgtgaaaggttcgggagttgtttttacgcacggggaagggtatttcctttgctcctacgtattcctcaattgtgatgaggaaatcagacctacgtag

SEQ ID NO: 113104 - DNA, 1521 bp, Glycine max
  Peptide Sequence Number=SeqID_229882
atgatgagcatgaagaagataatggaggtcaatgcggctgcacgattgcacgccctcgactttagaggactgcacgtcctcaccttcagagggctacacgccctcgcctttagagggctacacgccctcgccttcagaggactacacgtcctcgccttcagaggactacatgtcctcgccttcagaggactgcacgtcctcacctacagagggctacacgcccttgccttcagaaggctccgcgccctcgacttcaaaggactacacgtcctcgccttcagagggctgcacgccctttccttcaaagggatacatgtcctgaccttcagaggactacacgtcctcgcctttagagggctacaggtccttaccttcagaggactacaagtccttgccttcagagggctccatgtcctcgccttcagaggactacacgtccttgccttcagaggactacacgtcctcgccttgggaggactgcatgtcctcaccttgggaggactacacgtcctcacctttagaggactacacgtcctcgccttcagtggactacacgtcctcgccttcagaggactacacgtcctcgccttcagaggactgcatgtcctcaccttgggaggactacacgtcctcaccttcagaggactacacgtcctcacctttagaggactacacgtcctcgccttcagtggactacacgtccttgccttcagaggaatgcacgtccttgccttcagaggactacacgtcctcgccttcataggactacacgtcctcgccttcagaggaggactacacgtcctcgccttcagtgggctagacgccctaaccttcagatggttacacgccctcaccttcatagggctgcacgcccttatcttcagagcagtacacgtccacgccttcagagtactacacgtcctcgccttcagagggctgcacgtcctcactttcagagggctccacatttgcgcctttagagaattcaaggccgctgcaaagagacgagtgcgaatcatgctcactaacatgaccattcttacacagatatggatgacattgctacttagcaacattctgcccaacgaccacaatgtcgatctccccctgtggaagtatcagggtcccttggactcagagaagtccaacagggccctagggttcctagctctgatcactaggccctcattaaccgggctttcatcgagaagttttgtgcccccaggcaggcacagggtgaggcaccacagcagcctggggacgaccagcagggggcaacagacgcaccgccaccaccttcagggtccacctcagcttatctacaaaggctggagtgttgcctatgacacatggccgaccagtaggagaccaaccacccaggcaaacgttaaagaagcgctactaggaggcaacctagaattggctacgaagaagctccccgcgacaaggtccaggaagggcaccattgaagagggttacaatgcagccccgcaatccgacacaggcttcgacaaacactga

SEQ ID NO: 113105 - DNA, 488 bp, Glycine max
  Peptide Sequence Number=SeqID_229883
cttgcttctacagtctctgcgtgtcaacgggctcacttgcctctggttgacaaaaggtgcggataaccataaggtgtgtccgcatgctaccgggcccttgggtcacgatagcagaaatgagacttttttgcggtctcggtcggttgtcgctgacatcttcgggaagggtgcagatgaccacattggtctctacgtgtcaacgggctcgcttgcctctgacactgacatctccgagaaggtgcagatgacctcattggtctatgtgtgccaacgggctcgcttacctctggttgacaaaaggctcgcttgcctctggttgacaaaaggtgcaaataaccataaggtgtgtccgcgtgctaccgaacccttgggtcacgatagcagaattgagacttttttgcattcttggccggaagacgctcacatcttcgggaagggtgcaaatgaccacattggtctctacgtgtcaacgggctcgcttgcctctg

SEQ ID NO: 113106 - DNA, 274 bp, Glycine max
  Peptide Sequence Number=SeqID_229884
atggcacgcaaagacaaattatggtcattctgcgcccttttgtcatccagaggcggcgagcccgatgacatgcggagacaaattatggcagcgaatccggcagtatgcggagacgttggtcgttcagtgctgatcattttcaagaattttgcaggtactgctggcggggagattgaccgaccgaatgacccttgcttgaccacttcgaggtacttgacacccatcgttaggcaatccgcgaagttccgcgacatgtcgggagttgaaaggacgt

SEQ ID NO: 113107 - DNA, 725 bp, Glycine max
  Peptide Sequence Number=SeqID_229885
gttcgctatcggtctctcgccagtatttagccttggacggaatttaccgcccgattggggctgcattcccaaacaacccgactcgccgacagcgcctcgtggtgcgacagggtccgggcacgacggggctctcaccctctctggcgcccccttccaggggacttgggcccggtccgccactgaggacgcttctccagactacaattcggacgccgagggcgaccgattttcatggtgggcttttcccgcgggtagccccgcctgacctgaggtctcgttgggagcgtgcgtgcacgcaaagggtcgtcgatgggtccagaactgaccggctcgcacgtgattggtctcgagcgtggctcatccaccattttatcacggcgaagtcggccatgaacccagatttcaaccaaccacgaggcgggtgctcgcgggaggtcagcatacaccccgcgcagcaacattgttacatgtttgcgttggggaaacgatgtgtgacacccagggcaggcgtgccctccggcctaatggcttcgggcgcaacttgcgttcaaaagactcgatggttcacggggattctggcaattcacaccaagtatcgcatttcgctacgttcttcatcgatgcaagagccgagatatccgttgccgagagtcattgtatgtaaatgttgtgtcgtgacgactcccgcgggacaccgtctccgggcccccgggagtcgcacttaa

SEQ ID NO: 113108 - DNA, 237 bp, Glycine max
  Peptide Sequence Number=SeqID_229886
atggtgctgcaaaatccggtggaaggtaagaagcgcaaggattatcgggtcaacgaccagggcaggctgacggtagatggtaagccggttgccaccaccatcagcgtgaaaccgctggataaagccagctcggacaaggctgccgtgctggcgctgaacaccggtgccagcacgaaaatgctaatggctgaatgccccccttgcttcatcgggggggcatcgcggcctcgtgtttaa

SEQ ID NO: 113109 - DNA, 633 bp, Glycine max
  Peptide Sequence Number=SeqID_229887
atgctggtcgaaacggaaaacaaccgctgggttatcccccctcagcgtgcattgtggctaccgcctctgcagatacatagttacaatctgctgtctcacacagatctcagggccgtctatttcagtggcagccttatcgcggaatgtacaaattttgcgaagagtgaccaggtgcatgtcattacggctacgccactggtgaaagaactgataaccggtctgttcagtgataactacaacagaccgagccagcggaaaatggcactgttgcttctggaaatactcagcgaagcgccttctctgactgcggaacttccaatgccacgtgatgagcgattattctctgcggccagagaacttgtggtaaatcatcgctgggaaataccactgagcgatctggcttttatcgcgtcaatgtctgaacgtactttttcgcgattgtttattaaggatacgggttttagtttcagaacctggaagcaaagagcaagaatttatgcttcgttagatctccttgcgaataacatccctatcaaacaggtcgcttataagctcggtttttcatgtccggctgcctataccgctgcttttcgttccatcctgaatgcaacgccgcgcgattatttgccttaa

SEQ ID NO: 113110 - DNA, 663 bp, Glycine max
  Peptide Sequence Number=SeqID_229888
atggtggaaagctccacgtttgaaaatgcctggctgaaggatttttccgcgctgtgccgcggtttccttttcacctcgccatggcgcagcctggccacccagggttgctataccacgatcaacacgccggtaggcgatgccgcgctgctgcagggcgactttcaacagcagctgcgccagcactttgccgcggcgaaaaagcaggggatcgccaatccgctgctggtgggcgcgattccgtttgacgtcagccagccagcgtcgctgttcatacccgaatcctggcagagctttaatcgcgccgacctgcaacaggcgctgccggcgcagcagagcgatctgccggcagtgcggcggcggacggcagtgccagaccacgcggtgtttacccgcatggtggccgacgccgttgccaccattcagcgcggcgatccggacaaagtggtgctgtcgcgcctgatggatatcgtcaccgagcagccggtggataccgccgcgctgatgcagcgcgtgatcgcgcaaaatcccaatagctaccatttccatctgccactggcggaaggaggcgcgctggtgggtgccagcctcggaactaatgctgcgcaaacaggggcgcgatttctcctcctgcccgctggccggctcggcgcgccgccatcatga

SEQ ID NO: 113111 - DNA, 543 bp, Glycine max
  Peptide Sequence Number=SeqID_229889
atggctgtcctgttgttcattttccagtcgctgtcaggaacggcgcgggccgaccagggctggccgcgcagcgtacagggcgcgaccggaacggtaacgcttcaccaggcaccacagcgcattgtctccaccagcgttacgctgaccggctcgctgctggcgattggcgcgccggtcatcgcctcaggcgcgaccgcaccgaaaagccgcctggccgacgatcagggcttcttccgtcagtggggcgaggtggcaaagcagcgccacgttaagcggctgtacattggtgagccgagcgccgaggcgattgcggcgcaagccccggatctgatcatcgtcagcgccaccggtaatgactccgccctgaagctggtcagtcagctgtccgccattgcccccacgctggtggtcaactacgacgataagagctggcaggatgtggttacgctgctggggcaggccaccggccatgaagcacaggcagcgcagcgcgtaaaagagttcgacgatcgcgaagcggcgctgaagcaggccattacgtag

SEQ ID NO: 113112 - DNA, 690 bp, Glycine max
  Peptide Sequence Number=SeqID_229890
atggctcaggaggaacaaggctcctctgctagcacaggctcttgggctatagaggcctcatcccctccagaaggagaagctggactcctggccaagccagctgtgcaaggaactcctccacactcatacatagcaaataatgtctcagagatgaatgaggagggtcctgtaggaggagctagaactgatggagctgttaagggagctgcagtagaagaagatggaacagtagtggaaggagttgtagaaggatctggtaaagtagatgaagaaggagcagaagtatctggtgctgctgaagtagggggagcctcagatctcttacccttggccttccttggccctctgaatgtcactgttggatcatctagattccaacagttcttctttatatatgtcaagttaatggcagggctgagactctccaaagatatggaatttgatgtgactcctctagctttacacaaagttgtgattaaggctggaatgttgggcaatgatagaaatctggtgggagatgagaggctgaccatcagcattaagcttaaatcccctccctgggatgcagagcttagtagccaactcttaaggatcaggcctcaagagtgcaaatctagagggtcttcaagaaggtattcaacgtgtcctcatcaaacttcaccaaatggcctctcaccctcacctatttag

SEQ ID NO: 113113 - DNA, 291 bp, Glycine max
  Peptide Sequence Number=SeqID_229891
atgaatctaaaagtgatagacaagataggttgtgacataaggacttcacttatttcttatcagaaaattcacaccttccatgtcaacataactcacaataagaaactattagtacaacattggctaagattgttagcaaagttatcagaaggccagttgattgatggaaggttcaagtgcctaaaccatggatggcaattcgaaggtgaaggtaaatgtgtgaagatagctcatgttggttacagttcatcctttactagtaaatcaatgcaatacaataatttcttctga

SEQ ID NO: 113114 - DNA, 204 bp, Glycine max
  Peptide Sequence Number=SeqID_229892
atgataaagggagggttgcacgtaagattatgggtatgggtggagccatggaggtggttacgatgcggggtgatggttttggacgcggatttgatagatctaatgatgatggtggagcggtggtgtggtgatggtgtagggaggtcacgtggcggcccgcgtcatgatggtgatggggttgggagaaagatggcgacacagtaa

SEQ ID NO: 113115 - DNA, 297 bp, Glycine max
  Peptide Sequence Number=SeqID_229893
atgcacgcttctgaaaaaggcttctacctgcatggtgtttcaccggcacggatggcgaaatgcatgcacgtgaaaatggcaaaacctatttcgcccgtgaggatggcgacattcagtgaggatggcgccatgcatgtgaaacctgttgctacactgacacacctgttgatggcgacatgcatgcactgtttcaccgacaggaatggagaaatgtgtttcgccatgctcctcgacgaaatgcttacacaaaacagacccccaacgcacaatggacccttattgggaattagtttctaa

SEQ ID NO: 113116 - DNA, 1182 bp, Glycine max
  Peptide Sequence Number=SeqID_229894
atggagaaaggagcaatggtttttccttttccaatagcagtttcttgtctttttattatcgtccatatttttgctaattctgtttcaggtagcctagttttcaacttctatgcagcttcatgccccacagcagaactcattgtgagaaacacagtcagttcatcttcttcttctgatccttcaattcctgggaagctacttcgcttggttttccatgattgctttgtggaggatatttatctttcatattttcggtcttttcctcttgtgcttggacttaattcctttaaggagtcagatcacttgcttgcacttaaggctttccctaaatgggctagccggttctgtggggttcaattaggccctaagttcaaattctacaagaatcttactgggaatgtgggatgtgatgcctctttgatgctactagggaataatactgaaaaaagtgatccagcaaataggtctgttggaggattttcggttatagaatcagcaaaaagagtccttgagttcctttgtcctggaacagtttcttgtgctgacataattgctttggctgctagagatgctgttgaaattgtcggtggtcctatgattgaaattcccacagggagaagagatggaatggtttcagttgcttcaaatgtcagacccaacattttggacaccagttttacaatggatgagatgattaaccgtttctctagtaaagggttgtccttatttgaccttgtcatcctttcagggggtagaggttccaaaagggctcacaccataggagcagctcattgcagctcattcagggataggttccaagaagactcaaagggaaagctcacactcattgacaaaacccttgacaatacctatgcagacgagctaatgaaagagtgtcccttaagtgcaagcccttctgttacagttaacaatgatcctgaaacatccatggtctttgacaaccagtactacagaaatcttctcaccaacaaagggttgttccaatctgattctgctctgctaagtgacaatagaacaaggaaatttgtggaggacttggcaaatgatcaagagtttttctttgaaagttggggccagtctttcttaaagctcactagtattggagtcaaaactggtgatgagggtgaaattagaagttcttgtgcatcaattaatgcataa

SEQ ID NO: 113117 - DNA, 273 bp, Glycine max
  Peptide Sequence Number=SeqID_229895
atggttgttgcccacaagctatttgatacaactgctattccaaatcttgtttcttggaacaccatgatatctggttttgaccataatcaaatgtttgagaagtcattggagatgtttaataggatgcatttgcttggtgttgaacctatgagtttagttatgggagtgttcttttggcctgttactcgaatggtggatttgttaagagagatggcaacgctcgggttgggcagtgacgaagaacttggagatggggggcggggcaggggctag

SEQ ID NO: 113118 - DNA, 675 bp, Glycine max
  Peptide Sequence Number=SeqID_229896
atgggtgtcaccgccgggctccgtcttctccctcagtgccaaaaatttcttttagaatcgccaaaaatgccccgccgaagactacctcctcctgctggcgagcatggactagctcaaatccaccacaaaactcgaccacgtgctctcacgcgctcacaacaacgtgatgcacgcgctacgaagatctcaatctcaaaccctaggtcgatcgctaaagagctttgtcttcacgatcctctccgaactagttcgctcttaaaccggttcgtgcacggcaacgatgtgttccgaaaccaacggttcaagctggtgaactggattgagaagggaccgtggatcgtgaagaaggccatggggagccatagcgcatgcttgttagggaaagtgttgaactgcatttactacaaaggttctaattacctcaaaattgacgtcgacatcgaaattttgcacctcgtgttagggtacgtgacaacggtgatgatcgacatggggtttgtggtagaggcgcaggcggaggaggagttgctggagtggttgatcgatgcaattagggtttgccatatggaaatggcgttagccacggtgattgagtcaccgcacgtgccgcgtgggattgggttggctaaagtgaatcatcataagtctacggatgagcttgctttgaatgattag

SEQ ID NO: 113119 - DNA, 519 bp, Glycine max
  Peptide Sequence Number=SeqID_229897
atggacagttacctgtatcttcacccaagtgaaaacccagccgtttctcttgtttcaccagtcctggattctacaaactatcattcatggagcagatccatgattacaacattaagcgccaagaataagctcgaattcgtggatggaggtgcaccaaagccagcgaagacagatcgagtgtatggttcatggcgtcgctgcaataacatggttgtatcttggattgttcattcggtttctatctccattaggcagagcattctatggatggatagagcagaagaaatttggcgcgacttgaagtcccgatactcgcaaggtgacctccttcgtatttcagatcttcattcttgttaccatcgctcaaagaaaactagaagatcgagccatatagtttctacgtggcttgaacgaacaatacagcaatgttcgatcacatgtactgcttttggatccgatgcctgcgatatcgaagatattttcatatgtagcacaacaagaacgtcaattatctggtaa

SEQ ID NO: 113120 - DNA, 471 bp, Glycine max
  Peptide Sequence Number=SeqID_229898
atggatccagctcatgtctcaatctcacatgacagaacagattggactgcaaagagggaagatgcacaaccattgtgttttgaggtgactgaaagattgataggttttgcaggttggtggggcagagagaaagaaggaaagaacatacctaacttcttgagctttagagccccttgtgtgcttcaaaacaacagggaaattgttgacaaaaacggtgaaacacgctacttcagtggtgtgtttctttgcacaccaacaggacaaggacaagggaaatcaatgttaataacaaggaaatggatggacaaagtggggaatggtattgctgttgctttggtgggcattagcaattttggtatttgggacaaagttgaaagcacttctcttagtatgtgcatgcatgtgctctcgattggagtctatacgcatgctcaaccgccattgcaatggctatatcaaattttattatga

SEQ ID NO: 113121 - DNA, 327 bp, Glycine max
  Peptide Sequence Number=SeqID_229899
atggcagaggcagaatccaacttacttacaagttgcaagggtagaattacagaagcaatcaaagacaaaatagtctcaaatggggaaaagggcttatggcaaaaggagatgaagcaatcactatggaaatttaaggagacttggttcatccaatattcagtgtttccttactgctggattttcctaactcctaccatcaaacttgaggacaaggtggttttctatgatcggggacttattgatataaatgcaacagccattcaagggaaattaatgggaggtgcatcattgtggaaggcattaaaacaggtgtatcaaaatgagtga

SEQ ID NO: 113122 - DNA, 594 bp, Glycine max
  Peptide Sequence Number=SeqID_229900
atgaaaccaaaaaccactacccggtatttcattattcaagtgaagaaacatgaaacattccttgtactactgctctctatctctgtcaagaagaagaaaaagaagtcttgtggtaaagggtttgtgcacatattaaacgcaatgcacagtgtaaggttcatgtcatcacccattggtgtcacagttactgtgcctaataatgcaaggccatgcaataggatttcttgcatccgggtcaaggcttctatggtggactcttcctctgattttgttaagcgcatggaactggcctgcgatcatatcatagtgatgtccttggttgttttattttctaccaagaacatgtctgtactctataggttgcatcagagtgcaactaaagaaataagcaaccaatgccaattgcgtgtacatcttgcaactctaaagggcatactgaatgtaaatggtgtggaggcactggtttcttcattattggtgacaatgtgctttgtgaagttccatccagaaacactagctgtgttgtttgcagaggaaagggatcaaggtgctgttctgattgtcaaggaacaggctttcgtgcaaagtggttaa

SEQ ID NO: 113123 - DNA, 378 bp, Glycine max
  Peptide Sequence Number=SeqID_229901
atgggacaccaataccatcaagcaacagatggacttttaaaccttttcacaaaggccaatcacgatctctcaatggttcaccatcgcctcgaaaaggagtttcagcaggtttaccctgacaacgctaaccctatgaagctggtttctagaatcaagaagattcaggaagatatcacaatcttgaagggacagtgccatgagcttctggctgctaagcaggatttgattgataaggctcagagaattctggtggagaacagaaatttggtgcagcgtatgcagccatccttgggcatctcccgcactggtgaagatgatgctgcattcactaacttcaaacagcctcacaagaggagttttagttgttcaaaggattaa

SEQ ID NO: 113124 - DNA, 693 bp, Glycine max
  Peptide Sequence Number=SeqID_229902
atggcacttgcaaataccagtgttgcgagtacaacggttctgagttccatgtcaggtctctttacccttttctttggagccattcttggacaggactcagtaaatataaccaaaatagcagctgttttaatcagcatggctggtgttgccatgacaactgttgggaagacttcggcagcagatgagaatattagtatgactcaaaagcattctatcatgggggacatttttgctctactctcagcaatatgttatggtttattcacagtgcttctcaagaattctgttggatcaggagaaaaggtagacatgcaaaagctttttggctgttttggtctctacagttttcttggcttttggtggctagcatggccattaaatgttgtgggaattgaaccacatttcaaatttccaagttcaatgtccacttgggagattgttattgcaaatagcatttgctcaagcgtgatttcagattacttatgggcactttctatagtttggacagctcctttggtttctacgttgggaatgtccttgacaattcccgttgccatgatagctgacatggttatacatggtcgcaagtactctgcaatgtacatccttggatgcattcaggtttttgcaggatttacactagcaaacctttcgggtaagatttcaagaagtgatacagagttaagtacgtga

SEQ ID NO: 113125 - DNA, 558 bp, Glycine max
  Peptide Sequence Number=SeqID_229903
atggagaagggaaagggagtgatgggatcgggaggaagaagatggggcgttgacttctccgacaattccacttctcgcgacattcccgatcctcccggtttctctcgcgcttctctcgatcaggcacaagctctctataaccctttcttctctttcaatttcgacgattcaacgctaagtcgccagaagaaggacgctgaatccaactggaaagcccagaaagcttgggaggtagcacaagcacctatgaagaatttgctgatgatggggttcatgatgtggatggctggtagcacagtccacttgtttagcattggaatcactttctcagccctttggcaacccatcagtgccctacagagcgtgggaaagatgtttgagccctacaaagacaataaggtggagcttcttggacctaagttgttattcattgcccttaatttgggcggcttggcactaggtgtttggaagctcaatgcattggggcttcttcctacacacacatcagactgggtctcatccttggcacctgctcagcaaaaatcgatattgtattag

SEQ ID NO: 113126 - DNA, 1272 bp, Glycine max
  Peptide Sequence Number=SeqID_229904
atgaataacggcgttagtcaagaatccggtgtgctcctcgatttggcatcccacgtgaaccgcttcgccttcgattccttccgttccgactacaacaacagcaacacccttctctccaatttctcgcaattcaacaacacaagaaccggagaagcggcagtcaaacgcagcgtttcgctggggctgaaggttgggggagcgagtgtgcggtttaggaacattctcaatgacttcaacagagccgttaggtttcactgcgagaagatcccgattgggttcgcctcgcttcgcgtcggtgacggtgacggtgacggtaacggtgctgatggtaacgggaatggtgttagagtggatgagtgtagcggtgtggagaatgaagggtttagagggaatggcgtggagggtgagaaacctaaaaaagttttgattttgatgagtgacactggtggggggcatagagcttctgctgaagctatcaaagctgctttctatcaagaatttggagatgattatcaggttttcgttactgatttgtgggctgatcacacaccttggccattcaaccaacttcccaggagctatagctttttggtgaaacatgggccattgtggaagatgacctactatggaactgccccgcgtgtagtgcatcagtctaattttgctgcaactggaactttcatagctcgcgaggttgctaaaggcctaatgaaatatcagccagatataataatcagtgtgcatccactgatgcagcacgttccacttcgaattttgaggtctaagggtcttttaaagaagattgtttttactactgttattacagatttaagcacatgccatccaacatggtttcataagcttgtaactagatgctattgtcctacaacagatgttgcgcaaagggcattgaaagccggactgcagcaatcccaaataaagatttttggtctacctgtccgaccttcctttgttaagcctgtccggccaaaggatgaactaaggagagaattagggatggatgaggatcttcctgctgtattattgatggggggaggtgaaggtatggggcccattgaggctactgctcgggcacttggagattcattatacgacgagaatattggggctcctgtaggtcagatccttgtgatctgtggtcgtaataagaaacttgctaacaaactaagttctattagttggaaggttcctgtgcagccgtccatgtgtatggacgtgctcttacatgatgaactaggtgtctatccttag

SEQ ID NO: 113127 - DNA, 1668 bp, Glycine max
  Peptide Sequence Number=SeqID_229905
atattggcactgatgttggaaaacagttcaatatagaaaagcctggaagagaccaagatatgttggaggaagtcacaatcatagaggagccaactatagctgatttccagcgtctcatggagcttacaaattacacagataaagggtcttctcagctggcatacctcatgcaacactgggagtataagcaggctaacgcggttcggcttctcagagaggaacttgacaaccttagtaaacaaaggaaggaagttgagctcaggaagttggagatactgaaagacaatcggttcgaggaagagaattatggtggtgacaagcgcccagtttctatattggatgaggtttactatacatggcaggatgtgccagtgccactaaggaaaagtgatgtggttgtgcaaaacaagaggattgaaattgaagctgagtatgacactgttgtgtattggaaacagcgggcgctgcagttggaaaaacagttggaggcaagtgtccagagggagcagatactaatggacaagttgcaagaaagtgtaaagaatcttgaaaggcagtcttcacctgtggaagaactatctcagattctgaagagagcagataatttcttacattttattctccaaaatgcacctgttgttattggccatcaggacatcataggaaaaacagatgttgaaattttcacaggatccggtgttaaggaatcccaagatttcaagagggaagtaatggaaaaagggttgcctgcaaaaaaagaaattacttttgagacagaattatttgggtcaaagacattcttgatatacgtagaacctgtctttagcaaagcaggagagacaattggagtaaactatatgggaatggaaataacagatcaggagcttattttctccctaccctaccctcccttttcaacagaggagactatgagagcaaaacaaatgctggcaacaatgtctcatgagataagatctccactgtctggagttgtcagcatggctgagattctttccaccacgaaactcgatcgggagcaaaggcagctcttgaatgtcatgatatcttctggagatttggttcttcaacttataaatgacattcttgatctttccaaggttgagtcaggagttatgaaattggaagctaccaaattccggccaagagaggtagtaaagcatgtactccagacagctgcagcatcattgcagaaaatattaaccttagaaggaaatgtggcagatgatatacctgttgaggtcattggagatgttttaaggattcggcagattctcacaaatttagtcagcaatgcagtaaagtttacacatgaaggcaaagttggcataaacctgtacgttgttacagaaccaccttttgccaaagcagaaggccatcaaaagatgatcacagaacagtctacaaattcagcaaatggggtgaaggaagagaaacgtgcatcaacgccgcgaagcaacgatgatcaaaattgtcttgatggtcagaaaaacaatgaccatcctagccaaaatcatgcagtcaatgatgaatgcagatcttcagttaaaagtgaatgctcaataaatggagatactgaggagcaaacgcattcaactgaaactgtgtggatacgttgtgatgtatatgacacaggaattggaataccag

SEQ ID NO: 113128 - DNA, 252 bp, Glycine max
  Peptide Sequence Number=SeqID_229906
atgaagaaaaaatttgaggtgcttaataataaggacatggttagtgcagataggaacaggaacacccagactgctggacctcgtatctgcttatgggaggactttgcatacaggccgatgaaaatagtagcaatggctcttgttggtttcttcaggtttaaactggcaaatggaacaccaaatgtgacttacaaggtcatgtttacgcttcacatggacaagggtcttcatctgtgtgcaattccaaggtaa

SEQ ID NO: 113129 - DNA, 498 bp, Glycine max
  Peptide Sequence Number=SeqID_229907
atgcacacacatgacctctattccatgaagtgctttaaatgtcttggaagaggacacattacttctcaatgccccaccaagaaaaccatgattatgaggggccaagacatttatagtagcctagatgaggctacttcttcaccttcctctagtgaaagtgaagaagcaaaaggggaagaatctagtgaagaaatctacccccaagaaaaagaacaacctttaatggttaaggaggagtgtgaggtaagtgtctcctccaagaggttagctaagaaggaaatgcattttgaaataaagacaaatattaaagttatttcccctcttagacaacctccacattttctcctttgtgaaaagacacttgttaccattgccacacctcttaggcttgagtttattcctcaagtaaaggagttgttggatgagggattggttcgcaagagcttaaatccttatgctttgttggtacccaaaatagtgatcaaggggttcccatga

SEQ ID NO: 113130 - DNA, 214 bp, Glycine max
  Peptide Sequence Number=SeqID_229908
tttctatgcacatattcttctgaacgcgccagactatcccccagccctagccctgtgcacctatgcttctgaatgcgtcaagactggactcgccaatggaagtggcgataatcacttgctatgtcgccagtggcagtggcgagaagccactcgtgcatggcgatttggcttgcatgcaaggcaaaaatcacgtaaaaacaacatcccctcgtaa

SEQ ID NO: 113131 - DNA, 417 bp, Glycine max
  Peptide Sequence Number=SeqID_229909
atgtgtaagaaggagcatgaatctttcaaagaatacgcccaaaggtggagggacatggcagctcaagtagtgcccccaatgatggagagggagatggtaacaatgatagtagacatgttaccatttttctactatgagaagatggtgggttacaccccttcaagctttgccgatttagttttcatcggcgaaaggatcgaagtgggtttgagaagaggaaaatttgattatcctgctttgatgaatgggaagcctagggcaaatggagagaataagaatgagggaggaacccatgctgtgactatcgttcctatatggccaaatttcccaccagctcaacaatatcaatactcagccaatatcagcccttctcattacccaccaccctatcagccaagaacactcaatcatccataa

SEQ ID NO: 113132 - DNA, 447 bp, Glycine max
  Peptide Sequence Number=SeqID_229910
atgaattgtgttttcgttcatgcgtcctccacccacaagtttggagccatgcgtagtgattgcttagtgcaattctccattctcatcccttttttggagcccatgaattgtgttttcattcatgcgtcctccacccacgagtttggagccatgcgtagtgattgcttagtgcaattctccattctcaacccttttccggagcccatgaattgcgttttcattcatgtgtcctccacccacgagtttggagccttgcgtagtgactgcttagtgcaattctccattttcaacccttttttggagcccatgaattgcgttttcgttcatgcgttttccacccacgagtttggagccatgcgtagtgattgcttagtgcaattctccattctcaacattttttcggagccccatgaattgcattttcgttcatgcgtcctccaccttcga

SEQ ID NO: 113133 - DNA, 216 bp, Glycine max
  Peptide Sequence Number=SeqID_229911
atggctagcggcacagcatgccccgcaggtggagcggggtggccagaatggctagcgggcagggcaagtactgcagagtgtggtgtcaggtctccttatgtggtggctcgtggtccacaggtgtaccccttgaatctccccaacaattggtatcagagccgatggttcaagttggtgactagcttagatgagtatgcaagtaccgcaggtggctag

SEQ ID NO: 113134 - DNA, 405 bp, Glycine max
  Peptide Sequence Number=SeqID_229912
atgaaaaagttacggaagcatataggacttgattttattctctttcctcttctttctcagccatctaaagtgaaatatgcttatttagggttacggggattttatgaaagcattactgtcgcaacctacccttcgacgggagggcgacgcgagactcgcgggatgcgtgttccacgaaaggaatacgcgcggagtcgccaccaacgtttatttgaggaaaacgtcggaaaaaccggaaaagacgcgatctacgaactgataagtgaaaggttcgggagttgtatttacgcacggggaagaagagaaacgttaaggcattggaccattaacgatctcttggggcggtcgacaaaagcggggcttttgctcctacgtatcctcaatgaggaactcagacctacgtag

SEQ ID NO: 113135 - DNA, 165 bp, Glycine max
  Peptide Sequence Number=SeqID_229913
atggagaagatggatgtgcacataataacaagggggacccctaagggaaaatgggcacttagggcaaaggcagctcgccttggcgagctgaaacttagtgttgaagcaataagctcacccaaccgagctggagctcgcccaggcaagttggtttcttcaccatga

SEQ ID NO: 113136 - DNA, 514 bp, Glycine max
  Peptide Sequence Number=SeqID_229914
tgcggaccctcaaggcaatcctccattctcccctttttcggagccccatgaatgtcattgcctagcgctgttcatgtgtcctccattagcaagtgcggaacctctgaagaaaaaagaaggagtagagacgagagtcatcatcacggaaagggcaggacggacgaaatcagtgtcctatctttgctttcctcttatctccgatgagagtcccaagacgtgtcagaaatcaaaaggaagcaggcttgcgcaatccgagaaattccgtgatgtgcggaaatcgaaaagatgtgtttttgcgcgatccaaggttgttgcttctggaggaagcaaccttgctcgcctgggcgagctgggtggcaagctcctcccctattttgctataaatagggggaggagtgaagaagaaaagggttcagccttcttggcacttctctctctctctctcgaaattgctgaggaaaattatttccgtgaagaaaatccaagccgaggcgcttccgtaacgtttccgtga

SEQ ID NO: 113137 - DNA, 478 bp, Glycine max
  Peptide Sequence Number=SeqID_229915
ggcgaggttcaaacgaagaaaaggcttatggtggatacctaggcaccccagagacgaggaagggcgtagtaagcgacgaaatgcttcggggagttgaaaataagcgtagatccggggattcccgatataggtcaacctttcgaactgctgctgaatccacgggcaggcaagagacaacctgcctaaaccgtgaaaacggggttgtgggagagctatacaagtgtcgtgctgctaggcgaagcagcagagaatgctgcaccctagatggcgagagtccagtagccgaaagcatcactagcttacgctctgacccgagtagcatggggcacgtggaatcccgtgtgaatcagcaaggaccaccttgcaaggctaaatactcctgggtgaccgatagtgaagtagtaccggaaaccaccggagccgtagcgaaagcgagtcttcacagggcaattgtcactgcttatggacccgaacctgg

SEQ ID NO: 113138 - DNA, 741 bp, Glycine max
  Peptide Sequence Number=SeqID_229916
atgtcagatccctatttcatcaaattgcaccttagcaaatttgctgcgaaggacgatttggaacaccttcaactgatgaaaaatgtctgcctcggatccatccctgaaatccacatggaatcgtgtgatgtaagttcgttattccattccctacaaattgaaacgttcttgttcgatttcgaaaacatggcaggttaccatctggtcggttcatgtaatgggttgcactgtggggttagcgaaataccagaaggataccgtgtttgtttctggaacaaggcgacaagggtgatatccagagaatcgccaacgctgtctttttccctgggcattggtcgtagaaaaatgtttgggtttggctatgatccgtcaagtgacaaatacaaggttgtagcaattgcattgactatgctctcacttgacgtatttgaaaagactgagatgaaagtttatggcgcgggtgacagtagttggagaaaccttaaaggttttcctgttctttggactttacctaaagttgatggagtgtatctgagtggaacccttaattgggttgttattaagggaaaagaaaccattcattctgaaatcgtaattatttatgttgacctggagaaggagacttgcagatcactgtttcttcccgacgatttttgcttttttgatacaaatattggagtatttagagactcgctgtgcgtttggcaagatagcaacacccatctggcttgtggcagatga

SEQ ID NO: 113139 - DNA, 165 bp, Glycine max
  Peptide Sequence Number=SeqID_229917
atgcacgaatatgatgcaggaatgatatgcccattacaatgccatgaagagatgcatgacgcaatcaaggaatatgccaaaagatatcatcctcttaaggaatacattgtggcgatagggactttcagcgacaatgcatcattaaaagaggaaaactctagatga

SEQ ID NO: 113140 - DNA, 315 bp, Glycine max
  Peptide Sequence Number=SeqID_229918
atgacaactgagatcaaaggtttagaatctaataacacatggaccttggttccccttctagcaggaaaacaatgcattggctgcagatgggtgtataaggtgaaattcaaacctgatggcactgtggatcgccacaaagccagattggtagctaagggctacatacagcaggctggcattgagttttctgatactttctccccaattgctaaacttacatcagttagagttcttttggctgttgcaactgctaaaaattggtccatcttacaacttgatatggataatgctttccttaatggcaatctattttag

SEQ ID NO: 113141 - DNA, 170 bp, Glycine max
  Peptide Sequence Number=SeqID_229919
ggagaccagtcagggtcactctgtttttcgagaatgctccaaccatatgggatcagcacaggcttaaaggagcattcaaaccgggtgtatttacccccaaggcctacactccgaggagtccgttaaggcctctccctcttgattcaggtccaacccagaaaaacatttga

SEQ ID NO: 113142 - DNA, 204 bp, Glycine max
  Peptide Sequence Number=SeqID_229920
atgacaatctcggactcattcatcgttggattttcgtgcaatttgagcaccaggaagaaaaataaatcgtatgaagataatacaaatggaggcttcaatcccttctccgtctctctgacgtttgagaactctatcggagcagtcgaaggaaaaaaactggaggaatctcaaggaaccgctagagatgctgctatcgctggctga

SEQ ID NO: 113143 - DNA, 259 bp, Glycine max
  Peptide Sequence Number=SeqID_229921
atggctactatcccaaccctgacttatctcccgtctgacgaaaacgtcattctgcaacttatctcccgaccgcttccggccgatgccgatctctttgacgtcgccgacaactgcgccgcgctggtgagcgtactggtcgaaaccgatgatgtcgggagccgtactgcgctgtgcgagcgtctccttcagaccctgcgcaggctgcgtgaactctgcgatgtcgatcttccaccatacctgattgaacagctgatcgtcg

SEQ ID NO: 113144 - DNA, 582 bp, Glycine max
  Peptide Sequence Number=SeqID_229922
atgatcaacatcctcggcaaaaccacctccatcaacgtgcgtaaagtgctctggacctgcgaagaagcaggactcgagtatcaacaggaagattacggcagcggttttgcctcgacagaaacggatacctttcgcgccctgaaccccaacgccatggtgccggtactgattgacggtgatttcgtgctgtgggagtccaattccatctgccgttatctggcgcgcaaggccggacgtcacgatctgctgcccgcagagccgcaggcctgtgccaacgttgagcgctggatggactggcaggcaacagaattcaacaacgcctggcgctatgtcttcccggcgctggggcgtaaaaacccggactttaacgacccggagcgcattgcggcggggatccaggagtggaaccactgcatcaccattctggagaaccagttgcagcgcaccggtgcctttgcggcgggcgagacgtttacccttgcggatgtggtgcttgggctgtcggtgaatcgctggaaaatgacgccctttgataagccagacgtgcccgcgattgaggcctggtttggtgggatcctctag

SEQ ID NO: 113145 - DNA, 372 bp, Glycine max
  Peptide Sequence Number=SeqID_229923
atggggccagttccaatctttagcgctggagtttcaaaaaattatgcaaataatcaaggcctatgtggaggaaaaacattggcgccttgccaaaccaagtcttccaagagtaacttggctgttattgctggagctgctgctggcggggtgactcttgcggcattaggattgtgtattggattgttcttctttgtgcgacgtgtttctttcaagaagaaggaagaggaccctgaaggaaacaaatgggcaagaagtctaaaaggaactaaacaaattaaggcaagctatattggtgcattgcacagaacatatatgattacacaactattcatttttcttgtagatccatttgtgtcttgtagcaatagataa

SEQ ID NO: 113146 - DNA, 342 bp, Glycine max
  Peptide Sequence Number=SeqID_229924
atggaagccaatgtggttgcagttgccgctaccagggctattgctaaggagaacccgacgcccccttctgatatcaaccaaatgaatcatcgaacctcagatatggtgggcaaagatttgggaagtacggacgaccccatgatgtgcaaattcaaaacgagcacgcctttccgccatatgacttgcctcccaactatacaccacccaatgtggcatacactcccaataagaatgtcaataactccacttctatacccattgagagccaacaaccccaaactgatcatgcacgtgtctcttaaaccgtgggggagacacatgaaattccccaccacaatctag

SEQ ID NO: 113147 - DNA, 2693 bp, Glycine max
  Peptide Sequence Number=SeqID_229925
atggcgacgccgcacgtcaccggcgcggtggcggtgttgctgcagcgtttcccgtacatgagttcggcgcagattgccgacgtgctgaaaactaccgccaccgacatgggcgcgccgggcatcgacgcgctctacggctgggggatgatcaacctgggcaaagccattaacggcccgggcatgttctataccgtcgaggatattccggcggagttccgcatcccggatccgacgggcgtggcctacggcccgacccagtttgtcgccaatattccgggcctgggcgccgaggtggatgccggcacgctgcacgccagaaagtgtgacgacatcagctgcgaactggaagtctactccaacaacatctctggccacggcggcctgaccaaagaagggatgggcacgctggtgctgacgggtaacaacacctattccggcccgacgctggtcaatcaggggcggttggcagtcaacggctcggtcacttcggccgtcagcgtgcagagcggcggcatcgtcggcggcagcggtacggtcggttcgctgaccgcccgtcagggcggcaccgtggcgccgggcaactcgatcggcactttgaacgtggcgggtaacgtcagcttcgagccgggttcgcgctacgcggtggaagtggggccgaacggccagagcgatcggatccagagcagcggatcggcgacgatcggcggcggcgaggtggcggtgacgctggagaacagccccaacctgctgacgcaaagcgaggtgcgcagcctgctgggccagcagtacaccatcctgagcgcgcagcagggggtgagcgggcagtttgacgcggtggcgccgaactacctgttcctcggcaccgggctgagctaccagccgaccggggtgacgctgagcgtcgggcgcaacggcaccagcttcgccagcgtggcgcagacgccgaacgagcgagcggtggcggcggcggcggatgcgctggcggcgggcaacccggtgtacgagagcctgctcggcagcggcacggcgggcgaagcgcggcaggcgttccgtcagctgtcggggcaaatccatgcggacatcgcctcggcgctggtgaacgacagccgctacctgcgtgaggcgctgaacgggcgtctgcgtcaggcggaagggctggcgagctcgtcggccatcaaggcggatgagggcggtgcctgggcgcagctgctgggggcgtgggaccacgcgtcgggcgacgccaatgctaccggctatcaggcctcgacctacggggtgctggtggggctggactcggcggcggcggacgactggcggctgggggtggcgaccggctacacccgcacctcgctgcacggcgggtacgggtcgaaggcggacagcgacaactaccacctggcggcgtacggcgacaagcagttcggggcgctggcgctgcgtggcggggcgggctacacctggcaccgcatcgacaccaagcggtcggtgaactacgggatgcagtcggaccgcgacacggcgaagtacagcgcgcgcaccgagcaactgttcgcggaagcgggctacagcgtgcagggtgagtggctgaacctggagccgttcgtgaacctggcgtacgtgaacttcgagaacaacggcatcgcagaaagcggcggcgcggcggcattgcgcggcgacaagcagcacacggacgcgacggtgtcgacgctgggcctgcgtgcggacaccgaatggcaggtgagcgcgggcacgacggtggcgctgcgcagcgagctggggtggcaacaccagtacggcgggctggagcgtggcaccgggctgcggttcaacggcggcaacgcgccgttcgtggtggacagcgtgccggtctcgcgcgacggcatggtgctgaaggcgggggcggaagtggcggtgaacgagaacgccacgctgtcgctgggctacggcgggctgctgtcgcagaaccatcaggacaacagcgtcaacgccgccggcatgccggctccgtttttatttgcggctgcgggattagcgctaaaggctcaagccccgtttgatttgcgcagtccgagcgatgtgctcatcgtctcagtagcggcaacggaacaaattttccctggtgttactatggttattattaaaaaacgtgctggtgttattttttatagtgtattgctgtatgtctcttttgataccatgtttgacgatgcaacatgggagctgtttttacattacgggattggaaaacgtcagcatgcccgcgagctcagccgcatcttggatctgagtttttcacatgcgcaccgcaaactgaaagggcaaagcccctggacgctggaacagatcaacagcgtcgcggccgcgttgggagaaacgccggcggcgatcgccgatttgagcgccgaacacgagaccaccgagccaaacatggcgcgcgatgccatctttttcgtggcgggggtggcgatgccttgcgtcgggcacattggcgatgagcttcctgccgggcggccggcggaatttgtggcgctgcgcgtggaagggcagtggcgtatctatcgcgccgatgaggcaccggcaggcccgcgttacggcgtcgatctgatcgaaatccggcccggcttcggcgacgacgagcggctgagcatcgcggtattggacgattcgcataaggcggccgatgagctggccaa

SEQ ID NO: 113148 - DNA, 948 bp, Glycine max
  Peptide Sequence Number=SeqID_229926
atgaagcttggattcctcaaatgtacaactaagcatggtgtttatataaagggcagcaatactactaacttgactgtagtgtgcctgtatgtagatgacttgcttgtgacaggaaataatgagattgaaattgccaactttaaaggagagatgatgagagaattcgaaatgactgatttggaccttatttcttattttcttggaattgaattcaagagaactgatgagggagtgatcatgcatcaagggaggtatgcaagagatgtactgaagaagttcagaatggttgactgcaattctgcagacacacccactgccactggtgtgaacttggtgaaagatcctaatgaagaagaagtagatgtaattttgtatagacaaatggtgggctcactgagatatatggagaatcctaaactttctcacttctgtgctgccaagagaataatgaggtatgtgaaaggtactctcgattatggtattctgtttcccagtgctgccaaaaaatgtaatgttctgggatatagtgattctgattggtgtggagataagagtgataggaagagcacaacaggttatgtgttcttctatggtgatgccccaatctcgtggagttcaaagaaggaacaagtggtggctctctcctcatgtgaggcagaatacattgcagctgctatggcagcatgtcaagctcaatggcttgataatatttttggtgaactgaagatgaaggaaaagggtgctattacactgatggtggacaacaaatttgccatcaatctagctaaacacccagttgctcatgggaggagcaaacacaatgaaacacgatttcatttccttagagagcaagtgacaaaaggcaagttaagtgttaagtattgtccaactactgtgcaagtagcagacatattcactaaaccattgaagattgatcagttcaaatag

SEQ ID NO: 113149 - DNA, 1542 bp, Glycine max
  Peptide Sequence Number=SeqID_229927
atggagaagagatttggccgtggaagaaggagaagggaatggaggaggttttggtgggtgaaggtagtagcgtttgtcgccggtaacaatggaggacgtcagagagggatggagactagactaaacagtggtatggaggatgaagaaaataggtctgcaaattctggaggcagcggtgtcgtgtatagagatactttgtgtttgggcagaaaccaagtcagtgttccacgtgctcctggggagtctccccttttgaatggtactagtactagttatttgacttgttctctgcgcatggaagccatgaaaggagcaagagttggcgtgggcgaggaccacgacatgggtgacggaatgcaatgcagtgaccacccttacagaaacaaccctggcggtatctgcgccttctgccttcaagacaaactcggcaagcttgtttcctcttctttccctctccctctccttcctccttcttccccttcttcctcctccactctcccttccatctcctcccttcctccctcctcagcccccgctccttcctcctccaccgccgtttctcacttcaatcatccatactaccctcgtagaacgcgcctcccttttctcttgcccaagaagaagagcaagaaacccacgtcagcacccacctctgataatatccttctcaagcgcagcaaatccactgccactccccgaagaaaccgctccttggtcgacgacgacgacaacgacgacgacttagtcattgggccttttagtcccaggaagagaaacggcttctggtcctttctctatctctcttccaaatcatccaagaaactcaactccaaaagcttcagagacaacaacatcaacaacactccgaggatctcctccattaacttagcaccggcaagtactagttctgcaaagcttaaagaaaagtgttgctctggttcttctctcaagactgacattgttgttgaacaagataacaataacagtaacagtcccaacactgcttctgcttcttctttcgagcgcaaggtttcgagatctaaatctgttgggtgtggtagcagaagcttctctggggacttcttcgagagaatctctactggctttggagattgcactctcaggagagtggagtctcagcgtgaaggtaagccgaaggggactggtggtggcgcctccgccgccgtgagccgtgccggcgaacaacaccaccaccattgcattaaagagagggtccggtgcggaggcttgtttagtgggttcatgatgacttcgtcttcttcgtcctcgtcttcttcctcgtattgggtttcttcttctgctgatgatgctgctgctgtgaatgggaaatcagcgactgtggcactctctcataacagaggtaggagttggggttgggcttttgcgagtcccatgagagcttttagcggtaaaccttcttctaaagagagtaaccgaagggatattataagagatgccaatgataagaatgccacgcctaacttatctgctataccttccttgcttgctgtcagaggctga

SEQ ID NO: 113150 - DNA, 255 bp, Glycine max
  Peptide Sequence Number=SeqID_229928
caaaataggggaggagcttgccacccagctcgcccaggcgagccaggttgcttcctcgagaagcaaccgccttttggaggaagaatctggaaggcccaagtgggcctgctttcggaatgttacagaaactcacagattgtgcaacaacacttccttttgatttccggcatgtctcggaacttcacgtattgtgcaacaaagggtgccaagtacctcgaagcggtcaaccaaaggttgtatgccatcaaacaatag

SEQ ID NO: 113151 - DNA, 3357 bp, Glycine max
  Peptide Sequence Number=SeqID_229929
atgaatcgtagagtgaggaggaaggtggcgaggaagaacaaagggaatgtggtgcagtctagtttccctgaagatcaagatgaggttttggatttggaaccccaaaggcaagggtttgttgattggaagtgcttgcccgatgatacagtaattcagctgttgtcatgtctgagttatcaagatcgagctagcttgtcgtcaacttgtaagacatggaggtctcttggcagctccctgtgtttgtggagttctctggatcttcgttcgcacaggtttgatgccggcatggcttcatcgcttgctcccaggtgtgtgcatcttcagaagctcaggtttcgcggggcagagtctgctgatgcaataattcatcttcgagctaggaacttgcgtgaattgagcggtgactattgcaggaagattactgatgcaactctctcagtgattgtggctcggcatgagttacttgagagccttcagcttggaccggatttctgtgagagaataagtagtgatgctattaaagcaatagctcattgctgtcctaaattgaataaacttagactctcaggcatcagggacgtaaatgctgatgctattaatgccttggctaagcattgtccaaagttgactgatattgggttcattgattgtctgaatgttgatgaggttgcgctgggaaatgtgttatcagttcgtttcctttctgttgcggggacatcaagtatgaaatggggtgtggtttcccatctttggcataaacttcctaacctgattgggttagatgtttcaagaactgatattggtccatctgctcttttaagaatgttatccttatcacagaatttgagggttttaattgctctgaattgtcccatccttgaagaagacaccagcttctctgctagcaaatataaaaacaagttattaatctctcttcgtactgatatttttaaagggctggcttctttattgtttgataatacaaggagaggaaacaatgtatttttagactggaggacctcaaagaataatgataaggacctcaatgaaattataccctggcttgagtggatgctatcccatacacttttgcgttctgctgagagtccccaacagggtcttgatagtttctgggttgaacaaggtggagcacttttgcttagtctaatgcagagttctcaagaggatgttcaagagagggcagccacaggtcttgcaacttttgttgtaattgatgacgaaaatgctagcatagattgtggaagggctgaagcagttatgcgagatggaggcatacgcctcctacttggccttgcaaaatcttggagagaagggcttcaatctgaggcagccaaggccattgcaaatttgtctgtcaatgccaatgtggccaaagctgttgcagaagagggtgggattcagattcttgctggtttggctaggtcaatgaacaagctggtggcggaagaggctgctggaggattatggaatctctctgttggagaagagcacaagggtgccattgctgaagctggtggaatacaagctttagtggatcttatattcaagtggtcctctagtggagatggagttttagtaagtttctctgattttatggaacgtgcggctggtgcattggctaatttggcagctgatgacaagtgtagtacagaggttgcactagcaggaggtgtacatgctctagtgatgcttgctcgtaactgcaaatttgagggagtgcaagagcaggctgctcgggcattggctaacttagctgcccatggagatagtaacagtaacaatgctgccgttggacaagaagcaggtgcccttgaggctcttgttcaacttacttgctctccccacgagggtgtcaggcaagaggctgctggtgcactttggaatttgtcatttgacgatagaaatcgagaggccattgccgcagctggtggagttcaggccttggttgctcttgcccaagcttgtgctaatgcctcccctggacttcaagagagggctgctggtgctctgtggggattatcagtctcggaaactaacagtggaaaagccaagtttatgagtgttgctaggcttttagtggtggttgattgttgttccgttgtggcacaacagggaacaactctatggggatctgtaactgtacttccaccaacctctgccttgtcaatgcagaatactggcaaagttactcatccccctccccttcagagaacttgcctctggcagttttgtgcctttctagaaattgaagtcacgacctttgattcttataccatttgtttgattgatcgcttacagaagtgtgggatcgctgtggagtggatcgtactaggatcggcaagcaaattcactgagttgaagacccgcgacattgtagggtgtggttgcagattagcaacaagcatggcatggcgcaaaacggtagtgcggtgcaagtttgttgtcgtggttgaagcagccgtgcagaaatgttctgcaacttctggcaaggtagagatgttctgcaattctgacgatgcagaaagagctaaagagaaaatggtggctgatgggagaaagagaaagaaacaagggtttctcactttattttactttttgggtcagagtggtgttgccattggacgagaaggaggtgttgcacctctgattgcacttgcacggtctgaagcagaggatgttcatgaaactgccgcaggagcactatggaatcttgctttcaatgctagtaatgctctaagaatagtagaggaaggtggagtatctgcacttgttgatctctgttcttcatcagtatcaaaaatggcacgattcatgtctgcgttggcattggcatacatgtttgacgggagaatggatgaatatgctttagtagtcacttcatctgaaagtatttctaagagtgtgagcttggatggagctagaaggatggctttgaaacacattgaagcttttgtccttatgttctctgatctacaagcatttgcggctgctgctgcatcatctgctcctgcagcattagcacaggttactgaaggtgcgcgcattcaagaagcaggacatttgagatgcagtggtgctgaaattggaagattcatcactatgctacgaaatccatcatctatactcaaggcttgtgcagcatttgctcttctccagtttaccattcctggtggacgacatgccatgcaccatgctagcctcatgcaaagcctgggagcatcaagagttctgcgtggtgcagctgctgcagcaactgctccacttgaagcaaaaatctttgccagaattgttctgcgcaatcttgagtatcaccagatagagcaagcactagcgtag

SEQ ID NO: 113152 - DNA, 831 bp, Glycine max
  Peptide Sequence Number=SeqID_229930
atgggtgaagcaaactctccacatcaccgcaaacacccaatcaccgcaaactcaccaccaccatcacactcaccaatgtgcgatcatcatattcttcaacaaaaccaacaagtggtggagcccacagacctgttctccatgatgcacatcaacaaccgtcagccaccctgctccgccgccaccaaccccatgaagcgccgatcacccccgtcttcctcctcctccggcgagccctgcgccaagaagctcttctgcgaccaagaggatcccactcactacggcttctccgccgttcccattcccctcaacatcaactccctcgtcaacaagggtggctctttccccgtcctccgccgctgcgtctccgacccctacacctctccggcgccggcaccggagccggagcaatccatgccgccggagagaggctctgggctgcctcccctgccgccgagattccgacggagcgtgtcggatctctctgttccttcgccagataaggctttgtcctgtttgagctccgaagaaactgccacgcctgattccgtgaggctgagaaggatgaaggagcgtttgaaagagatgagacagtggtgggatgaagttatgaaagatgaggaagaagatagaggtggaagagaagaagagtgtgcagttgttgctcaagatgacaaggccctagctcaggatgatttggtaggtggagattctgaagaatctgttagtgttgattggattgaacggtgcgtaagccttggttttaggtgcccctgtgggaaaggctatgaggttctcctttctcaaaataactgttactacaagttggtgtag

SEQ ID NO: 113153 - DNA, 459 bp, Glycine max
  Peptide Sequence Number=SeqID_229931
atgcttcaagtgcaaccaataaacctgacattctttcttgcatcatataaaatcaagtctgtttatgtgagaaacttgtcacctgcagtgtctcctaaaattgaagacgaattcaagaattttggtagaatccggcttgatggtgttgttattagaagtcacaaggatgtcggtgtttgttatgcatttgttgaatttgaagatatgactggcgttcataatgcagtcaagttttccaactatccctatcatgcattcttctttagaggatggttcatatcctcaactgctacatcttgcttccctatccggaatactaaaaggagccttccacctaaggcaaagaatttggtagttgtttggggtttgagagcttttgtctttggtgtctacttctacaccatgaatggatacaagatatttagccaccagaaggaacaagtgaaagagagattgtaa

SEQ ID NO: 113154 - DNA, 480 bp, Glycine max
  Peptide Sequence Number=SeqID_229932
atggcaaggaacgtgggtttaaatatgataggatactccaccattgcaatggttttcataattggtgtaactaaagcaacagaatatatggttggtgacaacttcggatggaacgttccctcctatgagagcttctatatggactgggctagaaccaagagattccatgttggtgacaaactcattttcagctggagcggagagcattcgttgggaattaggaaagacgatatttattacgagaattgcagcaccagcttagaaggtggtctcacgtacatatttaatggtgcaacgataaattatactattgtttctacacctgggcctgtctatttcatctgcacagttgacgatcactgtgaaagaggccagaagtttagaatcaatgtgtctgctgctcctgcactatcgtttggaatcttatctgcatttctctctagcttggctgtgtatttctgcttcaccgttaccagttag

SEQ ID NO: 113155 - DNA, 291 bp, Glycine max
  Peptide Sequence Number=SeqID_229933
atggatccctttaaaggacaaggaggcattcagatgctgctgattgcagaacaagaagcccaacatattgcaaaggatgaggcagagagggaggcaacagaatacagatctcacattgaagaggagtatcaaaagtcaatttcagagaacactgggagttctggatctaatgtaaaaaggcttgaggaggagacaaatgctaagattaaaaatttaaagaaatcaacttcaaaggtctcatcagaagtggttgacatgctactcaagtatgttacaaatatcaaaacataa

SEQ ID NO: 113156 - DNA, 279 bp, Glycine max
  Peptide Sequence Number=SeqID_229934
atggatgaagatcaatggacatatgacaatacgatgtcacaagaagttcatatggattatgaaaatgaagaagaatgtggtgtgaatccactacatgttgattgttcggatgcttttaatacttctcagcatggaactcgtcgaaccaccacagaccatctcgaggaagccatagccgccctcaccgaacattccgatttggctaataagttcgaagccatctgtgaacgcctctcccacatgacctcttctgctccgccacccccttccgcgccgtga

SEQ ID NO: 113157 - DNA, 264 bp, Glycine max
  Peptide Sequence Number=SeqID_229935
atgaatgaattggttaataagatagtaaaaggttatcgtggagatccacgcagtttgttgtctgttgtgaggatcccccgtgaagccaagtggaaatgtggccagatgagccattttttatctgttcaaccaaatgcaaggtcctggatattactaatatggatcaagatgttggttgagcggacagatcacacaaagcttgtctaccctaagagaaagaaaggaggaaaattttctttcctttataatgcaaagaattattaa

SEQ ID NO: 113158 - DNA, 459 bp, Glycine max
  Peptide Sequence Number=SeqID_229936
atgttcactgaattcattaatgagaacgtgaatctgaacaaagcagatgaatctatgttaaccactgcaatagtggcaccaccagcagccatgatggataagaaagcaggacaagtagtgcctcaacttgcacttatgaatgccatacctgatgttgtgtttgtgccctcagctacacttttggctctcattgctattaagatcataaaattaaccttcattggaaatacaacatctaaggacacaaagacacatgtgcaacctacacctgaacaaaaacttccaaccacaattgcatttgaaaaagaacctcaaattgcaactaaacaagaacctcatactacaactacaattgaagaacctcaaattgcaactgaacaagaacctctaaactacaactgcaccttcacatatacctcgatacatccacaaggacaacaccttttgccccttatgtaa

SEQ ID NO: 113159 - DNA, 2400 bp, Glycine max
  Peptide Sequence Number=SeqID_229937
atgagtagaagcagaggacacacgatcatggaggttggacctgacggggttgccatcatcaccatcgttaaccctcccgtcaattctctctcctatgatgtattgcgcagttttaaggagaattttgatcaggctctacagagagacgatgtcaaggcaattgttgttacagagtctgagcttggagattattcaaataactgggaagggacggcacttaagtttgctcaatttatcagaaaaatatcctctccagttaccggagaggagagtccagtatcaaatatgcagtcacatgggatctgtctactaccggactctccaataattggggagaagccggagcaatttaaaaacatagacttagtgcaaagggaagattttctggaggttttgatatttctgcatttggtgctcaaaagccggaagttactttcattctcgttttctaactctttcctctcccctcttaaagagcgtccaaagcctggttggctatcggtagaaatcatcactgatactatagaagcggctaggaaaccattggttgctgccattgatggccttgccttgggtggaggcttagaatttgcaatggcatgcaatgctcggttatcaaccccaactgctaagctaggcttgcctgaacttcagcttgggataattcctggattaggaggaacacagcgacttcctcgtcttgttggtttaacaaaggcacttgagatgatgctgacttcaaaaccagttaaagggaaggaagcttttagtttggggcttgtagatggtttgatgtcaccagatgatttggtaaacactgcatgccagtgggccctggatatcatgggtcgccggcgaccatggattgctagtctttataagactgacaaactagaaccccttggggaagcaagagagattttgaaatttgcacgagctcaggttcaaaaacgggctcctaatctccaacatcctttggtttgcattgatgttattgaagcaggagtagttgctggtccccgtgcaggactctggaaggaagttgaagcatctgaaggacttataaagtcagatactagcaaaagcttaattcacgtatttttttctcagagaggaacatccaaggtacctggggttacagattgtggtttggttccaagacacgtcaagaaggttgccatcattggcggaggactaatgggctctggaatagcaacagctttaattcttagcagctatcctatcatattgaaagaagtaaatgagaagttcttagaagctggtatcaataggattaaagcaaacttacagagccgtgttaagaaaggtaaattgacccaggaaaattttgaaaacacagtctctcttctcaaaggtacccttgactatgaaagcttcaaagatgtggacatggctgttgttgagaatgtttccttaaagcaacagatctttgctgatctggaaaagtattgtccacctcattgtatacttgcaagtaacacttccacaattgacttgaacctgattggagagaggaccaaatctcaagatcgaattgttggagcccatttcttcagtcctgcacatgttatgccgcttctggaaattgtacgtaccaagcagacctctgctcaagtggtagttgacgtgttagatatttcaaagaagataaagaaaactccagtggtggttggaaactgcacaggatttgctgttaataggatgttcttcccatatacacaagccggtctctttcttgttgaacatggtgcagatgtttatcaaattgatagagtaataaccaaatttggaatgcccatggggcctttcagattggtggaccttgttgggtttggtgtggcgattgctactggcatgcaatttattcagaattttcctgagcgaacatataaatcaatgcttattccccttctgcaagaagataagagagctggcgaaacaactcgcaaagggttttatttgtatgatgataaatgcaagcctagtcctgatcctgaattgaaaaactatatcgagaaagctaggagctttactggtgtctccgttgatcctaagcttgtcaagttacaagaaaaggacatcattgaaatgacattctttcctgtggtgaatgaggcttgtcgagtccttgatgaaggtattgcagtcaaaggatctgatcttgatatttctgctgtcatgggcatgggttttccaccttacaggggaggtatcctattctgggctgactctcttggatccaagtacatatattcaaaattggagaaatggtcagagttgtatggagaattcttcaagccttgtgcctacttggctgcaagagctgccaaaggaattccactgagtgcctctgtggagcaggcaaattcacggttgtaa

SEQ ID NO: 113160 - DNA, 519 bp, Glycine max
  Peptide Sequence Number=SeqID_229938
atggagcggagaaactgtttgcaaccagggacactgtggtgccccaagaccatccctaactataactccaatgacctatcgttccaaaacaataaaaacttcgtaccccattgcccagaggctcttcgctatgcgaagccagcccccattataagcccatatagaaacagtcatcccttctaccatggtggttttggcattcctcctccatcatatggaataccaagtcagtttggatccccaatacctcatcctggcctacagtatgattatggtttgtatgctagggctcgtgcaccatacagtccattgcccatgttcccacctgcaagctttggaggtattaattatggcccaaggcccagaattgatggctatggatatggctttcaaagtcctcctcctccatgggctgaaggattagtagctgataattttgcatctcgaaaacgcagaggagaacttcagtttaagaagcaaagcttgttccacaaggaaaagaagcaagtttcgatgtaa

SEQ ID NO: 113161 - DNA, 612 bp, Glycine max
  Peptide Sequence Number=SeqID_229939
atggcttccgccaccgtggattccgactttgaattcttggaatctgttcaacaatacctacttggacacgattccgtcaatctcatgcctgaaacccaacaaactgcatctcatgatccattttcagaccctaaatgtgatggtgatttggagaacatcattgttttccgaagtgaggatgcaacggctgtggtggcgcgtgatgtccacgcgccaccaacatggaagcattacagaggggtgagacgtagaccatggggaaagtttgcggccgagattagggatccaaagaagaatggagctagggtttggcttgggacttatgatactgaagagaaagcagctttggcatatgataaagccgctttcaaaatgcgtgggcgaaaagctaagctgaattttcctcaccttattgattccgatatgttgtcggaggaggtgatggtgacaacttccaagagaagtttagcggaaaattctccaccctcatcaccgtcgtggtcgtgttcagatgatagcttagaatcacaaggggcaaagaggaggaagagcctggctgatctactgaataaattagccaagaatagaagccatgtcaaggtggaacgttga

SEQ ID NO: 113162 - DNA, 1368 bp, Glycine max
  Peptide Sequence Number=SeqID_229940
atgattgaggggttgtgcaagaggggtagcgtgaagcaggcttttgagatgttggaggagatggttgggagagggtggaagccgaatgtgtatactcacacggctttgattgatggtctgtgcaagaaagggtggactgagaaggcgtttagattgtttcttaagcttgttcgaagtgaaaatcataagccgaatgtgcttacgtatactgccatgattagtgggtattgcagggatgagaaaatgaaccgcgctgaaatgctgctgagccggatgaaggagcagggattggcccctaacacgaacacgtacacgactctcattgatgggcactgcaaagctgggaattttgaaagggcatatgagttgatgaatgtgatgaatgaggaaggtttcagtcccaatgtttgtacctataatgccattgtcgatggcctttgtaaaaagggaagggtgcaagaggcttacaaggtgcttaagagtgggtttcgtaatgggttggacgctgataaagttacttatactattctcatatctgaacattgcaaacaggcggagattaagcaagcgttggtgttgttcaataagatggtcaagagtggtattcaacctgacattcattcatacactacattgattgcagtgttctgtagggaaaaaagaatgaaagaaagtgagatgttttttgaggaagctgtgagatttggacttgttcctacgaacaaaacttatacatcgatgatatgtggttattgcagagaaggtaatttgagattggctttgaagtttttccataggatgagtgaccatggttgtgcttcggattctattacttatggtgctcttataagtgggctgtgcaaacagtcaaaattagatgaggctcgttgtttgtatgatgccatgatagaaaagggccttactccatgtgaagttactcgagtaactttggcttatgaatattgcaagatagatgacggttgctctgctatggttgttcttgaaaggctggaaaagaaactctgggtccggacagttaataccctggtcaggaagctatgtagtgagaggaaagtaggtatggcagcgctgttctttcataagttactagacaaggaccctaatgtcaatcgtgtaacaatagcggcatttatgactgcatgctatgaaagcaataagtatgatcttgtttctgatttgtctgcaagaatatacaaggaaaaccatttagcaatcaaagtcagtggaagtttattagaactcagtaacatgctgttgttgtaccaatgtcaagagtctcaagacaagataccatcttctgctggcaggtgtacagcgtgcaaatttgttgaggaaagtgctagctga

SEQ ID NO: 113163 - DNA, 411 bp, Glycine max
  Peptide Sequence Number=SeqID_229941
atgggagaaaataaacacaccggagttagtgagagagagagaaaggagagggggtgcaaacaacgggaaaagttgaattccaaaaaccatcatcatcgatccgtgccgctctacatcattaagagcccaacaacaatgcaccacgcaaccctggtcaagattcatgttgttattgttgttgttgttagtgttgttgtggttatgccggtagcattttcagcgagatttagctgtatgcgcgtgaaaagcacgcaggaaggagcccgtgacggttctgatcaatcgctgtgcagtggtaacctgctttgtgatgtggtggaaggatcttcttccgtcttggttctcgaatcccgagccttacactgctgcttggaccaccatcacctcagcatggctataactataatctag

SEQ ID NO: 113164 - DNA, 448 bp, Glycine max
  Peptide Sequence Number=SeqID_229942
atggagcagttggtgaagcaagcctctgcttcccccaacgctaacgcactcacttccgttctcgttgaagccacttctcacctcaacctcttcgctttctcacaatttctcgccctccccaaccttctacaggttcttctttctccaatcatcatcgttggagcttctgtttatcgattttacaccttcaatgagtattactttatcgatttctgtttccattctttttccatgacattgcagcttcaagtaactgagaattctgtttatcttgatatgcttcggttgtttgcacatggaacatggagtgattacaagattgccaccatcgtcgtcgttatgaccactgttgccatcaccaccatcgccaacgacggtcatgccaatagcagtagtgacaacagcgacggtgacgacgatcatgctaacggaggtggtgacagtcatg

SEQ ID NO: 113165 - DNA, 187 bp, Glycine max
  Peptide Sequence Number=SeqID_229943
atgtgaaaaagggaggtacaacaagcaaaaagtggtagaaataaagaaaaaaagaagaaaatcagaagaagcccaagtccagcaaggcgctaagcgcaggacgcgcgctgagcgcaatgtggcactgagcgcgaggcttcgcgctcagcgagactacgaaggcccaaacccaagtttgcacctataa

SEQ ID NO: 113166 - DNA, 375 bp, Glycine max
  Peptide Sequence Number=SeqID_229944
atggaggcttatcctgaccgtttcattgtattgcataaaccgacggctgacttttcagggtggtataaaacggtacaggagaaatacaacctaaagccctatatgaaaatccggaaacctgagtcctttataactcaagtgcgttatcagacaacagatgcagagctattcttacttaccaattcgagcagcaggcatagtgcttcactggatattcaatttgatcaggagatcattaagcgtaaacaggcgtggttatgggatgcgacaacaggcaggagaagcattatgacgggaccgtcaacaaagaaaagctggatcgtcttactgatcttaaagagctgccttcttacagtcattttgccggaactgtag

SEQ ID NO: 113167 - DNA, 324 bp, Glycine max
  Peptide Sequence Number=SeqID_229945
atggtggcagtcaataatgatgacattggtggtggtgacagaggtgatattaatggtggtggtgtgttgatggcgacgacagtagtggtagcaattaatgtcaatgatgttaatgatgacaacgatgatggtggtaatagcaaagtcagtgacgatgatggaactaagtggtggcgggtggtggtgacattaattgtgatagtgatggtagcaatgttagtgataatggtgatgtcattgacgatggtggtggtgatagcagtgttagtggtcatggtggtggcaaccaattacgacggtgacaacgatgatgatagtaactga

SEQ ID NO: 113168 - DNA, 1101 bp, Glycine max
  Peptide Sequence Number=SeqID_229946
atggtggatctgccacaggaattgatacatgaaatccttttgcgcttgcccgtcaagtctcttattcgattcaaaactgtctgtaagtcatggctttctcacatctctgatccacactttactgcttcacattttaaactaggggcagcacccactgagagacttttgttcttatcgcctattgctcgtgaattcctatccatagacttcaatgaatcccttaatgatgattctgcttctgccgcattgaattgtgactttgtggaacattttgattaccttgaaatcattggttcatgtagagggtttttactcttggatttccgctatactctctgcgtgtggaatccatccacaggtgtccaccaatttgtgaaatggtcaccttttgtgtcatctaatatcatgggtctcgatgtgggtgatgagttttccttatctattcgtggttttgggtatgacccttcaacagatgattacttggcagttctggcatcgtgcaacgacgagcttgttataatccacatggagtatttctcactcagagctaatacttggaaagaaattgaggctagccatttgtcttttgcagaaatagcttataatgaagtcgggtcgttcttgaacactgctattcattggttggcttttagtcttgaggtatcaatggatgttattgttgcttttgatttaactgaaaggagtttttcagagatacttctaccaattgattttgatttggacaattttcaactctgtgttttggcggtactgggagaattgctcaatctatgtgctgtggaggagatcagacattcggtagaaatatgggcgatgggagaatacaaagtaaggtcatcttggacaaagaccactgttgtgtctcttgattatttttctagtctctccttatttccaatatgttctaccgaagatggagatattgttgggacagatggctgtaatgtattgataaaatgtaatgacgagggacagctgcaagagtaccaaatctattctaatggtccatatcgatcagctgtgtacacagaatctctactttcactcccttgtgacagggagccagcagaaaatgtttaa

SEQ ID NO: 113169 - DNA, 864 bp, Glycine max
  Peptide Sequence Number=SeqID_229947
atgggcactctagtgggacatgtagctccaggttttgggttcttgtcaaccccaagtcctacaagggcccatcatggttcccaagccccaagctcaccaacctctggacccagatggaaccattccctccactctttaatctccatcaccttcttcctctacgcagcatgtgccataatcttggaccgggcccaagtccaggcccaatttgcccaacaactgcttctcttgcatcttcattccgcggaccacatgggcccagaaggccgataccaccttttgctacagattttggtctttgtttcactcttcaccactctcattggaattgggcacccccatagcttgttggtcaactttgttcgctccgtcagcatattcttccagggtttgtggcttattgtgatgggcttcatgctttggacaccttcactcatacccaaaggttgttacatggttgttagatgctcttctcccgaggcacctaaccgtgctgtttcacttgtcaagatcgaattcaattggttcgttatcggtgtgaccgtttttgccgtttctttgtacttggttttggtcaaactttatggggagaagaaggtgcagtatttttcgttggggagtgaggataaggaaaggagtaggggcattatcgcgttgtgttgtggtgggatcaaattttctgattgctatcgcgttcatcaccgaagggctctttatccttgtggaggaggcttgcagctttatgacccgagaagggatgccatttatcttcagagaaggaaaagcagtggcgtatttggtctttgcttagagttgggagtaggatttgttgactatcccaagaatggactacattggaactag

SEQ ID NO: 113170 - DNA, 201 bp, Glycine max
  Peptide Sequence Number=SeqID_229948
atgaatcccaagttaagtaggggtaagaatgagcgaataaagattagtgctatccagggtggagaggaaggggtggccgaactcttgtccttgaccttggtagccaatatgagctgccatgggaagatttgtcgacataatttcgggttggcgatgaccctaaggaagggaggagatgagaagattggttggataccatga

SEQ ID NO: 113171 - DNA, 720 bp, Glycine max
  Peptide Sequence Number=SeqID_229949
atgggttctcggtacgaagtggaagtgaagcccttatcagcacgcgcgctcaagaacgtgaactggcgccacggccccaacctcccctacgtcgtcgtttgggccgaccgaagctacttactctccacgtccgtggacgagaacggcaacaccgacgcgaattggaatgaaacgctcacaattccgttgccggctaagcccctcgaggatcaaaatttgttcatccacgtggtccacgccggctcgggggaggacaccaagtcgctgatcggcaaggcttggctccggctggtggatattgtcaacgacttcggaatcggtgagcgcgtgagatgcacgctctcgctgaagcgtccctcggggaggccgcaagggaaggctgaggttagcgtgaccatcagggagtcgagctatggtgcgcagggtgggtacaacgcacctcccaacggggcaccaccacaaaaggcgaattgttacgctacgccaagtgggtatccttataatgcgacggcgaagggatgggctacgctcgctgcggtttttggtggaatatctgtggaagatgctgagtatgttgatgacaagaatcaagatgatgcggaagaaaaaagagtggaggatgatcttggtgctgaggacaagattcaagataacgtggaagcaagagtggaggatgatcttggtgaccatgctgatgatgatgacgacttctggcgatga

SEQ ID NO: 113172 - DNA, 642 bp, Glycine max
  Peptide Sequence Number=SeqID_229950
atgtcaggacctcaatgctgttcaaatccaccaagcttgaaccccactggaggaggtggccatgttgacaaagtaggtggtattgattcctatttcactggatctcctcactctaaactcgccgttcttatgctctccgatgtttttggatatgaagcgccaaatttaaggaagcttgctgacaaagttggagctgctgggtattatgtagttgttcctgacctcttggatggtgaaccctttaatcctcagaattcggacaggccctttcctgcttggataaaagattgtggtgctgaacctacaaaacccataattgaagccttaaaaagtaaaggtgtttcagctattgcagctgttggtttttgttggggtgctaaggttgttattgaacttgcgaaatccaaacttattcaaactgctgtgctattgcatccatcatttatctccctggatgacatcaagggtgttgatactccaattgctatacttggagccgagattgaccaagtttctcctccagagcttgtgaaacaatttgaacaagtcctagctgctaaatctggggatgcagaagctgtgaaggtggcagaagaggcccaccaggacttgctggactggcttgctaaacatcacaagtga

SEQ ID NO: 113173 - DNA, 1017 bp, Glycine max
  Peptide Sequence Number=SeqID_229951
atggtttcggtgtcagcagcggtgtgcaagcccgtagtagcgagtttcaacccggcatcactgaggaatatggactcgctgtccctttttcgtcaccaccgcaacaacaaggagaaagtagtggtaatcatgggcgcaacggggacaggaaagtcaaaactggcaatagacctcgccacgcaattcccaccagcggagatagtcaactccgacaaaatgcaagtgtacgaaggcctagacatcaccacgaacaaagtcaccgaggaagagcgtcgcggggtcctacaccatctcctaggcacggtcaaccccaacaccaacttcaccgcccaagacttttgcgaccacgccacactcgccgttggctccattttgggccgtgacggtttacccatcattgcgggtgggtccaattccttcctcgacgcgttggtcaaccatcacaccgagtttcggttacgctacgagtgctgcttcctctgggtcgatgtttcactccccgtccttcattcctctctctccgcacgtgtggatcgcatgatccacgctggccaggtccacgaggttcgaaaaagctttcagtaccataacgacgattataccgtaggtttacgaaaggccattggcgtccctgagtttcatgattttttcagagccgaagccgacggagccgatgagaggaccaaacagcggctcctcgaggctgccattgcttccctcaaaaccaacaactgcagcctcgccaaccgacaggtccagaagattcatcgtctttacggcatgtggaaaaggaacatgcaccgcctcgacgccaccgaggtttttctcaagaacgctactcgccaggaggaggcagaggaggcgtgggaggatcacgtgttgtccaagagcagaaggattctcaataagtttctgtatgaggatacgcatgtcgctcccgcaggtattgctgcgtcagttgttattgcttcttcgccgccagccatggctgccgccgccgccgccgcaactcactag

SEQ ID NO: 113174 - DNA, 3117 bp, Glycine max
  Peptide Sequence Number=SeqID_229952
atggaaaccccattagtgatccaaaagcatacttcagaacccgactatttgccggtggaaagcttgaaggatgttatgtttgttttgcgaacggagacagtgaagatatggagagtagcactcccaatggctctgcttgcactgtttcagcttctcatggactcctcaacttccatctatgctggtcatattggagacattgaactctcttctatcggtgtttaccaaggtgtcatcggtgccatctatttttacttgctgtttggtatgtcatctgcactggcaacactttgtggccaagcttttggagcaggaaaaattcaatctacttgtatttatgttcaaagatcatggattatacttactgccacttgtataatcctcttgcctatttatgtatatgccactccaatcttaaagttgcttggccaagatgaaggaatagctgaagttgctggaagatattctatacaagtaattccctacatgttttcttttgctgtagcttttcccatccagagatttcttcaggcccagagcaaggttaaagtaattatgtgcatagcatttgtggatttgcttatacaaaatgggttgctttacatattcataaatgtatttggttggggtataaccggcttggcaatagtgactaatatcgtagggtggttatatgctgtggctttggttgtgtataccattggttggtgcaaagaagaatggagtggattttgttggatggcatttagggatttgtgggcctttgctaagttaagccttgcatcatctgtaatgaattgcttagagcaatggtatattacatgcattatgctacttgctggtctactagacaatcctgtgattgctgttggttcctattctatttgcttcaatgttcagggttgggacgacatgctacgccttggaataaatacagccataagtgttcgtgtctccaatacgcttggcatgtcgcatccaagagcagccatatactctttctgtgtgacaatgttccagtctctcctccttggtattcttttcatgaccgtaattttctttagtaaagatgagtttgccaaaatctttaccgacagtgaggatatgatactagctgctgctgatttagcataccttcttggtgtaacaattgttctcaatagtgcttcacaggtgatgtcaggtgtggccattggaagtggatggcaagttatggttggttatataaacctagcatgttattacattgttggactccctattggaattttccttggtttcaagctgcatttaggggtcaagggtctctggggaggcacaatgtgcggcagtattcttcagactttagtcctctttacaattatttggaagaccaactggtccaaggaggttctcatggactcctcaacttccatctatgctggtcatattggagacattgaactctcttctattgctgtttaccaaggtgtcatcaattccatctatttttacttgctgcttcaatgttcagggttgggactacatgctgctccttggaataaatacagccataagacagtgaagatacggagaataacattgccagtggcactgtcacagctatttcagtttctcacaaactcctcaacttccatctatgttggccgtgttggagacattgaactctcttctatctctgtttaccaagcttcaatgttgtgggttggcacttcatgctgcttagcttcttggaataagtacagccataaggaagtttatagcaaacatttcagtctcaaacggagtgttaagggaagaactcctcaaatggagacacctttagtgatccagaagttcacttcagaatctgactacttgccggtgaaaagcttgaaggatttgaagtttgttttgtggacagagacagtgaagatatggagaatagcattccctatggcactgtctgcactgcttcagtttctcacaatctcctcaacttccatctatgctggccatcttggagacattgaactttcttctatctctgtttaccaaggtgtcatcagtgccatctattttgacttgttgacatttcttcaggcccagatcaaggttaaagttattacgtgcatagcacttgcagttttggtcatacaaaatgtgctgctttacatcttcataaatgtatttggttggggtacaactggcttagccatggtgactaatatcacagggtgggtttatgctatggctttggttgtgtataccattggttggtgtaaggaagaatggactggattttcatggatggcattcagggatttgtggtcatttgctaagttaagccttgcatcatctgttatgagttgcttagagcaatggtatggaacatgcattatactacttgctggtctactagacaatcctgtgattgatgttggttcctattctatttgcttcaatgttcagggttggcacacgatgctgctccttggaataagtgttgccataagtattcgtgtctccaatacacttggcatgtcgcatccaagagcagccatatactctttctgcgtgacaatgtttcagtctctcctccttggcattgttttcatgattgccattttcttgagtaaagatgagtttgccaagatctttaccgacagtgaggatatgatacgagctgttgctgatttagcataccttcttggtgtatcgatggttatcaatagcgcttcacaagtgatgtcaggtgtggccgttgggagtggatggcaagttatggttggttacataaacctggcatgttattacgttgttggactccctattggaatttttcttggtttcaatcaacatttaggggtcaaggattcttcaaatgttagtcctcttaatcattatttggaagaccaactggtccaaggagtgagactgacaatattcattgctggtcaaatcgctagctgcagtggcgaaaccactggaatcgtcagtgagagtggcgtttttgttgctggaatcgtcagtgagagtggcgtttttaccacgtattacacgcaggagtttctcgccagtggagcaaacagctcatcgcatgagaatatggagcatcaacaacctccactcgaatga

SEQ ID NO: 113175 - DNA, 285 bp, Glycine max
  Peptide Sequence Number=SeqID_229953
atggcagtccagcttccaatagataaagaatcagggcagtctttaggatttgcatacatttggtttgtcaaggaagagtctgcacaattggctgtcctagagatgaatggaaagtttttttatggcagctgttgtgactacactcaaggctccggatatggtacctcagtgatcggccagtggagctgcaaagggtgtcatttcttaacgatggttaagcagcagtatattagccaccaggatcggagggagtcttctgggatcatcagagaggttctatcttag

SEQ ID NO: 113176 - DNA, 720 bp, Glycine max
  Peptide Sequence Number=SeqID_229954
atgtcagggcctcagtgctgttcaaatccacccagcctgaaccccagtggaggaggtgggcatgtcaataaagtgggtggtgtcgattcctatttcagtggctcttctcactctaaactcgcccttcttatgctctccgatgtctttggttatgaagcaccaaatttaaggaagcttgctgacaaagttgcagctgctgggtattatgtggttgttcccgacctcttggatggtgaaccctttaattatcagaattctaacagacccttacctgtgtggctaaaagatcatggaccggacaaaggttctgaagctacaaaacccataattgaggccttgaaaagtaaaggtgtttctgttattgccgctgttggtttttgttggggtgcaaaggttgtggttgaacttgtaaagtccaaacttatacaaactgctgtgctaatgcatccatcgtttgtctctctggacgacatcaaggctgttgatattccaattgctatactcggagctgagattgaccaatattctcctcccgagcttgtgaaacaatttgaacaagtcctagctgctaaagctggggttgctagttttgttaaaatatttcccaaaatttcacacggttgggctgtgagatacaacgctgaagatgcagaagctgtgaaggttgcagaggaggctcaccgggacatgttggactggcttgctaaacatcacaagtga

SEQ ID NO: 113177 - DNA, 522 bp, Glycine max
  Peptide Sequence Number=SeqID_229955
atgtcaggacctgagtgttgctcaaacccaccagttctgaaccccaatgcaggagctggccatgttgaaaaactcgctggtctcaattcctatctctccggttcccctaattccattgccattcttctcatctccgacatttatggctatgaagcaccaaatttgaggaatattgcagacaaggttgcagctgctggttattatgtggttgttcctgacttcttccatggtgatccatataatcctgagaatgctagcaggtctatccctgtttggttaaaagatcatggcacggacaaaggatctgaagctgcaaaatccataattgaagctttgaaaagtaaaggtgtgatggctattggggctgctggattttgttggggggaatgtgcccttttcttcattcccacagctaaagtcgtggttgaacttgcaaaatccagactaatccaagctgccgtgctattacatccatcgtttgtctctgtggatgatatcaaggtgcattttgcatattgctga

SEQ ID NO: 113178 - DNA, 1456 bp, Glycine max
  Peptide Sequence Number=SeqID_229956
caacttgagctctagttggacctcgaaaccgccgctggcggttaagtaccggctcgacaccggttcgctggacgaaccgggcggtccaaagagtctctgctccactttggaacgccttttggcgtgggagaagaagctctacgaggagattaagtcaggtggttctgttgcattaattttgagccaaaagcctaaaaccatgtggtttgggaacgaggctagagaaggtgtgaagattgaacatgaaaagaaattgtcagcactgcagactcaggaatacaaaggagaggatgaagctaagatattcaaaaccaaggcttccataaataggctgcagtcactaataagtgttacatctcaggctgtgtctaccacctcaactgccattattggccttagggactctgatcttgtccctcagcttgttgatctcatacatggattcatgtacatgtggagatcaatgcaccactaccatgaaattcaaagcaatatagtgcagcaagtccgtggtcttgtgaacagatcatcaagaggtgactccacttctgaactccacaggcaggcaactcgggaccttgaatcagccgtttcagcttggcacaacagtttttgtcgccttataaaatttcagcgcgaattcatcctgtccttgcatggctggttcaagctcagccttgttccagtccacaatgataacatcaacggcagggaaacctctgaaacataccaattttttgatgaatggaaactcgcacttgaccgtgtccctgacacggttgcatctgaagccatcaagagctttatcaatgttgtccacgtgatatcttccaagcaagtggaagagctcaagatcaaaaaacgaaccgagactgcatctaaggaacttgagaaaaaggcttcctctctgcgaaacctagagaggaagttctacagctcatattctatggtaggcattagccttcctgattctgcacctgacaatggacaagtgttggatgcgcgtgacccacttgctgagaaaaaaatagaactggcaacctgccaaaggcgtgtcgaagatgaaatgctgaggcattcaaaagctgtggaggtaacaagagccatgactctcaacaatttgcaaacaggcttgcctggagtgtttcaggcattgaccagtttctcttccttgttcgctgaggcccttgaatcagtgtgtacccgttcatatgccatcaaatttctgttagcacctcctaattactggcttcgaggcactagacctccagagaagaagaggcttcctagtaacataatgattcaaaagatatttgcgataacggaatttggcggtgcttgtccccctaaagcagacagcatcaagcaaggatattccctatggtgccaggaacatgcagaacaattttatgttgtttactgtgttattgctcaggctgaagaatgcacttattga

SEQ ID NO: 113179 - DNA, 732 bp, Glycine max
  Peptide Sequence Number=SeqID_229957
gatgatggggaaattgaaggggatgtgaatcatcgcactcaagcaggatggatgaaatggagaaaagcatcgggggtgttatgtgatgcaaaggtaccgatcaagctaaagggaaagttttatcggactgcggtaagaccggcgattttgtacggaacaaaatgttgggcggtcaagagccaacatgagaataaagtcggtgtagcggagatgaggatgttgcggtggatgtgtggtaagactcgacaggataaaattagaaacgaagctattagagagagggttggagtagcgcctattgtagagaagatggtggaaaatagacttaggtggtttgggcatgtagagagaagaccggtagactctgtagtgaggagagtagaccagatggagagaagacaaacaattcgaggcagaggaagacccaaaaagactataagagaggttataaaaaaggatctcgaaattaatggtttggatagaagtgttgatactccaactgccgtgcttggagctgagattgacaaaatgtctcctccagagcttgtgaaacagtttgaacaagtcctaactgctaaacctggggttgttgattgttttgttaaaatatttcctaaagtttcacacggttggactgtgagattcaaccctaaagacgcagaaactgtgaaggctgcagcagaggaagcccatcaggacatgctaaactggtttgctaaacatcttaagtga

SEQ ID NO: 113180 - DNA, 1974 bp, Glycine max
  Peptide Sequence Number=SeqID_229958
atgtcctcgtcggggttccctggcggcggtggtgcgtcggagtttttcgccggggtaggtggtttcggcggcagatccattccggcgaccagcatgaacaaccccaacgccgccgcctccgccaccaacaacaacctccaccctctctaccgaacccaacaacaacaacaacaacaacaacaacagaacctccccgcaatgtttctagatccttcctcgcagatcgcccaacggcaaacaccaaccctaatcggtaaacgtaccctaaccgaattccaagcctacaaccaaaccaacaacaacccaaaccacgtcctctccaacctcctgcttcgtaccgttaagccccgaaccactttctcccataaccatatggactttcccgttcctgaattgcaaagccaaaacctttatgccaaccaaacgcagcgttttggtgttccgttacttcaccagctccgccctcagcccattaatctccccaacaacgggcccgtgcccatgacaggcccaaattttggctaccggaactcgaatttgggttttccaccaaaccagaaccgggttcgtgtttctcctcctgtttctgttccggttcaggttcagtcatctgaaccggaaaagaagatcatggaccacaggcttcttgaattggagaagcagcttctggaagataacgacgaagaaggagaagcagatgctgcgtctgtgataaccacgagcgagtggtccgagacttatcagaatttaatcagtcccggtccggttcagaaaccggttttgacgaccacgtcgccgacttcgtcgacgacgtcatccacgtcatcttcttcctccgtggcttcgcctgcttccggatgctccaagcaaactctcatggaagccgcatctgcaattgttgaaggaaaacatgatgttgcagcggagatcctcaaccggttgaacggtgtgaaccggagtgataggttaacggattgcatggtttcggcgttgaaatcgaggatgaatccgggggagcatcctccgccggtggcggagcttttcagaaaggagcacgccgagtcgtctcagctgcttttggataactcagtgtgcttcaaggtagggttcatggcggcgaattacgcgattctggaagccgcatttgaggagaaaacggagaataacaggttctgcgtggtggattttgagattggaaagggaaagcagtatttgcacctcctcaacgcgctctcggcgcgtgaccagaacgcggtggtgaagatcgcggctgtggcggagaacggcggcgaggagagagtgcgcgccgtgggagacatgctgagtctactcgcagagaagctgaggatcaggttcgagttcaagatcgtcgcgactcagaaaatcaccgagttgactcgcgagtcgctgggatgcgaagtggacgaggttctcatggtgaacttcgcgttcaacctgaacaagattcccgacgagagcgtctccacggagaatcctcgggacgagctcctgcggcgcgtgaagcgtctggcgccgcgcgtggtgacaattgtggagcaggagataaacgcaaacacggcgccgtttttggcgcgcgtggcggagacgctgtcgtattacagcgcgttgttggagtccattgaggccaccactgcagggagagaaaataacaataacaacctagaccgagtcagactcgaggagggactgagtcgaaaattgcataactcggtggcgtgcgaaggaagagatcgcgtggaacggtgtgaagtgtttggaaaatggcgcgcgcgtatgagcatggcggggttcgagttaaaaccactgagtcaaagcatggccgagtcaataaaatcgcgactcaccacggccaacaaccgagtcaactcgggactgactgtaaaagaagagaacggagggatttgctttggttggatgggaagaacactcacggtcgcatctgcttggcgttaa

SEQ ID NO: 113181 - DNA, 177 bp, Glycine max
  Peptide Sequence Number=SeqID_229959
atgcatctgatttgcacatttggatgggcaaagatattgttgcacttcaggaataaaccaattacaatatcgaaacatgggaagctgattgcgatgaaaggaacaccgtaccggttcggattcggattagatgtgggcacaaatattcaagaaattggcgcaattcttcaagagtag

SEQ ID NO: 113182 - DNA, 1686 bp, Glycine max
  Peptide Sequence Number=SeqID_229960
atggagactcaaaagctaattatacatttcattcttcttcttcttttcatttcttgttcatcctctttcactcccatagataactaccttcttagctgtggatcacagaacaatgcttccctcttcaaccgcatcttcgtcagtgattccaccagccatggctcaatttttctctctgctgacaaatccatttccctcacctaccaagaccctcctccaaatttgcctactttgtaccacactgcaagagttttccccatcactgggagctacaggttcaacatgaggataaatggtacccacttggttcgttttcatttttcaccttttaaggctcaaggatttgatctaaaatctgccaactttagtgtcttggttgatggtaatttggtgctgagaaatttcaagccaattaatggtgcactgcttaaggagtttattttgaagatagagtcaaatttgcttgaaattttatttagacctgaaggtaattcaggttttggctttgtgaatgctgtagaggtgtttactgctcctgctgattttgtcatagattatggagctaggttggttggtccttctggtgtggtagagtacaagaacctttcatctcaggttttggaaactgtgcataggattaatgttgggggtgtgaaagtaactccttttaatgacaccctttggaggacttggattcctgatgaggaatttctggttcttaaggatgctgctaagcgtgtggggagcactcacacactaaattaccagaagggaggcgcgactcgagagatcgctccggataatgtttatatgactgctcaggaaatgaataaggatcactccattattgcttcacagttcaacataacctgggattttccagtggctccaggtggtgttcggcacttggttcggctgcatttctgtgatattgttagtcctgctcttaatttgctctactttgatgtgtatatcaatgggtattatgcttacaaggatcttgatttgtcatcccttactgtccatgtgcttgcatctccgttctatgtggattttgttgtagattccaatgaattgggtgttattcaaataagtgttggcccttctgaactgagtagttctgcaaggatgaatgccattttgaatggtgtagagataatgaagctagtgaatgttgtggactcacatgttgttccaaggaagaagaggttgtgggtgttggtgagttcaattgttggaggaattgttgttttgctttttgttatagctgctttgctgctttctctcaaatgcaggaagaagaagaaaacgccaagacaaagaacaatggaaagtgtaggatggacgcctttacgcgtgtacggagggagttcacttagtagaatgtctgaagggacagcttttccctctcctggttcttatggttattttggcttgacaatcccttttgccgatatacaatcagcaacaaacaattttgatagaagtctaattatagggtctggtgggtttggtatggtttacaaaggggtgctcaaagacaacgtgaaggttgcagtcaagagaggcatgcctggatccagacaagggcttccagaattccagaccgaaataacaatcttttccaaaattcgccatcgccatcttgtttcactagttggatattgtgaagaaaactcagaatga

SEQ ID NO: 113183 - DNA, 702 bp, Glycine max
  Peptide Sequence Number=SeqID_229961
atgaagagaggcaggcgcaaagaagagaggcaggcccaaaagcatgagaaggtgattctgccacaggaaatggtaaatcaaattctgttgaggttgccggtgaagtctcttctccagttcaaaaccgtgtgtaagtcatggctttctcacatttccgatccacactttgcaatttcacattttgatctagctgcagcacgcacagagaggattgcgctgttagtgccttttgatcgtgaattcctatccatagacttcgatgcgtctcttgcttctaatgcactaaacctcgaccctcttctagcctcaaaatctttttctcttgtgatcctgggttcctgtaggggttttctactcttgatctgtggtcataggctctacgtatggaatccatctacaggtctctacaaaattctagtttggtcacctattatcacttccgatcgcgagttcgagattacaacttttcttcgtggttttgggtacttcttcccaatctgcattacagcaagtgttgatattgtcggaaaagatctcggaactggattggttgaatgtagtggcaagggacacctgcgagtacatcggtcttattttaatggtcaatgtggatatgaagtggccctgtatacagagtctctactttcactcccttgtgatagcaagccgagcaaacaagcggaagtagatgacaaacaatag

SEQ ID NO: 113184 - DNA, 489 bp, Glycine max
  Peptide Sequence Number=SeqID_229962
atggagagggttgcagagccaaaggtacttcctcggtccttgcctgttctagttgaggtatccaatgcacacacggatgcaataagggaagctggtcaaagactaaatgggcaggatgtttcgagtgtgcgtggaattccaggaagggaagggaatcagtttttgaaagcgcgggatggccctatgaaacgtctggcctccatcagagaagtggcccagttatcaaatgcacgaatagttttggtaagagaggatatgggattcgatacacgctgtcaagagcctccctcccctgcgcctacaagaatgtggaaaggaaagggctctttaccggaagctgtagaacttgtgcctgatattgagaaattgaagggtggcaatgattcttttgtggaaactggtccaagttcatttgcaggtgctagtcatcccccagaacctgttgatactgatcttatgagaacggttttgtaccaaaggtcaaactaa

SEQ ID NO: 113185 - DNA, 252 bp, Glycine max
  Peptide Sequence Number=SeqID_229963
atggcggcttgtgcttgcaacctggggagatgttcagtggttcaggccgagcttggtttgggtgatctatcatgggatcatatcagactcattaaggataaaggcatcccagggcaaagagaccaatcaagtggccgagacaggcttgataaacatgatggactcgaggtggctgagggagttctcgtcgtcgactctcctcctccgctcctggcagaccttgctgttgttttcttctttccttggttttag

SEQ ID NO: 113186 - DNA, 208 bp, Glycine max
  Peptide Sequence Number=SeqID_229964
atgactgaaagctacacgaatattgcagacaaggttgcagctactgggtattatgtcgtggttcctgacttcttcaatggggaaccctatgatcctgagaatgtgaaaaggccgaaagaaaaaggtattgaagttgcaaaacctgttattgaagccttaaaaagtaaaggtgtcactgctattggagctgctggtttttgttggggcg

SEQ ID NO: 113187 - DNA, 530 bp, Glycine max
  Peptide Sequence Number=SeqID_229965
gaattttcggttatcttgatccggagtatttccgaaggcagcagcttacagataagtcagatgtctactcatttggcgtggtgctttttgaggttctttgcgccagacctgctgttgatccacaacttgatagggaacaggtgaacttagccgaatgggcacttgaatggcagaaaaagggcatgctggagcatatcattgatccctatcttgttgggaagataaagcaaagctcattgaagaaatttagtgaaacagcagagaaatgtttagctgaatatggtgttgataggccaacaatgggttctgtattgtggaatttggaatatgcacttcaactcctagaaagtgaacaagaaggggagccatatgatgatagcagtgctcaggaagcagtgaatgtgacaactacaacaattcctgggagtccttcgagtaacgtaagaagagagggagataatgataatgcttattcagacataagtgctactgaagttttttctcaactaatgaacagggaaggcagatag

SEQ ID NO: 113188 - DNA, 1692 bp, Glycine max
  Peptide Sequence Number=SeqID_229966
atggttgaagaatcaaatgagatgggtaacttatcttcgccatttttaggagctcgtgcatcacagaatactgagaactctccccttgccccagattctgaggagaaagaatgtgtttgggatgcctcattgcctccaagtggcaatgtcagccctcatagcagtattgacagtactagtgttgtcagaacaatgagcattgctaatagttgtgcaagtacatatcgaagtgatgcagtcactagcgatggcatgcttagtttggacaggaattgtgatagcactaaaggaagtgtaagaggggattcacttgagagtgcaaaaactagtgctagtcgagcaagtgacagcagtggcctcagtgatgacagcaactggagtaacattactggcagtgccaacaagccccacaaaggaaatgatcctaggtggaaggctatccttgccatccgaacacgggatggaattttgggcatgagtcattttaggttactcaaacggcttggttgtggtgatattggaagtgtatatctctcagagttgagtgcaactcggtgcttttttgcaatgaaagttatggacaaggcatccttagcaagcagaaataagctgactagagcacagacagaaagagagatattgcagttgcttgaccatccatttctgcctactttgtatacacattttgaaactgacagattctgctgtttggtgatggaatactgtccagggggtgatctacacactttaaggcaaaggcaacctgggaaacatttctcagagtatgctgcacgcttttatgctgcagaggtcctgttggcacttgaatatcttcacatgcttggagttgtgtatcgagaccttaaacctgaaaacgtactggtccgagatgatggtcacataatgctctcagacttcgatctttctctccgatgtgctgtttcacctacccttattagaaattttgacagtgacccctcaaaacgaggtggtggtgcattctgtgtccagccagcatgtatcgagccttcatcagtatgcatccagccttcatgtttcatgccccggctctttgctcagaaaaataagaaatcacgaacgcctaaagcagaacctggcatgccgtccagcacgcttcctgagcttgttgccgaaccaacaacagctcggtcaatgtctttcgttggcactcacgaataccttgcccctgaaatcatcaaaggagaaggtcatggaagtgcagttgattggtggacatttggaattttcttgcacgagttactatatggtaaaactcctttcaaaggatcaggaaaccgtgcaacactgttcaacgtagtaggccagcagctcagatttcctgaatctccggccacgagttatgccagccgtgatctgatccggggcttgctggtgaaggagccgcagcaccgacttggggtgaagaggggcgcgaccgagatcaaacaacaccccttctttgaaggcgtgaactgggcgttgattaggtgcagcacaccacctgaagttccaagaccagttgaatgtgatctaccagcaaagtttgaaccagttgatactgttggggttggcaacatcaacaatagcaacaatagtagtaagaggatggtgggtaataataatactgacatgaagtctgggggtaaatatctggactttgagttcttttaa

SEQ ID NO: 113189 - DNA, 171 bp, Glycine max
  Peptide Sequence Number=SeqID_229967
atgggtggatatggttttggatatgacccatcaaccgatgactactcgctgtatttctcactcagagctaatgcttggaaagaaattgagcctatccatttgtcttaccagggctgctctgatcgtgtggttttggactttgggttggtcttcaacggtgtccttcattga

SEQ ID NO: 113190 - DNA, 245 bp, Glycine max
  Peptide Sequence Number=SeqID_229968
gtgttaagattccaattgctatacttggagctgagaacgacaaagttgcttgtcctccaacgcttgtaaaacaatgggaagaaatcctaaaggctaaacctgagattgatagttatgtagaaatatttcctaacgtctcacacggatggacagtgaggtacgaccctaaagatccaagtgccgtgaaggctgcagataaggctcatcaaatcatgataggttggtttgataaacatttaaagtga

SEQ ID NO: 113191 - DNA, 810 bp, Glycine max
  Peptide Sequence Number=SeqID_229969
atggatgacaacgaagagataacaaaaactttccaaggcgccaaggtctggtgggtttcaaacaaaaccatcaccaaatcacagtcgatctcgttttaccctgcgaggttcgaaaccctagccatggagaaagaaatgaaacaacagattatatatgatcttgtcaacttcaagaatgggaaagagtattatgacaagattggaaaagcttggaagcgtggttatttactatacggtcctccggggaccgggaaatctacgatgatagctgctatggctaatttcatgtactatgatgtgtatgatcttgagttgacggctgtgaaggataacacgcagttgagaactttgttgattgagacaacaaagaggatcattgttttcacgacaaactatgtggacaagcttgatcctgctctcgttaggagtggaaggatggacaagaaaatcgaattgccttattgttgctttgaggctttaaaggttttggcaaagatttatttggatgttgatcaccatggtttgtttcatgctgttgaggggttgttggaagagagcaatatgacacctgctgatgttgctgaggatatgatgcctaagtcgaagagtgatgatgtggagacatgcttgaagaagttgattgaatctcttgagaaggccatgaagaaggatcaagaagaagcacaaaagaagcgtgatgaagaagaagctaggctgaaggaagagaaggaacagtttgcacaggaagaagcaaaaaagagtgatgagaaagctgggaaagacgtgaaggagaatggtttcgtccattga

SEQ ID NO: 113192 - DNA, 285 bp, Glycine max
  Peptide Sequence Number=SeqID_229970
atgcatttaatacctgttattgacatgaaaacctatgaatatctgtatagctttttaaatcttgagagggtcttggataatctatactcattttgtggtgctggtgctgggaaaggaaaaacgaggagaagaggttttagggaagtgatagacacgcgcaaggaaggagcgtgcgatggagagttgcgagagtatccaatgattattaggagattgcgtgtctggttacgaagacacaaagcgacacgcacgggggcaatcatgggaccaggtggcgcaacatga

SEQ ID NO: 113193 - DNA, 399 bp, Glycine max
  Peptide Sequence Number=SeqID_229971
atgtggcaaatggtacattggttgttgatggcgtgtttctgttgttactttgggctattcacgttgttgaccaagttgaagcaaactgaagtggattgtgaatacttaaagagatgctatgagaatttaactgaagagaatagaaggttgcacaaggaggtccaagagcttagggcattgaaattatccccacaaatgtacatgcatatgaaccctcccaccactcttacaatatgcccttcttgtgagcgtactcactcctttgcatcctcctccactgccaccatccactcggcggtggcggccacatcgagcaatcgcaaactgttcggcacaaacatccggctgcccgtgtccttcaacactcggccatttgaaggcccaattcctcggccataa

SEQ ID NO: 113194 - DNA, 225 bp, Glycine max
  Peptide Sequence Number=SeqID_229972
atgcatgcaggccttaagcaaaccgccggtggaactggcgagttcgctgtccgtgaagaaatcgccacaggcaatggcgatattgccatgcatagggaaccgccagtcaaactggcgagttccaggcaggagggcgtaggctacgttgcagactggtgcaggcttgttgggaaccgtcattggcactggcgggttgcaggaggaactcgccaacactactggtga

SEQ ID NO: 113195 - DNA, 405 bp, Glycine max
  Peptide Sequence Number=SeqID_229973
atgtacgggcggcccctgttatgtgcaaattctaaacaagcaccccttcacgccatatggcttgcctcccaacttacaccacccaatgtggcgtacactcccaatgagaatgtcaataactccacttctatactcattgagagccaacaacctcaatctgatcatgcacatgtttctcaacccatgggggagacacatgaaatgccccaccacaatctagcggacttcgagccttgcctcggatatgccactaaagggcaagcaattggtgatatacccctgcaaaacacattgaagggccctcagtatcacccacaaccacacccattgcattccacagcgggtaaaaaccctcatgctatggcagaaatgggagaagttggatcatctagaggaaaggcttag

SEQ ID NO: 113196 - DNA, 229 bp, Glycine max
  Peptide Sequence Number=SeqID_229974
gtacacaacgacatggccaaagaaggttggacagcaagacacgtgggagaaccaacagaggaaaaaatggaggggcaaaaagaccaaaaaatcgggaaaagtgccaggtgtcaacatttcaagtatgggagggcatcgcaagacgctacattggccagccaactgtaggtcacagatcgaggcgaaggcgacggacagacgatcattgaagcttgtttattttggataa

SEQ ID NO: 113197 - DNA, 615 bp, Glycine max
  Peptide Sequence Number=SeqID_229975
atggatacctcagagccctacactggggcaatgaaaggcaccatgcataaacctcaagtgaacctagggggaaagaatgtcatgaacttcggagggctgcacgccctcgccttcagaggactacacgtcctcaccttaagaggactacacgtcctcaccttcagaggactacacgtcctcaccttcagaggactacacatcctcgcctttagagggcgacacgtcttcatcttcagaggtccacacatcctcgccttcagaggactacacgtcctcgccttcagagggctacacgtcctcgtcttaagtggactacatagggttgaacaccttcgccttcatagggtacacgcccttaccttcagagggctacgcgccctaacctttagaggactacaggtcctcgccttcagagggctacatgtccttgccttcagaggactacacgtcctcaccttcagaggactacacgtcctcatcttcagagaactggacgcccttgcctttgtaggggtacacgccttcatcttcagagagctacacgccttcgctttcagaggaatacacgtcctcaccttcagagggctgcacgccctcgccagcagaggaatacat

SEQ ID NO: 113198 - DNA, 1350 bp, Glycine max
  Peptide Sequence Number=SeqID_229976
atgggatcgagtcaggcgccttcgtttaaaaagaggttctatcaagtcaagatcaagagcctaggagtcgccagtctaaaagagttaggacaattgatgggtcaactccagcaacaagcctttcgcaaagcttacggtaagatctgggaccgaaccatggcagaggtctccacggaggccattgcctccctcgcccaatattatgaccagcctttgaggtgcttcacctttggggacttccagttaacacccacggaaatgtttggaagcaaaggcgagagtcttgccaagtcaaggcgaatgggcccgttcatggacatcctagcacttttgatcttcggggtggtcctctttccaaatgtggatgggttggtggaccgagcagcgattgatgcttttctcgccttttacgaccgcaaggaaagcccggttgtcgctatcttagccgatctatatgacacattcgaccgaagatgccaccgctcatgcaccgagaaaaaagaggcaaactgggaccgactcttagcaagcaaagaagaagcgtctgtcaattggttccctcgatggaaggaaggaagaaccgggattcttatttcgtgtgggaaatttccaaatgttcccttgatggggatgaggggttgcatcaattacaatcccgtcctcgctataagacaacttggttaccctataagaggggcgccatcaaaggaaggcctcataccttttactatacgaggtttcaatagcaccaacgcgggggtgtttcagagggtccacaaggcatgggaaatgtcacaaagaaaggacaaggaacttaggggaagtagcaacgggcccatcggcggttaccgtaggtggttgaaagcctacgcacaagatctggattggctcctgagtttgaggaccattaagggggtggaagttgaaacttcggaagaagacgaagagaatgccaaactgagagacgtcaatatagccactatcaagaccttgaagcaagagaccaagagggcccgtagggaagaatatggctggaacaaattccgaggggctgtgtggggcagtaacagcgagcttaagctccgaagagaggaaaaggaccaatcgcgagtagatggtttgatcttgaaggatgaattgaggaccgaaacagacatgttagccattatcaacaagtaccatgaagaattaaatctagccatggcccacgagcacaaagtagcggacgaatacgcccgagtctacgcggaaaaggaggctagaggaagggtgattaactcgttgcatcaagcaacgatgtggatggactggtttgctcttactttgaacgggagtcaagagcttccctga

SEQ ID NO: 113199 - DNA, 546 bp, Glycine max
  Peptide Sequence Number=SeqID_229977
atgggtcaacttcaacggcaagccttccgcaaagcctatggaattagaccgccaaaggcaagtcgaaaatggggtggtcggaataccgagaaaatatttggagcgatcgacgtttttctcgcctatcataaccacaaggaaagtccggttgtcgctatgctagccgacctatatgacaccttcgaccgaagatgtgaagaaagcaatgcaaggattgtttgctgtactccaactctctatgtggggctggtttcacacctttttctccaagtaggtaggcccgtctatccgctacaaggtcaccgctcgtgcgttgaaaaaggaaaggcgaattgggaccaactcttggctagcatgggggggcgtctgttaattggttccctcgctagaaggaaaggaagaatcaagattctatcttcatgcgaaggatgtcccatgagaggagtgccatcagacgaaagcatcacgcctttcatcgcacgaggtttcagtgaccacaacgcgagggtactccaaggagttcacaaggcatgggatgcggcgtga

SEQ ID NO: 113200 - DNA, 570 bp, Glycine max
  Peptide Sequence Number=SeqID_229978
atgacgccggttgcgcgcagggcggcgcccatcgccacggcgatgatggccagcgccaccagcacttcgatcagggtgaagccgcgttggcggccgcgccggcgcgcgggaaggggcggcaattcagcggatgtcatagtgtccggcggcgtcgcgcgtcagcgtcacatgcgaatcgcccgcgcgcagccgcaggctgaatggatcggtgacccattcggtgttgaagaccagcgggcggtcgggatccaggcgccactgcacctggccggcgcgccaggactgcgggcgcagggccgcgtcgtgttccagccggtccatgggcaggggcctgtcgtcctgcgcggtcggcgcatcggagcggccggcgcgttcgaacgaccagccgccgctggccggcgaccagcgcagggcgcggccgtcgctgcgggcctcgccttcggccacggtgaatgcgtcgagcagccgctgggcatcgtcgcgcaacggatcggcgcccttgccgatggacaggctgaccatgctggcggcgatggcgacgatcaccagcaccaccatgacttcgactag

SEQ ID NO: 113201 - DNA, 240 bp, Glycine max
  Peptide Sequence Number=SeqID_229979
atggataatgaaagagaatggaatagagatcacgatggagtaggttgctatggatgctgttacatttatatgaacaatgaatattttacaagaaatgacggtgggttgggtttgatagagttggtgaggaagaagcggtttatggagaaagaagagatggctagcttctactttttgttgggtattattgcgttggtaaactttggctcactcatgcctttactaccactacggcgggct

SEQ ID NO: 113202 - DNA, 441 bp, Glycine max
  Peptide Sequence Number=SeqID_229980
atggagtccaataatgctgaatatgtggcattgggaggagaaggttctgctccaaagttagagaatatcaacaaggtttcaattatacctctgatgttctttatcttttatgaggtctcagaacaaccatgtaaatcaaacttggatgagtctgaattttccaaattccattctaacgtgaaacattgggacatagttggtatcactggccactgggtttctagtattctactggaacacctgaggtggcttttgttgcaacatcgaacagctctaggatcaatgtatttagatggtcaattggggaaaacaattgcatcgcctccaatgtctcctcgaggagttagacagctctctttctccgtcaaatcattgcttgagaaattgcagaattcatcacaagtaggtgttatacattggctcttcaaaaggacagcctga

SEQ ID NO: 113203 - DNA, 287 bp, Glycine max
  Peptide Sequence Number=SeqID_229981
gcgttgctgcatggcccagaaaaggtgtaggttctgtattgcattacaacaactgtggggtagcagttacagctgttgctgagcagcggaagatgggtagaaatccgtctgtttcagcccagtatgctgctccaagcagttcatatccaagacgaaacccaagctgtaaaagtgagaaggtggaagaggggattgaaggtgctaatggacttcagactaagcctcagtacatagcacgaaaagttgttgctgctgctcaagggggacctggtggtaattggtattga

SEQ ID NO: 113204 - DNA, 255 bp, Glycine max
  Peptide Sequence Number=SeqID_229982
atgacagacgaacaagcatcaatttataaccagattgttgaagctgttaataaagatgaaggcggtatattttttctctatggatatggagcacccatggctcacaaattttgttttgtggcacttgatcacagccttagagatatcatcaatcacaactcaagggacaggaaaatctctggaggtccaagtaatggtcaaaggtggatattaacggcagatcctgccagtcattccaagaggcagccgctctaa

SEQ ID NO: 113205 - DNA, 2388 bp, Glycine max
  Peptide Sequence Number=SeqID_229983
atggaaggagagggaagcattcatgtacaagttgatgaactacaaaggatgaggctcagcgaaaccatcagcataggcaccaccatgtttgagcctcgtggactcagcagcatagacaagctggacagtaataatagcactgccaattctgtgtcttcaacaacctcagcaccagaaaagaagctcacccttttcgctcttcagcttgcggtgcttgaaaaagcagcaaccgggttgggaactctcggcttcatttgggcaaccgttgtccttctcggcggtttcgccatcaccttagaaaaaaccgacttctggttcatcaccatcatacttgtagttgaaggaaccaggattttcagcaggagtcatgaacttgaatggcagcaccaagccacatggtccatcactgaggtacttgtaactcccagtacaaagaaccatcaccaccaatatgtttcaacagatactaccccaacaaggacacgaactaggatgtgggttagctcagatgttccactcctaccatatgctaaatggtttttcctttcgaggcatgtcagtagacttctctattggcttcagcttctttctgcaacggcttgtgtggttctctcgttaataaagctcgtcaagcatgattatggagaggtggcaaagggggacactgacaagaggaaccgcaaatctgctctctctatcttctatgccttggctctttcggaagctttgttgttcctaatggaaaaggcctattgggaatggcaagtcagctattgtaaactgttggaagaggtcaacaaggagtgtgagttggggccatcaggaatggtgtccactagaaggctcttctatgatgcctattcaagatgtgtcaatggaagcatatttgatggcttgaaaatggatatggtaggtttttctatggacttgttggcttctaactcccctgatgagcagctcattggagcaaggattcttaggcagttttcaatcagtgaaagattttgtgatgacacccttcaaaagattggaattgacatatcaatggtggagagactagttgagatgttgaattggacagacttcaaggacgaagagattaggctctcagctgctgagattttgtcaaaactagctggcaagaagcagaactctctccgcatagccggaataccgggagctatggaatcaatatcatctcttttacaaactaataggagtgtgattcctgcagctgatgagattggtgaaaagaaacttgtatttgatcaccaaaattatgggttctggacttttaaccacttgggactcctcatactgaaaaaacttgcacgtgaccttgacaactgtggaaagattggaaacacaaggggcctccttccaaagatcatagacttcacacatgctgaagagtggttgctaaagagtgaaaatgttactccatcccaagttctgacactgaagagatctctgcaactggtgaagatgctggctagcacagttggcaccactgggaaacatcttcgaagagagattgcggagatagttttcaccatcagcaatattagagatattttaaggcatggagagaagcatcctcttctacagaaactttgcatagaaattttaaccagtctggcattggaagaggatgcaacggaaagaatagggggtacaggtggagtacttaaagaattgttcaacatatttttcaaacacaacataccagaaaatcagaaacatgtaaaaattgttgctggtgaggcccttgcaatgctggctttagaaagcaagagtaactgccatcgaattttaaagttgaaagtactagaaaagctcgctgaagcattgaaagatccattgctccgtgtcaatgcagctagaattctaagaaatttatgcacctatagtggatcagaatggttcatccagctaaagggggtaacaactgcagcacccataatacttcgggcgatcatgtcagaagacaacaagatacaagaggtgatgattggactagcagcaaatgttttcagatacatgacctctcatgaatcaagcattgtatttgaagaagctggaattactgaggctgaacttgcaaacaaattagttcagattctcaagaaataccagtatcccccaactaagattccaaggataaggaggttcgtaatagagctggctatttggatgatgaaagacaaagcagaaaacatagaaacctttaagggtctgggaatggaggaggtgttggagggtgtcttagagaccacatcagaacttgaaagctttaatgttttctctggcactgttggactgaaccggcacactctaacaactcagtcactggttgagatggcattgaaattgatggaagatagttaa

SEQ ID NO: 113206 - DNA, 295 bp, Glycine max
  Peptide Sequence Number=SeqID_229984
ctgggttgcttctggaagcaacccagctcgcctgggcgagctaaggtcgcctgggcgagctgggcggcaacctcctccccctttttcctataaaaaggctgaagggggctgttctaaggatccctcagccccctggctatgtatttcaactgttttgggtgaaaaaaattgtttccgtgaagaaaatccaagccgaggtgcttccgtaacgcttccgagatgtttccgtaagcaaatccgtgaaggttttcgtccgttcttcatcgttcttcatccgttcttcgttcttcaacgg

SEQ ID NO: 113207 - DNA, 935 bp, Glycine max
  Peptide Sequence Number=SeqID_229985
atggcagattcaagcccttacaccaaaccccatttcccactttccgaccacagctcccggatccaaccaaaacccaccaaccaaggtaagtcttgctcaggtttcatccttaaagttctattcttggcactgtttgtcgctgttcttccactttttccctcccaagcccctgactttgtgagccaaaccatactcaacaagttctgggagcttctccaccttctcttcattggcattgctgtcacctatggtttgtttagtagaagaaattcagaacttgacaccacacacacagaattagaaactactcactctagtgccaatgattccactgctgctgctcctagttatgtgtccaaagtgtttcctgcttcttccaatattttttatgataatgggtgtgataacgaaaatggaaattcttgtgaggttgatgagaagatggtgcattgttggaataatcagtactttgatggggggccagggggtgtgtgctccaatgggggtggtactgttggtgtttttgatgaacagtacaaaacccatttgccaatttctgaagatagttttggttattctgttagatgtgatgggaatggaattggaaccggtgtggttcaagcttggaattctgagtactatcatagtgagccagtggtggttgtggctcaaccaaactgcaacaccggtgaatgtggggaggttgttgattataaacctctagggctaccgattcgcagtttgagatcggttgctagagatgtagatagttctagatatgccaatgaaagtgattccagttcagtttcaaggggttcttctagcggattgggtaagagcggagatagggaatttggggatctgggtccttccaatttggagaaaaaatttaatgatgctgctgctgctggtggatcagcttctgcgattccctg

SEQ ID NO: 113208 - DNA, 1071 bp, Glycine max
  Peptide Sequence Number=SeqID_229986
atgaaaggagctgaatatgaccccaaaagtgatttattggatcaggagttcatgctgaaaggaaaatggtatcaacggaaggatgtagagataaaaaacagtcggggtgatgttcttcaatgcagccattacttgcctatagtcagccctgaaggaaagcctctgcccggatgtagggctgatgctagtgaagctgctataattttacttccctcaaacattacagtttttactctggatttttctggctctggaatttctggaggggagcatgtcactctaggctggaatgaaaaggatgatctgaaggctgtcgtcaactatttgcgggatgatggaaatgtctctttaattggcttgtggggtcgctcaatgggagctgtaaccagccttatgtatggagctgaggatccttcaattgcagggatggttttagacagtcccttttctgatttggttgatttgatgatggaacttgtagatacatataaagttcgtctgccaaagtttactgtgaagtttgcaatccagtacatgcgaagagcgatccaaaagaaggcaaaatttgacataacggacctcaatacaattaaggtggcaaaatcttgttttgttccagctctactaggccatgccattgatgatgattttatacagccccatcactctgatcgaatatttgaggcttacatgggagacaaaaacataattaaatttgacggagatcacaattctcctcgtcctcagttttactttgattccataaacatcttttttcacaatgttttgcaacctccggaagatgaggttggggaatcattttttgaccccatgaatgattactttggtaaggatgtttggagatctgtgcacgaattaggctacagcaatgaatcatcatctaaaaacaaaggcatgactcaagatctgcacttagtaccttcactttttgtaaatatcttacatgtttctttgttagatgcagaaccatcaacaagcagcacgataaatgccattgagcaggtccgttcaagacgaccaatgagtaggatggaggtttgcatttattag

SEQ ID NO: 113209 - DNA, 2136 bp, Glycine max
  Peptide Sequence Number=SeqID_229987
atgggaattgatccatctgatcgtgtaactccaataagcttagatgaacgagttgagcttgtagggaaactgtacaagcaaagtttgaaacgaccagaactccgagatgaactttttgttcagatatcaaagcaaacaagaaataaccctgagaggcaatacttgattaaagcatgggagctcatgtatttgtgtgcatcctcaatgtctcctagtaaagatattagcagttatctatcagaatacattcataacatagcaaatggtgtggctactgattctgagattcaagtccttgcattaaatacattaaatgctttgaaacattctgtcaaggctggtcccagacatataattcctgggcgtgaggagattgaagctctgttgactgggagaaagcttacaactatagtgttcttcctagatgaaacttttgaagaaattacgtatgacatgtcaaccacagttgccaatgctgttgaggagtacattgggttagatgcaaacaaatatattggggatctcctggcagaatttaaagctgcaaaggatcggagtaaaggagaaatcttgcactgtaaactgatattcaagaaaaagttatttcgtgagtcagatgaagctgtgacagagcctatgtttgtgcaattatcttatgtacagatgcaacatgattatattttgggaaattaccctgttggaagggatgatgctgctcagctttctgccttacaaatcttagctgagattggatttcttagcacaccagaatcatgcattgactggaattcacttctggagcgtttcctgcccagacaaatttcaatgacacgagcaaaacgggaatgggagtatgacattctttctcgttatcgttcattggagaatctgacaaaagatgatgcgcgacaacaatttctgcgtatattgagagcacttccttatggaaattctgttttcttcaatgttcgcaagattgatgatcctattggactcttacctggccggataattttgggaattaataaaagagggattcattttttccgtccagttcctaaggaatatttgcactcagctgagttgagagacataatgcaatttggaagcagcaatactgcagtcttttttaaaatgcgagttgcaggtgttctccacatattccagtttgaaaccaagcagggagaagaaatttgtgtagctcttcagacacacataaatgatgtaatgctgcgtcgctattcgaaagcaagatcagctgctggtggtggtagtggttctctgaatggagacatttctaataattctaaaactcctaatatggaattatatgagaagcgtgttcaagaattgtcaaaacatattgaagaatctaaaaaaaatgctgatcaattgcttgaagaattacgtgtgaagcaaaaacaagaagagaaaatgcaagaagaattggatgacttgaaagaatccttaaaagccaataaacaaaatttggatgccgttacaagtgaccgtgatagtcttgtatcattatgcaatgaaaaagataaggaactacaggctgctattctagacaaaaggaatatggaatctaggatggccaagttaaataatgcggtgatagagaacactgccaaaaaggatcttgctaatgctggaaatagacaagtgactcaaaagcttgaagatgagctaaaagtttgtaaatatgagctgctatcagccaacgaaactatcgaaagcttgaagagtgaaaaattgattttggaacagaagttatctgcacttgaaaagaggaatgctggagagattagttcccttaagtggaaacttgagcaagaacgcaaagttgtgaagtctgaagcgtacgagcttgaaagaaggctagaagggtgtaggcaagaattattgactgctaaggctatcatttcagtcaaggactctgaatttgatgcattgcagaataatttgaaggagctagaagaattgagagaaatgaaagaggatatcgatagaaagaatgaacagacagctgccatactgaaaatacaaggggctcaattagctgaaatggaatcactttataaggaagaacaggttttaaggaagcgctattttaatgtaatagaaggtggatga

SEQ ID NO: 113210 - DNA, 1212 bp, Glycine max
  Peptide Sequence Number=SeqID_229988
atgtattcttccttggattcaatttcatcagatatggacttccaagaggaagatatgggacaaaagaagacttcccatatgcatacttcagaaaatatgaattttcaggaggacatgggacacaagaagacttcctatgtgcatgattcagaaaatgtgaatttccaagaggaggatatggaacaaaagaagacttcctatgtgcctgcttcagaaaacaggaatttccaagaggtggatttgggaaagagttcccaggtgtcttcttctggaaatggaatgattgaatctaaaggaaaatatgcgggtgattcccgtccttcgtatttcaggccaatgtcagttgatgaaactcaacttgaatcactcagctcacggtctttccagtctatgggatctttctcatctcagtcaagtttatgttcttccctggattctgctttgtcagagaatatgaactcgccaaaggaagaacatggatcttcttcaagttcaccatcacctttggctaggaggaatggtgaagcttcattgcaagcatttcaagctcgtggatatactaatggttcctcaccaccggatgacataaagagcagtttgaatggtgaattgaggggtttaaatgagattgaaggtgaggatccccctggcaaaaaagagtcgcggatacatgttttgcagtcggactcagaaaagcctgcaagagtagcaaaagctccatcacaaggaaaatcggtcagaacaagaagagccagtggcctgacttcagggacaatgagaataggagaaacatctagcaagcaaactgatgaaaagggtgaaaagaacggtaataatgttgagtcagtaatgagaaaagatagaatgaaaagtagagaaccggaccttccattgaaaggagtcagcaagaaaactctggattcttattgtcctaagcctgagattaaattttccaatcatcataggagagataaactagagtcatccaaaaatttatccaagcaagattcggatatcgagcttgagaatactcaggtgagctcatatgaaaatggggtacctgaatgtgtcaatgattcagatctggattctgaggtggataagaaagctagtgaatttatagccaagttcaaagctcaaatcaggcttcagaaaataggatctattgaaagatcaaaagagcaaaagatcactcaaaacaagattaggtga

SEQ ID NO: 113211 - DNA, 1542 bp, Glycine max
  Peptide Sequence Number=SeqID_229989
atgagaattggttctccttcttcatcttcctcccgttgttcgcgtttctggtcgtcggcgctccgatcgaagcgcctcgtgtcgccggcggaaaaggccgcccgcgacagctccgacctcggcctctcccgccgcctcggcgttctcgacctcgtactcctcggaattggcgcctccatcggcgccggcatcttcgtcgtcaccggcaccgtcgcccgcgacgccggacctggagtaacaataagttttatacttgcgggagcatcatgtgttataaatgcactctgttatgctgaactagctacccgatttcctgctgttgttggaggagcatatctgtatgcgtacacagcttttaatgaacttacagcttttcttgtttttggacaattgatgcttgactatcacattggggcagctagtatagcgagaagcctagccagttatctaataaatattctagaactcttccctgttttcaaagataacattccaaaatggattgggcacggtgaagacattggagatgtgctatccatcaatgtcttggctccaattttgctagttcttctaacttttattctctgtcggggtgttcaagaatcgtctgttgtgaattctcttatgacagtgaccaaggttcctttccatcctacaagttacctcaatatagtacttaacattgcgttaatggtaatcatagttatcatcgtcatttttgctggagcgtttgaggttgacgtttccaactggtctccctttgctccaaatggtttaaaagccatatttacaggagctaccgtagtcttctttgcatatgttggatttgatgcagttgcaaattctgccgaagaatccaagaggcctcagcgggatttgccaataggcataataggaagcctcttaatatgtattgcattgtacattggagtatgcctggtgattactggaatggttccatacaatcttctaggagaagatgctcctttggctgaagcttttacgtctaagggattaaaatttgtttctatcctgattagtgttggtgctgttgctggacttacaacaacactccttgttggtctctacgttcagtctcggctataccttgggcttggcagggatggcttactacccttaatatttgctaaagtccaccccaaacgccacacccctattcattctcagatctgggttggcttggttgccagtgttttggctgggctatttaatgtgcatgtgctctctcacattctttccgttggtacactgactggctattcagttgtctcagcgtgtgtcgtcgttcttcgctggaaggacaagacaaatagtcaagtgtcatcttctgctgagcgggaaggcgtaatttgcctcattgctgtcgccctttgtggatttgctagtgggctcttgtatcgttatgatgcttcatttatttttctgattctggctttagttattgcagctggtgcttctgctgctcttgttttccgccaggtgaggattattttatattttatcaaagctctgtttggataa

SEQ ID NO: 113212 - DNA, 243 bp, Glycine max
  Peptide Sequence Number=SeqID_229990
atgcaatctgactcaagaagcaagttggtgagcggagatagtattgagaaggctgtgaggcggttgatggacggtggtgatgaagctctagaaatcagacggcgtgcagaagagtttgtaagaaaggccagagaagctgttggagaaggggcttcatcctacaacaatttaccgaacctgattgatgatcttctgcggctgaaggacaccaaggcttcagcttctccgctagttaattattaa

SEQ ID NO: 113213 - DNA, 171 bp, Glycine max
  Peptide Sequence Number=SeqID_229991
atgtcctatgcaataggaatgcaggatataaataccttattttatccagaaattgttgggtttccaatgaatgggaggaagatggagaatcttaggtatccagaaaatggcaaaatgatgggtcagagagggagaaaagagagaggtagcgagagtgagagaagaagatag

SEQ ID NO: 113214 - DNA, 282 bp, Glycine max
  Peptide Sequence Number=SeqID_229992
atgcattttatgaaaagatgtgactcttcacaattgaatttgaatttcaacgttcatatacattggaaactggtaatcgattaccagagagtaaatactctggaccagccccgagctcctgctcaatcccttattaagcctgatgaaaagagaaataagggttcaaaggcagggttcacgcctgagtctaaaagcttcaaggatgatgggtttggtcctccaccagcaagatggaaaggatcttgtggccactatgcaaatttctcaggctgcaataggtaa

SEQ ID NO: 113215 - DNA, 249 bp, Glycine max
  Peptide Sequence Number=SeqID_229993
atggaagtaaccatcttgcaaaaattggggcaaaagatggatcgagttacatcgttgcttcatctaatgccaaacacatttaggactgttgatgtccttgttacttccagtttcaccttgacaaagatgtcatggaccataaaagaacacgctttacgatgcccttaccaaacccgtgctagagctagagtaatgggtgaagtagaggaggtgcaagagcagataaaggccgacatggaggccatgtaa

SEQ ID NO: 113216 - DNA, 609 bp, Glycine max
  Peptide Sequence Number=SeqID_229994
atggcaatgaggtactccaatgacgggtttcttggcctttttgctttgaccatcatatccatcttcattctcggctcttcaacatcatcctacacatttcgcgttggtggcaaagacggttgggtcatcaacccttcagaagactacattcactggccacagaggaacaggtttcacgtcaacgactctctctatttcaagtacaagaaagggtctgattcggttttggtggtaaacaaggatgattacgattcatgcaactccaacaaccccatacaaaagatggacgagggtgattcattattcactttagacaaaccaggaccttttttcttcatcagtggcaaccttgaaaactgccaaagtggtcaaaagctaatcgttgtcgttttggccgatacacacgaacatagtcagtccccttctcagccggaagctgaggcacctatagcaaattggccgtcaggcccaaattctccggtggcatctccgcccaaacattcgggttctacgagcgtacgaggtttaagggttgcattggtgtcgctttcggtgttagtgttgaggacttggggtgggtttgctcttcagcaagttggcctagtttga

SEQ ID NO: 113217 - DNA, 423 bp, Glycine max
  Peptide Sequence Number=SeqID_229995
atgcaagaggtaaagcttgataagcttagtcttttggatgtatggaaacaaggctttcttgggataaattccttcaattatccctacaactacactaggcaagaagactgttgctcccaaccccaatgtgtagaagcaaagcttcatgaagaatcaagattgattcaaagatgttttgatgataacaaagatgatgacaaaggtgatgacaaaaagctcaaaggtcaatcaaagaatgagttgaagatgttcaagatagaatcaagaacacttcaagattcaagaggaaagttgatttcaagaatcaagaataaagattcaaggatcaagcttccaagaatcaagatcaagattcaagaatcaagagaagactcaatcaagataagtattaaaaagttttttcaaaaactgagtagcacatga

SEQ ID NO: 113218 - DNA, 228 bp, Glycine max
  Peptide Sequence Number=SeqID_229996
atgtctattgcagaagttcagaggcagagtactgaaaaggataccatgatggacataaacaagatgaatagagctgagattaatgaattggaaagagttcaatatgcaacagaacatgcaactaagatcttgtttctagatgttgctcaaagacaagtagagatggaagttgccattgttcctaatgacatggatcctacaaagaagaaatcttttgtgaaggcctag

SEQ ID NO: 113219 - DNA, 189 bp, Glycine max
  Peptide Sequence Number=SeqID_229997
atggcacccaagaggaacaatggttggaagacgagggttttcttgtcaaagggctcattaatcatgttggttggacacccttcctggaaaagttcagctcctagcattatggtcactatgccatattctggggaactacacatcaagacagagttagtatcagaggcaccaccaagggaaaggaagtga

SEQ ID NO: 113220 - DNA, 534 bp, Glycine max
  Peptide Sequence Number=SeqID_229998
atgatgaagaacgatgaagaatcttcacgaaatcgctcacggaagcgtctcgaaagcgttacgaaagcgcctcggcttggatttttttcacggaaaaaattttcctcactaatttcgagagaatccttaaataccagaagggttgaacaatttactctgcccttttcccctatttataggagaaaagaggaaggtggttgccgcccagctcgcccaagcgagcagggttgcttccacaagaaggcacggccttctgttggaaccttttggaaggcccaagtgggactgaatgttgtgaaactttacggaccatgcaaccatgctctttttgactcctggaattttgcggaacttcacagattgcgcaacaatgcttgttttttccttcttgaatgttgcgaaactttacaaattatatcacgatgggtgttaaacattttgagtcggtcaagagaaggtcgcatgccaacaaataatggtccccggacaaaattagggtacgacaagatgtacaaaaagatttctctcctttag

SEQ ID NO: 113221 - DNA, 1410 bp, Glycine max
  Peptide Sequence Number=SeqID_229999
atggacttgaaagaacagccactaaaactttacttcattccatacctggcagcgggtcacatgatccctctatgcgacatagcccaattcttcgcctcacgtggccaccacgtgaccatcatcaccaccccttccaacgcccaaatccttcaccagtccaaaaacttgcgcgtccacaccttcgagttcccttctcaagaagcaggcctccctgacggcgtcgaaaacatattcaccgtcaccgacctcgaaaaattctacagaatctacgtcgccgccaccatactgctccgcgaacccatcgagagtttcgtggagcgggacccaccggactgcatagtcgccgatttcatgtactactgggtggatgacttggcaaacaggctccgcatccctaggctggtcttcaacggattctccctcttcgccatttgcgccatggagtccgtcaaaacgcaccgcatcgatggtcccttcgtcattccagatttccctcaccacatcaccatcaactcagccccacccaaggacgcgcgtgatttcttggaaccccttctcacggtggcgctcaagagcaacggtttcatcatcaacaacttcgccgagcttgacggtgaagagtacctccgccactacgagaaaaccacgggccacagggcctggcaccttggcccagcgtccctcgttcgcagaaccgctctggagaaagcagagaggggccagaagagcgtggtgagtgcgaacgagtgcctgagttggctcgactccaagcgagacaactcggtggtgtacataagttttgggaccctctgctattttccggataaacagctttacgagattgcatgcgggatggaagcatcgggttatgaattcatatgggtggttccggagaagaaagggaaggaagacgagagcgaggaagagaaggagaagtggctgccagagggttttgaagagaggaagaaggggatgattatcaaggggtgggccccacaggtgctgattctggagcaccctgctgtcggtgcgtttttgacgcattgtgggtggaactccacggtggaggcggtgagtgctggggttcccatgattacgtggccggtgcacagcgatcagttctacaacgagaagttaataacacaggtgcggggtattggggtggaggtgggtgtagaggagtggaccctcagtgcttatttccagagtcagaagctggtgggaagagatcgcatagagaaggctgtgaggaggctcatggacggtgctgctgaggctcagcaaatcagacgccaagcactaaactttcagaaaacggctgcaaatgctgttcaagagggtggctcatcatacaataacttaacctccctcattcattatcttaaacaattcagagaccgtaaatcttaa

SEQ ID NO: 113222 - DNA, 342 bp, Glycine max
  Peptide Sequence Number=SeqID_230000
atgcattatttccaactaatttctaatgccatctactatttgcagggatcgtgcccacaagacacccagttgacccagagacatccaacagggccctggggtttccagctctggttacgggcctctatcaatcctacagggtgcccgtacccccccggcaaggtcatgccatcccgacatagttttacggaatgcctgtcacccccaacaaggtcattaggccccgcattaaccgagctttcatcaagaagtactgcgccccctagcaggcgcagggcgagacaacacagcagcatggggacagctggcagcgggcaacagacgcaccgccaccacctctag

SEQ ID NO: 113223 - DNA, 1080 bp, Glycine max
  Peptide Sequence Number=SeqID_230001
atggaacagttaccactagataaaccgctttgggaaatgcatatattcaagtatccgacaagcaatgctgcgggaactgttatatttaagctccatcatgcacttggagatggctactctttcatgacaactttgctttcatgcgtgcaaaatgctgagaatccttctgttcctataaaatttccttcgagccgatcagtggaatcaaaaagtaccaaaatcatgccaaaattattacctcaaactgtctctatgatgtttaagagtgcattcgattttggatggagtctgttaaaagatagcctgattccagatgatcaaacaccaataaggtcaggtcataaagatgtaggttttcgacctatgagtgtcacagatgtttctctctctctgggtaacatcaaagaagttaaagataaactcaaagtgagcgtaaatgatgtcttggttggggtaattttccttggcattcaactatacatgagtgcaaagaaccataaatcaagcagagcagagagtacagcattggtgctgctcaataccaggaaaattagagcttacaaatctgcggagatgatggatcataccaattccgaggcaccttgggggaatagattccacttcatgcatgttcccatgcctatgttaagtgataccaattacttgaacccacttgagtatgtgttagaagccaacaaaaatatcaacaggaagaggaattctttggccgtaccgttgaccggagtgcttttgcgcttgttgaacaaaatcagaggcccccaggctgctacaaactacgtgtacaagatattgaataatacaagtttaagcatctcacacatggttggaccaatggaaaaagtggctttggctaaccatcctatcaaaggcttatactttatgactgttggtttatctcagagcatcacagtgactataacaagttacatgggatatttgcgagttggatttggagtagaggaaggcttcatagacgaataccagctcaagtcatgtttcgaaacctctctggagatgatactgaaagcagcaaaaaatgttgcgaaaactagattatag

SEQ ID NO: 113224 - DNA, 486 bp, Glycine max
  Peptide Sequence Number=SeqID_230002
atggctgatcatcagcagggagatcaaccttcttcaaccaaagggatcgaaagaaggattggaagagaattatcacgtgttgatcaaatagacgaggctatcaactacatcaagaacctagagacaaaggtgaagatggcgcaggagaagaaagaaagcttaatattgcaaaggaaaagatctcgcagtggcggttcgagtagtacttctgaagcaccgaagattgagattcatgaagtgggttcctcgctacaaatcattctgacgtgtgggcttgataaccagatcattttcagtgaaattattcgtatactgcaggaagaaaacatagtggtcaagagtgtccattcttcatcattcgctggaaactcaatgttgaatgttgtgcatgcagaaattcagcaatattcatttcttctagaaacaaccgcaatgagtattgagaaattgagaaggattgtggacatgcatggaggaaatttttag

SEQ ID NO: 113225 - DNA, 195 bp, Glycine max
  Peptide Sequence Number=SeqID_230003
atgtggtcaaaagtttggttggcaacgctgtggactatctggaagcagagaaatgatgtggttttcaatggtggccaatgctgtagtgtgaagatgatggaattggtgaagtggtacactggttttactgttgaggttgcaagcaaaaggtatgcatgcatgtatctgggagggcactttatcatactgaagtga

SEQ ID NO: 113226 - DNA, 189 bp, Glycine max
  Peptide Sequence Number=SeqID_230004
atggctaatttcctgggacttaataaggtgaatcttggcataaaacggatgaatgggatgttaaaaataaatggttatcactcaagctacaaggctccaaatgagaacaaggttgaagatgaaatggtggaaggaaagagtcactctttccagcgagggcaactcacaaaggatgtgaaaggcctttga

SEQ ID NO: 113227 - DNA, 717 bp, Glycine max
  Peptide Sequence Number=SeqID_230005
tgagcatgtcggtttcgccgctgcctttcgccgcgcccggcgatgccatgccctggcgccgttgcctggtgctggtgctggcgctgcacctgctggccgcggcgctgctctggccctggcgagacaaggccgagccgccgtgggtgccgccgccggcggtcatggtggtgatggccgccgcaccgcaggccccggccgaggtaaaacaaccgccgggagaaaggacgccgccgcctcagccgcacggccgaacatcgccgtagcgccgaagcagaaaaaaccgcccaagccggtgaagaatccccccctgccgcgcacaccgccgcaggagaaaacgatcgcgccgccgaaggttcaggagcaaagcgtcggtgctccaccgccgggccgggcggataaaacggccgcgccgcaaactcgcctgacgccctatgctcaagcgggggtggacaactggcgcagccgcatcagcggccgcctgaatcgctttaaacgttaccccaaagacgcattgcggctgaagcgccagggcgtcgggcaggcagggccatgtgctggcggtgacgctggtcagcagcgccgggctgccgtcgctggatcgcgaaatccaggcgctggtcaagcgcgcttcgccgctgcctacgccgccggcggatgcttacgtcaacggcacggtggaattgacgttgccgatcgatttcagtttgcgcggcgcgg

SEQ ID NO: 113228 - DNA, 1267 bp, Glycine max
  Peptide Sequence Number=SeqID_230006
gttctgtttcactcccctcgccggggttcttttcgcctttccctcacggtactggttcactatcggtcagtcaggagtatttagccttggaggatggtccccccatattcagacaggataccacgtgtcccgccctactcgtcggactcacagctcatgcatcttcgtgtacggggctgtcacccggtcctgggctgctccccgttcgctcgccgctactgggggaatctcggttgatttcttttcctcggggtacttagatgtttcagttcccccggttcgcctcgttaacctatgtattcagttaacgataatgcacaagtgcattgggtttccccattcggacatcgacggctgtagcggttcatatcaccttaccgtcgcttttcgcagattagcacgtccttcatcgcctctgactgccagggcatccaccgtcttgttccggattgttaaagagcaatatctcaaacacgacgttaccggcggagtcctaaccgctagacgaaggggacacaaagtgtcacgacttcgcagccgtcctgctcgtaaggaggtgatccaaccgcaggttcccctacggttaccttgttacgacttcaccccagtcatgaatcacaaagtggtaatcgccctcccgaaggttaagctacctacttcttttgcaacccactcccatggtgtgacgggcgactccaatccggactacgacatactttatgagggccatgatgacttgacgtcatccccaccttcctccagtttatcactggcagtctcctttgagttcccggccggaccgctggcaacaaaggataagggcaccaaagcatctctgctaagttctctggatgtcaagagcggtcgacttaacgcgttagctccggaagccacgcctcaagggcacaacctccaagtcgacatcgtttacggcgtggactaccaggtctttgtccagggggccgccttcgccaccggtattcctccagatctctacgcatttcaccgctacacctggaattctacccccctctacaagactctagcctgccagtttcgaatgcagttcccagtaattccgattaacgcttgcaccctccgtattaccgcggctgctggcacggagttagccggtgcttcttctgcgggtaacgcttgcgcccattgtgcaatattccccactgctgcctcccgtaggagtctggaccgtgtctcagttccagtgtggctggtcatcctctcagaccagctagggatcgtcgcctag

SEQ ID NO: 113229 - DNA, 579 bp, Glycine max
  Peptide Sequence Number=SeqID_230007
atgggattccctcaacctcggcgcgcacgtcggggacgaggcggatcgcgtgatgcacaatcgtcagcgcgtggtagagcaacttgcgctaccggcgatgccgcagtggctggagcaggtgcacggccagacggtggcgcgtctgccggcggctgcgtccctgccgcgagccgatgcggcgataacgcgggaaagtggcgtgccatgatggcagcgaagttgccgcggcacatgccggctggcgcgggttgtgtcatggggtgctggagcagacgctggcacagtttcactgcccggcgagcgagattcatgcctggctcggtccggcgattggtccgcaggcatttgaagtgggggctgaggtgcgcagtgcgttcctggcgcaggatgccgctgccgatgcggcttttcgcccggccggtgagaaatattttgccgatatctggctgctggcaacccagcgtctgcaggccgctggcgtgcgttctgtcacggctgatgcgcgctgcacctatcaggaaagcgccgattttttctccttccgacgcgacggaatcaccgggcgtatggcaactttga

SEQ ID NO: 113230 - DNA, 477 bp, Glycine max
  Peptide Sequence Number=SeqID_230008
gggtttgaagagagaaatgcagagaaggggatgattataaaggggtgggcaccgcaggtggttatactggggcacccggcaattggggcgttcctgacgcactgcgggtggaactcgacggtggaggcagttagcgctggagttccaatgatcacgtggccggtgcatgacgaacagttctacaacgagaagctgataactgaggtgagtgggattggggtggaggtgggggccaaggaatggagcatccttggctttggggagaggaaacacttagtgccaagaaattccatagagaaggctgtccggaggttgatggacggtggtgatgaagctctcgcaatcagacgtcgtaccaatcactattcgatcatggctgcacgtgctgttcaagaaggtggatcatctcacaccaacttcaaagccctcattcatcatctcaagctattcagggaccgtaagtcgcttcatcaatag

SEQ ID NO: 113231 - DNA, 141 bp, Glycine max
  Peptide Sequence Number=SeqID_230009
atggtgagcagagatagcattcagaggttgatggacgattccgatgaagctcacaacatcagaagccgctcaaaaggcaaaacaggctcttcaggaaggacaaagaaatggatttgcgggggggttttaccgagtgaatag

SEQ ID NO: 113232 - DNA, 3909 bp, Glycine max
  Peptide Sequence Number=SeqID_230010
atggtgaacatgggtatatttaagatattaaaaaaagatcatgaattgttgctaaacatggttagaatgtggacaaaaaatggactatgtacaaaaaccagaaaagaaaaacaaaatgtgcaaaaagaaaagaaaattccaacaccactccctgataatcatcatcttctctgtgttcctctcggtagcccttttcttctctggaaccacccatatgaactcctgacccgatgcttccatcccgtcgagttcaacaaagttgttaacaacggtggtttcatgaacttgttgaaggtcaaccttggaatgttaagcttgttggccacgtcatgcacccatggcggagtcgccgttgatgaaaaggataggagagagaatgaaggaagaaagggggaaagaaatccacccgcgacgcttgctccctcgtttgccgccgctggttccgcctcgagcgccgaacccgaacaaccctccgaatcggcgccacccacctcttcctccaccgtctcccctcccgtttctccaatatcagaaatctctacatcgacgaacgcctttccattcccctccacctcgtccgggaaaagacgcccgaacgacgaagagggcgatctcgattctctctgtttatcagatgctggtctatctgctcttggcgaaggcttccccaagctccacaaattgggcttaatctggtgttccaacgtctctagcgatggtttgacatccctagctcggaaatgcacttctctcaaagccttggacttacaaggttgttatgttggggatcaaggtctggctgctgttggacagtgttgcaagcagcttgaagacttgaatctgcgattctgcgaaggattgactgatactggtctggttgaattagccttaggtgtggggaagtcgttgaaatctcttggtgtggcagcttgtgccaagataactgatatctcaatggaggctgtagggtcacattgcaggtcccttgagaccttgtcgttggactctgagtgcatccacaataaagggctgcttgctgtggcacaaggatgtccaactttgaaggttctaaagctgcaatgtattaatgttacagatgatgctttgcaagctgtaggcgctaactgtctgtctctggagttactggcactatacagttttcagagatttactgataaggggttgcgtggcattgggaatggatgtaagaagttaaagaatttgactttgattgattgctatttcataagtgataagggtttggaagcaattgctaatggttgcaaggaacttacacatcttgaagtcaatggatgtcacaacattggaactttggggctagaatacattgggagatcttgccagtatctcactgagttagcattgctttactgccatagaataggtgatgttagccttcttgaggtgggaaaggggtgcaaattcttgcaagttcttcacttggtagattgctcaagcatcggagatgatgccatgtgtagtatagctaatggctgcaggaatctaaagaagcttcatattcgtcgttgttacaagattgggaacaagggactcattgctgttggcaagcattgtaagtcactaacagatcttagcattcgattctgcgatagggtgggagacggggctcttactgcaatagctgagggctgttcccttcattatctgaatgttagtggttgtcaccaaattggagatgctggagtgatagccatcgcaaggggttgtcctcaactctgttacttagacgtgagtgtactgcagaatctgggtgatatggcaatggctgagttgggagaacactgcacattgcttaaagaaattgtgctttcacactgccgtcaaattactgatgttggactgacacatcttgtgaaaagttgcacattgttggagtcttgtcaaatggtttattgctcaggtataacttcagctggggtggccaccgttgtttctagctgtcccaacatgaagaaagtcctggttgagaagtggaaggttagccaacggacaaagcgacgagctggctctgtaattgcctgcttggatttgtgcatggtttctgtaatgtcttccctttctgttgctcctgtcacccctccaattcctgcccccttaccccatccagacactgcagtttatcagatgacttacatgagcaaaggagcggtgcgttatggaggaatgatcggagtagcagccatgcccagtggatgtagcatcagagcaatatggattctcaacaaccttgacggcgtcgttttttcccggtttccggtggtagagaagcgttggcgagctgcttgcaactcaaacgcccacaatgatacccatcaaatcttctcttccttacccactgactccgacctcgctgatgcttttctcgaccgaaagcatagggagggatctgcacgaggatttggcatacgaaagagtaactcaactctgggatcggattcttgggtggatgatcccattactcgccatatcatcggtctttacattagcagagaaggggaggaaaataagaatctattgtggcctttaatcttgcacacaaagggcctttacagtattcttattctgccattggttgagcctatccatttaaatgcatatgcaaggttgtgtaaaagacctgattgtggagctgctcttggtatggatgacggcctgtcttccctcttactggatcttccatcagtaacaggggcatttatgatagcgcatgccattggtgacataattactggcgacacagtagaacctgaagtgattgtaagtgcagctccctctgttggagggctgtttgattcactcactggtagtataggcatctcttccagggcaaaacctgtggccccacctgttgcttcttcctccccttctagtgcagctgtaccaggatcagttacagcagatgctccaaaaatggggtctaggttattggataaagatgcactcagaacatttatcagtagttcaatgccctttggcacacccttggaccttaattattccaatattattaccataaagaccaacggcttttcggcaacagatttgcctcctgcggaccagaagcagccagcttggaaaccatatttatacaaaggaaagcagagaatgttgtttacaattcatgagattattcatgctgctctgtatgatagagatgagattccggatactatatcagtttctggtcaaataaattgtcgagctgacttggaagggttgccagatgtgtcatttcacttggctggattgaacacagcaaaccttgaagttttatcgtatcatccttgtgctcaagtttcagatcaaggtttggataagcaaggagtgatgttttctccgccattaggtaattttgtgttgatgcgttatcaggcagcttatgcccttggaccccccataaagggattctatcagttgtcaatggtttctgaggataaaggtgcatttctattcaagttgcatttaatggaaggatataaggctcctttgacaatggaattctgtactgtgactatgccctttcctaggaggaggattgtatctttggatgggactccttctgtgggaacagtttcaacttcagagcactctgttgaatggaaaattgtgacaagtggccgagggcttactggaaaaagtattgaagtgactttccctggaacagttaagtttgcaccttggcaaacccaaaggttgtcttcctctaggtcatcctttggaatcactgctgacgaggatagtgataatgaggcagaaaatgctagtaacatggttaatgaagaacatttgatggggaaaatgaacaagggtcttcctccagtcgatttagaggagccattttgctggcaggcatacaattatgctaaa

SEQ ID NO: 113233 - DNA, 324 bp, Glycine max
  Peptide Sequence Number=SeqID_230011
atgacgcaacgaatgacatcgctggggtcgagggagagggtgacgtggagggaggggagggggcggggttatgaggaaggggggttgaggagtaaaagagcatcttggaaaacgacgacgaagaggaaggattcaatgtcgttttgggagaaggttggggagtccatgagctcgaggaagtgggtgtggcagtgcagacaaaggaaaggggagggtgggagcttgagggacacgcttatgtcgcactcgtggcaccaattggttgtcggacccgccatcgatggtggtggtggtggcggcggaggaaatgggaagaagcactaa

SEQ ID NO: 113234 - DNA, 357 bp, Glycine max
  Peptide Sequence Number=SeqID_230012
atgaagcatattctctctaccaatcttggaaaactagtgagcacgggagagattttgacaaattctgatggttgctattcattcccacaagacattaaaaccccacaattgcttttggaacattcatgtcttggtgtagatgtgacagacctatacggtgattcattggccattatagtcagagacgatgtggagacacacaaacctgtttgcaagaagaaaaaaaactataaaattgaagaagtggaagaaaaaaattgtgaacatgaagaagagaaagagccaagagaatcaaggaaaacagaggaaatggtagggaaaggacacgaaagaagaaggatgtggttgaggggataa

SEQ ID NO: 113235 - DNA, 713 bp, Glycine max
  Peptide Sequence Number=SeqID_230013
atgggtgctacttacctcggagaacggccactgaaacttcacttcattccctaccctgcacctggccatatgatccctctctgcgacatatccacactcttcgcctcaagcggccacgaagttaccatcatcaccactccctccaacgcccaaatccttcacaaatccatccctccccaccgccgcctccaccttcacaccgttcccttcccttccaatgaagtgggcctcccggagggcattgaaaacctctccgcagtctccgacctagtaaacgctgccaaggtccaccaagccaccgccctcctccgctgccccatcgagcaattcgtggagcaccacctacccgattgcatcatcgctgactttctgttcccatgggtggatgacgtggccaacaagcttaacatccccagactggccttcaacggtttctctctctttgccgtctgcgccattgacaagttacagtctaacaatactaactctgaggaatattcctctttcattccgaatcttccgcatcctatcacgttaaacgcaacaccaccgaagatattgaccgagttcatgaagccactgctggaaacagagctcaaaagctacggcttaatcgtcaacgactttgcggaactcggaggagaagagtacatcgagcactatgagcaaaccacgggtcacaaggcgtggcatattgggccagcgtctcttat

SEQ ID NO: 113236 - DNA, 1377 bp, Glycine max
  Peptide Sequence Number=SeqID_230014
atgagtcagctgagcttacggattctagcacttaagaagaaattgcgttatacgaacgatgggaaagatctaacagtctttccgttatgttcatcaagacgcgcatctctgctagccttggctatcaccctaatgtctaagttgtcatctatgaggctcattggagacgcagggagacttgctcaagaaattagtgaagatgctctgatcgtgactcaagataaggggaagatggaaaggaaggaaaacaaccatatacctcatactgccaaaattaaaaagaagtctagggagccaaatgaaggcgaatggttcatctactctgggaatcggatgcattcacatatagcggctattggcacatttaggatttataatccaaatgaaaagaagctggacccaaggatcattagtgcatatttcattggttatgttgaaaggtctaagggtgatttaactcaaggcattggtgttgagaaaaatcaatgtgatgaagcagttcctacattaagttataagctagtgttttttggcgatactcaccaaaatcgtgtaacacaagctccacatcaagttgattctatcctagaagatccatttgaacaacatcaaacacaaaattttgagcaacctattgaacaacatcaaacacaagatgttgaacaacttgttgaacaacaaccagaaggcgtggatgtaacattaaggagattaactagaataaagaaacatgcacttcctagtgattatcaagtgcatttacaagagtctcaatatgactttggagttgaaaatgatcctaagtcatttttgcaagcgattaacagttgtaattctaagttatggtatgatgctatgaaagatgaattggaatctatggaaaataataaagtatgggatcttgttgagttgcctaatgggataaagcctactggatgtaaatgggttttcaaaaccaagaagaattcattaggtaaaattgagagacacaaggcccgattggttgccaaaggattcgctcaaagggaaggaattgaatacagggaaaccttttctcctgtatccatgaaagattccttacgtatcataatgacattagttgctcattttgacttggaattacatcaaatggatgtgaaaatgacttttctaaatggtgacttagaagaagaagtttatatgacacaactcgaagggagtctcgacttgtctcaaaaggcctataataataaagttctagaaagattttggatgaaagattgtttacccaacatggcacctattgtgaaaggcgatagattcaatttgaatcaatgttctaaaaatgagcttgaaagggaacagatgagaaacattccttatgtttccattgtatga

SEQ ID NO: 113237 - DNA, 1785 bp, Glycine max
  Peptide Sequence Number=SeqID_230015
atgggtggtgtaggaggaacacttgtggatggcattcgtagcttcttccatcgttgcaattctattaactctcacattcaccatcacaaaaacaaaaagaagaacaagaacaagaacaacaacaatattaacaacattgtctttgtgagacatttgcgtgcccagttggccaacgttcccactcagcaaactccttcctttaaccttctcaaagtccccaaacgctcccacttcaaatctccttccatggatcgtaacaaaaagggtgcactggaggtagagttttttactgagtatggagaggcaagtaggtatgagatccacgaagtgattggaaaagggagctatggtgttgtgtgttctgccgtagacactcatactggggaaaaagttgcaattaagaaaatcaacgatgtttttgagcatgtgtcagatgccacacggatcctaagagaaattaaactccttcgtttgctcagacatcctgatgtagttaaaattaagcatataatgcttcctccctcacgacgggagttcagggatgtctatgttgtgtttgagttgatggagtctgaccttcatcaagtaattagggcaaatgatgatctttcccccgagcactaccaatttttcttgtaccaacttcttcgaggcctcaaatttatacatgcagcaaatgtgtttcatcgtgacttgaagccaaaaaatattctagctaatgctgattgcaagctaaaattatgtgattttggacttgctcgagtttcatttaatgaggacccatcagctatattctggactgactatgttgcaactcggtggtatcgtgcacctgaactatgtggttcttttttctcaaaatatacccccgcaattgacatttggagcattggatgcatatttgcagaaatgctcagtgggaagccattgtttcctggaaaaaatgtagtgcaccaattggatctcataaccgaccttcttggtactcctcctgctgaaaccatttctaggattcggaatgagaaggctagaaggtaccttgctagcatgccgaaaaaacaacctattccattctccaaaaaatttccaaatgcagatccattaggtcttaatttgctggagcgattacttgcatttgatcctaaagatcgtccagcagctgaagaggcactaagagatccttatttccatggtttgtcaaatgtggaccgtgaaccgtcgtccactcaacccatttcaaagctcgagtttgagtttgagaggagaaaattggccaaagatgatgttagagagttgatttatcgagagattttagagtatcatcctcggatgcttgaagaatatcttcgttgtggagaacaaacaagcttcatgtatccaagtggggttgaccggttcaagcgacagtttgcacatcttgaggagcattatggcaaaggtgaacgaagcacaccgttgttgaggcaccacgcctccttacctagagagcgagttcctgctcccaaggatgaaaataatcaaaacaatgatgttgaaaatccaactggagcaaatcttcagagtcctccagggtctgatgtgacagattctggaaatacagatgcacaaaatggaccctccaggccaaagtgcagcgcacggagcctgttgaagagtgccagcattagtggttcaaagagtatagatgtgaaacaaagtaaagtttcagaggaggagccacttagagaggtcaacaatgagattctggatgagttgacacagaaggttgcttccctccattcttag

SEQ ID NO: 113238 - DNA, 675 bp, Glycine max
  Peptide Sequence Number=SeqID_230016
atggcgttaaaggctagaagcatgctttgcaatagacgagtgttgtcaaattcatccgttgcattattgaaagagctatggttggaggttagcaaattacaccatcagggaaagcctgtggttgagtttaatgatggtaatcttccaaatgaatttgataatgatggtactcaacctatcaaagatgaaaatggtcatagaaacattgagacccattatttaccttctacttcacaacaagcacatgatgcacataatcatcaaatgagggaggaatgggctgcaatacacattcaaataacatttcaaggatttctggccagaagagcactacaagctttgaaaggagtggtaaggcttcaggcccttgtaagaggctatgcagtgagaaaacaagccacaagctttggtgagggttcaggctcgtgttccggcaaggcatgttcgcatgtcattggaaactcaagcaacacaacagaaactaagcaaaagcttgcaaacaaattgcctatgcatcccatatgtgttcaaaatgttttcatgaaggaaggatggtgtgatagcataggatccgttgaagaaattcaagctaaaatattgaagagacaggaggcagcagcaaaacgggaaagagctatggcatatgctctagctcatcaggtgaatttacagtag

SEQ ID NO: 113239 - DNA, 1593 bp, Glycine max
  Peptide Sequence Number=SeqID_230017
atgtcatcttctaagctcacactgtacggaatcggaaccgcactcttccgcacccgtagaactgcacccgtaactgtaactccccactctccctttctcttcttcaaacccattcccttcccgccgtgcttcctccgccccgattcctcttcctcctcctccttctccgccgccgccgccgccgccgcagaaaccctaccctccgtcgaccacccctggccggaatgggtctccttcgtcgaccgcttgaacaccaaaggctacctccccaaaacctcctcttccgacgacaccgtaagcctttacgccaacatgaactctctcaaggacgcttgtctcagcttcgcgcgtgaccgttacgaccttttcaaaattaatgatgagaagggcatatgtatatctgaggttatatggtatcagagcctacctagtgattgtttgttggacctatggtgtcacccgttatcggatcacctgcagatgtctagtcttgcaaaattcactttcaagatgtccagtgctcggcatgagaggggtgtgttggagattccatgtcaactagtgatgaggctaaatttgctgcctacaaatgatatccaagcagtggttgagggtgggtgccctaatcttctccgtaaagctgttaattcagctaagaggctgagagcacacctgcaattagatgaaggggatgtttgtggtgcttgctatctacgaagctcttgtgatagagcttatgtgattctgaaggattttgaaactgatgcccgaactgttgatatagttcgaatacttttgttctacgcactagatccacttgtgctttctggaggagacaaaccaccgggccgggaagttattgaatcatctgtcagaaaacttctctctcagctaattgagttgagtgagtcccctgctcctgcccctgctcctgctcgttcaaagcctactgcacaggatggtgtggtagaaggccaatctctaagtgttacgactaatcaattgtttaaagatgttgagatgaagaaaggtgactggatgtgtccaaaatgcaatttcatgaacttttctagaaatacacaatgcctgaattgtaaggaagacaagcctaaggatattaacccgtttactgttcaaatgaagccaggagattggacctgtcctgaatgcaattatttaaattttgccagaaacagactatgtctagaatgcaaaatagaggggccggcgaaggaagctaataccattgaagttgaaaggaaaaaaggagattggacttgcccacaatgtgggttcatgaattatgctaggaacacgaaatgtttgcgttgtcctgagacaaggcctaagaaacatcctggggactggaattgtcccgggtgtgggttcatgaattttgctagtaaaatgaagtgtttgcattgtcaagagccaaacccaagttccaagaaatatagtggggattggagttgccccaaatgcgatttctacaattatgcaagaaatatggcttgcctgaagtgcaatgctgaacgccctaaagaacaaccaaccgttgactatgaggaccatgaatggagacgatcaaactga

SEQ ID NO: 113240 - DNA, 2172 bp, Glycine max
  Peptide Sequence Number=SeqID_230018
atggccgattcaaagattgcggagaaggtgcttgaaacattaacactcagctttgatcacattgtagtagccattgaagaatcaaaagatcttgagagtataactgtggaacacttcaagccagaaccagccacaagtctagaggtcgtggtggctggaaaaaaagaggaagaggaagacataaaggaggcagaagtggcgatcgaaatgcagaaacacatggttcaacttcccaatatcataatcttggaagcaattcaaatgatcagtgtgataattccaattctagaggaggcaactctttcagaagtcgaggtgattggcaacaacaatgcccatagcaaatacaagaagaatgatcaggcacacttggcacaagaggaagatggatctgatttagatcaagttttgcttatggtaaccacgagcagtaaagaagactgcttttcctggtatcttgacactggttgctcaaaccacatgataggcaatagagactggttggttgatttcaatccaaatgccaccattagtgtaagatttcaaataatagcaccatccttgcaaaagcttcttgagaaaggatttaccatgacaatgcaagcaaaccatgttgaaatctttgatgataaacaaagactagtgctcaaagcaccattatccaaaaataagaccttcaagaccaaggcaccacaaagagccaaacaacctcttggaatagtccattcagatgtgtgtggacccttcgatgctccatcccttggtggtaataggtatttcccggcttttgtggatgaatttaccaagaagatttggatatatttgctgaaagagaaaggtgcaatgttttctctttttgtgaaatcttgcacctcagttgaaaggcaatctgaattgaagctaaagatccttaaaacagatggagggggtgaatataactctaaggagttcaaagaattctatgaagctaaaggaattgaacatgaggtaacaactccatatacacctcaacataatggcttggcagaaaggagaaacagaaccctactggatatgggtaggtgtatgcttaaagggaaaagactaccaaactgctactggggagaagttgtcactacaacagcatgtgttttgaacagatgtcccaccaagagacttcaatttgtaacacctaaagaagcttggactgaggacaagcctatggtgaatcatctgaggattttttggtctcttagctacaaacacatcccatatgaaaggagaagaaagctagatgataagagtgaagctcttatcctagttggatatcatccaactggtgcatacaaactttacaaccccttgaagcagcaggtggtgattaacagagatgtcatggtagatgaaactacagcctggaagtgggaaaatgagtctaaaattcccaactcatatattctcgaggacaacccaagaaccaagaatgttaaccctgctggctcaatgcaacctcctgtaagaaggtcacatagaacaagatttccctccacaagacttgcagattatgaactatacagtaatagttcaatctccgatgatggtgaaatggtacattttgcttttatggttgacactgaacctgtacactggaagcaggccctggatatcatagaatggaaggctgctatgaaagaagagttggatgccgtagagaaaaatagaacctgggagctggttgatctgccatataatatacatccaattgatgtgaggtgggtgtttaaagtaaagctcaaaccagatggctcaattgcaaatcacaaagccaagctcattgcaaaaggattccttcataaacaaggaattgattatacaaaagtatatgccccagttgcaagaatggaaacaatcagattagtaattgtcgttaccagttctagaaattggaccatatgtcggcttgatgtcaaatctggttttttgaatggaccactagaagaagaagtatacatcttgcagccaccaggatttgaaataaaagggaaggaacacaaagcatacaaattacttaaatctctttatggcctcaagcaggcccctcaagcttggaacagattgattgacaatttccttaacaaacaaggatttgtgaaatgcacaatagagtttggtgtgtatgtaaaggaaatttag

SEQ ID NO: 113241 - DNA, 321 bp, Glycine max
  Peptide Sequence Number=SeqID_230019
atggtggcaacagatacacctgttgtaatgactgtgtcattcattaaggaacatattgatttgggcatccatgatataatgtaccaagtctccaaacaacttgttgatattgctaagcccatgatggcagcgcgcacacttagcatgccccagcacctatgcattcctggcattgccctgtgggcttgccattcagcccgtcttaaaacacagaccaaggagtctaacatgcatgcgagtcaatgggcgagtaaacccataatgcggaaggaagctgattggtgggatccccttgtgggttgcacgactgatcaaccttga

SEQ ID NO: 113242 - DNA, 1536 bp, Glycine max
  Peptide Sequence Number=SeqID_230020
atgaagattacccagatttctccccctaacaaaatcgcgactctcccaaccccaaatttgcggagcgtgaatgcatgcaatgcgaatcctcagattttaattgagggacaaggttgcgcatcatcggaaggctgcacaagtagcagatcttggtgcttggctatggtgagacacgacgctatgagaagggtaccttccattctcttcagaaccctcacgtcccctcgcgtcgccacctctttctccgtccccaaccgccttctccaggccgcgctctaccgcagcgccgccgcccgctctcaccgccgccgcttctcctcgctcctcggtcctctcgccgccgcgtctctcggcgttgctggggctctggtctctcaggaagtcctcgccaaggagcccccgccgccagaggctctcccgaacgacgtcgttctttaccagttcgaggcttgccctttctgcaacaaagtcaaagcatttttggactactacgatataccttacaaaattgtggaggtcaaccctctcagtaagaaagaaatcaaatggtctgagtatcagaaggtgccaatactgatggtagatggtgaacagctaaatgattcatcagttataattgataagctgggacataagattctgtccaagaaaattgtagattcaacttctgaggacgaagagacaaaatggcggcgtttgaaggagatgaaagctggtgatacaaagaaggtggagaagctggaacaagtggcgaaacatatgtttcaggatctggttgggatgctgaaacttcacatgaatgacaatgataagttttccaaggatgagcacagtctacttcaagagtggagattggtgaaggaagagaaggacaagcattgtcttcttgaaggctatcttgaaaaattttcggtgaagtatgctggagctgcagctatgtattttgtgtctaagaaactgaagaaaaaatataacatcactgatgaacgtgctgctctttatgaggcagcagaaacatgggtagatgctctggatggccgggagttccttggagggtctaagcctaacttagccgacctggctgtttttggggttttaaagcccatacgctatttaaggtctggcaaggatatggtggagcatacacgtattggcgagtggtatgcaagaatggagagtgctggtcaatcatcatcgaagcaccattgtcctgtaattgatggtagcgaaattattgctctgaagtcaagcataagggcattaaacacgaggaccctaatatatgagacacaaaacattcttgaagtcgaagaagagcttgtagtgactgaagattggttaggaagaagtgttgtctttgttgtttccatcggtaagaggcttgctactgatgagagaggccttcaggaagaatccaatggttactacgttggtaacgcgatgattctaatgagctccaccatgtctccctcagtggttgtctcaacgggggaagacgtgtgtaggaatctggcactagagatttgggacatgtga

SEQ ID NO: 113243 - DNA, 534 bp, Glycine max
  Peptide Sequence Number=SeqID_230021
atgaatgcaaggctgggagatttcggattggctcgtatgcatgatcatcagggacaagtggtcagcacaacaagagtaatagggacagtaggatacattgctcctgaagtgattcgatcaggaacggcgtcaactatgtctgatgtgtttggttttggaatattggtgttggaagtagtttgtgggagaagacctattgaagaacataaaccggggctaatcgaatggttgatgtccctaatgatgcaaggccaattgcacaaccctggtatcagaccaactatgaggcaggctgtgaaaattttggaggtggaaattgacagcactgagtctgatgaagaaaacatagagatgagttttcttggaaaaataaaatcagctgctatgtggtctagagctgaatgtgctttaccatacaggggttacccttcttttgatgaagttaagatgttcagttttaattctaggacatctggaagtggctcaagtacctttccaggatcagaatcagaaatcaccagagaaaacagatag

SEQ ID NO: 113244 - DNA, 303 bp, Glycine max
  Peptide Sequence Number=SeqID_230022
atggttcaccaaggattgaactccgacgctctaataccatgtcatgaaacaacattccaaaagcttaagctattaggtgagaagaaggatttattattttggagagcaatggttgggatgaagtatctttctgctccaattatgtgtgtttatgttaaggctcgcacgatgggtgatgctctttacgaggcagcaaaaatatgggtagatactgagtcgcagggagttccttggagaaactcttccgttggagttgctcttagttttagggatacatggagaagaaagatggaatttctataa

SEQ ID NO: 113245 - DNA, 1980 bp, Glycine max
  Peptide Sequence Number=SeqID_230023
atgttccttcttccttctccttcgtcctcctacctaatgaagcaccagagtcacaatgctctctggtttcgaggactcccttatggtagtggcaagctaatacggcacatccggtgtgcgaagagaaccggaaaacagaggtacccatcggagaagaagaggctgaggacaaagcagaaagagctcttatcggattccaaggagaagagcaagtttgagggcacatggaggctcttcaagctcgccgttcctctcgatcaagaccctggcaaagactctctccatgtctccgatgcccttctacaacaaatcgccacagttctcaagttcccggttgcttcgctgttgccaccagaggctttcaccatcgttaggaagtcctttgatgctaggaagaaattaaaagagcccaaatttgtgcatactgtggacatggatgtccaaaagctcatcagtctggagcctcgttgttgggacttcatttctcggctggagcctaaagttggccttgtggaacgtttgcatgatgaaagagattttggtgatctggcgagtatcattcacgacagtaaagaaaataaagttgcattgaaaggggaaaatggacatagcattttctcaacagagttttacaagaaccaggctacgagaaaaccaaacattgcagtagtgggaagtgggccctctggcctatttgctgcccttgttcttgcagagcttggtgcagatgttactctgatagaaagaggtcaaccagtagaaaaaagggggcgtgatattggtgctcttgtagttcgtcgaattttagaattggaaagtacctggagtgatgggaagttggtaaccagaattggacgcaatagtggcagtgtccttgcagttatgagaactctagtgcattttggagctccaaaacagatattgattgatggaaagcctcacttaggaacagataggttggttcctttacttcgcaactttaggcaacatctgcaaaatttgggtgtcaccataaagtttgggacaagagtagatgatttagttataaaagatagacatgttctaggggttatggtatctgagtcagctgataaattacatttaacaagtcagaagatggaatatgatggagttattctggctgttggtcattctgctcgtgatatatatgaagttcttctttctcacaatgtggaattaatacccaaagattttgctgtagggctacgaattgagcatcctcaagaactaataaacagcatacagtatgctgaattggcttccgaggtttgtcatggacgtggtaaaattccagtggcagattacaaagttgccaattatattgacaaggaggatttcaatgacgtatctgattcaggggtgacaaatcgtagttgttactctttctgcatgtgtccaggtgggcaggttgttctcactagtacaagtccatcagaaatatgcatcaatggcatgtcattttctcggcgagcatctaagtgggcaaatgccgcacttgtggttactgtcacaacaaaggatttcgaagctttgaattattatggtcctcttgccggggtcaaatttcagagagagtttgaaaaaagagctgctatgatgggaggaggaaattttacagtgcctgtccagacagttacagattttcttgagaacaagttgtcagactccttaactttccagttaccaggatttatctgcaatgatgctctccttcatggtgtagagactaggactagttccccaatccaaattccacgcaatggtgacacttatgaatgcacttcggtaaaaggactatatccagttggtgaaggagcaggctatgctggagggatcattagcgcagcagtagatggaatgcatgctggttttgctgtggcaaaaaaattcagcttgtttcatggagatgttgagtctgttctgggcaaggctcaaaatgttggagttgtcaagtactag

SEQ ID NO: 113246 - DNA, 840 bp, Glycine max
  Peptide Sequence Number=SeqID_230024
atggggtgcatagcttccaagagtgcagctgttgaagacagcagggaaggtgtggcaagggaattcacttcatccagcaaaagggcggcctcgaagatgaaggcttccgtattgaattcggagaaaaggatcgatggggtttgggggaaagataagattttggatggtgctgatatgaaagtttcattgattgacaagggatccagtggttcgatgcggtcgagtaataataagaacgggaagaagaaaaaggagaaacctgaattggctgttcttgatcatcctggtcttggaagggttccaaagggtttagaaggagagcaagttgcagcagggtggccaacttggttttcttctgttgctggtgaagctgtccaagggtggataccgcggaaggcggatacttttgagaggtttcataaaattggccaaggaacctacagtactgtgtataaggctcgtgatttgactgaccaaaagatcgttgcgttgaagagggtacgctttgataattgtgatgctgagagtgtcaagtttatggcaagggaaatccttgttctgcgtaggcttgaccatccaaatgtaataaagttggaaggcttgataacatcgaagacctctcgcagcttgtaccttgtttttgaatacatggaacatgatcttacaggacttgcatcaagtcctagcattaagttttctgaaccacagtataaaaccattcatgggtcttcacataacaacttgagctttagggataattggtcattgacatggtatcaaagctttctaaacaaagttgttaggaatttgatatttgctgcccatattcttctaaactga

SEQ ID NO: 113247 - DNA, 1255 bp, Glycine max
  Peptide Sequence Number=SeqID_230025
gcaaatggggtctcaaactaagcatgttgatgtagaaataggcaatcgattaaaggatatgattcatgatcttggacaagagtctattcgtcaagcacatgcccttttgtatgatatattggaaagtgattcgaagaagtctttgtatccatggtacaagaagtcattgacattattgtcaatggtgttaagtcttgttaatgtgaaggctagatatgggtggagtgacaaaagcttcactcagttgcttaaggtagtgcaaagtatacttccagaagaaaacacgttgtcaaaaggttactatgaggcgaagaagatactgtgttcgatgggtatagagtataagaaaattcatgcatgccctaatgattacatactgtatagagatgattttgaagaaatacataaatgccccaggtgtggggtatcacggtacaagtcgaaggatgatggcaagtgtagtgatgacacaaaagaccttacttggcatgtagataggagaaagtgtgatggaatgctccgccatccggttgattcttcccaatggaagaaaattaatcatttgtatatagatttcaggaaagaggcaagaaatcttaggcttggacttgctattgatggaatgaatccctttggtagtttaagcactaagcatagttcgtggcctatttttcttgtcatttacaacctgcttccttggttactcaagaaagttatggacgagggggttgatgtgtttgatgggaatcgaaatgagacatttaagtttcctgcaatgaaaaatgtgagtgatagtgtcatcgacatgcttctgaacattcaaggcaagacaaaggatgatttgaatacttgtcaagatctagctgagatgggtatacgtgaccaattacatccaaggcagatggctacaccactgagctcccctcctcttgagtcaacaccttcaccgtttatgttgaagaggattagaaaagccacacaactcagatccttgtctgccagacctgtgggggtggagataccagtggttcatgttgatcttaccactgagaaagctctagcagatgacaaggatgatggcgatgacacagtctatgagaagtacgagcaccctgatcgtgttcgtactattggagtaagtgtgaagatcaaacaatactttggaccaacttcagcaggctcccgcacatctatgttgatcatccctgaagagctggatcgactcaaacaaaatattaaggatgagctaacatag

SEQ ID NO: 113248 - DNA, 264 bp, Glycine max
  Peptide Sequence Number=SeqID_230026
atgactaaagaagaaggacttgtccctattagagatgctcaggctttggattattcaccagagagttttgagactcgcgcgacagcatctgagcttagtgagtatggcggtgatcacgcgcttagcgcaggattcgtgctaagcgcacctttgggtttcctcgtgggtcttgttctcgctaagcttgagttgaccactaagcgagaagacgcgttgggcctatcttgttttcagaaggaagaggaattcaaagaagaagaataa

SEQ ID NO: 113249 - DNA, 1062 bp, Glycine max
  Peptide Sequence Number=SeqID_230027
atggctgtctctggttttgaagggtttgagaaaagattggagcttcatttctttggtgatgatccagccatgttcccacttggtctaaggaagcttgagttcgactcaatagaacaagtccttgaagctgtccaatgcactgtggtttcagcagttggaaactcatactttgatgcctacgtgttatcagaatcaagcctctttgtttacccaacaaagatcatcatcaaaacttgtggcacaacccaacttctgaaatccattcttcccttgatccactacgctgatcaccacttaggcctcaccctctcctcttgccgctacaccagaggaagcttcatcttccccaaagcacaacctttccctcacaccagcttcaaggacgaagtcacctacttgcaagacacaataccttcaagcctctgcttcagaaaagcctccatcatgccctccaaatcctcctctcactcatggcacgttttcactgccaatgacaacacacacacacacacccactctcccatgccttatgatcatgacaatgagttattattcaccatggagatctgcatgaccgagctggaccccatcctggcccgcaagtttttccggcgaccggacgacgagaaatccggagactctgccgggaaggagatgacggagctcaccggaataaacgaaataaacccggacgcacttatatgcgactttgcgttcgacccatgtgggtattcgatgaatggcatggacggggactggtactccaccatccacgtgactccagaggacggtttcagctacgcgagcttcgagtgtgtgggctccgtcgacaacggcaacataggacacgtattgatgaaggtggttcagattttccgtcctgggactatgtccatatcgaccacgtgcaatggcttcagcagcaacgacgtcatgtggacggagatggcaagcgcggtggagcctctcggcttcaaatgtaggagttgggcaatggaccaattccctaacgcgggtaccgttgtgtttcaaacgttcacttctcgccggaaaagtgtttaa

SEQ ID NO: 113250 - DNA, 1068 bp, Glycine max
  Peptide Sequence Number=SeqID_230028
atgggttgtgtccatggcaagtgttgctgtggtgacagttcttcatcagatgatggttctagggattaccgagaacttgacttcattaatggccacaggaagaacgtgctcgctcagcggtcattgaagcatgttcctgttccttcccacaacttcattttggaatacacttttctcactcagcgggggtactaccctgactcacctgataaagaaaaccaagatagtttctgcattactacacaactccaaagtaaccccaatgtccatttctttggtgtctatgatgggcatggccaatttggtagccagtgttccaatttcgttaaggataggttggtagagaagttgtcaaatgaccctgcattgttggaggaccctgctcaggcttacaattctgcattcgtggcaacgaatcaagaattgcgtagtactagtgagattgatgattctatgagtggcaccaccgcgattacggtgcttgttattggtgacactctttatgttgctaatgttggtgattcaagagcggtgctggccgttaaggatggcaatcacattgttgcccaggacttgtcctctgaccagacgccatttcggagagatgaatatcagagagtgaaactttgtggggcaagggtgttgagtgttgatcaagtggaagggctaaaggatccagatatccagcattggggtgatgaagagagttggggtggtgatcctcctagattgtgggttcctaatgggatgtatcctggaactgcatttacaaggagtataggggatagtttggcggagactgttggtgtcattgctattccggaggtgaaagcggttcagcttacacctaatcatcttttctttgttgtggcaagtgatggcatatttgaattcctgacaagccaaactgttgttgatatgaatctatcatccacttctgttgatggaaataatgatgttatctgttataggcagcaagctatatggatcctcatgatgcatgtgcagctattgcagagaagtcgtataaactatggttggaacttgagaacagaacagatgatataa

SEQ ID NO: 113251 - DNA, 666 bp, Glycine max
  Peptide Sequence Number=SeqID_230029
atgccttccttgcttatcaccatagcaaggaaagtccggtcgttcctgttttggccaatgcctatgacacatttgaccggagatgcgagaagagcggcgcaaggattgtctgttacacacctgctctttatgtatggctggtcttgcacctctttcatcatgaaagtagaccatctgtcccctgcaaggtcaccgcatatgcaccgagaaagggaaggcaaattgagagcaactcttgaacttggctatcccatgagaggagcaccgtcagaagaaattatcacacatttcatcgcacgaggtttcagtgaccccaatgcgaggatacttcaaggagtccacaaagcgtggggcacgatgcaaataaaagataaggagcttaggggaagcaacaacgggatcgtcggtggctatcacaagtggctgaaggcttggacacaagagttagattgggtcccgaagctaaagacctcaaatgaggaagaggctgaaacccctgaggagagtgaggaggttcaagccttaaaggtgaaacttgaaagggcacaagcggtcaaggaaaagttcaagacaatgaccatcaaggtctggaaagagtgtgatgagctgagagacatcaatgtggccacaaccgaaacattggaatgggaaacaaagagggcctga

SEQ ID NO: 113252 - DNA, 2163 bp, Glycine max
  Peptide Sequence Number=SeqID_230030
atgtctccttcagtttcttctcaagaaaaaggaagtaggaataagcgaaaattcagagctgatccacctctaggggagccaaataagtttattcctgcacctcaactcgagtgcctcagttatgaattctctgctgagaagtttgaaataaccccaggtcacaggcaagtcgctgcttgtgacctgtgtggtcttagccaagatcattctgatggactgaaacttggccttggattgtatagtcctggaacatctgaggtcgggcctagtcaatctaaggacaaacctgagacagatgaaattaacgatgcagattggagcgatctcacagaagcccagctggaagaacttgtcctgactaacttggacatcattctcaagagtgcaattaaaaaaattgtagcatgtggctacactgaagaagttgccactaaggccattttaagacctggcatctgttatggatgtaaagatactttgtctaatattgttgataatactttagcatttcttagaaatgcccaagagattgatacattacgagagcactattttgaagatctagtgcagcttgagaagtatgtcttggctgaattagtttgtgttcttcaggaggttaggccattcttcagtgttggggatgcaatgtggtgtttgttaatttgtgacatgaatgtgtcacatgcttgtgcaatggactgtaacccattaagtagtttaggtaatgataatactactagtgctggttcttctagccaagcagaaccacaatcaaaagcagaaaccaaatgtcctgaactgagtcttctaagtcccagtaaatcaattcctgcaggttctcattattctcaatcaaagaaaccctttgtgactggaattcctgttgtgaacaacttgaattctcaaattattggtggaacctcagagaaggagggcgccagttgtggatctgagtgcattaataaagcattcagtgctgcaggaacatctcaatctggcctgatggaagaaaagcgtggaacagttagaaaggttcattctggtagcaccatgagagactacgttcttcgacacaagtcatttcacgtagaaaaaaaatttcgtacttatgaattaaaaggatcttcaagaggaggaaaggttaatggcctgagtggtttagtcttggataaaaaacttaaatctgtgtcagaatcttctaccataaacttaaagagtgcatccttacagataagtaaggcaatgggcattgatactactcaagacaatattaatgttaacttctccagtaatgctgggacttctacctccactgcatttagcccggtggattcttctaatgctgtttgtagatcaaccaatacttcatttgcaataaatgcagcacatactatacctttattcagttgtccagcttcattatcagctaccaatacagatctttctctctcattgtcttcaaaaatcaagccttctacggaatctgtctgcagtaataatgaagcacctaatagtagttatatgggaataccgtataataatattaagtccccaaggcagtggataccacaggatggaaaggatgagatgcttttaaaactgtttccaagggttcaggagctgcaaaatcagcttcaagaatggacagagtgggccaatcagaaggttatgcaagctgcttgtcgtctgagtaaggaaaaggctgagcttcagacactaaggcaagagaaagaggaagttgaacgtctaaaaaaagagaagcaatctctagaggaaaataccttgaagaagctttctgagatggaaaatgccctgtgtaaagttagtgggcaggtagagcgagctaatgccgctgtccggaagctcgaagtggagaaggctgcattgaggaaagagatggaggctgctaagatacatgccacagaaaccgctgcaagctgtcaagaggtctcaaggagggaaaagaaggcacaaataaagtttcagtcatgggaaaagcagaaatccttctttaaggaagagctaacgattgaaaaacaaaaattggctcagctgctgcatgaattagaacaagctagagtgcaacaggagcaagttgaggcatttggtctcatggtgtattcttatgatcttatcaaatcggaagttatgacgagtgagtag

SEQ ID NO: 113253 - DNA, 219 bp, Glycine max
  Peptide Sequence Number=SeqID_230031
atggaacttgagtcatcagaaacttgtgaaggaaatggcaagacaaacactatttgtaggagacttttgtctttagaacagcaagaagttgaaggagataaatatcgaaagcgatctattggcacaaaaacacgaagccagagggttgatgctcttcttcatcatatgctgagtgctgaattgtgtcaaaatgagccttccagtacacaaacttcataa

SEQ ID NO: 113254 - DNA, 615 bp, Glycine max
  Peptide Sequence Number=SeqID_230032
atggtgtctgtgggcctcggcaagttctacggcaccagcctcccccgccctcgcatctacaccgatgtcaagttcaacgaccgccgtgtcgacccaccaactcccgtcaacggcccactcatgtcatgggccgcagaggcccactggtccatgggcgacctcagcttcaaacgcctccgcctccagggcaaaatcgaaggcaacgtcgaaaggctctgctcccagcgcgagaagggccaggcccaaagcccaccacccccgccgcgctcccttctccgtgggtccaaaggagcttcctccccttcgctaccaccggctccgttcgtgacgaaacgccgaaggaacatggatctgatccaagaggaagaggaacaagttaaaactccgagaagtggcgttaggaaggtggcttctttggagaacgagggagctgaaatgacgtggttgaagactcggagtagcagattggttaaaggtgtcgaagctgtgaagaagacggtggttgaagcggcagagaattcaaatcgcaaaacgaagaagattacaagtgaagctgctgaggagacggtgttagaacttcacccagattggccaagcgtgtgtccaattagatga

SEQ ID NO: 113255 - DNA, 141 bp, Glycine max
  Peptide Sequence Number=SeqID_230033
atgggcaaagaagaaacgggacctgcaatgaaggctgttctggctcacaatagaggctgggcaccaaggattactaagaaattaaggccgatgcagaataaaaaaaaagactctcaaattggaatatctatagcaagttga

SEQ ID NO: 113256 - DNA, 129 bp, Glycine max
  Peptide Sequence Number=SeqID_230034
atggctgctctccccattatgaagtactgcctttattccccaaccggaagtagtaggctcatcagcccattccaattctgtctcagagtctcacagacacagataaatggtaaaggcacaggactttga

SEQ ID NO: 113257 - DNA, 426 bp, Glycine max
  Peptide Sequence Number=SeqID_230035
atgggttatccttcaagactctatcttgttttgcttttgtccatttgtggtgtggtttcattagcttccccaattgaagatcagaagaaagatagaattactcagctgccagggcagccaaagaatgtgggatttgctcagtattcaggctatgtcactgtgaatgagcaaagtggaagatcactgttttactggttggtggaggcaccagtgaggcgtggaccaaggtcaaggtcactagtgttgtggctcaatggtggccctggatgttcctctattgcttatggtgcatctgaggagattggtccttttcacattaggcctgatggcaagacgagccctggtgcagcggtaaagttgtgccttggtgacttgttggtcatgggttcgaatccggaaacagcctctttgcatatgcaagggtaa

SEQ ID NO: 113258 - DNA, 3417 bp, Glycine max
  Peptide Sequence Number=SeqID_230036
atgaagcttgagtttaatcaaggtgaggctaacaagttttcattgatatggaatgagataattatgtgctttagggaagaagatatcatatctgatcgagaggttgaactattagagctgccaaaaaacccttggaatgtgagggttattcgatggccatgttttcttctatgtaatgagttgttgctggctctaagtcaggccaaagagctagttgatgctcctgataggaggctatggaggaagatctgcaagaatgagtttaggcgatgtgctgtcattgaaacatatgactgcatcaagcacttgctttttcagattatcaaacctgacagtgaagagcattctattgtgatggttctgtttcaagaaattgatcactctctcgagattgggaagttcactaaagtattcaaaaccactacacttcctcagctacacaacaagttgataaaactcattgagttattgaacagagaaaaagtaaattctaagcaattggtgtacacccttcaggccatttatgagattgttgtccgagattttttcaaggagaaaaggaatactgaacagcttagggaggacggtttggctccacaaaatccatcttcttctgatgttctacttttcgagaatgcgactcagttgcccgaggctatcaatgagaacttctacagacagattcggcgcttgcatactattcttacatctagagattcaatgcaaaacatcccagttaatctagaagccagaagaaggatttctttcttcaccaattcactttttatgaacatgccccatgccccccaagttgagaaaatgatggctttcagtgttctaaccccttattacagtgaagaagtagtttacagtaaagaacaactcagagttgggaatgaagatgggatatcaaccctgtactatttgcagactatatatgatgatgagtggaagaattttatggagaggatgaagagggaggggatgaacaatgagagggatatatggactgataaacttagtgatttgaggtcatgggcatcctatagaggccagacactatcaaggactgttagaggaatgatgtactactataaggccctcaagcttttggcatttctggattctgcatcagaaatagagacccaagaaggcgcacgcgaacttgttccactgaatcaagaaaactcaaatggttctaacttggaaaggtcaccttcccctatgactttaagcaaagcaagcagttcagcaagtttgttattcaaagggcatgaatatggcactgctttaatgaaattcacgtatgtgattgcttgccagatatatggagcacagaaggaaagaaaggacccccatgcagatgaaattttgtatctaatgaaaaacaatgaagcccttcgagttgcctatgttgatgaggttcccactggtagagatgcgaaagagtattattctgttctcgttaagtttgaccaacaactggacaaggaagtggaaatttaccgtgtgaagctgccaggtccaataaaactaggagaaggaaagccagagaatcaaaaccatgccatcatcttcactcgcggcgatgctgttcagaccattgacatgaaccaggacaactactttgaggaggcacttaaaatgaggaatctcttggaagaatacagacacaactatggtcttaggaaacctactattttgggagtgagggaaaacatttttaccggttctgtttcctccttagcatggttcatgtcggctcaggaaacaagttttgtcaccttgggacagagggttttggcaaaccctctcaaagttcgaatgcattatggccaccctgatgtgtttgacaggttttggttcataactagaggtggcatcagcaaagcctcaagagtgatcaacataagcgaggacatctttgccggctttaactgcacacttcgtgggggtaatgtcacacatcatgaatacattcaggttggaaaaggaagggatgttggattgaaccaaatatcaatgtttgaagcaaaggttgcaagtggaaatggggagcaagtactaagcagagatgtgtatagattgggtcataggcttgatttttttcgtatgttgtcattcttctacactacagtggggttctttttcaacaccatgatggtggttcttaccgtatattcattcttatggggcagattgttgcttgctcttagtggcattgaagctgctatggaaagtaacagcaacaacaacaaagcacttagtataatcttgaatcagcagttcatggttcaaattggacttttcactgcccttccaatgattgtggagaattcccttgaacaagggttccttcaagccgtttgggatttcttgacaatgcagctccaactttcatcagttttctacacattctcaatgggcacacgcagccacttctttggaagaaccattttgcatggcggagcaaaataccgagccacggggcgcggtttcgttgtagagcacaagagttttgcagaaaactatagactctatgctcgcagccattttgtgaaagcaattgaactgggactaatactaacagtttatgcatcacacagcactgtagcaactgacacatttgtttacatagccatgacattctctagttggttcttggttgcatcatggatcatggcgccgtttgtgttcaacccttctggctttgactggctgaaaactgtgtatgattttgaggacttcatgaactggatttggaaccgccaaagggtgtttgctaaagctgaacagagctgggaaaagtggtggtacgaagagcaagatcatcttaaggtaactggcttttggggaaagcttttggagataattttagaccttaggttcttcatattccaatatggtattgtctatcagctaggcatagctgctagaagcaccagcattgttgtttacttgctatcttgggtttatgtgtttgttgtatttgggatctatgtggtggtagcttatgctcaaaacgaatatgaagcaaaacaccacatctattaccggttggtccaatccatgctcatagtcattgccatacttgtaatagttgcattgctgaaattcactgaattcaaattcatggacattttcactagcttggtggcattcattcctacaggatggggcatgatattgattgctcaagtgttcaggccatgtttgcagtgcaccatagtttggaatgttgttgtttccttggctcgtttatatgatatattatttggggtcattgttatgacccctgtggctctactatcgtggttgccagggtttcagcctatgcaaacaaggattctgttcaatgaagcattcagtaggggacttcgaatattccagattgttacgggaaaaaagtcattgtga

SEQ ID NO: 113259 - DNA, 339 bp, Glycine max
  Peptide Sequence Number=SeqID_230037
atgacatggtgttacatcggtgtgtggatgcaagaaagaccgaacaaatgctattggaggtgcatgagggatcctttggtacgcatgctgtcataccctaatttgatctggggactatcatttgtgatgatcttcttcatcaatggattcctttgcttcttgaaagatgaatggcagcagaatggagaaaggaagagagagaggagacgccacttcaaggagaagatgagtctagaagaagctcaccaccataggaggccatggataagagctaggaggaagaaggagatgaatgagaggagagggagagaagagcacggaattttgtgctctaaatga

SEQ ID NO: 113260 - DNA, 158 bp, Glycine max
  Peptide Sequence Number=SeqID_230038
ggtcacttttgcggcatttttcagcccctgggcccactagaaatcttagggatgaagtaaccagctcacctgagcgagctagattacttcaggaggaagcaagcagcttgcttgggcgagctactgcgcaacctccacccctcatttgctataaataa

SEQ ID NO: 113261 - DNA, 956 bp, Glycine max
  Peptide Sequence Number=SeqID_230039
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatccatgcggcccatcaggtccgtgctgccgcccggtgggtaacccaccacgatggtgatgggcttgctggggtaagccggggcttgcgcaaaggctgcaggcgccagggccaggccagccagtgcaccgaccgcccaatgaaaaacgctgcggcgcatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 113262 - DNA, 243 bp, Glycine max
  Peptide Sequence Number=SeqID_230040
atggggttgaaccaagcacatgcttttaaggaaaggttcatcaagacaaggtcaaaggaggtgcaagaagggatgaaggtcgacatggaggccatgaaagagcaaatggccacaatgatggaggccatgatgagcatgaagaagataatggaggtcaatgcggctgcagttgccactaccagtgccattgctgaggtcagggatgtaacgacccgcctcatcgctatggtatccatactctaa

SEQ ID NO: 113263 - DNA, 438 bp, Glycine max
  Peptide Sequence Number=SeqID_230041
ttctgatctggataatttgttgatgcaattcaagaaaacaattgaatctactcaacgagcatttaaaagtctcgaaattcaagttggtaagctagtaaaagaagtggctaaatttgtggccacaagagaagaaaactttgtagaggttgaagctcatgaggaaagccttgtagaagagcatgattcaagagaaaaaggtgaagaaaaaagtgaggagaaagcacaacaatggaagaagtgctcacaagtagaaattcaacaggaaagtattctccaagtcaatacccctcctcatcaactgattgtcaaggaagaaaggcatggagaacatgagaaatccataagtgtcattctttccttgatcactagcacttctcttgcaatgacatggaaggtgtttccgaaatacatgagtttcatggagtctctagctaagag

SEQ ID NO: 113264 - DNA, 543 bp, Glycine max
  Peptide Sequence Number=SeqID_230042
atgaaaattgcaaaaacacccccaaaactcattccaattgatatctctaaggatccctacacatctgctccgatagaattcctaaacgtcaaagagacagagaagggattgaagcctccacttgtactgtcaccatgcgatttatttttctccctccaaaaatattatctcacaaatcccaatggtaaaagcgtgcgaaatttaatttcgaacaacatatccaaatttcataaaaatccaacggttaaaaagactgggatcgtagttttaccgagacagctctgggtttctgcgggaaaggaaaatgctacaatgcgaggggtatttctcttagctcagaatatcaaaattcccaacggtgggaattctcgtaattgggttgcgaacgttgtgctcaaatttcacgacgatccaacggtgaacgagtttgagatcgtcatttttctgagacaggttaggtggcctacgggaaaaagagagggttttgggaaaagagagaagaaacaacattgtgaggcagaggaggctaaggagtcagtctga

SEQ ID NO: 113265 - DNA, 3003 bp, Glycine max
  Peptide Sequence Number=SeqID_230043
atgtcttccatagtgaaaggcatattcataaggagcacagcggatgtgtgcaagaatagcatggttttgaagaagcagagcgaaattgtagggaggagaagcacaagagtgcagtggcagttgcatcttagatcaaaatcaaacacatggaagagaggtagtaggagatcatatcagcctccaatacgtggccaggccatccttaccccagcaacaccaccaaccaccaaaaagcgggtattcacttttggcaaaggtagaagtgaaggaaacaaggccatgaagtccttgttgggaggaaagggagccaaccttgcagaaatggcaaccattggcttatctgtgcctcctggactcactatatcaacagaagcatgccaagagtatcaacaaaatggaaagaagctaccagatggcttgtgggaggaggtacttgaaggcttgcaatttgtagagaatgaaatgggagccattcttgggaatcctttaaaacctcttctcctctctgtgcgctctggtgctgcggatcacctttggaatttggagtcacgtttagtaagggcatacagaaaaatgtataaacttacttgtttcccttacatttacaagatttccatgcctgggatgatggacacagttctcaacttaggattgaatgatgaagtggttgctgggttggcagcaaaaagtggagagcggtttgcttatgattcttatagacgtttcttagacatgtttggagatgttgttatggacattccacactcgttatttgaggagaagttagaaaagctaaagcatacaaaaggtgttaaacttgacactgatctaacaacttatgatctcaaagatctagttgagcagtacaagaatgtctaccttgaagccagaggagaaaagtttccctcaggtgctgaaagcaatacaccaacttcttcacgttttgtttactttctagtcgtcctagccattgatccatatccaaagaagcagttagaactggctgttaaagctgtttttaattcttgggatagcccaagggctattaagtatcggagcattaatcaaataactgggctaaagggaactgctgtaaacattcagtccatggtgtttggtaacatggggaacacttccggaactggcgtccttttcactagaaatccaagcactggtgaaaacaaactttatggcgaatttctaattaatgctcagggagaggatgtagttgctggaatcaggacacctgaagatttggaggtcatgaaatcttgcatgccagatgcttataaggaacttgaggggaactgtgaaattctagagaaacattacaaggatatgatggatatcgaattcactgtccaagaaaataggttgtggatgttgcaatgtcgaagcggaaaacgtactggtaaaggtgcattcaaaatagctgtagatatggttaatgaggggcttgttgatattcgttctgcaatcaagatggtagagccacagcatcttgatcaacttctccacccacagtttgaggatccatctacttacaaggataaagtgatcgccgttggtttgcctgcatcccctggagccgcagtagggcaggttgtattcactgctgatgatgctgaagaatggcatgcacaaggaaagagtgtcatcttggtgaggaatgagactagtccagaggatgttgggggtatgcatgcagctactggaatcttgacagctagaggtggtatgacatctcatgctgctgttgtagcccgtggatggggaaagtgttgtgtgtctggttgctctgacatccttgtaaatgatgctgagaaggtgtttgtagttggggataaggtgataggagaaggagaatggatctcactgaatggatctacaggtgaggtgatactgggaaagcagccactttctcctccggctctaagtgatgatttggaaattttcatgtcttgggctgatgaaataaggcatctgaaggttatggcgaatgctgacacacctgaagatgcagtaacagctagacaaaatggtgcccaaggaattggactttgcaggacagaacatatgttttttgcttcagacgagaggataaaggctgtgagaatgatgataatggcagttacaccggagcagagaaaagctgcactggacctgttgctaccttatcaaagatcagattttgaggggatctttcgtgcaatggatggtctgccagtaacaatccgattgttagatcctccacttcatgaatttcttccagagggtgaccttgaacacattgtcagggaactaacttctgacacaggaatgaaagaagaagaaatcttctcaaggatagaaaaactatcagaagtgaatcccatgcttggttttcgtggctgcaggttgggaatatcatacccagaactgactgagatgcaggcccgtgcaatctttcaggctgctgtttcagtgagtaaccatggcattacagttcatccagagataatggttccacttatcggtacacctcaggaattaaggcatcaagtgaatttaataaggaatgttgctgataaagtgttgtctgagatgggttcttctttaagctataaggttggaactatgattgaagttccaagggctgcactagttgcagatgagattgcaaaggaagcagagttcttttcgtttggaaccaatgaccttactcaaatgacgtttggatatagtagagatgatgttggcaaatttcttcctatatacctatctggtgggattctgcagcatgatccattcgaggtacttgaccaaaaaggtgtgggtcaactcatcaagatatgcacagaaaagggtcgtgctgctaggccaaacttaaaggtaagtcagattttcagttcaacgtcatctgaaaatgaaaatatagcaatttccattgacaaactgaaactccgaggactcttttgcagggttccaatagctaggcttgcagcagctcaagttgcagtttaa

SEQ ID NO: 113266 - DNA, 629 bp, Glycine max
  Peptide Sequence Number=SeqID_230044
atggtttctctattaaatccagaagcaccggaatatctaccaagccacaaccacaagcttcagcaacagcaacaacaactgcaaccccttgcttgtcccacttccttatttcctcatcacggccacttctcagtgttctctttatttccctcacgacatcctaaccctttcttttattatcccactttaacacttccaccaccaccttccattccattagcgctagaagctcatcaacaaactcgttttcataacataaaaaatgattctgattctaaccccgttgaagcacatgcagtgcaccagaagaaggatcaagtggtactagccgaacccaaaactggtggtggttcgataggacttgtaaagaagcaagctttgaatgcttacattaatggccgccgttctgctgagagttggagacagaagagttacccgccgagaaagaaggtggaagaaaatggtcaacgcaaaaatgttgactttttgaggaaccgaaaggtttttaggcaaccagatgatgaacaacccttcaggggttttcccaagaggaatcgttttaatctctcgttgccagttagggatggcgaaaccactgtaatgatcagaaatattcccagcaaatacac

SEQ ID NO: 113267 - DNA, 1978 bp, Glycine max
  Peptide Sequence Number=SeqID_230045
gttcgttaaccttctcggttccaagctccgccgaagccctaggttgccgtgcggcgctgcgatttggctgccgcgtgttcgatctgtgaaacggtgtcgtgcggtattgttatctgtggctgcccatgctattgggttggttttgatgccgcctgaaccattgccttgggatcgaaaggacttcttcaaggagaggaagcacgagaggtccgagtcgcttgggtctgtcgccagatggagggattcctcgcaccaccgcgacttcaaccgctggggatccgccgagtttcgccgaccgccaggtcatggtaagcagggtggttggcacctgttttccgaggaatctggtcatgggtatgcgatttctcggtccagcagcgacaagatgctggaagatgatagtcggccgtcgttctcgcggggtgatgggaagtatggcaggagcagtagggaaaatagaggagggccctttggtcagagagattggcgagggcattcatgggagcccagcaatggttctattagttttcccaggaggcagcaggatgtgaacaatgaccataggtcaatagatgatgccctagcgtattcccctcatccacattctgatttcgggaacgcttgggatcagcaccacttgaaagaccagcatgataagatgggtggtgtcaatgatttcggagctggcccaagatgtgatagagagaactctctgggtgactggaagccacttaaatggacccgctctggaagtttgtcatctcgaggctcaggttttagccactcaagtagctcaaggagcatgggaggagcagattcccatgaagcgaaggccgagttgctacccaaaagtgtggctgttaatgagtcgcattcaggggaagctgctgcttgtgccacatcttctgtgccatctgaggatacaacttctagaaaaaagcctaggctgggttggggggagggacttgcaaagtatgagaagaagaaagtcgaggtgcctgaagcaagtgcaaacaaagatggtcctgtcttgtctactagcaacacagaaccttgtaatctcctcagtcccagcttagttgataaaagcccaaaagttataggattctcagaatgtgcatctcctgcaactccatcttctgttgcctgcagttcctcacctggtatggatgataaattatttgggaagaccgcaaatgtggacaatgatgttagtaatttgactggttcacctgctcctgtgtctgaaaatcattttgcgaggttttcttttaacttagagaaatttgatatcgactccttgaataatttgggttcttcaattattgagttggtacaatctgatgatccaacttctctggattctggtccaatgaggtccaatgcaattaacaagttactgatatggaaagctgacatttcaaaggtgttggagatgactgaatctgaaatagatttacttgaaaatgaactgaagtcactaaaatctgaatctggggaaacatgcccttgttcatgtccagtagccttgggctcccagatggtaggtggtgatgaaaaatacggtgaagaacatgttggagtctctgatcaggtcatccggccattaccgctgaaagttgttgatgatcccaatacggagaagatgcccctttcaactaacttacatagtattcatgaaaatggcaaggaagaggacattgatagtcctgggacagctacttctaaatttgttgagcctttgcctttaattaaagcagtttcttgtgataccaggggatatgataacttctccagggacttggatgctgttcagtctacagctgtgaaatgcctagttccctgtactactaggaaagaagctagtgtgtctacttttgttgatggcaatacttctatggcgctaaaggatagcatggatattttatataaaacaattatttcttccaataaagaatccgccaacagagctagtgag

SEQ ID NO: 113268 - DNA, 528 bp, Glycine max
  Peptide Sequence Number=SeqID_230046
atggtgctgaaaaccatcgtagccgcggcgtggttcgttgtgtttcttgtgttttatctgaagatatgggagcagagaaatcgtgatgggaagtggtctgttgaagcaaacaagcgattgataacttttcttgaggttgcttttgttttcgtggttccggagcttctggctttggtcctttttgtgcttccttgggttaggaattttattgagaacagtgactggagggtctgttatatggtgtcatggtggtttcagacaaagactttcgtcggtcgtggattgagagaaggtcttgtggacaacattagatatggtgtggggttgttttcacacttgggtgagattcggagtatgcagcagttgaagttgaggtttcagtttttcgctagcgcggttctgtttaatctaatgccagaggagcagttgttgaatgcaaggaaaacattgagtggcaaagttaaggatggtattcataggatgaagctaaggtacgggtttggtcagccatatatgaagctgagttaa

SEQ ID NO: 113269 - DNA, 396 bp, Glycine max
  Peptide Sequence Number=SeqID_230047
atgaaagtagcgaagacaggttttcaaaatcacttctttgagtttccaattcatcatccgcaatctctgtttcttcgccatcttgagaaaccgcaagaggaagtagcgaagacaggttttcgaagcggtggaacatggatatgtcgaaggggcgtagaaacagcgttgggggatagaaagaagaagagttgggatgaatcgtgtcttttgcttaggacaaaacatagagtggatttggaaaaaagatatcaaggcaataccgtatctcaagtagtcgatggtattattcgtatttctgatatcgataaagtaatagcaggtttcgattgctgccaccccgatctgaccgcgcctacggcctggaatcagagttcagacagtagaaaaacaggataa

SEQ ID NO: 113270 - DNA, 177 bp, Glycine max
  Peptide Sequence Number=SeqID_230048
atggcgaaatcccaattatcctgtgagttagagcgcactaatacttttcatttcccagttgtccctcacctcaaaagttgcaacttgcctggtaccctgcgagactcaaaatgcttaattaaggcaacgattttgtatagatcacgtggcttgttctttccaaataccgaaccttga

SEQ ID NO: 113271 - DNA, 870 bp, Glycine max
  Peptide Sequence Number=SeqID_230049
atgattcgggccatacgtgcttgtaagactgcagcagaagaacgagctgttgtaagaaaagaatgtgctgccattcgcgctgcaataaatgaaaatgataatgactatagacatcggaatctggctaagctaatgttcatccacatgcttggttaccccacacattttggtcaaatggaatgcctcaagttgatagcatctcctgaatttccagagaagagaataggttatcttggcctcatgttgcttcttgatgaaagacaagaagttctaatgttggtcaccaattctttgaaacagtatccagtttttagtcaaagaaacatttgttcagcagaaatggcccgtgatcttgcaccagaggttgagagattgctgcaatttcgagatccaaatattcgcaagaaggcagcattatgctctataaggatcataaagaaagttccagacttggcagaaaattttatcaatcctgctacttccttactcagagagaagcatcatggggttttgatcactggggttcagctttgtacagatctgtgtaaaattagcactgaagctcttgaacatattaggaagaaatgcacagatggtttggtcagaactcttaaggatctagccaatagtccatattcaccagagtatgatattgctggtatcacagacccatttctgcacatcagattgctaaaacttttgcgagtgttgggtgaaggcaatgctgatgctagcgacaccatgaatgacatacttgcccagtgctcatgctgcaatgcttgggttatttggcatttctgcatggctccctgcatgaacttgtatgttgaaaaccatttagaatatcttgtccactttcatgtgatttga

SEQ ID NO: 113272 - DNA, 1032 bp, Glycine max
  Peptide Sequence Number=SeqID_230050
atggacttctttactagagacataaatgaggattctatgcttagatgcccattcttgaggaacatcaatgagcctactaacttctcattctcttcacctttggctttaccaatgcctgttcgtggagctaaaggtccaatttttgaagatggtcccaattttgatttggcatttaggcttttccacgggagtgatggtgtagtacccttatctgacagatcttttcggccttcagagaagaaagtacaggcagaacctcccaaatcccaattcaatcctttagctgcaaaggcagctactattagtctgtcatcatttggatttggtggggctttcggttttgatgcattttctgagaagtggaacaaccagaaaagaaaatccaaatcatcaaaaaataatccttcttcgcaggatggttcaaagcatgaggcaggcaatgattggctgcaaaacggtaactgccccatcgccaagtcataccgggcagttagtaatgtccttccacttgttgcaaaggttattcagcctcctccaggcataaaatacaagtgcccacaagcagtagttgcagcgcgggcagctatcgcacgcactgcatttgcaaagaacctccgtcctcagtccctgcctacgaaggtcctcgtgattgggatgctgggcatggcggctaatgttcccttgggtatatggcgagaacatactaagaaattttcgccaacatggtttgctgcagtccatgcagctgttccattcatagcaatgctaaggaagtctgtcttgatgcctaaatcagcaatggcatttactattgcggcatcggtgttagggcaagtaattggttcaagagctgagaggtacaggctgaaggcagttgctgcaagaaaggtgtctataactgaaacctctggtgttggtcctctccagttaccagtggctacaaaaaaagacaagcactgtggtgatgctgtggactggaatgcagtttctcttcagctggcaacaacttcaccaactgatgtattttgctga

SEQ ID NO: 113273 - DNA, 2835 bp, Glycine max
  Peptide Sequence Number=SeqID_230051
atgccggcattaattttggatgaaaaagagaagatgatttccaagtttgtatccagtaatgggctggttgaagatcccttggctattgagaaagaaagggctatgatcaatccttggaccccagaagagagagaagttttcttggagaaatttgctgcctttggaaaagattttcggaaaattgcttcttttcttgaccacaagacagcggctgactgtgttgaattctactacaaaaatcataaatctgattgttttgagaaaattaagaagcaagatggttgtaagcttgggaagtcatattcagcaaaaactgacttgattgcatcaggtaaaaaatggaaccgtgaattgagtgcttcttcgcttgatattttgagtgcagcatcattgatggcagatggcattgcaggtaacaaaaaattgcgtacaggaagctcacttttgggtggatatggtaaagtgaagacatcaaggggtgaggacttcatagagaaatcaagtagttttgacattcttggggatgaaagagaaactgctgctgcagctgatgtattggctggtatatgtggttctctttcatccgaggctatgagttcctgcataacaagttcagttgatcctgtagaaggtaacagggataggaagttcctgaaagtaaaccctttatgcaaaccacccatgacacctgatgttactcaagatgttgatgatgagacttgctcagatgagagctgtggtgaaatggatcctacagattggactgatgatgagaagactgcttttcttcaggctgtatcatcctttgggaaggattttgccaagatagcacggtgtgttgggacaaggtcccaagaacagtgcaaagttttctttagcaagggccggaaatgccttggattagatctcatgcgcccaatacctgagaatgttggatccccggttaatgatgatgcaaatgggggtgagagtgacacagatgatgcatgtgttgttgagacaggctcggtggttggaactgataagtcaggcactaaaacagatgaggacctgcctttgtatggcacaaacacataccatgatgaatcccatcctgtggaagctaggaacctgtcagctgaattaaatgaatcaaaggaaattattgggacagaagtagatcttgaagatgcaaatgtcacttctggtgcttatcaaatcaatattgattctgaactgggctgtgatggtagtgaagttttcttgtgtgtttctaacaagtctggatctgttggtgaacaagcaggtataattatgtcagatagcacagaagttggaaaagataaagcaaataaattgggaggtgcagctacagaattaatttctgctccagattcaagtgaaccatgcgagagtaattctgttgctgaggatagaatggtcgtttccgaggtttcttctggtggtcttggaaatgaattggagaggtatagagtgtctgctaccctatgtgttgatgatagagataataaatatgaagctgattcaggtgttatagttgatttgaaaagctctgtgcatgatttaagcactatggtaaattcttcactctcatctttgggcacttcttgttcaggattgagtttttgttctgaaaataagcatgtgccccttggaaagcctcatgtctctgcattgtctatggacgatcttcttgcaacttcaaactcattgttgcaaaatacagttgctgttgatgttcaatgtgagaaaacagctagccaagatcaaatgtcctctacttgtgatattcagggaggtagagatatgcactgtcagaattccattagcaatgctggccatcagctccctattactgggaatttatcagaccatgttgatgctgttagcattctccagggatatccctttcaagttcctttgaagaaagaaatgaatggcgatatgaattgcagcagttcagcaactgaattgccttttctgccccataagattgaacaggatgatgatcatatcaaaacattccagtcgtcagattcagataaaacatccagaaatggtgatgtgaaactgtttgggaagatactaaccaatccttcaaccacacagaaacctaatgtgggtgctaaagggagtgaagaaaatggcacccatcatcctaagttaagcagcaagtcttctaatctgaaatttactggccatcatagtgctgatggaaatttgaaaattttgaagtttgaccataatgattatgttggccttgaaaatgttcttgaaaatgttcccatgaggagttatggttattgggatgggaaccgaatacagactggtctctcgacattgcctgattctgccatcttgctagcaaagtatcctgctgccttcagtaattatcccacatcttctgccaaattggagcaaccatcattgcagacatattccaagaataatgaacggctcctgaatggtgcacccactttgacgacaactagagacatcaatggcagcaatgctgtgattgattatcagttgtttagaagggatggtccaaaagtgcaaccatttatggtagatgtcaagcactgccaagatgtattctctgagatgcagagaagaaatggattcgaagcaatctcaagtttacagcagcagagcaggggagtgatgggaatgaatggtgttggaagaccggggattcttgtgggaggatcgtgcagtggggtctcagatcctgtggctgcaatcaaaatgcattattccaattctgacaagtatggcggtcagactgggagtattgcaagagaggatgaatcatggggagggaaaggggattga

SEQ ID NO: 113274 - DNA, 1761 bp, Glycine max
  Peptide Sequence Number=SeqID_230052
atggcgtctttaccttcgggtcgcagcaacggtggttccaacggctttgatttgggttccggtgacatcctttattcgtacgacgaggaggactataccaaccacgattcttctaacggcactcacatcgatcccaccaagaagcttctttcgttcactgctgcaaaggaaatttgtaaaggtgttttaggcatcgatgcgatattgatgaggctaatgaaagaggattttgtgttcaagtgtagaaagggtagttttttgctaataaagctcctacccaagggtttggattctcatgcatcaaggatgggaagaacatcaatagttcctgctactgcctatagtccgtctgaagattctttgagccaggatgtgattgcaactgtcgagaagagtatgaaaacacatgctgacaaccttatgcagtttcttgagggacttggtactaggctgtcacagttggaattatattgttacaatctggacaaatcaattggggcaatgcgatctgatttaacttgtgaccacgaggaaacagattcaaaactgaattctcttgataaacaccttcaggaagtacacaggtctgtgctaattttgaaagacaggcaagagctagctgagactcggaaagaattagccatgcttaaacatgctcagaaagaatcatcttcctcaagccattcacagtcaaatgaggagagatcttcaccttcttccatggatcccaaaagaattgataatgtatctgacacacagaaccaagagctagctcttgccttgcctcatcaagttaccccccggcaacagcctgtggcatccttctatcaagtgcctgccccaaatgtgagacaagccactcaacgacctcattattacttgatgcccacccctttgcccaatccacaagctgtgaaccagcttcctcagaatcagtattggccttctgatctactgtatcgaattccacaatcaacatcatcatctcaggcaacccaatccccacccgtgcaacaatttttgcagtatcagcagctacagcaccaacaacagcaatggcttccacagttaccaccacagcaggtgcaagtgccacctccacaaccaccctcagcacagtctcaagtgagacccccctcggcaaatgtttacactccatatgctaccagccaagctacaaatcctctgcccacagaaacactaccaaacagtgtgccgatgcaaatgccttattcaggaattccaccccaaggatctagccatggtggtggtagcagcagcggcgatgccatgccaaatggatacagcggagctggtagaacagttccacagcaacctctgctccagctcatgaggggttctttttcagcacagccagctgatgtgtatggaactagtggggcccagtcccacaccacgcgtcctccggctagttcctacgatgtgtatgatggcgagaatgccagagcacattatccaccccagccttctcattatgctcaagctggatatcctccaactagtgcttcccatcagaaccatgcaccacataatcttatggtcgggagtcctagccagtcacaatttattcgtagccatctctacaatgatttgatcgagaaatttgtgagcatgggatttagaggcgatcatgtagcaaacattatccagaggatggaggaaactcagctgcctatagattttaactctgtacatgaccggttggatgtgcataatccccagaggggatggtcagggtaa

SEQ ID NO: 113275 - DNA, 954 bp, Glycine max
  Peptide Sequence Number=SeqID_230053
atgacgagccgtaagaaatttggaattccttggcctgaatgcaacgacggtctgtcctacgacgacgtcgttcgagcctctgatgccggggcgacactcatagagttttactccaccaagtacaagagttctgctcccttacaaggggagctagggaactggataacagttgatggaggagttgttactgattctaacacagtcctcagagttggatcaaagctaatctatcatagacttccatggaaggagccagatgcaccgcacatgatcgacgtcttatatgaagatgatgacatgacaaaactagccagagctcgtcttgcatctcattttgctgacggaacttctcacgttggaggaaaaaggttaaagatttcattcttagttaacttgtttaactcattgtctgctgttgtttatggaagcagagatacaaagcaggaacttgggaagattgcaaagatgtaccgagctcttgtgagtgggatagttgagaatgacaaggtgactattaatcaaccaattggaatagtaaaatatcctggtgttgctaaagggttatacgttgcttctgaatcagggaaagccacgcttatgtttattgatttcctctcatctgctattgttcttatgtttcctttccttcctaaaacttccctccatgacattcttgatcatccagtcatgcatagtgatccgctttatggtgttggtgggcaacctaaatgcttagattgtgactttgtagatgagagttttgctgaagatgggggttatcagagacctacgaaaccagttcccggagattgtgggtattacttgcatgcacataaattggttctctctcatccgacaactaacgagttaattgaaattattgcaccccttccttctgccctccacacagcagaagaggctaaggaaattgctatcatgcagcagactgcttaa

SEQ ID NO: 113276 - DNA, 393 bp, Glycine max
  Peptide Sequence Number=SeqID_230054
gcgcatctgggagttggcgaggtggaggacgaggtgctcgcgctggttgcgaacgttgtcggtttggaacccgaagaagagggcaagccagtccaggaggtccatacctggctgccatttcggggggcggaggaggtccccgacggagtggagggcggcggcggcggcgcggacctccgggaagcggagggatggatggtcggagagcggggagtggagggggatgatgttgtagggctgaacgtggtggtggtggcgattagtgatcggcatgtgatggggaatgtggatccagaagagcagggaacactgcgctggttccgggaggtgtttgtttactactacaaggtttgtctttgcctggaaagaaaaaaaggcgggttagttagttag

SEQ ID NO: 113277 - DNA, 408 bp, Glycine max
  Peptide Sequence Number=SeqID_230055
atgcatatgcataaggtgcagattccatacttaatagcgctggctgtaacaccccctactcacagcctcgagggaacattgctgctgtggtcacaagctcattctatcatcgtatgtgagcgttctttgatccaaaatgagcgagctttaactgaattttcgtctgccaataaaatatccattaccatgacctttggtatttatgcatgcaaaatcaagcttgttcaggccaagcacccggacaaaggtcgacataatcagaatgtgttttatgacctacttttttttttcttcctttccatgatgaaccgggccaagataatttgggtacttgttccttaccctgcagtttcacaagagcataagggaaatgtggcaacaaaacacaacagtttatgcacaacataa

SEQ ID NO: 113278 - DNA, 1068 bp, Glycine max
  Peptide Sequence Number=SeqID_230056
atggcggcggaatcgggtggtacgccgacaaactttgatcttcccgaggaggtggtgcaagtgctaccgtccgatcccttccagcagctcgatgtggctcgcaagatcacttccattgctctatcgacacgtgtcaacaccctcgaatcagagctgtcctcgcttcgcgcccagatcgccgacaaagacaacctcatcgccgaccttcaatctcagctcgactccctcgacgcttccctctcccaaatcgccgacaaactcctccaaaccgaacaagataaggagagcttgctccaggagaatgcttcgctttccaacaccgtcaaaaagctcaatcgagatgtctccaagttggaggttttcagaaagacgcttatgcaatcacttcaggaggaggatgataactctggagcagctccagacattgttgctaaaatacagagtcaagcaagtttgacttccacgtcgcagattggagataatgatgtttcattgccaccgtctgtatcttcttcaacaggaaattcttttgccaaggatcatgaatctgatgccataagacctagagtatcacagaatctcctcttagcatctcaaggttccacccctcggattactccccctggttcccctcctagtttgtcggcatcagtatcacctacgagaacatctaaacctgtatcaccacagcgacattcaatttcctttgcaaccacaagaggcatgtatgatgacaggtcttcaatgttttcctcaatgtccttaactcatggttcaatatcaagctctgatgcaggaacaggatcacaaactggacgaacacgggtggatgggaaagagttctttcgccaagtcaggaaccgtttgtcttatgagcaatttggtgcattcttggctaatgttaaagaattgaattcccataaacaaacaaaagagtcttggcaggactacaaggttgcagttggtttccttgcagtagggatgggaggtactctagttttaatgttcaatgctgagcataggctacaagtcgtatcgataaaggaaagattacttcataaccattaa

SEQ ID NO: 113279 - DNA, 414 bp, Glycine max
  Peptide Sequence Number=SeqID_230057
atgtataagttgaaggtgttgatagaggcttcaaagatacatcatctgaggcatttcactattaggttcagtagtgggaccacatccatgtttgaccatggttcgcaagtttcagtcgatgacagggaaagaaacaaggattcaagcattggaaaaatgggaaaggaagccagagatgttcttgtcacctgcgtagggattgggtcaaacgctataggcctcttccatgagttcatagctcacagtgatgtaaggcttattagagttgagacaggtggtttagggttggagagtggaagacattcttcaaagttgaccatgggtgaagtcggtatttaccatgggtccatgagttatttactgcaggatgacgatgggcaagttattgaaccacattcaatcatagttggataa

SEQ ID NO: 113280 - DNA, 822 bp, Glycine max
  Peptide Sequence Number=SeqID_230058
atggtatcatcggttccttggacaaagtccttcttcccgttgtggttctggaacaaaacccgcgttctactcacacaccattaccgttaccatcaccgtcattcgccactctctgacacagacatgaccgaagaaggggttgttgtctcgttgcaggaatggcagggttggggcaccacctccccactccccaccatggtttcccaaatcgttgaggatttgaaggttctggaagaagatttggatgcccacatgaattttggaggcaatggtggaaaattacaggggaattttagagtacaagaagataagaagcaccgtgccacgtatcaggctttgggtgattcagaaaagaagctccagttttattcggctagacagattgcttgtcgcatactaggtagcaggggttacctttgtcaaaagtgttggcttcccatggaggattgtatgtgttcaaaagtcacatcctgttcgctctaccctggaatcagattttggctgtatatgcatccaaaggatttcttgagacagaacaacactggaaagattttgtggcaggtgtttggggttgatgcggcgactttgtgcctttttggtattcctgaacatgaggaaatcatgtggaattcccttaaaatggcaggaaaaagtaacgtgtggtgcctttatcccaacaagaatgcagttttaaagtcagttcaaaatgtgtttggtgaggaatcagttgcaagggatgaagttgcaccgtccaagaaaacacgtgttaatggaaaggaaaaagaaattgttgaatatactcctactacactggatcagtag

SEQ ID NO: 113281 - DNA, 214 bp, Glycine max
  Peptide Sequence Number=SeqID_230059
atggcagtggtggtggagcaggtccatattgtgtatatgggtgaaagaatgaaccagagtgagcaacagttagttgaagactcccaccttgacatactatcacgtattctcagaagcaaaggtgctgctaggaggtccatccagtatagctataagcatggcttctctggattcgttgcagttttaagtcagtctcacgctaagctcattgcag

SEQ ID NO: 113282 - DNA, 2847 bp, Glycine max
  Peptide Sequence Number=SeqID_230060
acttagctggaggtttactggatattcctcacatgccaagaactattccaaggattatgacagttcctggagttatttctgacctggatgtttatggtagatatgatggggattctgatgttagctcttctggttatcgggagcggaaaatccttgtggcaaacatgttgccattgcaggccaaaagagatattgaaactggtaaatggtgtttcagtttggatgaggattctattctgttgcaattaaaagatggtttctcttctgacactgaggtgatctatgtgggatccctcaaggttgaaatagatgcccatgagcaggaacaagttgctcagaaattactggaggactttaattgcatacctacctttctaccccatgatgtccagaagaagttttatcatggcttttgcaaacagcagctttggcctctctttcattacatgctacctatgttccctgatcatggtgatcggtttgaccgcttgttgtggcaggcttatgtctctgcaaacaaaatatttgcagacaaggttatggaaataatcaatcctgatgacgattttgtttgggttcaagactatcacttgatggtcttgcctacatttttgaggaagcggtataatcgcgttaagcttggattctttcttcacagtcctttcccttcatctgaaatttaccgaactttgccggtaagggatgaaattctgaggggtttgttgaattctgatttaattggtttccatacatttgattatgctcgccacttcctctcttgttgcaaaagaatgctaggtcttgactatgaatctaaacgaggacatataggacttgattactttggccgtactatatttatcaaaattctgcctgtaggcattcatatgggtaggcttgaatctgtattaaatcttcaatctacatcagctaaattgaaagagattcaggaagagttcaagggtaggaaggtaattcttggtgttgatgacatggacatctttaagggcatcagtctgaagcttctagctgttgagcagctgctgcagcagaatcgtgatttgaagggcaaagttgtcctagtacagattgtgaatcctgctaggagttcaggcaaggatgttcaggaagcaaagaaggaaacatatttaattgcccagaggattaatgatacttatggctcaatcaattatcggcctgtaattctcattgatcgtcctgttcctcgttttgagaagagtgcctattatgctgtagccgaatgttgcattgtcaatgctgtgagggatggtatgaacttagtcccatacaaatatattgtttgtcgacaaggaactgcacagatggataaagctttggctagaaaaagtgattctcctcgtacaagcatgcttgttgtgtctgagttcattggttgttctccttctctaagtggagcaatcagggtcaatccatggaacatagatgctgtcgctgatgctctgtattcagctgttactatgaatgattcagagaagcaattgaggcatgagaaacactacaggtacatcagttctcatgatgtggcatattgggcacgcagctttatgcaggatttggagagagcatgcaaagatcattacaccaaaagatgctggggaatgggtttgggcctagggtttagagttgtttctctttctcctggttttagaaaattgtctgttgatcacattgtttcagcatacaaaagaactggtagaagagccatatttcttgattatgatggtactatcgtaccaaaatcttctataaataagacccccagccctgaagtcatatccatgctaaatgatatgtgcaatgatcctaaaaatactgtgttcattgtgagtggaaggggaagagattctttaagtgattggtttacttcatgcaaaatgattggacttgcagccgaacacggatactttctaaggtggagtaaagattctgaatgggaaaccagtcccttgtctcctgatcttgattggaaaaagattgtggaacctgtcatgcagttgtatacagaggcaactgatggatctaatattgaaactaaggaaagtgctttggtctggcatcatcaagatgcagaccctgattttggctcatgccaagccaaagaattgttaaatcatctggaaagtgtccttgctaatgaacctgcagttgttatcaggggccagcatattgttgaagtcaagccacagggattaaacaagggattggtggctgaaaaggttctttccactatggttaatgatggcaatccaccagattttgtgatgtgtgtgggagatgacatttctgatgaagacatgtttgagagcatactaaggacagtttcatgcccttcattgccagtagttcctgagatctttgcctgcactgtaggtcagaaacctagcaaggccaaatattatcttgatgatcctgctgatgtcttgaagttgcttcaaggccttggtgcttcatctaagccaaagtcaaggcatctagcacaattccaagtttcttttgagagcacgataggattctttgcgttcagtagtgcggtaatgagcttgacaaattcttctcacgtaaatggttacatcaaattgttgtatttgctggtgccacctatagctgtagttgttcctagaactgtagaacatatagttgtttgcattgaacatgaggcaccaaatagcttcatccacaaggttggaacgaggaacaatataggaaagtcttcaatcaagatggcttggacagttggactatgtcttggctattctgaaatccagggaatcatgccgacaattcccaatggatacatgagaaggg

SEQ ID NO: 113283 - DNA, 1950 bp, Glycine max
  Peptide Sequence Number=SeqID_230061
atgacctgtgttaaagaaaaagagtctcaaatttctgttaattttagttttcgtttcgtatcacgcttttcatcttccttcttccctcactttctctccctccaaacagcgtgcaattcttcttctttctctgcgatacatggagatgtcgtcaatggaggattcgcgctcctacgagattctctccacggttctcgacgctttcctccgacgcggacgatctccacgattaccgaacagttctataccgattgccccacgaatatctccttttacgccctcgttttaaggtcctttcttcgctctccatatctattcgtttatttcgctgtttatgctcggaattccaacagtaggatatcgttgactcgtgatttccgtttcattcgtcaatcatattgttcggtgttgaattttgcgtttgagtgtttggttggggaaattttaatggctggaaagttggaattggggcctccgaagtccgatatttccaatccgaaggaacaagcagcgaggaagatactgaaaattgttagatctcaaggacatccgtatgttgagttgcgcgagaacgggaaaaaattcatttatttctgcactttgtgtcttgcgccgtgttacagtgatgatgttctgtttgatcacttgaaaggtaatcttcacagggagagactatctgctgctaaggttactctgcttggaccaaaaccgtggcctttcaacgatggtcttgttttctttgatacttcaactgaaagtgataaagagttggaagttgcagatagttaccgaaacaggttgttgaagtttaacgacgatgacagcagtcttgcgattgtgaagtttggtgaaggggttcagtcaaatgctaaaccatgttcgattgagggtatgcaagatgatgagtgtgcattagtgattcctaatttgctgattggagatgaaatatttgatctaaaagttaaagaagttggcttggggaagattgccgcaagattccttgagaagtgtcatgctttgaatgggattaaaagaatatggtgtgaatggttaggcaaagaaagtaatggtgaacgagatggtgttgaggttctagagcatgattttgcagttgtgatttttgcttataattatgatctgggtcggtctggtttgcttgatgatgtcaagacattgctccctgtttctgctggccaaaagggaaagacttcattgtctgactctgatgatgttagcgattttttatgcaatcagtatgattcatctgcagaagagtcttctgattcaaacaactccagctcacgattgacactagatcaattcaacaatcatctttgcacaaggttcatttcaagcaaggctttgaggaaagaattgagacggaaacagcggctggcagcagagaaagtgtgtaacatctgtcaacaaaaaatgcttcctggtaaagatgtagcagctcttttgaatttgaagactagaagagtagcatgcagcagtcggaatagaactggggcatttcacgtgttccatacatcatgtcttatacactggataatcttgtgtgaatttgagataatcataaatcatttagtccgtccaaatattagacgagtagtgaagagaaaggttgcgtcagatggcgacaaaatgggaaaagaaaaagatataggaaaacatataagaactgtattctgcccagagtgccaaggtactggtatgatcattgatggagatggggtggagcagccagaattttctttgtcgcagatgttcaaattcaaaataaaggcatgtgatgcacgcagagattggatcaagagtcctgaagttttgcagaattgctcaactgggtttcacttcccttcacaatctgaagagatatttgaggaaaaagtggaacccataaatttactgcatttttatcgtgctgatgatcagagtggggcataa

SEQ ID NO: 113284 - DNA, 1404 bp, Glycine max
  Peptide Sequence Number=SeqID_230062
atgatgctaatccgatcaaaatgcaaacttgtgaaaatgtgtggtgtttctgtttgtgggtctctcggaatgtgcatgtactcgacggaaagcgtggtggcgagtctcgaaaatggcgtgtttaagaatggggacccattgagttcagtgagtcccattctaaatcaatgggtggaagaaggcagagaagtcaccaaacttcagctcgaagatctcgcttaccgcctcactcaatctcgtcgcttcacacatgcccttcaggtgttggagtggatgagcaatgaaaggaactatgagttgtctccgggaagcattgctaaacagatcaacctgatatcaaaagtccatggccttgaacaagcagagagatattttagaggcatccctgatgataaaattgagttcaagatctatgctgctcttttgagatgctatgcggaacataaatctgtggaggaagcggaggctggtaaatacgagaaattggataggttgatgcaagaaatgaaagagaaagatatctgcaatgctagtacatacacgattcggttaaatgcatatgtggtcgtcacagacataaaggggatggagaagttacttatgcaaatggaagctgatcccgtggcaactgtggactggtatacatacatgactgcagctaatggttatcggagagttcacaattttgagaaggtcgcggaaatgttaaagaaatctgagcatttagccagaggcaatactaggaggcttgcttttgaatctattcaaactatgtatgctattattgggaataaggatgaggtttatcgactttggaatatgtgcacaagtcttaagaaacccaacaactcaagttacatacgtatgttaagctcattagcgaagctggatgaaatcgatggggctgaaaagattttggaagaatgggaatccaaatatgcaaattttgatgtcagaattccaaatttgatgatcagtgcttattgtaaatggggtcagtttgataaggctgaggcctatatcaggaggcttttggatggtggcaagcaattagatggaagaacatgggaccgattggcatgtggctataaagcaggtaatgatatggagaaagcagttcaggcaatgaagaaagcagtctcgaaaaatctaggaggaaggaggccagacccctttactctggttgcgtgtgttaaatacctgaaagaaaaaggagacttggatttagcccttgagattcttaagttatgcatagagaacagccatatctcagtcacttcctatgatggactgtcaagttatgtgcatagtgaaaccccggatacaggaccccttgatcttatcaaaggagattatcaaatgtttgaaaatgaaaacactcaacttcttgatggggagaactaa

SEQ ID NO: 113285 - DNA, 645 bp, Glycine max
  Peptide Sequence Number=SeqID_230063
atggccttagaccagtattttgatgaggctgtgccccagttggattccttggaagataaatcgtctctcgaaacatggaaatgtggcagtgacgatattgcagattcggatagaaatgcctctggtggctttgattgcaacatatgcctggagtgtgtgcaagatccagtggtcactctttgtggccatctctactgctggccctgtatttacaaatggcttaatttacaaactgcctcttctgaaaatgaagaagagaagcaacaatgtccagtctgcaaatcagaaatctcacagtcgtcccttgttccactatacggccgcggccaaaccgtgttaccatctaaaggcaaaggccaccaagtaggggttgtcataccaagaagaccccttggtcctacacttgattccgcaactgtttccccacctatttctcacgtttatcatcgccattatccgaatcatcctcaacaattcaactcaattcctggcagttacacttcaatgttcaacacaggtggttcactagcaaatgcttttgatacaacatatggagtctttgaaaatttatggacagatcatgttattttctttttgcttgaagcaaggtatcctcatagccagaaacatgagacaaacccttga

SEQ ID NO: 113286 - DNA, 571 bp, Glycine max
  Peptide Sequence Number=SeqID_230064
ggcccttgaaaagtttcagattggtcagatttgggcattttacagtgatgaggatggattgccaaaatattatggtcagattaaaaagattgcgacaagcccggatcttgaattgcatgtttactggcttactagctgctggctaccagagaataccattaattgggatgacaaagatattcttatttcctgtggcagatttgaagttaataaaacagatgatcttctcagtgtttatagtactacctcttgtgtttcacatcaagtgcatgctgatgctgttggtaagaataagaattatgccatctttccgaggaaagttgttgaagaaactgatctgtccataaatgttttagttctggagtttgttagtgggtatacttcagttttcaggggcaaatcaaatgaaggatcatcagtcaatctacgaatacccagagaagagttgcttaagttctcccaccaaatcccagctttcaaactgacagaagagcatggcaatcttaagggcttctgggaacttgatccagatggaactagtgctagtagcaacattttggtattgtgttga

SEQ ID NO: 113287 - DNA, 621 bp, Glycine max
  Peptide Sequence Number=SeqID_230065
atgggtcagagtttatatacagggaaagatctgagcaagttttatcgtattgtgtttggagaagacatagcagcttcagatgctgatgaaaaaagtgcaaggagctgcaattcagggagcctgaatgccaccttagcaaaaggaaaagcaattctttgtttccagtctcggtcacagaggtcagccacagttgctataagaataagaactgtaacggaagttggaggcgctggtctcatatttgctcagtttcctactaaagatgtcgatacctcgtggagtaaaccctgtgtccaagttgactttattacaggaacaactattctgtcatacatggaagcaactaggaatcctgtaattaagtttagcaaaacaaaaacagttgtggggcaacagttatcaccagaagtggcattcttcttttcgcgaggaccaagttctctgtctccttcagtgttgaagcctgatattgctgctcctggggttaatattctggcggcttggtcacccgcttcttctgcccgtttggtatctgatgctgcaaatgaagatgagtcagatttacatccccttaacttcaacattgagtcaggaacttccatatgccatgcccccacataa

SEQ ID NO: 113288 - DNA, 696 bp, Glycine max
  Peptide Sequence Number=SeqID_230066
atggtggagaagatgctagataccttcccagtggccatccatgatgttgattctgacaacaagaatgttgttcttttggcaatagagaacaggcagcctcgtgtctacaagctgctcacaaagaggaatttggtaaaggaaagtgcatttcgtcatatagataatcaaggtaacagtgcattgcaccttgctgccatgtatagggaacataggccttggcgtgtccctggtgctgccatgcaaatgcagtgggaatataagtggtacaagcttgttaagaattccatggcaccaaatttctatgcacgttacaacaagggacaaacagctaaacaggttttcatcatcactcaagaaccactggtgagagagggaaggaaatggctgtccaagacctcagagtcatgctcactagtagcagcacttgttgaaacggttgcattcacaaactcagcagcaataccaggtggtgccaatgaggtaactggtgtgccagtgttgagtgaacaacctgctttcaaagtctttgctgtggcatcacttgtggcactttgctcctcagtgacagcccttgttttgtttctttcaatactcacatcaaggttccaagaaaaggacttacaaaagaagcttctcatgggaatgacttcactctggacatctatagcatcagtgttggtctcattttgtgcatga

SEQ ID NO: 113289 - DNA, 387 bp, Glycine max
  Peptide Sequence Number=SeqID_230067
atgggcaagaacaaaaaagttgaacaacaaaacaaagtaataattgtagaatacaaggtttcaatgtactgcaatgcatgtgaaagaactattgccaaagtcatctccaagtgcaaaggagtggaaaagttcattaccaacatgaacgaacaccaggtggtggtgacgggtcggattgatcccatgaaagtattggaaaaattgaagaagaaaacgggaaagaaagtggagattgtgtctaagatggatgatcatgaagagccagacgacgaatcggataaacttgttataatgcatcagttcgcgcctgaaaatgatagttgcataaacatccaaaccatgatgatgttcagtgatgagaacccaaatgcatgtgcagtaatgtag

SEQ ID NO: 113290 - DNA, 1485 bp, Glycine max
  Peptide Sequence Number=SeqID_230068
atgaggtgttgggtagcagtagcagttgcagtaacagcgttgattattacaggaggaggtagaggttgtgcgcctcatcggattcttgtggatacagatgttgacactgacgatttctttgctcttctctacctcttgaagctcaacacttcacaatttcaattggagttaattttatacaacgtaagcaacatattttggatgagttttaacgaaaaattaaaagaaaaatataagcggaaagcgaaaaagggcatcagcatcagtgcaaatgcttggacgagtgctggtcatgctgttaatcaaatatatgatctactttacatgatgggtcgagatgacgttgccgttggagttggaggcgagggtggaatactacaaaatggtactatactccctaacgtcggtggatatcttccaataatagaacagggaatgacaacagtaggtggttgcagatacaggcgggccattcctgttggtcttggagggcgcttagacatcgatgccaattatggcatcaggaaagctttcctaccacagggaactaggaaatacactccactacagcagccaactgcacaggaagtgttgattgaaaaaatatctgcaggtccaataactctgcttgtgattggagcgcatacaaacattgcaattttcctaatgaataatccacacctaaagaaaaatgtggaacatatttatataatgggcggcggtgtaagatcaagcaacccaacaggttgttgccccaaaaatgcttcatctacctgcgtgccaaggcagtgtggtgaccgtggcaatatgttcacagattataatactaacccttatgcagaatttaatatatttggagacccttttgcagcataccagacttggatgatactacctcaagtgatccattctggaattcctatcacccttgttcctcttgatgcaacaaacacaatccccatcaacgaacaattctttgatgcatttgaaaagagtcaagacacatatgaggcacagtacattttcaaatccttgaaaatggcccgtgatacttggtttgacaacgaattctattcgagttattttatgtgggactctttcgcagctggtatagccgtctcaatcatgagtaagcccaacaaccaaaaaggtgaaaatgaatttgcagaaatggaatatatgaacataactgtaatcacttcaaacaaaccatatggggtatctgatggctccaaccctttctttgatggccgaagagttcctaaattcaatctagaaaaaggtggggtgcatagtggccatgttcaacaaggacttagagatccactttgctttgtgaataatgggaaagggaaatgtcaggatggttacacagcagaggtgagtggtccagactcagtgagggtacttgttgccacaaaagcaaagcctaacaaggatgttgggagctcacttgacagagaatatttcataagcttcttgaat

SEQ ID NO: 113291 - DNA, 1290 bp, Glycine max
  Peptide Sequence Number=SeqID_230069
atgtccactgtgttagaggagcacaaggctgttgataatggagaagccaattggattcagggtttgcaagatcccttcattcaacatgggaaggatgctgctgctgcctgtaaagatgttgaatctaatacaatagtggaaaagggatccatcggaatggttctgtttagcacatttgttgctgtttgtggttctttctcatttggaacttgtttttccgtgtttggttctttagtaacaattggtacaatgcttggggctataacaagtggtcggattatggatttcattggccggaaaggggcaatgagaatgtcaacaggattttgcataacaggatggctagctgttttcttctcgaaggtattcatcttctgcaacaaattcatctttagaaaaatgttggaaaatggaactgaggtttcacttgtgttattctatcaactacaggatccttactcacttgacctgggaagattttgcacaggatatggaattggagttatctcattcgtggtgcctgtatatatagctgaaatagcacccaaaaatcttcgtggtggacttgcaacaacaaagcagcttatgattgttattggagcatcaatctcattcttattaggaagtttcttaagttggagacagatagctctagcagggcttgtgccttgcctttcgttgctgattggtttgcactttatcccagagtctcccagatggctggattatattgaaactcttcaaagccttcctaaaactaagcttatggacctgttccaaagcaaacatgtgcgatcaatagttattggagttggattaatggtatgccaacaatctgttggaattaatggaattgggttttatacagccgagacttttgtagcagctggtctttcttcaggaaaaattggttccatagcatatgctttagttaattatgtaatctttaaactcaaagtccggtttaacctgaaattccatcacctttttggcactgcttgtaatcagatctacgtaggggcgttttcaattggaatgggaccggttccttggataataatctctgaggaaaattcaagcaatgttctaatactagttttcacattgcagatctttcccatacacgtcaagggaactgcaggaagcttggtgattttggtgaattggctaggatcttgggtagtttcatatactttcaactttctaatgagttggagttctcctgcaaagttagtcccagaaaccaaaggaaaaacactggaagaagttcaggcatgcatcaattcatag

SEQ ID NO: 113292 - DNA, 336 bp, Glycine max
  Peptide Sequence Number=SeqID_230070
atgacatatagggacggcaggggtagggatgattattattctcctgagcgatcaagatcttattctaggtctctctctcccagtggtgggaaggactacaggaagtcccctcgtcttagggagaatggtcggagtcctaatgacaagaaggatcagacacccagcagatccgagagtcctaggggcaatgatcgtagtccttcaaggtctcgttcacggtcatacagaatgttgtacattaatcactcatcaggaaattcatgttctgaaatcggacattccacgctgatttgtgagcaggcagagattggaatgtggaatgtggaatgtggttaa

SEQ ID NO: 113293 - DNA, 465 bp, Glycine max
  Peptide Sequence Number=SeqID_230071
atgcaagcgtcggcagatccttgcatgatagcacatctctaccataattgcaccattgaaaatgtccaatctaatgagcgtaatcaccgtatggatagattctatcttaaattaaaacacaatcaaggaaagaattggcacttaaaaaacgataaggatatatctttgttactaattgaggatagtgcagattctgaagatgactatggctttttcactgtgtgtcccagcagcatagctatcagtgatgataatgaggatgatgctgagtcatgtagctgtgacacgactagtactcgtggcctacctaaggatagtgaagatgataaagaatttgctgaattttgtggcaatgaagttgcagcattagaagatgaagcagaaacaaggatcgatgaagttattgtgaatgaatccgaagatagactattttgggagacctgcatggcggtggggtatccatga

SEQ ID NO: 113294 - DNA, 720 bp, Glycine max
  Peptide Sequence Number=SeqID_230072
atgggaaggtatcgaagccggagcaggagctatagcccccggcggcgaagcaggagcccaccggcaccgcgcggacggaaccgctatgtcgacgatcgctacggtgacagcaggtcttacagagaccgccgctcacctcttccttccggcttgcttgttcgcaatcttccccttgatgccaggcctgaggatcttaggatcccatttgagcgctatggtcctgtgaaggatgtttatctacctaaaaattactacactggtgagcctcgcggctttggatttgtgaaatatcgatatggtgaagatgcagctgaggcaaagcaacatcttaatcatactatcattggtggacgtgaaataaggattgttttcgctgaggaaaacaggaaaactcctcaagaaatgcgtgttaacactcgaggaagtggtcgatatggaggtggtagaaggaggaatcatactagatccccacgacgccgatatcgttctattccttgtttatcatacatgttatttttgcagcatattctcggtctccatcaccagctagggatgattcaagtcagcacgatgaaccctaaatgtgcagttgccgtcgctgttgatgcagtttctctccggattcatccttgtcggaaactgactatgtacagccgtgacccaacgtggttccgtgacgccatcacgattgcgttttctccaaaacctgctacactatag

SEQ ID NO: 113295 - DNA, 6270 bp, Glycine max
  Peptide Sequence Number=SeqID_230073
atgaaagccatttcactgctcattcgggctggtggtgttggagtgaatcttcaggctgctgacacagttgatctgcaagctcaagcaagggctcatagaattggtcaaaagagggatgttcttgttcttcggtttgaaacggttcaaactgttgaagaacaagtcagggcttcggctgagcacaaacttggagttgctaatcagagcattactgctggttttttcgacaataatacaagtgctgaagatcgaagagaatacttggaagcactcctgcgtgagtgtaagaaagaagaggctgcacctgttttggatgatgatgctctaaacgatgtcttagcccgcagtgaatcagagttggatatatttgaggctgttgacaaaaaaaggaaggaagatgagctggctacatggaagaaattgatgcttggacaggcagctgatggttccgatattcctcaacttcctgctcgtctggtcactgatgaagacctgaaacagttctatgaagcaatgaagatatctgatgtgcctaaggctgaggtagaatctagtggagtaaagagaaagggtggatatattgggggccttgatactcaacactatggcaggggaaaacgtgctagagaggtacgttcctatgaagagcaatggacagaagaggagtttgagaagatgtgtcaggttgaaactccagattcacccaacaaagtaaaagaagtggcagaaaagagttgtccaacaaatacttccagctctgtggtatctacttctaacttacaacctgtgcctgtgcctccagcggtcccaacattgccagctgtggagagtttgccggtagtggtacagcaagttaaagagataaccccacccgccaaacgtggtcggggaagacctaaaagaataacttcagataagtcaccagctgtagtggtctctccagtaacttctggaactgttgaagtagacacacagttacagaaaggatttgggtctggacatttagcatcgtcaactcctgattctgttgctcattctgctgaagttgtaggtgtgaatgcacctgtgcagcagtctgacacagtagtttctcctaactcacagtctgtcattcctatgcctactattccaccaaattctcaggtagctgctgttcctgtttctgtacctattcaagcaagagggcaagggaggaaaagtcatggtggggaagggattagacgtagagggaagaagcaggtcatgatttcacctgcaatccctgttggttctgttggtcctgatctaaaggttaatgataaattggaagataaattggtcagtccttcaggtcaagctatatcccagagtgaaactgttcccagctttgctgcagagccccatccaccttctgcttctttgagcagtggaaaggatcctttgggtgttggggttgttttgaattctcaagcaccccctcctttgccctctaatacaaccttggttcaaactgcacccacttatccgtccgtacagatgctaagtaaaggacaaaatcagaagtcacaaactggagtttcccgtcgtaggggaaagaaacaggcaacaatattagcaccggttccggatcttttacatcaggatttacatcaaactgctaatttgccgatttcatcaggcagtatatcaggtgaaaaagccactgaattaaagagcttgcaagagagcaatgttcaagaatcaaaatgtgttgtcctggatcaagcatcacagagcgtaggtgatcaggatttaaaatcactgggaggatcagatgattcatccaaacagacagtgatcatgtcttcatgtcaagatagtatgattaaatctccaggacaagatcttgacacggttaaaaatcctgatgctcatgattcttctgtaaaggttgttaaatcttctgaaattacctcatcgaaaattgatgaagtttgcaataactcggggaatgaaactttacttggcacaacagtgcctgttactggggtgatacaggatcaacattcaggtggtaaaactcataatcaaactgttgaaatttcaaaaaccatcccttcagttgttgatactccaattaattccttgactgacaatgaaactacacaaagcatcaacaagtctttagatcctgtgactccaacgattgttcccagtacattaactactgtttatcccacgccaggttctgaatctactcatccaggcttggctgaatccattcccaccaaaaggcaaggtcgtaaaactcaaaatagagcagagccaccacggcgtaagggaaaaaaatcagctgcagtgttacctgttgttcctgatgctgttactggtcaggatcctaagttaagtcatcatgcacaaaattcaccagtagattcattgccggggaaagccactgccaatatcactcaaacccaagcattggagatccttttacccagtggagtagttagtcatgattcaaaacgaaaagagagggcaaccaattctacccaaaataagctacagaaagttgcatcaacaaggattgatggtgcacctatgtccacagataagatttctgtgcatgatgttgcacgggtaatgaaggaagttttctctggaacttgcttaccaaagcctaaagctcatgattctgctgggagtgaagataggaacacacctgttgtacctgtactgactaaagctgcagtggatgtcgcttccaataaccagagtttggaggatagagcgtgttctaatatagcagctactggtgcagcatgccttgcttcaaatgttcctgtgaatgttagcgaaaaacaaccagaaatggcatccaatatggataatttggagggtaaagcaagtttagatatgccaactactggagaacatagcctgacatcagatgttaaagaaaaggctgaacagatgcaacattctgttgaaagctcaaccacgagttgtaaaatagctctagatacaactctcaatgctgtccaaaagatcgatggttcttctgagagacttccaactggctctgctctcaatgatttaaatatagatagttctagccatcagatgtgttcatcttcaggtgctgaacctcttgcagtacttgatcgtaagcttaaaaaccaatccgactctttagagaagtgttcaagatcttctcctcttgatattggtggcacaggatgcccaccaactccattggaaccagacagttttagcaataatcctgtaactagtcaggctgatacctgcactcggagccattcatcctcaaacaaacctcctgataccacagaacacatttctaatgaaaaattggaacccttgcaaccatctttgaaatcttcatctcttgcttgtgttgacggctctgggttattggttcagactgaaaatttgggtgatcaaccacaagtgatcccatcatgttctgcaacagatcttcctccaatggcgatgatagtttctagtatttcagaatatactgaagttaaaaatgaaactgagtctactttaaaaccttctactgaactctcatctgatgaggggattgttgggtataaaattcctgcttctcagttgctggagcccgaggatcggattgcatttgaacataattctcaaatggcattagaaccctccacgaaacagtgtttagaatctgcttctgaaatgaaagttcctgtgagtcctaaagctgttgaagttcagaagcatccagatgcactagaacctgctgatttgcatggtactccattgattgagagttgcccaaaatctctctgtgaagaaaaaagggatgatagggtttccaaatgtgaacagcttcagtcttgtgttgttgaacctataaatattgaccctgtttcccaagaaaatatagtattatccaatcctattaacaatccaaagactgattcttccgaggcttgccatatggaaatggacacatcagacaggtcagtgttgccacaaccttcttctggtttggaagctgtagggaatgagttagtagatatttctggtgttggcagtcttttagagggaagtaaatccgaagctgcagttctgcccccgtcaaccttgatagaagaacaaaataggggatcagctgtaacatgcccagttaggagttcagaacctttggaggagtcaatggagaagggtgtggctaacaactctgcagttcaggaggaagcaaaagttgataaagtagaaactgatgttcaaatggattcttccattagtcagactttgcaagtaaaacatgaaatttttcaagcaaatgtgaatttgccctcccatctgatggcgaaggaagaaaacatagaagtctcatcctcaaggcccctatctatcagttcatctccatcacatgaattgaaggattctgaacttgaactaggtgataaatatatatctccggttggtgattttcagactgaatctaaagataatatgttgaagagcttggatttagtttcatctccttccgttaggaaggaagaagggatcagttctacatctgatattgatggttctgaaggcctttcgatgtctctgaatgttcatcaattaataactgtcccagatgctgtcgagtcttcatcgtcccaagtgaaagaggaaaaaaagattggggtatcttctgacagtaaattagttgtgaggtctgtatctgaaaatgacatggaaggatctggtcttttgccagaaaaccctgtgctggaaatcaataaaatgtcatcagattcctcaacgattgttagccactctgtggagggtcaagtgtcatttgtgaaagaagataattcagaaattaaaattggtgatcaaatggatgcttctcatgtctctgagaatgatttagaaaggattacttctaaatgcatggatgtaccttcttgcttgcagatggagggagataaggttgatatgttgtctgacaagggccctctttgcagttcccttgcttctagtgaaccaagagatcctttgattgagaatagtagagatggcatcgaggattctgttgcaaatccattaccacaacagaaatcaaaatgttctgaatctgggaaggttgatgagatgaaaacatctgatgttgtcagggttgatccaggactgaagtccaaaatcgcagattttccttcttccttagtgatggagcaagataaagctgctgcatcatatgatagcccactggctgctgcagaaccaaaatattgtttgaccggagagaattgtgaaaatgctaatgaggaaccaaatccttcagaagctgagatcggtaatgaaatgaatgcatctgatgtagctggggttaatacacagctttcatcaagtagcattattgtgccatcatcttccttgatgactgaggatgataatattgtggtgtcatctgacaatggtccacaatgcagtatgcaagtactcaaggaatcgaaagattgtcagactgaagaggggagctgtaaagatgccactgagggtccctctacaaatccagtactgctgcaggaattaattattaattctgaagctgagacatgtaatgaaggcaagacacagattggtgggctatctgtggaagatgtcacagcatcagagggaaaaagagaggtggagacattgcctgatgagggtccacaaggaatattggaagcccaggatggatcaagaggactagctgacattgaggatgggacagatagtaaaagctgtgctgctgagatggaaaatgtatctgaagtcccaaagccctcagtatcagctgagaagggggaagacttgtctaagaaaggtataattggcagccaagcaaaaaggcaggtatcagaagaatctgaagctgttacgggaggtggaattgatgttactccagattgtttggctgtgccagaaacggcaactaatgatggggcttcatctttgtgctcttcagcagaagggagtgaacatgtggacagcttgtctgagaaggatttagttggcaaccctgtagcagaacttgacactaaagtatctgaagctggtgtttctgaccaggaaaatcaagtagtgcaagaaaatgcattggaagatatggaacatgaggagaacttgtccgagacgggtttagttggcaacgccgtagcaaaacttagcaccaataaatctgaagctggtgttagtaaccaggaaaaacaagaaaatgcattgaaagacattgaaaagtcccctccttctgcagcagagggctgttcttag

SEQ ID NO: 113296 - DNA, 326 bp, Glycine max
  Peptide Sequence Number=SeqID_230074
tcatgcttttggaaagcaatcaggtggtgatacatttgtgatagagggattcacaaattggaataagaaagaaagactttcatctcatgttggaggtcctaatagtgctcataacattgcttggaggaagcgtttgacaacgtcaattaattgtatccgttttctattaaagcaaggattagctttccgtggtcatgatgaatcaaccaattctgctaaccaagcacgtgacatatcaaacaaggagcaaatgactattgctttgcgttatgctaacaaaaagggaagtattgttgagcgtttttttggtatggttcatgctaaag

SEQ ID NO: 113297 - DNA, 2577 bp, Glycine max
  Peptide Sequence Number=SeqID_230075
atgcatgcgcttgcgccggtgcatcccatgttcgttttggagcaaccctacatgctttggttgctgtttcatgacattcttgagaaggatctggtttcttggaattcaatgttgtttgcatttggactgcacgggagggctaatgaggctatatgcttgtactgggaaatggtggcgtctggtgtgaaacctgatgaagtaaccttcacagggctgttaatgacttgcaaccacttggggcttataaatgagggctttgcgttctttcaatcaatgagtttggaatttggagtttcccatggaatggaccatgtggcatgcatggtggatatgcttggtcgcggtggatacgtggcagaagcaacaagtttagctgagaagtattcaaagacaagcataactaggagcaattcatgcgaggttctactaggagcatgttatgcacatggagatttaggaaccgggctaaagaacttggagcctgaaaaggaggctgcttatgtattgttgtgcaagtgggaagtggagggaagcagagatggtccggaagggattggtggatcaaggggtgaagaagaaagtgcctgggtgaatctgaaatcgacttctgtataccgattgggggactggtgggatgttggattaaatgtagcttcacttggccatagcatccactataatattttcccatctggatctttgatggactgcaataaagaagaggccttaagggccaaggacattgctgaaaagaagatggaaaacagggattttgttggggctcgcaaaattgctctaaaggctcagcagctgtaccctgatctggaaaatatagctcaaatgcttgttgtttgtgatgtgcactgctctgctgagcagaaattgtatggtaatgagatggattggtatgaaattcttcaggtcgaacagacagctggtgatgcaataattaagaagcaatataggaagtttgctctccaacttcatcctgacaaaaacaactttgctggtgcagaagctgcatttaagttgattggggaagctcaaagagtgcttttggacagagaaaaacgttctctctttgacatgaagcttagagttccaatgaacaaacctgctatgtcacgttttgattctacagtgaggaacaatgtaagatcccactctacaagctcaaatgctcggcagcaacagcagcaatctaggcagccagcacagcagcagcagcaaaatgtgaatgtacaaagtacatcatcaccagcatctaattcaactcagcaagcttctgaccagcagaaagatggtttgaatcatggtactttcaagatgggtgctggatctcatggcaattcacaggctgagaagtccaatatggggccttatgataaaaaaagacctagtaatgtctctggaaaaccatatggaaagaggaagaggaagcaggtggctgaatccagtgaaggttctgattctatgagaaccaatgattctgaagaagatatagttgccggcaaggatggtaattctggagtagaaaaccattcaacttcaagagaagggcttccacgcagatctacacggcaaaagcatcaagtttcctacaaggagaatgtgaaaaacagtgataatggcttcttgaaaccacgtggtgatggtgaaagtcatggtgagacaactaaaataaatgatcagaatggtttagctcctgaacttaaagaagtaaaacagaaacaacacttgtattctgaaagaaatgaggaaactaagacagataagggaaaagatgcagtgggagggtcaacacagatggatggaacttcagagcattccccagattcaacctccaaagcagaaaatcatccaaatgtttatgtctatcctgatgcagagttcagtgattttgacaagggcaagaataaagaatgttttactgctgggcagatatgggctatttatgatacatcagaaggcatgcctagattctacgctttaatcagaaaagttctgtctcctggattcaggctgcagataatatggtttgaaccacatccagattgcaaggatgaaatcaactgggtaaatgaggaaatgcctgttgcttgtgggaaatataaacttagtgacattgacatcactgaagatcatctaatgttctctcatcccgttttgtgtgaaaaaattagccgtaatacttttaaagtgtatcctagaaaaggagaaacttgggccctttttaaaaattgggatattaaatggtacatggatgtgaaatctcatcagctgtatgaatatgagattgttgaaatcttgacagattatgttgaaggtgagggtgtatatgttgcatacatggctaaggttccgtctttcaaaatgactggtcaggaaggagtgggtgtaccagcaggatcttatgaacttgatcctggagctctgtcagtgaatcttgaagagattgctgttcctgaaacttcagatgtgaaggttggtcatagttcatctggccttgtgaatacaagtccttcagatagatcagaactccttatgacatctgagggagatgcatctattcccaag

SEQ ID NO: 113298 - DNA, 2001 bp, Glycine max
  Peptide Sequence Number=SeqID_230076
atggtcattggagcttgtttggatacaaagctaaaagtccttttcggagcttttgagagcttctctaccggaaaatataattggagtttcacctcgatgatgattcacataaataagtgtttacatggaaggtcaacagaggttctggagttagaattgaagtttcatctcaataattcgtgtaaaaaagttttctcagctgtgtctggattggagctttcaatgtccaaggagaagcacacatatgttgaagttccagctgcatgcatcatattaataggcttgtttgcccttcaacattatgggacacacagagttggcttcttgtttgctcctgtaattatcacatggcttttctgccttagtaccattggaatatacaatatattttactggaatcttcatgtatacaaagcactctctccatattatgctttccaacttttaaggaaaactcagaaaggaggttggatggcccttggtggaattttgctgtgcattacaggatcagaagccatgtttgctgatcttgggcactttacacaattatcaatcaagattgcttttacttctgtggtttatccatctttaattcttgcatatatggggcaagctgcttatctatctaaacatcataacattgcacaagattatcactttgggttttatgaatctgtaccagagaaattgagatggcctgttctcgttatagccatacttgctgcagttgtgggaagtcaagccattatcactggaacattctcaatcatcaagcaatgctcgtcattaagttgcttcccaagagttaaagtgattcacacatcatccaaaattcacggacaaatatatatccccgagatcaattggctattgatgatgttgtgtttggccgtaactatttgtttcagagacacaaagcgcctgggtcatgccgcaggtttggcagttatcacggtgatgctggtgaccacttgtttgatgtcaatggttattgtactatgttggcaccagaatgttctccttgcacttgggtttgttttcatatttggctccattgaggctctcttcttctctgcttctcttatcaagttcctgcaaggagcatgggtgcctatagcattggcacttgtgcttctgactgtcatgtatgcatggcactatggcacactcaaaaagtatgaatatgatgttcaaaacaaggtttccatcaactggctactcgaccaaggtcccagcttaggtattgtccgagtgcatggggttgggcttttacacaccgagctagtgtctggaatccctgtaattttcttccagtttgtagccaacctcccagccttccatcaggtcctagttttcctatgcatcaaacatgtgccggttccacatgttaaagctaaggaacggtttctagttggtcgtattggtccaaaagagttcagaatctaccggtgcatagtgcgatacggataccatgacgttcacagagatgattttgagtttgagaatgatcttatatgcagcatagctgagttcatacgcacagaaagaaccgaatcgaactctccaaatgatgagcccctaaaggatgacagaatggcagttgtagggacatgttctacacattcccttttgatgagtgaggataaagtagataatgttgagaatgtagacttgccagggccatcagaactaaaggagataaagtcacttaaggtgacccaacaacagaagaaaagagtaaggtttttggtaccagagagtccaaagattgacacaagagtaatggaagagttggaggagttgatggaagccagggaggctggggtagcttacattataggacagacacacatgagagcaaaaccagggtctagcatgttgaagaaaataggcattaatttagtgtatgaattcctaagaagaaatagcagggcaccctcctttgtcactggtgtgcctcatgcgtcatctctagaagttgggatgatgtaccaagtttaa

SEQ ID NO: 113299 - DNA, 1791 bp, Glycine max
  Peptide Sequence Number=SeqID_230077
atggtgttcatcgtgtcacccaatcacaaaaccttctccatagacataaaccctaacaccaccaccctccatctcctcaaactcgctatccaacacatcctaacccttccaatctcccaccagcgcctcttcctctcccacagtcgccgattatccgccgacaatgacggttccgacgattcccttctcatctccgatctcggcgtcggaccctactcaaccctaaccctccacgttcccttcctcggcggcaccaacccccctgcggtccccaaaccccgcttcgacttcctcaactccaagccgcctccgaattatgtcgccggtctcggccgtggagccaccggattcaccacacggtccgatatcggtcccgcccgcgccgctcccgacctccctgaccgctccgccaccaccattggcggaacctccggcgccggacgtggccgcgggaagcccggggaggacgaggacgacgacgatggggaagacaaaggctacgacgagaatcagaagtttgatgaattcgaagggaacgatgttgggttattcgcttcagcggaatatgatgaagatgacaaagaagcagatgcggtttgggaagcagtcgataagagaatggattctaggaggaaggataggagggaagcgaggttgaagcaggagattgagaaataccgtgcttcgaaccctaaaatcactgagcaattcgctgatttgaagagaagattgtatactctttcccctgatgattggcagagtcttgagaagttcgagagtggggggtattcgtcgaggaacaagaagaagaggtttgagagttttgtgcctgtgcctgatactcttttggagaaggcaaggcaggaacaagagcacgtgacagcgttggatcctaagagtagggctgctaatgggactgagactccttgggcacagaccccggttactgatttgactgctgttggtgagggtagagggactgtgttgtctttgaagttggataggttgtcggattcggtttctgggatgactaatgtggatcctaaagggtacttgactgtgcttaatagtatgaagattaccagtgatgctgagatttcggatttcaagaaggctaggttgcttctcaagagtgtcacgcagacgaatccaaagcaccctccgggttggattgcggctgcgaggctggaggagttggcggggaagcttcaagcggcaaggcagttgatacagaaagggtgtgaggagtgtcccaagaatgaggatgtgtggctggaggcttgtaggctggcgaatccggatgaggcaaaggcagtgattgcacggggtgttaagtccattcctaattcggtgaagctgtggatgcaggcttcaaagttggagaatgatgatgcaaataagagcagggttttgaggaaggggttggagcacattcctgattctgttaggctgtggaaggctgttgtggagcttgctaatgaggaggatgctaggcttttgcttcacagggctgtggagtgttgtcctttgcatgttgaactgtggcttgcacttgcgcggttggagacttatgacaatgctaaaaaggttcttaatagggcgagggagaggctgtccaaggagccggctatatggataactgctgccaagttggaggaagctaatgggaatacttccatggttggcaagatcattgagaggggtataagggctttgcagagagaaggtgtggtgattgatagggaagcttggatgaaggaagcagaggcaggcgagcgtgctgggtccatt

SEQ ID NO: 113300 - DNA, 777 bp, Glycine max
  Peptide Sequence Number=SeqID_230078
atgcagtgccagcgcttctccgccgtgctttttctaagcttatgctttagaattgcgcaagtatacgcgcacggggattctgatctggacgaacattggtacaccggaaccgccacgtggtacggcgaccccgaaggcaacggtagcaacggaggggcatgtgggtatggtacgttggtggacgtgaagcctttgaagggaagggtggcagcagtggggccagtgctgtttaagaagggtgaaggttgtggtgcttgctataaggtcaagtgtttggaccgtagcatttgttccaaacgggcagtgacggttataataaccgatgagtgcccgggctgtcggactgaccgaacgcacttcgacctcagtggctctgcctttggccgcatggcgctttcgggtgaaaacgttaagctcagaaaccgaggtgaaatcccaatcctttatcgaagagcatcatgcaagtatggtggcaaaaacattgtcttccatgtcaatgaaggttccacacctttttggctatctcttcaggtggagtttcaaaatggagatggggtgattggctccatgcatatacaacaggcagggtcgagtgagtggctgcagatgaagcgtgaatggggtgcaaattggtgcatcattaaggggccattaaaaggacctttctctgttaagctaagcacatccacagggaaaagcctcattgccaaagatgttattccaagcaattgggctccaaaagccagttatacttctcgcttaaatttcctgtcttaa

SEQ ID NO: 113301 - DNA, 987 bp, Glycine max
  Peptide Sequence Number=SeqID_230079
atggcgtcgttcgactcgttcgaggaacaatcacatcaatcgccgacaaggggacccttcgaggatgacaacagctacacggacatgggcatgggctacgagtctcatcagcattatgattacgatgaccaacatcctcaattcaacaacgtggatccaaacaacaacaacttcagcgataacgcacattctcctcctgtttatggcttcggcatttccacccccaaccccgacttcgtttcccccttcgaaccagctgccgctgatgacacgaccttctcctccgacggtccaatgctccccgacccatctcaaatgcaagaggaaggccgtgctagacgtgaatggcgacgtctaaatgccattcatcttgaggaaaaagagacaagagagaaagagatgcggaatcagattataaaggaagctgaagagtataaggaagctttctatgagaaaagaaaggtcaactgtgagaaaaacaaagagaacaatagggaaagagaaaagatacacttggccaaccaagagaaatttcacaaagaagctcacaaccattactggaaagcaatagctgagataattcctcgcgaggttcctaatatcgagaagagaagagggaagaaagaaggtgagaataagccttctgttcatgttattcaaggtccaaagccgggaaaacccactgatcttgcaagaatgcgccaaatgattttgaagcttaaacagaaccccccttctcatatgatgcctcccccacccaaagaagagaaagatgcaaaagaaggcaaagatggcaaagataacaaaaatgcaaaggaagggaaggatgataaagatgtgaaaagctcaacaccaactgcaacaacaggtgttgtagaaaataaaccttcttcccctgcaaaagatgttgctgctaatggtgaaccacaagatcctgctattgttgagggtgagcaagtagctagttctgaaccaaaagctgcttag

SEQ ID NO: 113302 - DNA, 789 bp, Glycine max
  Peptide Sequence Number=SeqID_230080
cccgagattcttcttcacttggtacatcatcatcatcaacaacaacaacagcatcagcagcaacttcttcagtattggagtggcgcgttgaatctaagtccaagaggaatgttaacaaggttggggccagatggaaggccattgtttagtcctccaacacagcgcataaacacaacaaaactctataggggagtgaggcaacgccattggggcaaatgggtcgctgaaatccgtcttccacgaaacagaacgcgtctctggctaggcacatttgacacggccgaagacgccgccatggcctacgaccgcgaagccttcaagcaacgaggagagaatgcaaggctcaatttccccgaattgttcttcaacaaggacaaaaaagaacaaggagaagaagaagcttcttcgccggttctttcggctattgcaaagcagaatgaacctcctcctgcccaccaccgtgacgtcacgatagaagagtctaacgaaaatgactcaggtgacgccaccgtgagcgacgaggttcatgctcctgctgctacagcgagttccgaaggggtttctcaggaactggtttggggagaaatgtctgcatggttcaatgctattcctgctgcttggggtcctggtagtcccatgtgggatgatttggatgccaccaataatcttctttgccaatcacacattcctttttccaatcccaatcaacaacagttcaatgatgctgatgatgctcagagacaggaacaaaacacaggaccaggttacctatggaaggatcaggattga

SEQ ID NO: 113303 - DNA, 1587 bp, Glycine max
  misc_feature (1186)..(1186): n is a, c, g, or t
  Peptide Sequence Number=SeqID_230081
atggggttccaacaagggaatgcggaagtggggttgtctggaatcacttttggaacaaagaacaagtacaagaggatgaactccgagcttccagaaggttgcgatgatgttttgcatcaagaagcaaggaggaacagtacctggaagtatgtcatagcatgcgccttctatgcttctctcaacaatctccttctcggctatgatgtgggtgtgatgagtggagcagttatatttatcaaagaggatctgaagatatctgaggtgaaggaagagtttttggttgctatattgagtattatttctctgctgggaagtctaggtggtggaagaacttcggatattattggtagaaaatggacaatggccatagctgcagtgattttccaaattggctctctcataatgactcttgctccttcattttcaatactaatggttggaagacttttagccggtgttgcaataggatttggaggctcgattggccctatatatattgcagagatatcaccaaacaacaccagaggctttctcactacctttccagagattttcattaatataggaattcttcttggttatgtgtcaaactattcattttcaggcttttcaccacacataaactggaggataatgcttgctgtggggattttgccctcagtcttcattggatttgctcttttcatcattcctgagtcaccaaggtggttggtaatgcagaaccgaatcgaagaagcaagatcagtgcttttgaaaacaaatgaaagtgatagggaagtggaggagaggctagctgaaatacaacaggctgctggtgtggccaattgtgaaaattatgaggagaaacctgtgtggtatgaacttttgtttccttcgccttcgcttcgtcgaatgatgatcacaggaatagggattcagtgttttcaacagatttctggaattgatgcaactctgtattatagtcctgaaattttcaaagcagctgggattgaggataatgcaaaactcctagctgctactgttgctgttggtgtgacaaagaccctctttatattggtagcaatctttcttattgacaaaaaaggtagaaggccactgctattggtaagcacaattgggatgacaatttgtttgtttagcataggtgttagtctttctttgtttccacaagggtcatttgtgatgncattggcaattctatttgtttgtgggaatgtggctttcttttctgttggattaggccctgtgtgttgggttttgacatctgaaatcttccctctaagggtgcgtgctcaagcatcttcacttggagctgtggggaatagggtgtgtagtggccttgtggacatgtctttcctttcggtttcgcgagcaattacagtggctggagcattctttgtgtttgctgctatctcttctcttgccattgtctttgtctacatgctagttcctgagaccaaagggaagtcattggagcagatagagatcatgtttaagaatgaacatgagagggaaggaagtgaaatggagttaggagatgttgaagttgaacaacttgtgcaggacaaaacagttttgacaaattaa

SEQ ID NO: 113304 - DNA, 1265 bp, Glycine max
  Peptide Sequence Number=SeqID_230082
aagaagataggaagaggacatgggttgctgatgcggaggaatgtaagaaaagaggttctattgagactgccagagctatatatgctcatgccttgactgtcttcttaactaagaagagcatatggatcaaagcagcacagctggaaaagagtcatggtaccagagaatctcttgatgcattacttcgtaaagcagttacctacagaccacaggctgaagttctttggcttatgggtgccaaagagaagtggcttgctggagatgtgcccgcagctcgagctatcctccaagaagcttatgctgccattcccaattccgaggaaatatggcttgctgctttcaagctagaatttgaaaaccatgaacctgagagagctaggatgctgttggctaaagccagagagagaggaggtacagaaagagtctggatgaaatcagcaattgtggagagagaactggggaacattgaagaggagaggagattgttagatgaaggtctgaagcaattcccttcattctttaaattgtggttgatgcttggccagcttgaggaacagcttgctgagaatgaaaagcggcttgatcgcatgaatgcagctaagaaggtctatgaagctggattgagaaactgtcctaattgtgtaccactttggctctctcttgctaatcttgaagaggagatgaatggactgagtaaagaacgtgcagttctcacaatggctcgcaagaagaatcctcaaaaccctgaactctggcttgctgctgttagagcggaattgaagcatggatataagaaagaagctgatattttgatggcaaaagcattgcaggagtgtcctaacagtggtattctgtgggcagcatcgattgagatggttcctcgcccccaacgtaaaaccaagagcgcggatgccatcaagaaatgtgaccatgatccccatgttattgctgctgtggccaaattattctggcatgataggaaggtggacaaagccaggacttggttgagtagggctgtgacactagctcctgatattggggatttttgggcattgctatacaaatttgaactgcagcatggaactgaggagaaccagaaggatgtactgaagagatgtattgctgctgaaccaaaacatggagagaaatggcaagcaatctcaaaggctgttgagaattctcatcaaccaaccgaatccatcttgaagaaagtagtggttgcacttgggaaagaagagaatgcggctgagaataataaacattga

SEQ ID NO: 113305 - DNA, 240 bp, Glycine max
  Peptide Sequence Number=SeqID_230083
gatggtgatcttgatttgaatgcttcccctcaagcacttgacaaattgttgggtcatgtgcttgcttttaaggcatgttccaaaatagatccttccaatgttgattgcgatgatgctacgcatgctgaatgtcaatctctatctgtcacagcttaccatgatccggttgtggggttgcctttaacacccaaaaagcggatgtcatctgatgaagccgatgatgagttagggagctcttaa

SEQ ID NO: 113306 - DNA, 267 bp, Glycine max
  Peptide Sequence Number=SeqID_230084
atggcccgcatgaaaaaatctagtcaaatgacatctaaggtaggaaaagaaattgtagataagattgattccttggaagagcaggcctcacagggaagctttgtcgcccatggacgtcaagatgtactaactactaccattgggcaaccagaacaccctagtcgtgtcaatgctgctggagttggtgtcacgatcaaacaatactttggaccgacttcaaggagcttttgcacgtctacgtccatggctcctgaagacctagagtag

SEQ ID NO: 113307 - DNA, 411 bp, Glycine max
  Peptide Sequence Number=SeqID_230085
atggactctagagatggtggctattgtagaggtggcagtggtgcatcagatgatgtgaacctgagtaggagcggatcatttgatacaggctacagtggtttggatgacgccacttcaggccttcatctttctccacttgggccttcaatcatcatcaatggcagctatacaaatgaccagccttgtttctatgacgtgttggacttgtttaagtctgcctctagtcatgggcccttcaagtgcttcatggtccttccccttggttatgtcctcataacttggcatgtgttagatcgtggcaagtgcattggattgcacaagtggtataaaatggtaagaaccgagtatcgaactcttggggaacttgtgttacttggtaaagctacttcagtgaataggtgtctagtatga

SEQ ID NO: 113308 - DNA, 123 bp, Glycine max
  Peptide Sequence Number=SeqID_230086
atggaggaggcacgaggagaagctttggctgcgcaacaacactggtttcgtaggagtaataaggcttccggtaatcgattacaggatgttgtaatcgattacaggctgcctgttcttgtgtaa

SEQ ID NO: 113309 - DNA, 213 bp, Glycine max
  Peptide Sequence Number=SeqID_230087
atggcagaaccatcgaagaagagaaagggatcatcctccaccgccgctgctgctgcccatcgccgccacggaccatccgaagcacccacaacacctattcatccctctttgtcatctccaagatcatccactttgttttcatctgatgatcagcgtctatggtacctttctcaattttcttctaggatcatcttagaccctaagtacctagac

SEQ ID NO: 113310 - DNA, 1044 bp, Glycine max
  Peptide Sequence Number=SeqID_230088
atggctcacagtataaaggagagcattgcagagcagccatctagtttgcaaggcgggaaattgagggaatatcaaatgaatggcctgaggtggctggtttccctatacaacaatcatttgaatggaattcttgctgatgaaatgggactgggtaaaacagtacaggcaaaaaatgatagaggaccgtttctcgtggttgtgccctcttcagttctacctggttgggactcggaaataaacttttgggctcctggtgttcataaaattgtctatgctggtccaccagaggaaaggcgtcggttattcaaggaaaggattgttcaacagaaattcaatgttcttttgactacgtatgaatatttgatgaataagcatgatagaccaaagctgagcaaaatacattggcattatataataattgatgaaggccaccgcataaagaatgcttcttgcaagttgaatgctgacttgaaacactatcagagctctcacagattgctgttaactggaacacctttacagaacaatcttgaagaactatgggcactacttaatttcttgttaccaaacatattcaattcatcagaggacttctctcaatggtttaataagccatttgagagtgctggagatagctcgcctgatgaagctttattgtccgaggaggagaatctcttgattataaatcgtctgcaccaagttttgagaccatttgtacttaggaggctgaaacacaaggttgaaaatgagttgcctgagaagattgagagactaataagatgtgaggcctcatcatatcaaaaacttttgatgaagagggtggaagaaaatcttggttctattggcaattcaaaggctcgatcagtacacaactctgtcatggagcttcgtaatatatgcaatcatccatatctcagtcagcttcatgcagaggaggtggataacttcatacctaaacattatctgccaccaattattagactttgtgggaagcttgagatgttggaccgtttattgccaaaattgaaggcgacagatcatcgg

SEQ ID NO: 113311 - DNA, 352 bp, Glycine max
  Peptide Sequence Number=SeqID_230089
ggcccattggcaacttcttgttatgtatccaggtgacaatatagtgctttggttttgttctttgcgaaagaagcctgatgctgccatcaaggctgcagtgaatagtgcaatgaaatcactaagcaaaagtgaagagggaaagccagctcaacccgtgcctcagtggattgaagcaaagagtcatgttcaaatgggaaactacgagtgtggatactatgtcatgcactgcgcatatagcacaaaatttcgtgctcttctctccctctcccctcattcatctccttcttcctccaagctcttatccatggcctcctatggtggtgagcttcttctagactcatcttctccttga

SEQ ID NO: 113312 - DNA, 520 bp, Glycine max
  Peptide Sequence Number=SeqID_230090
atggcttcaaaacagttccagttgataatgcatcaaagcatggcatctcttttgctacagagcaagatgggaatgagaggttggtatcagctgattttccaccttctccaaaatatacaatgtcagagagatggatcatggatcagcagaaaaagaggcgtctactcgagcaaaattggatgctaaaacagcagaaaacaaagcaaagaatggctacaagttttcacaagttgaaggaaaatgtgagctcctctgaagatatttctgctaagaccaaaagtgtcatagagttgaaaaaacttcaactattagagcttcaacgtcgtctccggagtgattttctgaatgattttttcaaaccaattgcaaccgagatggaacatttaaaatcaattaagaaacataggcatggtaggagggtcaaacaacttgaaaggtttgagcagaaaatgaaggaagagcgtcagaagcggattcgtgagaggcagaaggagtttttcagtgagatagaggttcacaa

SEQ ID NO: 113313 - DNA, 297 bp, Glycine max
  Peptide Sequence Number=SeqID_230091
atggaggtgtgtactatctggcatcttgaggagaatttgactgatgttttggcccgtttcaggaacaaacccaaaaagaaagagaaaaagtcaagagagcctcgctttgtcttcttcactaaaacggagatcaatcaccttgaacatggatacagatggagaaaatctggacagaaagcggtcaagaatagtccatacctaagaaattctgctcataaggatcctagctttcgaggtctaggttctaaggtgcacgaaagggaaaataacaaaatggtagtggagcatgattcctag

SEQ ID NO: 113314 - DNA, 117 bp, Glycine max
  Peptide Sequence Number=SeqID_230092
atggcaacttacggaataaagacaagttcagcagttcaggctatctccaattctccgggttcacaacatcagtttcccgtctcacaatccaaacgtgctgttgtccagaaattttaa

SEQ ID NO: 113315 - DNA, 465 bp, Glycine max
  Peptide Sequence Number=SeqID_230093
atgggtgtgagtcaaaaaagaaaaattcgaatccgagtgatccaagttcaggactcagattcagatttggtcgtccaattaaagaaagaacaaaattttagaatctgtataccgatgaaatcaaaaacagaatctgatgccaaagttatttccttaagacctacccatcttcaatttagtgtgtggaaagaacaaaatcagataagagagcaagcggggatcagggcgatgactgatttttcttttggtagtaccaatttttgtgggacgagcaagagaaactctcaggtggtgaaagcaggggagattgtgttgtttgtgacttgtgaggaacaaaagagtgttgggagagagctttccacatgttgcaacaagggaacacccaaggaaaacagttatgtaactgtgctgtttgtccatacgcgtgatgtgttgaacgctgattggtggctccatcattggtga

SEQ ID NO: 113316 - DNA, 240 bp, Glycine max
  Peptide Sequence Number=SeqID_230094
atgacgatcgtagacttcggtgcattcttagacgggcctgtccaggtgcccgtcttagaatttgttgctttctacgacggtcatttccaaccgttgttgatatcgtcactacttttcactacatcggagacgacgacggtcgttaaccgatatagaatgccatccataaccaatattgaatgttgcttttgtagtagtgacataacaattataatgaatgtattacggtatttcatttaa

SEQ ID NO: 113317 - DNA, 1831 bp, Glycine max
  Peptide Sequence Number=SeqID_230095
atggcctcttcacataatgttgaattggaggctgctaagtttctgcataaacttattcaagattctaaagatgaaccagccaagctggctactaaactctatgtgatactacaacacatgaaatcaagtgggaaggagcattcaatgccatatcaagtgatatcaagggcaatggagactgtcatcaaccaacacggtcttgatattgaagcattgaagtcatcacgtcttcctttgactggtggtcctcaaataggatcttcttcacagtcagtgaatgtaacaaaagattccagagtgggtttggctgaaaatgaggtgtccaaaatggacccgtttgcttcaggtcggccaccggttgccccaagtggtggagcgcctgattattatcaaggatctgtggcacagaggagtagtcagtcttttgatcaaggaagtccatctagtttggattctaggtctgctaactctcagtcacaagatagacgtgatactgccaattgggacaaacaggtgagtcaaaaggatggcaagaaagctacaacaaagagaaagaggggagatacatcatcacctgtggaactgcatgttgacagtccttctcagctggatcctcgcaatactggtgttaatgcaaggaaggggaaaataaccaaggctgaatcatcagatggtcttccagttaaaaatggtgaactaaccaactttaacatgactccaaatagtggtcaaatggagaatgtttcggctttgtctggtagcatgaggacaatgcttagagcaaaccaagaaggccatcatttattggcaaaacaaactgatttgacaaaggttggcaatccgatggtgcgagcacctaattcaaagtatgcagaagacactgaagtttcctctgcacatattgcttcagggaagcagcaaggtgcttatgcaaatgttcatggagggatgtcgcttgcagctggtgcatcttcaatggttgaagctttctcaaattcaatgcaatatggtggtgcagttgagcgtgacaggggaagttctactactttatctgatgggcataaaattgttcaggttggcaggcaaaatagtggctcggaaatgaatatgcttagacaaggtgtttctcctagagacacgggaaaatccactgttcctgccatgcctttcaaggaacaacagttaaaacagcttcgagctcagtgccttgttttcctagcatttagaaatggtctagcaccaaaaaaactacatcttgaaattgcacttggaactgccttttctagagaagatggttctcgcaaagatctaattgacctcaaaggaaaatcacaatcttttaatgaaccaggtaactcatctggggccatgatgccatttggaggtcccagcaatgccagacagacggataaaaaccttttggggtcctcttcagttggcaaaattgtggaggctgattctttgtcaaagggaactgagagcccaagaatgttggaggacaaaggtaacctacatgtcacaaaaagaggagaggttgatagacgaattcaagaaagagtggcttcacaagcttcctcagccacttcatgtcagcagcaagattcttcaagtacaaggggtgctttagttggtaataatcatttagatgatgttgacattggtaatatgcaggttggaagatccaaccaatcttctgttgctggcccaaataactgggccggttttgctggtgctaatgaggcttcaaagggacctcctcaggtctctgctattcaacatgagttgcctatagaaagaagagagaatattcctagtcagtttcaaaatgttg

SEQ ID NO: 113318 - DNA, 2688 bp, Glycine max
  Peptide Sequence Number=SeqID_230096
atggccacctttctccgcagctccaccctctctcgcagccgtagatacaaatatgaaactcttgggggtgtgcctagcagtggaagggaccacattctcaagtccattagctacagacgcagaagagccaagcagaggaaaatcttcctcacaacctataagctagattctttcacagagcccgaatcgcctaagctcaacaatgttgctctcaagttcaagaaaattgtagcctctgtcttgaagcttgtgcaaactaaagcagcatatgtgcctaaaagatatgagtctctagagaacccttttgctcataaaccgccgcgtaagcgttctcgtcgtggttctggtttttgcggaaaggaaagtaaggtatacactgatgttgtcattgtcgtgaaagcggataatcctaatgaagaaatcggattggactatttggagaatgaagttgggataatgtacgtaggatctcaacttagctcggggcagatccctcctttcttgcagccagggaaaaacacaacaacggtcaccgtggaattgaagggggaaaatgaatttagtgttgaaatgcaaaatcactttatggaagaccaggaaaaagggaatattcctttgttgataacagtgaagcttcccataaggatcgtgattaatgatttgattcatctcagaaaagttgtggagtggaaggcagaggaaattggggttggcctggcttacttgggtttgattatggggattgtggcgatcaaacgagcccggtgccggctcaggctactcaagaacaagaggcaggcaatagcaaggcaactgagaaaggacttggctgagctaatacaaagtggccatgaagaaactgcatttaaccgggtggaacagcttatgggagatgaaagcttaacagctgcgtatgaattgttagatcacttctgcgaatttatccttacgcaactctcctacatccagaggcacaaggactgtccaaatgatattaatgaagcagtctctagtcttatatttgcttctgcaagatgtggggatcttcctgagctcggtgtcatcagaaagctctttggacagcgttatggtgagaggtttgcaactgcagctgtagagctatcaccaggaaatctattgaaagagaacctgtcagtgaaatctgtgccggatgatatgaagtacagaatggtggatgaaatagccagggataactgtctgcaacaacaggttttagccatacaatattaccctgattggcaacaagtgcaggtgaaagaaaataaagggtatcaactagtggagagtgatgccaaaataattgacattatttcaggatttaaagttcacccttcagagattgaagagataacaagagatgtcacatgtgttaatccatccatttccaaacaaagtgattcttgttctctgccagaaccaaacttagctgatacttcagctatggcgtctgcggttcagcaatatcccccatatttcctgagatatcctttggagaagaaagtagtagatatagactttcctgagctactttcttctctaaattttgatttgcaaaacaagggggaaagaatggccttaacatcttctgcacaaagagtgagtttccctccctattctgaagaaatggtagattatgtggatggcattaaggagttttctgtaccaaatgatggtggctgccaggaccaaatgctatttaagttcagatcttctggtctatccaggagacaaaaaactcaatttggttatgatagtgatattggtcaagatggatcagagagtgagaactcaagcacaaggacctcaacaaagagcaaaaggagacctgagaaaagatcaagaaggagatcatcctccatggaaaaccttggccttatggatattggatacatgatatattatcacaagccatgcaaaagtcccttagctcataagcatagtagcagaaagcaccataagccttcactagaaggaatttccccatcaagttacggccagaagagactgatgctacatggtttctcagaagagggaaatgttttacagtcatgtcacagccaagatggcacaaggagaaaacttttcaactttaaaatgagtggctgcagcttggaccaaccttgctatttttgcctacatgatgatgaagactatttggaacctcaatcaatgaagcaaaagagagggatcagagccacacatgctcaacaagaacttctgcctgatgaatgttgccactgccaactcttttgtgataatgagttgaaccaaggaattgaattggttaccatccctcggagaccaaataggaggagttatagtggtgcagctgagtatcatgtattcaactaccaggattgccaagctggtaatggaaacaatgaaacaaaagaaaaaatctctgcttctcccaaagtttccaatccaaggactggtggttcctcaacaatagtagaaacagaagctacctattcaagggccatgacaatgccccaagagaggcacagaaacagcaaagataagatgttaaggacatattcatgtccttctccacatcctattcatgttcatcctaagttgccagactatgatgacattgctgccaagttcactgctctcaagaaagagcgcatggaaaacatggaccgcagtaaggaccaaaactag

SEQ ID NO: 113319 - DNA, 324 bp, Glycine max
  Peptide Sequence Number=SeqID_230097
atgtcttccaccaatagttctcaattgaaaccccacgaatatggtgatggctctaatgatgaatcatcttccatatcttccaacttttcaagcaatcaagatgatcaagaacaacccataactccctgtggtttcattaatcctctcaaggcccatgaaggacacttctaccttcatccttgcactgatgatggcataaatgtcattacttttcttgatcattacctccactatgaatgctatccaattcccatcatgtcttggtttcagaccagtggctcaaaagagttacgtattgctgcaaaagaggctgactggaaatga

SEQ ID NO: 113320 - DNA, 877 bp, Glycine max
  Peptide Sequence Number=SeqID_230098
gattatatcatacactctctgcactggattttttgttaccccaaccacttctggtctccgcacagctccttccctctttcatagttggcggccactgagaccacctccgatctccaagccctctctggcggatttgagcttttctggcgagattccctcatcagtttccatcttctcagcaccacttactgtccaatcgttgaagactagcaattgccaatccttaccgcttgaagatcctgatgtagaagaagtgaaatatttcgttgagaaacggtttggagtagagattttgcttggcctgaatgcctttggtgaagatggaatcctttcgctaggcacactgtcactgagcaaagatgccaaggcttttgcagcctcattctgcagtgaccatcatggtgctgcagaggtggtcgcggtggtcactgatgaagaaggggagggtctgcagtcccgtggattgtggagccttgtaggggttggaaagaaaaatcttgtgccagaggaaagagctaggatcgaagcccaaattaaaactgctgaagctgctgcaagaatgagggctgaggaagagtcaaggcagcggagagaaaaggaaagagaagcttcacgagctgcaatagaaaagatgaaaagaaccgttgatatagaacataatatggagattattaaagaacttgaaagtttgagtggatgcacgctatcttataaggccgttggcggtagaaatggctacaaagttgcattggagacattggataaacatcagtttgagaacccattggagcggcttggtttatttatcaaggaagacttcaccacagatcttgatgaggaggtgcaagcgagtggttcgagcagtgaactattgtag

SEQ ID NO: 113321 - DNA, 804 bp, Glycine max
  Peptide Sequence Number=SeqID_230099
atggctactcaccttcttcatatcgaacccgccgagctccggttcgtctttactatgcaagctcagcgcatggcaccgcctgatatgctgtgtaaagacaaatttcttattcagagcacagttgtcccggttggaaccacagaagatgacatcacctctgatatgatactcaaaaggttgaatgattttagaccttttctctttcaacagtttgcaaaagacagtggaaagtttattgaggagaagaaactacgggtagtcctcatcagtccaccatcttctccggtgttgcttccagtaaatggtgatatgaagcatgatccatccaacgaaattaatgtgcaaaaagataggttgcccagtggagttgaaaacatacctccccctcgtaaactatccaataaccaccaccctaatgtttccgaggaggttaaaggtttggaaccagcccaggatatgaaggaggatagagcagatgaggatattgtcccaagacaagctgagaatgttggtgacatgaagccagcaaaagatgatgtgcagtcgaatttagccaatgaatctgaggaattgaagtcaaaacttagtgtaatggattcaaagctaagagaggctgaggtaaccatcacgaagctgaatgaggagaggcgcaggaacactcaagaaaaagatttgcttaagaaagagttggaggtgttgaagaggcaaatcaatacgaaaggaaatcaggctggttttccatttctgtttgtttgcatggttgctcttatcagtgtggcagttggatattatattcatccataa

SEQ ID NO: 113322 - DNA, 1275 bp, Glycine max
  Peptide Sequence Number=SeqID_230100
atgattgccactgaaactatagtaccaagtacaaaattgaagatcaagttctcaaccaaaaggatagagattgattctgggccaaaatgtgagtttggacagaaagtgtatcacaatgataaaaacaggcgctgtaattctaatgaaaattcctcagcactgaattctaacaagaggggaccaccagtaagtgttgagggccaaaaggagaaaagacaaaagattgatcggaaagggtcgatgcagtgtgctacaatacttaagagtttaatgtctcactcatatagttgggtgtttcttaagccagtggaccctgtagcattgagtattccagattattttacaatcatatctcatccaatggatttgggcacaattaaatctaagctggagagaaacatttattctggcactgaggagtttgcagatgatgtcagactgaccttctcaaatgcaatgaaatataatcctcccggtaatgatgttcatatgatggcgaaggaactcagcaaaatatttgacagaaaatggaaagactttggtaggaaatggaagtttgaagatgagcatgataaaagcgaaactgaaacaattaaggaaactgggagaaaaagtcttgatgcaatgcttccccggcataaagattccttgcccaaaaaaacacaattattcgaacacaaaggaatgcacaagattagatcattggcaacaaaagatgccagagtggagacacctaaattatcacagattccttgcaagttgattgagaaagacttgcacaaaggcagcaaaggtaatcatgatgtggaacagcctgctggctctctaaagtcatatttttcagtacgttttgtcacatccaagtgtagaatttgtggcaatatcatatgccattgtgaaaatcctagcaattcaacacaggtgtcatcagacatatcatccgaaggatctgaaggaagggacctaattgcacgtggtgccgattcattgagacaggattgccggactaaatgtacatcacctatggagaagaaatctgatcttgattctgatggagctgtaagttctttggacagtgaacatgtttgtcctagttctcagcatgtaactcctactactgatgcctcttctggggaaggtcagcttctctttgcctattatgcttcagttaactgctgctacctcttgtatgtggatctgtatggtgctaatttatatgctgtttgttgttttagtatggagcatgcctgttttgcccgtccagctttctcctaa

SEQ ID NO: 113323 - DNA, 1191 bp, Glycine max
  Peptide Sequence Number=SeqID_230101
atgtccccctcttctactggctttggcatgccaaaaagcaagtgctccctacgttgcaaaccttcatcatcaaccctttcatttcatcacacacctatgcctatcaacacgattccgtttcaggtgaagaagaaacaatttttccgcaattttatgactataatgctctttggtgcagttggtactttgatatcattctgcataatatcactaggtgccatacacttttttcagaaattggacattggttccctgaagattggagattttctagcaattggagcaatattttcagcaacagattctgtttgcacgttgcaggttcttaatcaggatgagactcccttactatatagcctggtctttggggagggggtagtaaatgatgctacctccgtagttctcttcaaagcaattcagaattttgacctttctcacattgacttaaccactgccttgcaattattagggaattttttgtatttattcattgcaagcactgtgttgggaatctttgctggattgctcagtgcattcattattaagaagctctattttggcaagttgataaggcattctacagaccgtgaggttgctctcatggtactcatggcatacctttcatatatgctatctgaactattttctttaagtgccattctgactgttttcttctgcggcattgttatgtctcactacacgtggcataatgtgacagagagttcaagagtgacaaccaagcatgtttttgccactttgtcattcattgctgaaatctttatcttcctctatgtggggatggatgcattagatatagaaaagtggcgaattgtaagtcaaagcccaagaaaatcaattggggtcagttcgttgctgttggcacttatcttagtgggaagagctgcatttgttttccctttgtccttcttatccaacttgcttaagaagtctcaatctgagaaaattgagttaaaacaacaagtatgtgctttcctcccgtttccttgtcagggtcttgagctcttgataactgaggtgttacattcctgcgatgatcttgtttcacaggtaacaatttggtgggctggtctcatgcgtggtgctgtctctatcgcacttgcttacaatcaggtgaaagaatcaaacttcattgcttttaattcttcatctcttgccactttcaagttttaa

SEQ ID NO: 113324 - DNA, 853 bp, Glycine max
  Peptide Sequence Number=SeqID_230102
tggaagcacagctgtcactatagtgaagcagggttcaaatttgttcatgggaaatattggggattcccgagcaatcatgggatccaaggacggcaatgactccatggtggcaattcagttgaccattgatttgaagcctgatttgccaagggaagcagaacgaatcaaacagtgcaagggtagggtatttgcattacaagatgagccagaagttcatagggtatggttgccttttgatgatgcaccaggattagcaatggctagagcatttggagatttttgcttgaaggaatatggtgtgatttctataccagaattttctcatcggctgctaacagacaaagatcagttcattgttcttgcctcagatggggtctgggatgttttgagcaatgaagaggtggttaggatagtatcttcagcgccaactcgatcatcagcagcgaggactctggtggattccgcagctcgtgagtggaaacttaaatatcctacttcaaaaatggatgactgtgcagttgtgtgcctatttttggatggaaaaatggactcagaatctgattgtgatgagcaatgctcctcttctgcaaccatccagaagaaccattggggtaatccggttgagtcagatgacagtcaaaagcctgagccatctttgcgaaggaactttactgtgagatcctcagaagaaaatgaaacctatggaggaggaggagttgaagaggtatctgttggtgttgaagatagaacatcagcggctgaagatcaacactggtctggtctggagggtgtcacgcgagtaaactcactggttcaacttcctagattttctgaggaaaggccaaactcttga

SEQ ID NO: 113325 - DNA, 1179 bp, Glycine max
  Peptide Sequence Number=SeqID_230103
atgattgaagtgcaagcaaatgccatggagcagagttggtgggccaatatgcctcacgagcttctcagagaggtcctcctccgaattgaatcgtcggagtccacgtggccgctgcggaggagcgtcgtggcttgtggcggagtgtgccgcacctggaggaggctcatcgtcaaggagattgtcaagccacctcaattctcttccaacataaccttccccatctctctcaaacagcctggcccgagggaacatctacttcagtgcttcattaggcgcaacagtgcctcacagacatattatctgtttctcagtttatctagtgccctagtagctgatgatggcaagttccttctggctgcacgcaagttcagacgccctacctgcacagattatattatctcccttgatgcagatgatatgtccagagaaagcaatgcctatgttgggaaattgaggtccactcttaatcagatactgttgctagctattcttcttttcttgtttcttagtgcaaagactaaccctttatcttcacatttcataagatcaaattttttgggaaccaagtttacaatctacgatagaaaaagttgttccactgagctggtggtgaattcaaaacaagtttcacctaggcccagggtcccaacaggcaactatccagttgctcacatctcatatgaactgaatgtactaggctccaggggcccaaggagaatgcactgtgtcatggataccattcctgcttctgctattgaaccaggaggggtagccgtagcagccccatcacagactgatttttctgttagtaacagagatacttcattcccattttttcagacaaactcaactagtctggaaaactccatatctggagaccagagcaataaaaaagatgatgtgctagtgttgagaaacaaggctgccaggtggcatgagcagctgcagtgttggtgcttaaactttcatgggcgagtaacaattgcttcagttaaaaactttcagctggctgtttcaccagaaaatggacatgctggactgcaagaggatgaggtcatcctccaatttggaaaaattgggaaggatttgtttacaatggattaccggtaccctatctcagcatttcaagcatttgcaatctgcctcagcagcttcgctaccacagttgcttgcgaatga

SEQ ID NO: 113326 - DNA, 321 bp, Glycine max
  Peptide Sequence Number=SeqID_230104
atggggaatggggattggcttcttcttaatttcccatcagaagcacataataataaagaaaactcaaatcttgatgagcggtattggagaataaaccaagtgggaatcgaatcaaatgctgagaatcttgaaaacgatgaagcagaggaatccgaggaagaacaaaatgaaaaggtaatcgacaaagacaaagaacgtggtggagccgtgattcctcttattcttcgatttggggatggattcgttcagttcttcgatcttcgccattgcagagcagagcgtagagtggagggttccgatcttcaccgcggctattgctga

SEQ ID NO: 113327 - DNA, 342 bp, Glycine max
  Peptide Sequence Number=SeqID_230105
atggcttgtagaccttcttctttccttgcacttcttctcatcaccactatccttcttgccactacatggcaagcagttgctagacgccacattggtccaaaacactcaaacaatggggacaagaaagagcctcagtttttgttccctcctgaagggttgccacctttctttgggtttacacctcaaaacccaaacactggtggtagtggactagggtcaggaccagctggtcgtggttacgttccaggtggtgatgacacgtttgtcccaaaccctggttttgaggttccaaaccctgggagtggtggtggagttccagttccagttccagttaatccgtga

SEQ ID NO: 113328 - DNA, 204 bp, Glycine max
  Peptide Sequence Number=SeqID_230106
atggagaaagtggcggcgcttcttgaagatgatgaagaaagggaacaagttgtttttgaagacctatcttccatgaaagaaacgttaactattgaaaaagaccacataacaaagatgactaatgggaagcctagtgggaaggttgagcttagaaagtggaaacaaagtgacttggtattgaatccatccaatggtgatagctag

SEQ ID NO: 113329 - DNA, 462 bp, Glycine max
  Peptide Sequence Number=SeqID_230107
atgtcttctctagatcctagaattgaacctttgttggtgcaagttgggttttcagatgttgtaaagcttagacaagttaaaattgacaatggtttagtgattgctttggttggaaggtggagacctgagtcaaacacctttcatcttcttgttaatgaatgcacaatcaccttggaagatgttgctcttcaactgggtttacacattgatggaagaccagttactgacccaacatattatgagaatgcactgatgggatcaacacttaaactaaaatggttcaaagaaaacatgttgactctcccagcagaacccacaccacaacaatttgttgcacattgtaaggcatacattttaaggctgattggtggggtgttgatgccaaacaagttagggaacaaagttcacttgatatatctaccattattaactgatcttgattgggctggctggtacaactga

SEQ ID NO: 113330 - DNA, 498 bp, Glycine max
  Peptide Sequence Number=SeqID_230108
atggaggttcacctatttatctttatctattactcctctaagcatgccgaagctatttccttacaagttgaagcccctgctaatgttgtggacgacatcattgtacgtaaggtccctatttatcttatagacactggtgtcatggacaagaccctagaggtgtcccatgcagctccagctgatgaggttgtccctcaagacaaagaacctgcgtccaagcagttcataacgtcacatgaagctacatcaagagagaaaggtgaacctgatgctattattgtctactccacaagcttaggactaacccccttaaactatccactagccactattatgaccagagatcaaaatcttcaacaagctcagatgatcatgctaggagttgttgcacctacacctgtgcctacacaagaacccacaacacttaagcctacaccactgtccattgaagcaacaccacctactcaaccatcaccaccacctcaagttcaagactga

SEQ ID NO: 113331 - DNA, 228 bp, Glycine max
  Peptide Sequence Number=SeqID_230109
atggataagagcttgaaggtagaagaagatgagtggagggagagggagagggagagaaggaacacgaaattttgtgcctcaaatgagcctaatcttcttggagtcttctatccaatgcccttggggaataggattgcatcaatgtctatggacgaggaggatctccctatggagcaagagatcatagaggaggattccacacaggattcgtctgaggagtcctactag

SEQ ID NO: 113332 - DNA, 501 bp, Glycine max
  Peptide Sequence Number=SeqID_230110
atggagtactcactcccttattaccataatcaaggccagatgacgagactaatgttgcatccctcattctacattgatgttatcgagaccaagtggaaacactatgacgtgctccatcctacaccgtcctactaccactttgcggcatccatgtctaagtttgtcattccattcgagtcgcattcgccatttactgacattacaatgttttatgctggatctgactcctcatccaaggatactaatgccacctctccttctctaatgtatccccatttggtgttgccaaaagcttgggtaccacccggggtggatatggtggatctcgtgtgggaggatgagggagagaaccgggggaggactgggggaggacatgtgtatgaggagaagatgtctgatgtagctctatgtggagcttgtaggccttggatcttcttcataaatggagtccttttattcttgaggttcaatggcagaggaatggagaaggaagaaagatga

SEQ ID NO: 113333 - DNA, 708 bp, Glycine max
  Peptide Sequence Number=SeqID_230111
atgtatgtgaaagaactattgaagaaattcaacataaaagatgcaaaacaaataaagacacccatgcattctacaacagatcttggattagacatagaatcaacaaaggtggatgggactcaatacaaaagggcatatcatccaatgaatcttagcatacatttacatcgttcaacatatggacacttactcacgcatttgcacttatcaatagaaactcttggtatcgctttcactctatctaagaaaacatttcgtcttcctttctatgaccaaaccctatttctaaccttacacttaacctctcttatgaacgcttcaaactcatttgttgtcgagatcattccagtcatagaaataactataattcatattgagaatgagccttctatacacattgaacacttcttcgatatccaagaacttgagaagaggaatgttgagttcgccaaccgcaaagtgattattccaaagttctgggaaccaaggtggtgctttccagcgattctattgccaaggccacttggttctttcctgagggaagcacttatcaagaagggtggaacaagaatgatgactcccatgtggcaaaggctttgtaaaaagagaatgatgataaagctgggaaaatgtggaagcaaagcttccaagcttattttgatgatgccaaagactcaagtcaagaatcaagattcaagcaagttttaa

SEQ ID NO: 113334 - DNA, 114 bp, Glycine max
  Peptide Sequence Number=SeqID_230112
atgacgagacactccccaatggaaggggcgatacagggtgaggtggaggcagtctcgctaatgggaggggcgagacaggctgatgtgatgtttgataatatgaaggtatattaa

SEQ ID NO: 113335 - DNA, 316 bp, Glycine max
  Peptide Sequence Number=SeqID_230113
tggtagagaaagggtcacagctcctaaacaaggccaaagctgagctcgttgattttacaagctatgcagatgtctcaaaccagccaggttgttacgtcattttctgggagatcaaaggtgaggccgaggataaggtacttgaggcatgctgcagggaaatggatgcagcttttgttgaccatggctatgtggttgcaaggaaaaccagttcaatagggcctttgatgctgtgcattgtagagagaggaacttttaaaaagattttggattatttcgtggagaatggggcaggattgggccagttcaagacccccag

SEQ ID NO: 113336 - DNA, 1449 bp, Glycine max
  Peptide Sequence Number=SeqID_230114
atggaaccccaaattctcggttacaacaacaatggcaactgcctcagtgactctgatatcattacctggtttgaagacgtgtccaagaacgctggttctgttcagactcagacactgtgcaagattctgaagcagaactgtggggttgaatatctaaagaaatggctgggggactacaatatctcagaaatggatgcaagtgccttggaatctctttttacttctgtggttccccttgcttcacataaagatttcgagccatatatccgaaacattgcagatggagacacagctcctatactcacacaacaacccataaccactctttccttaaggttgtgcagctctggaaccacagagggaaagcaaaagttggtaccctttacccgccatagtgctcaaacgacccttcaaacattcactttagcagcagcctatagatcaagggtttatcccacaagggaaggaggtaggattcttgaatttatatacagcagcaaccatttcaaaacaaaaggaggcttaactgttggaacagccacaacacactactatgcaagtgaagaattcaaaaccaaacaggagaaaacaaaggcattcacttgcagcccctatgaagtaatttctggaggggactataaacaatccacgtattgtcacctccttcttggccttttcttctctgatcacgtagagtttatttcctcagcttttgtctatggcatagtgcaagcattttgcaccttcgaagaggtttggaaagacctttgcaatgacataagagatggcactttgagttcaagaatcaagttacccaaaatgagagaagctgttttgggtataatcacttcaaacccctctttggcctcaaaactagaagcaacttgcttggagctagaagatgtggattggtttggtttggttccaaaactttggccaaacgcaaagttcgtttgttccataatgacaggctctatgcaaccatatttgaaaaagctaaggcattatacaaatggggtgccactaataagtggtgactatggttcaactgagagttggataggggttaatgtggatcctagtttggctccagagaaagtaacctttgctgtagtacccacgttttcttactttgagttcataccactttattatagacagaaacaaggttgcagctcagtagctgatcatgatttcatggaagaggagccaatcccactatcccaggttgtacataagtctcttttcgtaacaccaaataagctcttccaaacatttgggtcacccactcaacagaaattttttcacacggtttggcaggattggttagaaccattgtcctcacataaaataatgcttagcgtggaaacattatttcgtaaagaagctatagatgaccctcagttggacatgaacaaggatatgtaccgaataatctcttatctttga

SEQ ID NO: 113337 - DNA, 636 bp, Glycine max
  Peptide Sequence Number=SeqID_230115
atgctcattggaaagacaggagttggcaaaagtgctaccatcaattctatatttgatgaggttaataaggccaacacaagtgcttttcacatgggaaccgacaaggttcatcgagttgtgggaacagtggaggtatcaaggtgcgtgaaattgacacgcctggacttctaccttcctggtcagatcagccagcgaagaaatgagaagatcttgcactccgtgaagcggttcgtcgagaaaacaacaccacctgatgttgtgttgtatcttgatagtgatgacatgccactcttgcacacaatcacaaaaattcttgggccatccttttggtccaatgccattgtggttctgactcatgcagcatcgtcatcttcttacagctatgacttgtttgttacgctgggttctcatgttgtccatgaaaccattcgtcgggcagtcggtgacaacaaggatctcaggaatcctgtggtgttggtggaaaacaacatgagagtgttgccaaatggccaggatagtagacctagacctacgaagaagccttctttaccttttctcttgtcaagccttctcaaaataagaccacaattgaagtcatcatcagcaaaagatttgacgagtctaacaacaccttaa

SEQ ID NO: 113338 - DNA, 273 bp, Glycine max
  Peptide Sequence Number=SeqID_230116
atggattttgaaatctgccaaattgtgcagcaaaaagctgtcaaatttgtgcagcagaattttccaaatgtgcagaaaaatgcttgtgcattgctggttatgggaaagggacccggtgctgagaggaacgagggtaagggttacgtaggagtacagtggtacctggagatatgtcgcgggggtcaggagaccttggggacgtcaggtggggtgctattgcccaaaaccaagcttgaccaatcccgagccaacccgggcatagtcagtcagtga

SEQ ID NO: 113339 - DNA, 267 bp, Glycine max
  Peptide Sequence Number=SeqID_230117
atgtcacgatggcgtgaccttgctgggggggacgggcacccggtaggactgactgaggcgcataaccagagctggaaacaccagggctctattggacttctccgggatccacactcatctccttgcagcggttgggtgaaatcttgccccggtaagcatagtatctgcacgatagcctccctctctggttgtgctcgcacagtttgcactcctccaggatcaaggggtggctcaggaactgataaaaggaaactactggccccttaa

SEQ ID NO: 113340 - DNA, 670 bp, Glycine max
  Peptide Sequence Number=SeqID_230118
agggctgcactccctcaccttgagaggactacacatcctcgccatcagagggctacacatcctcgccttcagagggctacacgccctcaccttgagaggactacacgtcctcgccatcagagggctacatgtcctcgccttcaaagggctacacgcccttgccttcagaggactacacgtcctcgcctttagagtgttgcatgccctcgccttcagaggactacacatcctagccatcagagaactacacgtcctcgccttcaaagggctgcacgccctcgccttcagagggctgcacgccctcgcctacagagggcagcacgccctcgccttcagagggccacacgtcctcgccttcagagggctgcacgccctcgcctttagaggactatacatcctaccattcaaaggactacacgtcctcgccttcagaggactacacgtcatcaccttcagagggctgcacgccctcaccttcagactacacgtcctcgccttcagaggactacatgtcctcgccatcagaggactacacgtcctcgccttcagagggctgcacgccctcgccttcagaggactatacatcctcgcctttagagggctacgcgtgcccactttcagtgggctccacatccgcaccttaagagtatttaaggtcctctacccttaa

SEQ ID NO: 113341 - DNA, 141 bp, Glycine max
  Peptide Sequence Number=SeqID_230119
atgcgagtgtccgctaagcgtaacactcctgggctaagcgcgaggaagaatccagaagaagatgagctatacaggttcgctaagcgcgtagacagattgactgtgaaagaaaagcttaaaccaaaaccggtgagtctgtga

SEQ ID NO: 113342 - DNA, 171 bp, Glycine max
  Peptide Sequence Number=SeqID_230120
atggaacaaggttggttcttggattctcagctaagaaattgtagaaggttttggttcattgtctgcttattgaggttgggtagaacttggttgattggtcaatgtcgaaatgtgaattttgatagcatcaaagcagcagagtcagttaaatctttagctataagcctataa

SEQ ID NO: 113343 - DNA, 612 bp, Glycine max
  Peptide Sequence Number=SeqID_230121
atgcaaggccacgctgaaactaataactctatcatggcaccgctctctcaaatcccaccttcttcttctcttcacccttcaaacattgctgaaacgggtaacatctacaccaccacctccagaaagcgtgttaagaaaatggaccacaccaattgcgagagcctcaacgtggaacgtgaaagaaggtcgaagatgactcaaatgttcactcagcttcaaaccactgtccctggtgtcttacctcaggctacaagggaagtgattataaacgagacaattaagtacattaaggagcttgagatgaagatgcaaaagctggaggagttgaaggagtcaatgaaagaagggtccatattgcttgcatgtggtaacaacaacatgaattgctccgtcacggtttctgtctctgctaatgttgcattctttggtattcaatccctgcctcgatccggtttggtctcggtgatcatgaaggtgttctgcaagcaccgagctgagattttggctgcaaatgtctcagttaataatgggaaattgatattggcaatcacggcgatggtgcaaaatggtggtgtcgttgaaaatattagaagacaaattttgagtttgtag

SEQ ID NO: 113344 - DNA, 153 bp, Glycine max
  Peptide Sequence Number=SeqID_230122
atgggacttgatgatactccacaacctaaatcgaaggctgctgctgggtggattgttgttaagtgtaatagacaaaaaggaagcaccgagtgtggctattacgtcatgcacttgatgtccactataatcctaagaagtttcaggaataactag

SEQ ID NO: 113345 - DNA, 183 bp, Glycine max
  Peptide Sequence Number=SeqID_230123
atgggaaaagattattcaaaagcgaaacatgctgggcaaggctgtcaatgtcttgctaaagaacgtaagaaaaagaaagaaattagagagattgacaaacgattgggaatagagatacctaatccatatctaaatctagtaaataaagcctgtaacaaaaacttcatactgaatgtactttaa

SEQ ID NO: 113346 - DNA, 621 bp, Glycine max
  Peptide Sequence Number=SeqID_230124
atgggttgctgcttcagcacccctaactctaagccacctcaaaatggcgacaaacaccaacaacctcaccttggatcccacgaacaaaactgcagaatcagaatccgacaatccgttgaagaggaatctgtgaaagaggttctctcggagacacccatctccaaacctcaacaagttccaactttgatgccacaaacgaagacccaattgcccgttattcaaccccaaaagaagtttctctcgtgttggaaacatgcagcaacggcgagagcttctccaccaccaccaccgccaccaccgtcacggaaaaccgagaagacgaagccacgagcaagagaagcaacggaactcgcaatcggaagcgttcttacgccgtcgacggcagagaccggaggcccaaatctccggcgagaaagccggaaattccggcaaggtcacggccacttcgcgggagggagtccgaccatgtccgccgtcattctggcgaggggactgtccggcagtcgaggtctccgtcgcgtggcggtcggagtcagctcaggccgccgggagggattagccggcgagttcctccggctaaggctaagggtgttgtggaggaaaacgacaccgtttcagtga

SEQ ID NO: 113347 - DNA, 594 bp, Glycine max
  Peptide Sequence Number=SeqID_230125
atgggagaatatttctgcaacatctgcaaattcttcgatgatgatgttgagaaagaacagtttcactgtgatgattgtgggatctgcagggttggtggtcgagataattttttccactgcaagaagtgcgggtcttgttatgcagttggtctgcatgataatcatttatgtgtggagaactccatgaggcatcactgtcccatttgttacgagtacctttttgattcattgaaagatgtcattgttatgaaatgtggtcacacaatgcaccatgaatgttacctggagatgataaaaaatgacaaatattgttgtcccatatgctccaagtcagtgattgacatgtctaagacatggaagagaattgatgaagagattgaagcaaccgtcatgcctcaagattatcgaaacaggaagaagtttacttccacattcttggccaaaaatgtggtcactgcagatcatataatacccgcacagttgcacctccagttcttccccaatgaccagatctcttgggttcaagaagggaacactgtcagcagaaagttaaagttagcaccctgttattactatggagggttattgaattaa

SEQ ID NO: 113348 - DNA, 219 bp, Glycine max
  Peptide Sequence Number=SeqID_230126
atgggatctaactggttgaggagaatgtatgggaaaaaaagggtatttgaaacttacgacaacaagacccttgatttgctcctttgtaattttgatctccatggtctcatcctcagcgaattaaagcaaagtgtagaggaaaatgccactggcctcatcaccctcaacaacttctccgttctatctccttctgaccctaagtgggaaggtgctttgtaa

SEQ ID NO: 113349 - DNA, 482 bp, Glycine max
  Peptide Sequence Number=SeqID_230127
atggggtgtgttggaaataatccaagtcccacatcgactaacaatacaaccatattagactttataagtgagaggcaaccctcaccccttgagctagcttttagggttgagttaggcctctcaaattcactttctaagatgtcctcactttgtggtgacaaacacccaccatttgttgttcacgccccgagcctaggaagtgcttggcgtgaggaggggcaaccctcaccccttgagctagcttttggagttgacttagacccaaactcacattctaagatgatatcagagaaggttctgcccctgttggctgaggctggagattttcatgagtttgaaaacacagtttcagagcttgtcaagtttcttgattctttgttggatgctgccgtgactgacccagatagtgaaatgcagagaatgatgcatttgaagctatctctgagatccatagatatatttgttctccttctactgaccag

SEQ ID NO: 113350 - DNA, 318 bp, Glycine max
  Peptide Sequence Number=SeqID_230128
atgggcccaatcaaaactgttatgagtgctgctaggtgcacccagcagtattgttggtgcacccagcaattatgtttttttcttcctcccgcgcagcttcttcattcttcttcttcgctgccagtcttcttcttcttcaccgccatcgccgccattgttgccgtgtttaggaggaaggtgtgggtcttcgcgtttgtggtgtgggtcttcacgtttgtgcttcttcttcgcgtttctgcttcttcttcgagaaaacgctgtcgggaagttgctgggttgtttacggatcacttgatccgtaaactactcgcagcttaa

SEQ ID NO: 113351 - DNA, 573 bp, Glycine max
  Peptide Sequence Number=SeqID_230129
atgggttgtgggaaatctaaacacgatgtagcttctggaaacaccgttctccaacgcaagaaatccactgtcaattccaaggaaaataatgagactcaaaccgtggacaaaaacaacgacgctaatgttgacaatgtaagtttagaagtggaagagaagaacaaggaaaatgtcaaggagattggagttgaaggcaagggtggtgatgagtccaacgacgttgctgggataacaaaggtacagcaagaagataaagcattggagaagagtgcacaagctgaagctgaagagaacgaggcaccggaagaagtgaaggctgttgctgttgcagaagagaaacaaccaacggaagaaaacaaatatgaagtggatgtgagcataaaggaagagactttgcctttggtgaaggaagaagaaagcaaagacacagatgaagaggctttggtgaaggaagaagagagcataggcacaaaagaagagacattggataaggaagaagaaaccaaagaaacaacagagcaggaaaagactttggtcaaggaaggagaaaccaaaggaaccacggagagttag

SEQ ID NO: 113352 - DNA, 180 bp, Glycine max
  Peptide Sequence Number=SeqID_230130
atggttggagcattctcgcaaaacatcgtgaccctgactggtctccctatgatcttacttagtgagagtgacctgacaaacccatggtgtgctaggaatgtgataactcactccctgtgtgttgttgtgtttggatcctgtgatgatcttgaacttgtgttcgggggagcagatgaatag

SEQ ID NO: 113353 - DNA, 1396 bp, Glycine max
  Peptide Sequence Number=SeqID_230131
accgcatcatcaaaagcctggtactgagcttctccctccttctcctttccacctcaagatcatggtttggaccaaaggattaagtcgtgccttaggtcacgttactggcaaaggtcgagtcgttgtgactgcggcacacgatgagctagtggtccttgcgccaaatgttgaggctgatgtatttccggatgacccgatggcaccagctgattctgaggagattgtggcagacattcctgcggacacaggcgtggaggctgctgaggatgagcatgagggattttcgggtggtccgagcgacccatctgtgttgacccagtatgcagatcacattgcttgcagcgtatggacgggagagcgtcctgagttgaagttatcctctcacgggaggaaggtccatagtttaggcaggcctgtccctgccattgatggactcgttgctgggacaggactaagtcctctaatcgcgtgttcggtagacaccggcgattggggacttttgtcctcgtttgtggagcggtggcaccgggagacgtctagtttctatctctcagtgggagagctcacgatcacactagacgacgtctcgtcgcttctgcatctgctcgtggttggcgacttgcacgcctttcagcccttgcacgtggatgatgtggttcagatgctggtggacttattgatggtctctgcagagtctgccatggctaagacagcccagtgtcgtggaccgtacgtacgcctgcaatggggagtggctgctctggttcatatgtacgatcagctgaacgatgcctctatcagcaacagccgacagcttggcagttacatcacacttctgcaagtggattgcgacgaagaagatcgtgaagagcatatgtacaccggcatactgggagcgcctggaccgactctgaattccggatgtctattggatccctttggatacacgcagaccattcctgctcctcctgtcgattcatgggtgtcgtatgatgatatacacgacaagtggatgcactactcagatcatatcgtttcagcaggcgaggtgtgcactgtgccaggtcagtgtgctagtgactacatggactggttcttccacatcttgcatcctttcatgacaccaggccacgcatcagatcctcttcctgatggtcatgccctgcagccccgagtcgtccctcaggccccacagacggatatctctcacgtgccggagccaggagctccgtcgacatctgtggaggagcctagacatgcagtggaagtttgtgatgagattgctgagaggttggagtgccatctgagtctaggggtggtcacgccaggctcatcgacacatgaggtgatcgaagaatgcctcaggatggccaggagtgtgacacaagatcatcta

SEQ ID NO: 113354 - DNA, 948 bp, Glycine max
  Peptide Sequence Number=SeqID_230132
atgtcactttctgattcacactttgtatcccaattcagctatcatgttgtagaaaagtgttggaggagtgatgttgtggatgtaaaaagtggaaggggagaccttcgatatgatgagtacttatacacctcagggagaacatctagaggatatgagggttcatatggggtttatgatctaggagaaggaaatgtagaagataaatctatcctagatttcttattagctcatgacttcacaatagccaacactttattttttggtgttgttttgtctgcttactgtactaaggaaattaattgtgttattgctggtgctggctattacaatacagaactgcatgtcatagatgggattccacaacttatctttgttcgctcaagctatactattgagactgttgaagcagaacgaatatcagttgatcatgttgctcatcttaagccatctgatggtggttcagctgctacacaatcctttggagtaggggaagtgtttgatttctgttctgattgtcagcttgtcatgagtttgaataataggggagggttgtcttgggcagttaatagcaaacatgaaattttgttgaatttgactaaagccagtgaaggtttcatggctgctcaccttactggaatacacagtgccatcaaaatgcttcatagcagaataaaggtgctacatcactatcttcttgcaatgcaaaaaggtgatgttccttgcgagaattcactattaagacaagtgtcaagtctcctgagaagattgcctgctattgaatctggcaaatttcaagatgatttcttgatggagtacaatgacaccttattgattagttacctggcaatgctgaccaactgctcaagtgctatgaatgaactggtggacaaatttaatattgcgtatgataggcatagcagaaggggtggacgaactgcttttatgtga

SEQ ID NO: 113355 - DNA, 1809 bp, Glycine max
  Peptide Sequence Number=SeqID_230133
atggggaggccctccaagacgcaggtttcgaacgaattttcctccgaagaggaaaaggaggaggcctccgccgccgccgccaaccacgagatcgaagatgacgacgaggagctcgaagcggtggctcgctacgttagctccgatgacgacgataattcgccggatgaagccgctgaagacgacgacgaggataaacaggatgagagtaatgttgatccggaagttagcaagcgtgagaaggccagattgagagaaatgcaacaactgaagaaacagaaagttcaggagatattggatgcacaaaatgcgaccattgatgctgatatgaataatagaggaaagggcagattgaactatctcctacagcaaactgagctgtttgctcattttgccaagggtgaccaatcttctcaaaagaaggcaaagggaagaggtcgccatgcatcaaaagtaactgaagaagaggaagatgaagaataccttaaaggggaagaagatggcttagcaaatacacggttggtgactcaaccatcatgcatccaagggaagatgagggattaccaacttgctgggctaaactggctcatacgattgtatgagaatggcataaatggtattctggcagatgaaatggggctgggcaaaacattacaaacaatatctttgttaggctacttacatgagttcagaggaataacaggccctcatatggtggttgctccaaaatctactcttggaaattggatgaatgaaattcggcgcttttgccctgttttacgtgctgtaaagttccttggcaatcctgacgaaaggaagcacataagagaggagttactcgttgctggtaagtttgatgtgtgtgttacaagttttgaaatggtaatcaaggagaagtctgctttacggcgatttagttggcgctacataattattgacgaggcccatcgaatcaagaatgagaactcactcttgtccaaaacaatgaggctatacaatacaaactatcgactcctcataactggcacaccattacagaacaatcttcacgaactctgggctcttctcaactttcttttgcctgaaatatttagttctgctgaaacttttgatgaatggtttcaaatctctggtgaaaatgacgaacatgaggttgttcaacaactacacaaggtcctccgtccattcctccttcgaaggttgaagtcagatgttgagaaaggtttgccaccgaaaaaggaaaccattctcaaagtaggcatgtcgcaaatgcagaaacagtattataaggcattactgcagaaggatctggaggttgtgaatgcaggtggagaacggaaacgtctcctaaatatagcaatgcaactacgtaaatgctgcaatcacccatatctcttccagggtgctgaacctggccctccctttacaacaggagaccatctcattacaaatgctggtaaaatggtcctactggataagttacttcctaaactaaaagaacgtgattctagggtccttatattttcacagatgactaggctgctagacatacttgaagattatctcatgttttgtggataccaatattgtcgcattgatggcaatactggtggagatgatcgagatgcttccattgaggctttcaacaaaccaggaagtgaaaaatttgtcttcttgctatctactcgcgctggaggccttggcattaatcttgctacagctgatgttgttattctttatgacagtgactggcaagtattcatattgattgtcagcagccttctaacttgcagcggtgccataagttcatga

SEQ ID NO: 113356 - DNA, 1017 bp, Glycine max
  Peptide Sequence Number=SeqID_230134
atgaaaatacatattaccagaaagaagctcaccattcaccaaaaaaggaagaagaaagaagctcacgattttaagaaagatggaactgcgaaaggaaatgcatcggggcaatcaaatcgtggtggtggtgcagcctcaaggctttcacccctgtctcctgagccttatgatcgtgcagcaactgttgacattcctcttggatcctcaaaggacctcgaagccaaggagaaggagctccaagctagagaggctgaattgaaaagaagggaacaggagctaaaacgaaaggaagatgctatagcacgagctggaattgttatagaggataaaaattggccacctttttgccccatcattcatcacgacattgcaaatgaaatacctatacatcttcaatcaatccagtatgttgcatttacaacatggttaggtttggttatatgccttttatggaatattatagcagttactgtagcttggatcaaaggagaaggtctttcaatctggtttctatctatcatatactttatttccggtgttccagcatcctatgtgatgtggtatcgtcctctttatcgtgcgacaagcagtatgtacatctggggactttgtgagcagaatttttctctaacgaaaggaggtgccagaagtagaaagagtgagaaaggagagagctgtggggacagatggagtatgttgatgacggatagtgctctaaggtttagtttgtttttcttgtcttacggggtgcacattctcttttgcgtttatgctgcagttgctcctccaattatcttcaaagggaaatctctcacaggtattctgcctgcgtttgaggtattggactacaatgcattggttgggatactctactttattgggtttggatttttctgcattgaatcactgctgagcatttgggttattcagcaagtatacatgtactttcggggcagtggaaaggctgcagagatgaggcgtgcagctgcgcaaggggccatgagggcagctctatga

SEQ ID NO: 113357 - DNA, 255 bp, Glycine max
  Peptide Sequence Number=SeqID_230135
atgttgtccacaatccttactccacttaacattatgaatgctttgtgtttgagcaggatggaatctcaggtgaagcacgcccttgttgtcaaagttatgggtcgtactgggtctagggggcaggtgactcaggttagagtgaagtttttggatgatcaaaaccgacacatcatgaggaacgtgaagggacccgtgagagaaggagacattctcaccctacttgagtctgaaagagaagcaagaaggttgcgctag

SEQ ID NO: 113358 - DNA, 501 bp, Glycine max
  Peptide Sequence Number=SeqID_230136
atgaaatggaagagagagttagggaagaaagaaacttacggcgaagggattaacctcgtcttgggcgaaggggttggtgtcgtaggtactcatgccaaacacggagatatagacacagtgagagagaaagagatctatataaaaatgaagaaaaaaaatatggatgcgagatttggtgagggaatgaagatatttgttggtggcgaggggaatagaaatgaacggcttctctttgcgattgtgatattgtttgtcggtcaacaaggggggggaagaaaagtgaagaggaacggagagaaacaagttcgcgcgttaccatacgagggacgaaagatattcatgcatcgtttcctcatctatcttacaaccagcgccaagttctacgtcaaagacaatgacatgttcgaagtcaacctgatcagtcacactgtccccgtcgagaggatccacacaagtgctacccgcaatgaagagggagatggagagaagaagagtgagtga

SEQ ID NO: 113359 - DNA, 615 bp, Glycine max
  Peptide Sequence Number=SeqID_230137
atgcttacgccaacagcgacaacgcttatgccgccatcgatgatgctagatgcgaccaagagagaaagaagaccaccgagtgcctttgcaaatcccgcatcaacaactgcaagagtatttacatatgaagaaattttagatgctacaacagactttaacctagaaggtttgctaggtcgaggggtttttggctctgtgtacagatgccaacttaggaacggccagcttgacccaagtagcaaacaaggagacaaagaatttaggcaggatgttaacttgctgtcttccttaaattacccaaattttgtgaaattgattggttatgccattgggcctgtttgtgtagatcatgaaaaggaacaccttgacttgagaacaaggatgttgatagcatttggtgtagcaaagggattgaggacaacaatttatcctgattgtgaagtatacaacgaagtgggaacctttagttatatggatcccaactatgtcaatattggcctagtaacgttcagtagtgatgtctacagttttggaatggcattgctggaacttctcacggggcataaggttaatgatagcaagcgtgaaggagggcaacaaaatcttattttgtgg

SEQ ID NO: 113360 - DNA, 177 bp, Glycine max
  Peptide Sequence Number=SeqID_230138
atgacggtacggtgtggtggatttttgataaaacgccaccaaatagcggtggcgttgcgggtttcaaatggcggcaccatggagaccgttataggtttaacggtggtgcagaattatggttgtcttgggttgactcgacccaaccctaaactcgggtttggaatcaaaatgagatga

SEQ ID NO: 113361 - DNA, 246 bp, Glycine max
  Peptide Sequence Number=SeqID_230139
atgaaagacatcggtgaagcaagtgttattttgagagttaaaattataaggaaaggagatagtacattactgtcccaagagcactatgttgagaaacttctttcttggagattagccaaacaaactattattgctagatcagcaatggagtcacagtttgttgttctaaaaatggctggtagtgaggctaagtggttgaaaaatttcctagctaacattcctttgggaatgaaaccgaaccattaa

SEQ ID NO: 113362 - DNA, 378 bp, Glycine max
  Peptide Sequence Number=SeqID_230140
atggctgaagctgcaaaacttgtcaacaatgttgacgcgtccaaccccatgccactgactgcaacctttgtcaagccaccgcctaacatctcaaaattgaggtcttcgttggccaaaactttcatcactgttgtcttcgctctttccactcccaaaactgatgtcgctgctgatgccagtcaacttcaacaaatgggtttaggtcaacaaggaatcctaagagatatgagactctctcatactcaaatacactgccgaggacttggtcaaatagagattcatcattgccaactactactgttggaccatgaacaaagaaaaagacgtcaaggtacaaatcaacgaataccacaagctgctagaagacttggagattga

SEQ ID NO: 113363 - DNA, 1545 bp, Glycine max
  Peptide Sequence Number=SeqID_230141
atgaaaacgccaaacggctctccggtttctagttcatctccgaaacctcgtcaccaccgaaaccgcgaacccggttcagccacacactccagcgaatgccactccccggtccgacgcaaatcctcgagccccggccggccacacgtcgtcatcacggaggacgccggtcccacgcgccaccaactatggccttccaccgcgaagagaagctccggaacactcgccgatcacataaccgaagacagaatcatagagcgcacttcaaccgcaaataacaacacacccacaacaattggtggctccgcgcgacacgtggcaagattttcaacaccctcagaatctaagaaactaagttataataacaacaacattgctcctggaagattgtcgttggatgaaaacgctaagtccttctcttctcggagacactccagaaactctcttgaattagactctgacgcgggaaaaaaattaacgtcaaaaaaagcagacctggaagttgctaaaagtgatgcaacaacaacgccgagaagggctaggagaggaacttcagattccaacgttgcgaacttgaatggtgattcctcctcctccgttttgaaacggttcacgttgaaaactgctataaggagggcgaattcgctcgctggaacgtacaagagttccaagacttcgtgggctttgtctccggggaggtcggagtcaccggctatgtcggttgagagcatggataaagcggtgtcgttttcgagcttcaaggtcccacccactagtcctacgaaggtgaaaggggtggagaagttactcaacatgggttttgatctcttcaagggtaagaaaagtggtggctttggctctttgtcgcccgttggttttggagttcactcggaggttgttcataggcttcgtttgcttgataatcgcttggttcaatggcggtttgcgaatgctagagcacaagttgtcaatggaaacacttctcacaaggctcagagcaatttgatatgtgtttgggacggtctcacaaagttacagcaatctgttctgaaaaagaagatacagtttgtcagagaaaaacttgaaatgaagatcgcttttgtactgtattctcaaatgaagctactggaagcttggggaggaatggaaaggcaacacttactagcaattactgccatcaaagagtgtttgcattcggttgtttgcagagttcctattttggaaggtgctaaggtgaacatgcaaccaacgtccattgctctacggcatgcatctgatctcacagtttccatcaagtcaattttaactactttttcatcctcagtatgtttgttaacactggaggttgataagatttcagcaatgctatcagaattagcaaaagttgttgcacgagagaaacagctcttagaggagttctatgatcttttccaggccatatgtgtctttgaggttcaggaaagaagtgtaaagtgcaatctcgttcaacttgaaggttggcaacaaaaatatcaacggcagcaattactaccagagatcacgtcatag

SEQ ID NO: 113364 - DNA, 171 bp, Glycine max
  Peptide Sequence Number=SeqID_230142
atggaaaagaaggaagaattccttaagggaaagttctcaagctttagttgttggagtggacttggtcctgcgtactcacacaaagcctgcactgctcgcttagcgcaggtgcctgtattcgtgctaagcctgcacttctcgctcagcatgggtgcttgtatttgcgcttag

SEQ ID NO: 113365 - DNA, 663 bp, Glycine max
  Peptide Sequence Number=SeqID_230143
atggaggttggcagtgtgcgccaggtggtggtggaagttgtgctagaggcgaggcgtccagcattgtggctctggctttggcacaatagggccctaggaagaaacgaccacctgagtgtcacacaatgctctgatcaactccgggaaccccaaccgagaggtgctagactaggcgatctgggcaaggttaaaataagaaagtacgctccatgtttgagcgagcgtagtgagatccttccgcaacaacttccatggggccccatcggtgttcaagacgaatcctcgttcggcaaggacgacgagggtgtcaaggatgtcgttgatggtctctgcgtcaaatctgataacatgcccccgcaccttacatacccggtgccattgcctccattggagctcttcgtaaaattcattgaacatgcctgtagagagctccacattcctctccggaggaatcccatgtggattcccctccttgagtgggcactgctcggcgtttccatgaggccatccgaaaaaataggtgcgcatttagctcctagtcttgaggcttctgggcttagcgctacagtctcgcttagcgcgagctactcgctaagcgatttcatccatctatatgagtgtgctactcgctttgctcgcctagccatgctcttcaattgctaa

SEQ ID NO: 113366 - DNA, 261 bp, Glycine max
  Peptide Sequence Number=SeqID_230144
ggcatcaactgcttaattgaatttataagttcatacccgatagcagtagccaatgtcggaagaggagccgttggtgctttagttccgcagctcttgcctgagacggaaagttggcaaaggcttcagacgcggtctccggctcaaggtcaatttatttttgagttcccggcccaagtcaaggcgatgcaatactcgggcgataaggaagaagcagtcccaggccttaggtccagaccagatctgagaactttcgagatgtga

SEQ ID NO: 113367 - DNA, 156 bp, Glycine max
  Peptide Sequence Number=SeqID_230145
atggagagcggagactgggtttccatgggtcacagcactcaatggctttggtattctatatatgaaagcaaacaagtgagctggcgcacaagggtggtagtcatttcaggttggacaagaagattcatatttgggagagattctagtcgtatttaa

SEQ ID NO: 113368 - DNA, 411 bp, Glycine max
  Peptide Sequence Number=SeqID_230146
atgagttcaacaagccgtgcttgggcttggaccgtggcagctggtgttggagtggtggaggccatgaaggatcagggtatctgcaggtggaacagtgtgatgagatcagcacaacaacatgctaaacataatatgaggtctttgtctcaaaccaagaagctttattctcaatcatctgttatggcttcagccaaattgaaagatgagaaagctaagcagtcagaagagtctctgagaaccgaagatgagaaatggaagactcaaaagatgcaccaatcagagaagattctcaacatgtcttctgctgctggggagagacgtatggattggatttggaagagtgcgccagtaccaattcatggcaatcgccttaatttgatcgataatcatctttggaatgatgaaatttga

SEQ ID NO: 113369 - DNA, 480 bp, Glycine max
  Peptide Sequence Number=SeqID_230147
atgatgttgggaggtgcaacagcaaggggcgtttccctgattaaacttcttcctccgttccgctttcgcttcaaacactcctctgctctttcaaaaaccatttgtaaaagttcattggcacttggcagttttcaggtttattcgacagaggcatctcctggcatagagagagtgacacatgaagtcctgaaagaatttcttgccactgttgaaaatgcaccaacatccaatgcaaaagtctattacggatatatcgataagatatgcaaggctggaaatctttcagttgccagtaaaatgctagaaattttaaatgataagaacattgttgttacccttgatgtgtataatctcatattagtggaggcaagtcagaagaatgacattgacctttcttgtcaagttttcaggaaattattgttgtcttgtgaatccccaagtgcaacctcatgccttaagtttgcccaggctttctcaaag

SEQ ID NO: 113370 - DNA, 297 bp, Glycine max
  Peptide Sequence Number=SeqID_230148
atgtgtcgtggaacttttgtggttgcaaccactgttggagtggtggaggcgttgaaggatcaagggtattgcaaaatgaacaacacaatgatgaagtcggtggctcaacaagccaagagccacttagggtcagcaactcgggccaagaagctggcttctccttctccttcttcttcttcagcaacttcaaataatgagaagagaaggatggcagaggagtctctcagaacagttatagtgctcataacatatagcactgttgatggattgattgtgcaaggttttgatccttattga

SEQ ID NO: 113371 - DNA, 3105 bp, Glycine max
  Peptide Sequence Number=SeqID_230149
atggatcaagggaggcaggtattcacagtggaccttcttgaacgatatgctgcaaaagggcgtggagttatcacttgcatggctgctggaaatgatgtcattgtgattggaaccagcaaaggatgggtcatcaggcatgattttggggttggcaattcaaatgagattgatctctctgtgggtcgtcccggagaccagtcaatccatagggtttttgttgatcctggagggagtcactgtattgccactgtagtgggtcctggaggagctgaaactttctatactcatgccaaatggaccaagccacgaattttaagcaagctgaaaggtcttgttgtaaatgctgttgcatggaacaaacaacagataactgaagtttccacaaaggaagtcattcttgggacagaaaatggccaacttcatgagttggctgtggatgagaaggacaagaaagagaagtatatcaagtttctctttgaattaacagaacttccagaagtttttatgggtttgcagatggaaacagctagcatgataaatgggactagatattatgtgatggctgttactcctactcggctttactctttcactggctttgggacactggaaatcgtacagtacattttatggaacttcctggtgacataccaaacaggcaagttgctcgctctctctaaaataagaatattactgttatatcatgggaacattcaacataaaattgagttgcattttttcattaagcaacgaagagctgtacattttgcatggctttctggagctggtatataccatggtggcttaaattttggagggcagcaaagctcttcaagtggaaatgaaaattttattgagaacaaggctcttttggactactccaaattgtctgaaggagctgaagtagttaaaccaagttcaatggctttgtctgaattccatttcttgttgcttttagggaacaaggtcaaggttgtaaacagaattagtgagaagatcattgaggaacttcagtttgatcaaacttctgattcagcatctaagggtattataggattgtgtagtgatgccacggctggtttgttttatgcttatgatcaaaactctatctttcaggtgtctatcaatgatgaaggccgagatatgtggaaagtatatcttgacatgaatgaatatactgctgctttagcaaattgccgtgatcctttccaaagggaccaagtatatttagtccaggctgaagctgcattttcttctaaagattattttagagctgcatctttctatgccaaagaatttgatttgcagatcaattatattttatcatttgaagaggtcactttgaagttcattagtgctggtgaacaggatgctttgagaactttcttattgcggaagcttgataatttagaaaagagtgacaaatgtcaaataacaatgatatccacctggacaactgaattgtacctggataagataaatcgactgctcttggaagatgactctgcatcagataatagcaatttagagtaccaatcaattattaaagagtttcgtgcttttctcagtgacagcaaggatgtattggatgaaacgactacaatgaagcttttagaaagttatggaagggttgaagaattggtatattttgctagcttaaaagggcactatgagattgtagttcaccattacattcagcaaggagaagcaaaaaaagcattggaagtgcttcagaaaccttctgtgcctatagatcttcagtataagtttgctccagaccttgttgcccttgatgcatatgaaactgttgaatcgtggatgactacaaagaatctgaacccaaggaaactgattcctgcaatgatgcgttattcaagtgaaccacatgcaaagaatgagacacacgaagtcattaaatatcttgaatattgtgttcatcgattacataatgaagatcctggagttcataacctgctactttctttatatgcaaagcaggttgcgtggcttgctttgttatacatgatccatgaagatgatagttcacttctacgtttcctacaaagcaaatttgggaaaggaccagaaaatggtcctgagttcttctatgatcctaaatatgccttgcgtctttgcctcaaggaaaaacgaatgcgtgcatgtgttcatatatacagtatgatgtcaatgcatgaagaagcagttgctcttgccttacagattgattcagagcttgctatggccgaagctgataaggttgaagatgatgaggatttgagaaagaagctctggctcatgattgctaagcatgttgttgaacaagaaaaaggaactaagagggaaaacataaggaaggcaattgcatttcttaaagaaactgatggcctgctaaagattgaggatatattaccattctttccagattttgccctgattgacgacttcaaggaggctatctgctcatcattggaggattacaataagcaaattgaacagctgaaggaagagatgaatgatgcaacccatggtgctgacaacatcagaaatgatatcagtgcacttgctcaaagatgcactattattgatcgagatgaggagtgtggggggaaagggaccttgactaatccgaagtttggccaggaggtttgccagcgaaaaattctaactgctggcagggaattcggcacgggccgtggctatacattagtagggcaaatggcacccttttatatctttccgtgtggacatgccttccatgcagaatgcctgattgctcatgtgactcgctgtacagttgaggcccatgctgagtatatactggacctgcagaagcaacttactttgatgggcagtgaagcaaggagagaatccaatggtaccctttctccagaggagtccattcctagcatgaccatagacaagctccgatcacaactggatgatgctatagctagtgaatgcccattttgtggcgacttgatgatccgtgagatttctttgcctttcatcaatcctgaggaagagcagcatgtgctatcatcatgggagataaaaccaagcgctggtagccagagaaacagtatctcgttacctgcatctgcatga

SEQ ID NO: 113372 - DNA, 1701 bp, Glycine max
  Peptide Sequence Number=SeqID_230150
atggtgatttcttggcttgtccactcgattacaccctcgataaggcagagtatcttatggatggataatgctagagacatttggaatacagtcaagatactcacaaggagatctgctgagaacttcagagttgcagtaagaaatggtttctacaagacaaggaatgtgatcttctatgagtattgttttccattcattggccaagacaaacctgatcctatcattgtcctttctattcctttttctcaatgcattgatcaatctgagggtgtctcatcaaaattatcaattgatcatatcatgcctgtgtcaaataataatgattctgatcccttgactttagagcaaccctctaatataaccagaagatctttgagacagacacacagaccaagcaagtataaggatttctatgtttcatactcatcttcaattgtggtcagttatttttgcggtcttgaaccttggacctataatgaagcttctaaggatcctgtctggatagaggcaatgaatgcaaagattaatgctttagaacttaatgatacttgggttttgactgatctgcctcaacataagaatgttgttaattggaaatgggtgtataagataaagaacaaatcagatgggtcagtggaaatacataaggcaagcaatgtgcttcagatcattctttgtttctcaaacatggaatctatgactgctctgttagtttatatggacaatattgttttgtcaggcaatgatttgattgaaatacaaggtattacacaactgttggacaatgcttttaagataaaggatttaggtgacttgagatacttcttaggttttgaagtagccagaaaacctgctagtatcaacttgtgtcaaaggaagtatgccttagacattctcagtgatgctggtatgcttggatctaagccaatatctactccatcagattatgctactaagatgcatcaacaatcaggaactcttctttcaatggaagatgcttcctcttttagaagtgattgtgactgggctagttgcattgacatcaaaaggtctattactggttatgctacgtacattggtgactcattgatttcatggaaatctaagaagcaagtcactgtatccagatgctcatcaaaagctgaatacaaagcactcgccagtgtcatttgtgagctacagtggcttacctatctgctggaagatttcaaagtagactttcaacaatctgctactttgtattgtgacaacaaatctgcccttcgcatagccgtgaatccaatgtttcatgaaagaacaaaacatattgagattgactgtcacatagttcgagagaaggtgttaagtggtcttgtgaagttgcttcctattccttctacaaatcaattagatgatgtttatactaaagtcctaatgcctgacttgtacacaaagatgagttcaagcagaacttgggctgtggcagccagtgttggagttgtggaggccttgaaggaccagggtctgtgtaggtggaacaatgctttaagatcagcacaatatcaagtgaaaaaccatgtgagatccttgtctcaggcaaacaaggtttcttcttcctcatcttctgctgtggtttctagtagattaaaggaagagggtgcgaagcagtcagaggaatcattgaggacagtcatgtacttaagttgttggggtcccaactag

SEQ ID NO: 113373 - DNA, 369 bp, Glycine max
  Peptide Sequence Number=SeqID_230151
atgggacccaccagcaatgagtattatacagaaaatcatatcccaagtgaaaggaaaaaagaagaaaataagagaaagaagaaaaatatgagttacttgaatcgtgtttggatggcggcaacggtggcggtagcgcaaggccacaccgatcccggccacaagtgcaagacggcgctcaactccatccaccacaaccggagccgcctcttctccggcggagccctgtctgatctccggccgctgtccggcgtcgttggacctgacgtctctggcgcggcagcggggagctccgacgcgaagaatagggtgagccaagccgatgactctctgaggaaagtgatgtactttagttgctggggtcagggctga

SEQ ID NO: 113374 - DNA, 501 bp, Glycine max
  Peptide Sequence Number=SeqID_230152
atgagtagtgcaacaagcaaggcttggattgtggcagcgagtgttggagccgtggaggctttgaaggaccagctgggtgtgtgcaggtggaactatgttttgagatgtgctcagcagcacatgaaaaaccactttagatccttgtctcaagcaaaaaatgtttcttcttcatctgctcttgttgcaagcaaattaaagggtgatgagaaggctaaaaaggctgaagagtccttgaggactgtcatgagagcatggactgtggcgattagtgttggagttgtggagaccttgaaggaccaaggcctctgcagatggaattcggctttcaagtcagctcaacaaagtgtgaaaagccatcttagatctttgtcacaggcaaagaagctctcttcttcatcttctgctatgctttctagcacactgcagcatggagagaaggccaagcattcagaagaatccttgaggaccgtcatgtacttaagttgctggggtcccaactga

SEQ ID NO: 113375 - DNA, 648 bp, Glycine max
  Peptide Sequence Number=SeqID_230153
atgactgacttctgcatcaggtacccaaaccggataaggaaagacatgaaaatgaatttttccagtctttgtcgggctattcgcctggcgaaacggattgacagatcgatattgaaatcgatagtcaccccttccaccggtctgccaagacagtctcaattaaaaaatgatattgtcgctttctctaaagacctgatcctaagggggtacgttgggagccaacttggaaagcgagaccttcgtggaggccgtaaaggtgaaaagacgcgtggaggaatattctaccctaccatctgcgtcatgaaatcgtttgggtttcctcaatggtccccctttatccgatacccttatgaccaaaagaatgaagagagatctccatggtctacagagaccgctgagagtaccatccactctctttcgggtctagacacttcggtgagtctattgactcaggctcccctggtagactatcgcaatctaccgaggctggcgctgtctgccaccgataggtggcccctcagtctgaagactcaccttattagaactttatttggtaagtctgttggagattgtttagatgcaatcttcagcagatctatgaagtaccctttcttcgctcagttcgaggtgtcgtattctttagagtag

SEQ ID NO: 113376 - DNA, 235 bp, Glycine max
  Peptide Sequence Number=SeqID_230154
atgtcgctgcatgttctttatctttatgtgttttctgggtttcccccagggattccccgtctattgtatctcccgttacaatctttcaaagaagtaaacgtgggggcaggatcatctcgagctaccttctggggtagagacaaagttaaagcggcagaaaaccaatcaaggactgaccgatcgtcgtttcttcccggcgctggacaagcagagaacgtcgctgcaaggcagccca

SEQ ID NO: 113377 - DNA, 264 bp, Glycine max
  Peptide Sequence Number=SeqID_230155
atgtcctggacattgtatccgacatcgtggatcctgcacactctgttaaaggtacgagcagttatgcaagtgggatcagcaactttcattatcagagtaatcaagcacagcggtatctgtaggggcgacagcaaaattctgcaagttgcaagtcgtttccaggatgtcaagacatctcacgtgacatcagctttctgctccccctgtctccatgctcctactgctgtgaagcagttcactgcggcatcttctatcagctactag

SEQ ID NO: 113378 - DNA, 162 bp, Glycine max
  Peptide Sequence Number=SeqID_230156
actggccaaggcagccaaggtcatgcaatgagacctactggtggcgtactgcacactgaatcgttcgatgagggtgtcgaagctatctatggatcttggtgggagtccaccataccatgtcaatgttgctccctcgagggatatagggaagacacgacatag

SEQ ID NO: 113379 - DNA, 546 bp, Glycine max
  Peptide Sequence Number=SeqID_230157
atgagagagtggtttgcttatagacttcggtccaggtcaaatgaagcacacactttatttcattctcaaaaattatttcaacaattcaatgttgaaggttataccatgcttgaatctgaaagacttagctacatcagaaacaaccaaaaaaagcttagagttgacaagtattctagcttacaaagttcattggatactggaacagctaaaggcttaaccaaaggaaaaagagtcatcttaccttcaacgtttgttgggagcccacgttatatggatcaactttactttgatgacagaccagacattgtatcacgaattttcagattgaaatatgaacaaatgctctcagacttaacaaagggtcaattactgggaaaagtggttgcatatatgcatactatagaatttcaaaagcgaggactccctcacgtccatttattgttatttctacacccagacaataaatatccatcttcaactgacattgaccagataatatcagcagaaataccttcccatgaagatgacccagaactctacagattg

SEQ ID NO: 113380 - DNA, 749 bp, Glycine max
  Peptide Sequence Number=SeqID_230158
cgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggtagcttcgcgccactggcttttcaaccaagcgcgatgaccaattgtgcgaatcaacggatcgatagggccacgctttcacggttcgtattcgtactggaaatcagaatcaaacgagcttttacccttttggttccacacgagatttctgttctcgttgagctcatcttaggacacctgcgttatcttttaacagatgtgccgccccagccaaactccccacctgacaatgtcttccgcccggatcgaccggccgaagccgaccttgggtccaaaaagaggggcagtgccccgcttccgattcacggaataactcccacttatcctacacctctcaagtcatttcacaaagtcggactagagtcaagctcaacagggtcttctttccccgctgattccgccaagcccgttcccttggctgtggtttcgctggatagtagacagggacagtgggaatctcgttaa

SEQ ID NO: 113381 - DNA, 3600 bp, Glycine max
  Peptide Sequence Number=SeqID_230159
atgaaaagagagaaaccataccttatgaagaagatgccatggtcaccaagaagagaagcaccgatagtagtgaggttcgttgtgattgccttattcatcatgataacagtaccaacaccaccaacagcagcagatgcagaagcagaagcagcaacaacaacttctgatgcagttttattgatacagttcaagcatttacacgtttcctctgatccctacagcttcctctccgactgggacccacacgcgccatccccgtgcgcgtggcgaggtatcacctgctcctcctccggcggcgtcagcgccatcgacctcagcggcgctgccctctccggcacactgcacctccccacactcacgtcactttcatcgctccaaaacctaatcctacgtggcaactccttctcctctttcaacctcaccgtttcgccaatttgtacgctcgaaacactcgacctctctcacaacaacttctccggcaagtttcctttcgcaaacctcgctccatgtatccgccttagctatctcaacctctctaataatctcatcaccgctgggcctgggccctggcccgagctggcccaacttgatttgtctagaaaccgtgtctccgacgtggaccttctcgtttccgctctcggaagctcaactctcgtttttcttaacttctcggacaataaactcgcgggtcaactcagcgaaacgctcgtttcgaagagcctgaatctctccactttggacctctcttataatcttttctccggaaaggttccgccgaggcttctaaacgacgccgttcaggtcctggatttctcgttcaacaatttctcggaatttgacttcggtttcggttcgtgtgagaatctagttcggttgagtttctcgcacaatgcaatctcttcaaacgagtttccgcgcgggttgggtaactgcaacaatcttgaggttctagatctttctcacaatgagctcatgatggagattccgtcggaaattcttctgaatttgaagagtttgaagtctctgtttctcgcacacaacaaattttccggcgaaatcccgagtgagcttggaagcctttgcaaaactctagttgaacttgatctctcggagaacaatctttctggttcgttgcctttgagtttcactcaatgttcttctctgcagagtctgaatctcgcgagaaactatttttctgggaacttccttgtttccgtggtgaacaagcttcggagtctaaagtatctaaacgcagcgtttaacaacataacgggaccggttccggtgtcgcttgtgagcttgaaagagcttcgggttcttgacctgagctcgaaccggttcagcggcaatgttccgtcgtctttatgtccttccgggttggagaatttgatcctcgctggcaattacctttcagggacggtaccgtcacagctcggtgagtgtaggaacttgaaaactattgatttcagctttaacagtttgaacggttccataccgtggaaggtgtgggctttgcctaatttaactgatttgattatgtgggctaataaactcactggagaaatccccgagggaatttgtgttaagggagggaacttggagacgttgattttgaacaacaatttaatttctgggtccattccgaagtcaattgcgaattgcaccaacatgatatgggtgtcgttggcgagcaaccggttaaccggggagataacggctgggattgggaatttgaatgcattggcgattcttcagctggggaataactcgctcagtgggaggattccgccggagataggcgagtgcaagaggttgatatggttggatttgaatagcaataacctaaccggggatatccctttccagcttgctgatcaggcagggttggttatcccaggtagggtttcggggaagcagtttgcgtttgtgaggaatgagggtgggactagttgcaggggtgctggtgggttggttgagtttgaggatatcaggacagagaggcttgaaggttttccaatggtgcattcatgcccgttgacacggatttactccggttggactgtgtatacttttgcttccaatgggagtatgatctaccttgacctttcctacaacttgttgtctggtagcatccctgagaatttgggtgagatggcctatttgcaggtgctgaatttggggcacaataggttgagtgggaacattcctgataggcttggtggtttgaaagcaataggggtgcttgatctgtctcataatagtcttaatgggtccatccctggggcattggagggtctttcttttctcagtgaccttgatgtgtctaataataatctcactgggtccattccttctggaggtcagttaactacttttccagctgccagatatgagaacaactctggcctttgtggggtgcctttgtcagcgtgtggggcttcaaagaatcactccgttgctgttgggggttggaagaagaagcagcctgctgcagctggggttgtcattggtttgctttgcttcctcgtgtttgcacttgggcttgtgttggctttgtaccgagtgaggaagacacagaggaaggaggagatgagggaaaagtatatagagagtcttccaacttctgggggcagtagttggaagctatccagctttcctgagcctttgagcatcaatgttgccacctttgagaagcctctgcggaagctgacgtttgcgcatcttcttgaggctactaatggtttcagtgccgagagtttgataggttctggggggtttggtgagaagctcattcacgtgacgggtcagggagatagggagttcatggctgagatggaaactattgggaagattaagcataggaacctggttcagctgctgggttactgtaaagttggagaggagaggctgcttgtgtatgagtacatgagatggggaagtctcgaggctgttttacatgagagagcaaaaggaggaggttcaaagcttgattgggcagcaaggaagaagattgccatagggtcagcaagaggtctcgcatttcttcaccatagttgcattcctcacattatacacagggacatgaagtccagcaatattcttcttgatgaaaattttgaggccagagtttctgattttggcatggcgagattggttaatgccctcgacactcatctcactgttagcacacttgccggaacacctggttatgtaccccctgagtactaccagagttttagatgtacagcaaaaggggatgtctatagctatggtgtcatactgctagagcttctatcagggaagagaccaattgactcttctgagtttggtgatgatagcaatcttgttggatggtcaaagatgctttacaaagagaaaagaattaatgaaatacttgatcctgatttaattgtgcaaacatctagtgaaagtgaactattacaatatttgagaattgcttttgaatgtctggatgagagaccataccggcggccaaccatgatacaagtgatggctatgtttaaagagcttcaggttgacacatttaatgatatgcttgatagcttctctctgagagacaatgttattgatgaagcatga

SEQ ID NO: 113382 - DNA, 717 bp, Glycine max
  Peptide Sequence Number=SeqID_230160
atgaaaaattgttccaattggtggttttggttcacaaagttgagtagaaaagcttgcatcaagaaagtattgcttagtaattgtctccaggaactcatggagcttcaccaggaaagtgaagaagaagtcacagacacagagcaagccgaaaactggttttctttgacttctgctcaacgcatatgtgacatgtttcttgctcttgataaagatacaaatgggacattaagcaagcaggagctgcgagaatatgcagatgcaactctggctgacatttttatcgagagagtatatgatgaacatgttcgtcgtggaaagagtggtggtggaaatgcccgagagatggattttgagagtttcctggactttgttctggctttagaaaacaaagacaccccagaaggcttgacttacttgtttcgatgccttgatcttcaagggaggggttacctcactacagctgatgttcactcccttttcagagatgtacaccataaatggattgagggtggcaactacgaactttgtatcgaagatgtaagggatgaaatctgggatatggttaagccagcagatccactcaagataacattggcagacctactggcctgcaaacagggtggaactgtagccagcatgctcatagatgtacgtggtttctgggctcatgacaatagagaaactcttctccaggaggaagaaccagaagaagaataa

SEQ ID NO: 113383 - DNA, 1065 bp, Glycine max
  Peptide Sequence Number=SeqID_230161
atgtcaacctcgagaacctcatcagatacagccttcaaaggatatgacccgagccaaactcaaatgtgtctgtctctccttcaacgcaacacatctccttgtggtgagagaagaggtagaaggaagcaagcagaaccagggaggttccttggtgttaggaggcgcccttggggtcgatatgctgctgaaattagagaccccacaaccaaagagaggcattggcttggcacatttgacactgctcaagaagcagctcttgcttatgacagagctgctctgtccatgaaaggaagccaagctagaaccaactttgtttactctgacaacatcaacttccacactctccagctttctcctatgaatgttcaagttcaacctctcttgccagcttcacagacgttcttcaccaacaccaccaccaccaccactcagaccaaaacaccaaccaaccaaaatagcctctctcagattattcacagtgcttcaaactgtggaaacccctccccattgaacaatgacatgtgtgttgaaaccacatatgggtcagctcaggatgacaatttcttcttttctagtgattctaactcgggctatctggaatgcatagttcctgataactgcttcagacctgcttcatccagttccaacagttcaaactccagaaagagcaatgtgaatgatcaaaagactaacacaagctccatggagagtactaatcatcatcatcatcatcagttctcacatgttgatcacatgacttcgttctctcaagaagaaggcattaatgaaatggcaccaagggcctcttataacttatcagatttgagttatcaaagtgaagtgagtcaaggatcatgggattggaattgcagtgaactttcagctatatttaagaacccaatgagggtggaaaatgggtgcatggatgatgcattgtacccaataaatgatagtcctactagtccaagctatgggctaatgaatgaggctggttcttcttctacaacctgttctccatcacttccaccctttggggacgtagacttgggatacccactcttctga

SEQ ID NO: 113384 - DNA, 1698 bp, Glycine max
  Peptide Sequence Number=SeqID_230162
atggcaaactatgcctactcgatgcttcatcatttgcacattccagattccttctcgtggggttgtgtgattcgattcttctctcaaaagtgtctattcactgaagctgtttctctctatgttcaaatgcacaggacgagcttgtgtccaacttcacatgctgtatcctctgcactcaagtcatgtgctaggattcatgacatgttgtgtggcatgtcaattcatggacaagttcatgtttttggatttaacacttgtgtttatgtacaaactgcccttcttgatttgtattcgaaaatcggtgacatggggactgctcgaaaggtgttcgatgaaatggctaataaaagtgtggtttcatggaattctttgttgtctggatatgtaaaagctggtaacttggatgaggctcaatatttgtttagtgagattcctgggaaggatgtcatatcttggaactctatgatctctggatatgccaaagcaggaaacgtgggtcaggcgtgtactttgtttcaacgaatgccagagaggaacctgtcctcctggaatgcaatgatcgctggtttcattgattgtggaagcttggtgtcagcaagagaattttttgacacaatgcctaggaggaactgcgtctcttggataacaatgattgctggctattcaaagggtggggatgttgactctgctcgtaagctctttgaccagatggatcacaaagatttgctctcatataatgctatgatagcttgttatgctcaaaatagcaaacccaaggaagcccttgaactatttaatgatatgcttaaacaggatatatacgtacatccagataagatgactttggctagtgttatatcagcatgctcacaattgggggatctggaacattggtggtggattgagtcacatatgaatgactttggaattgtattggatgatcatttggctactgctttaattgacttgtatgcaaagtgtggaagcattgacaaggcatatgagctattccataacctgagaaagagggatttggttgcatattctgcaatgatatatggatgtggaataaatggaaaggcatctgatgcaatcaagttatttgaacagatgcttgcagaatgtattggtcctaatttagtcacctacactggactcctaactgcttataatcatgctggattggttgaaaaaggttaccagtgctttaactccatgaaggactacggacttgtgccttcaattgatcattatggcatcatggttgatctctttgggagggcaggatatctggatgaagcatacaaacttatactgaatatgccaatgcaaccaaatgctggtgtttggggagctctacttcttgcctgcagattacacaataatgtggagctcggggaaatagctgtccagcattgcattaagctggagactgatacaacgggttattgttctcttctttctagcatatatgctacagttgaaaaatgggatgatgccaagaagttgagaaagggtatggaaggaaaggatttcactggatgtagttggacaagatctgaagctcttggttccgttctacaacctcgggcttggcctttcttccccaaccatttcttaacctttcactctctcttatgcatatcaagcatgccttcatcctggacttgtgattcaacatgcaggaaacttgaataa

SEQ ID NO: 113385 - DNA, 2253 bp, Glycine max
  Peptide Sequence Number=SeqID_230163
atgtttggcttttctcgtcgccgtatgaaacttggaagattgaaggtgcagctttctgaggccaatcccggaaccagaactcccgtcagacccccaaaacggaacggaacggaaattggagatgcagctggagggtctagtggtcattctgatgaagttgattgccagccttcaactgagataactagttgtggcagctcagagaactggatggtcttgtctattgccggggataaacccattcctagatccaatgtctgtctttttctgcaactattattacttgtgtctttcaagcatgcagcagcagtcattgggaataagatgatagtcgtgggcggcgaatccgggactggattgttggatgacgtgcaggtgctgaattttgatagattttcgtggaccaccgcatcgtcaaagctttacttgtctcccagcagtctgccactgaaaattccagcgtgcaagggccatagtttggtatcctgggggaaaaaagcactgctcattggagggaaaacagacccaggaagtgacagaatttcagtatgggcatttgatacagagacagagtgctggtcactcatggaggccaagggggacataccggttgctcgcagtggtcatagtgttgttagagcgagctctgttttaatattgtttggtggtgaggatgcaaaaaggaggaaattgaatgatctacatatgttcgatctcaagtccttaacatggcttccacttcactacacgggaacagcaccttctccaagattcaaccatgtagctgctctttatgatgataaaattctttatatatttggaggatcatcaaaatccaggaccttaaatgatttatattcacttgactttgaaactatggcatggtcacgagtgaagatgcgaggttttcatccgtcacctagagctggttgttgtggtgtcctttgtggtactaaatggtatatcacaggtggtggaagccggaaaaaaagacacggagagactgtgatatttgatattgtaaaaaatgaatggtctgtggcaatcacttcgcctccatcttctatcactacaaacaaggcatgcctattattcatctgctgtcacctacttgcctcactactttctataatggaagaagcatttctagatgccttatattttggtttcagcatggtactcgtgcagcacaaggaaaaggattttcttgttgcatttgggggatccaaaaaagagccatcaaatcaggtagaggtgttgataatggaaaagaatgaatcagcactagggagacaatcagctcccagtaaatgttcagcatctgtactacttgaaaaacattcatcatccactagattggccccccaacttaatgattgttctcaacgtttagttgactcagttgctagacaaaatctagcttctgcaattgaacatggttccggcaggagatctctatcagaatccctggttgttgatcccaattttcccccaaccaacacctcccttcgtaagcaatttgatcacgatgaagaatacaatactgatctcaagatggacaagaactcagatgaaaattctttccctcgggcagtagatcacagaacaaacgaaaatgaccatggtaaacagatgaatagtagtggagccaagaacattacggaggaacaacaggcactgttatctggaattccaatccaacaaaacctagtatttgaaaatgacatgctagaaagtgataacgtgtcatttactgaaaacattaaatcaggatcactgactacttcaaatgtctatcattgctatgaaagtaaattggcttccctgataaggaaaaatggaattctggagggacaattagcagcttccttagcaagcaaagaagccgcagagaaaagtttggcatctgttctcaaaagtagacaggaaatggagaggaaattggcggaatcacataaggagatggaattgatgagagagaagctgaccagtctagagttggcccaggaagaggccaacaacctatcaaacattgtgcactctgacaatgtacggcttgagcatgatgtggccttcctcaaggctgttttagatgatacacagaaggagttgcactcaacaagaggagttattgcaggagaaagagcaagagcattccaactacagtatgaagtttttcatctcaaacagagattgcaatcaatggaaaatcgagcatctactacaccgagaaaaccgttccatgtgcagtga

SEQ ID NO: 113386 - DNA, 2295 bp, Glycine max
  Peptide Sequence Number=SeqID_230164
atggaagaaacatttgttcccttacgtgggatcaagaatgatctcaaagcaagaattccatgctacagacaagattggaccagtggattccaagctggaattaggatccttgccccaactacatacatattttttgcttctgcaattcctgttatttcttttggggagcaactggagagaaacactgatggaagtctcactgctgtgcagactcttgcatcaacagcactctgcggtgttattcactcaatcattggaggacaacctctcctcatactgggtgtagctgagccaacagtcttgatgtatacattcatgtataactttgctaaggatcgcaaggatttgggacacaaactattcctaccttggactggatgggtgtgtgtttggactgccctgttgctgttcttgctggccgttcttggtgcatgttccataatcaatagattcacacgcatcgctggtgaattatttggtctgctaattgcaatgctctttatgcagcaggctataaagggtcttgtggaagagtttggtgcacccaagaaccagagagaaggtaccaatcaggttgcacttcagtcatcttggctgtttggtaatggaatgtttgctttagttttgtcatttggtcttctttttactggtctacaaagtcgcaaggctagatcctggcgttatggctcaggttggctacgaggatttatagctgattacggagtcccactaatggtcctcgtatggactgcggtgtcttacataccagtcaatgaggttccaaagggaatccctaggcgacttttcagtccaaacccatggtctcctggaaatgttgaatgtgccccccttatatattgttggagcatttataccagcaactatgatgcagtgctttactactttgatcacagtgttgcatcacaacttgctcagcagaaggagttcaatctaagaaaaccctcatcttatcattatgacttgctgctcttaggatttttgaccatattgtgtgggcttattggaatccctccttccaatggtgtaattccacaatctccaatgcatacgaagagcttggctactctaaaacatcagcttttacggaataagctcgtatctactgcacgaaaaagcatgcggagaaatgttaatttgagccagttataccaaagtatgaaagaagcatatgatgaaatacagactccattggttccccaaatgccacttaccttggtaaatgtgcttccatggtttccaattttgaaatttgtgatattctttctccttatccttggtttgttcatccagcaggggctgaaagaactgaaggaatctactattgaactggcctcgagtcaaggatatcttgatgcccctgttgatgagcttgtctttgatgtgaataaggatgttgatgacctgttgccagttgaagttaaagagcagcgcctcagcaatctactgcaggcattgatggtcgcagcctgtgttgctgctatgcctgttttgaagaagataccaacttcagtgctttggggctactttgccttcatggccattgaaagcttgccaggaaatcaattttgggagagaatattgtatcttttcactgctccaagtcgaagatacaagctgttggaggaataccatgccacctttgttgagaccgtgcccttcaaaacaattgccatgtttactgtgttccagacactatacctgcttctctgcttcggcataacctggataccaattgccggggtccttttcccattgttaatcatgcttcttgtcccagtacggcaatattttcttccaaagtttttcaaaggtgcccatcttcaagagctggacgcagcggcatatgaggaagcacctgctattgctttcaacatgtcctttgaaacaacacctttgaatacttgcatcacatatatctggcaaagctcttgttcacagtttaacgtctataatccttggcagggtccaagtaaccaggcaccaacagtcaatatcagcggtggggaaattcttgatgaagttattacaaggagtcgtggagagtttcgccacactcaaagccccaaaacaacaagttcaactccaacttcaatgggagatataagaccagctaatagccctcaattaacaaggaggatttctagccctccagtaactgaattgagaggggaaagcagcctcagaccaaccaggaaggagatcaagttaatgcaaacacctagtccacggtcaccaggtcttggaaaagttaccaaagattcaccttcaacctaa

SEQ ID NO: 113387 - DNA, 808 bp, Glycine max
  Peptide Sequence Number=SeqID_230165
gttgttgattcaactggtggaacaatatggattgaggaagtggtctcatattgctaagatattgcccggaagaattggaaaacagtgcagagagagatggcataaccatctaaggcctgacattaagaaggacacatggactgatgaagaggataaagtactaatcgaagctcatgctgaggtaggaaataaatgggcagagattgctaaaaagttgccaggaagaactgagaactcaattaagaaccattggaatgcaaccaagagaaggcaatattccagaagaaagtgtcgctcaaaataccctagaggcactcttctgcaagagtacatcaagagcttgaacttagacaagaaccccccaagagattataggagaaaatcttcttctaattattctagtgccatcatgagtaacaacgaaaccaccacaagcaaagtcagtacgactgcaccaactttgccccagacagcatttcaattttgtgctgccactgattgcttggcaccaaactatgattttaatgtggtccctgatttcttctttggcgagaatttctttgaagaagggtgtagcattgattctcttctggatggtgtgccttgtgctcctcttatggataatatgaaagattttgaaggaaaattgcaatgtgatgatcgtacaatgtgtgttccttttgttaatatcgatgagaatcatgttgagacagagatgccacttgagatgatgggggttgaagtaaagaaggagctggatttggttgagatgatgtctcagattagtaatgaaattcttcgtgtgtga

SEQ ID NO: 113388 - DNA, 1530 bp, Glycine max
  Peptide Sequence Number=SeqID_230166
atggctccttctaggaaatctagaagtgtaaataagaggttttctactgttcgtgaggctgcatctagtaaagacaaaattacagagaatgctagcaaaaataggctgaaggtgagtcctggtattcagaagaagagaaaattggctgacatgttagggccacaatggaataaggaggagcttgagcatttctatgaagcttaccgtaaatatgggaaagattggaagaaggttgctcttgcagtgcataatagatctgtggaaatggtagaggccctgtacactatgaatagggcatatttatctcttccagagggtactgcttctgttgttggactgatagcaatgatgacagatcattatagtgttctgggaggaagtgacagtggtaaagaaagcaatgacgatgcagaaatatctaaaaagtctcaaaagcgtttgcgaggaaagcatctaagtgacagtaaagcattagaaggccacttttcagatcattctcagtcacattctgttgcatcaggtgatggttgcctgtcattgttgaagaagagacattctggaattaggcctcatgctgttcgaaaaaggactccccgtgtccctatttcatattctattggtaaagataatggggataggtttttttcatctgccaggcagggctccaaacaaatggttgatactaatgatgttgctcataagattgcattagcattgacagaggcttcacaaagaggtggctcttcgaaaatttctggatcaccagacaaaaaatttgtgccttcactgggtctgaaaagtgggaagaagcatcctaaatcagaaatagctggagcaaacttttgcagttctgatttggatgatggtagttctgagttgagtttaggaagcacagaaggaaataatgaagattattctagaaaaacaattcatcggagtggtagagaaaatactggaagagaaaggaatcaagaaaagaaaattaaaaaatatgggaagaattttgagacgggagagaatttaaacaagcatttgaatgacgtaaaggaagcctccagtggaacagatgacggtaaaaatcttagttttatcaaatcggattttgtcacagattttgcagatgcgaaaaatgcaaggtcctcttacaagggttccaggacgaaaagtaaaaagctacggttagagaaagatgaaggttctgcttttgatgctctgaaaactttggctgatttatctttgatgctgccagtaacgaaccctgataccgagtcatctgcacagttcaaggaaggaaaccatgatgctgttgatgaatctaaaatggaaacacataaagtatttcctaggattgaaagcactgcttcaagtaaattgggcaaggttttttctgataatggagttgctgttcctgaagcagaaggagcacaccagcttaatgcaggattcaggaaaaggaaacaaaaatcttttaacttgaaatacgatgaaattcatactggttctcatttaagtggttcccagaaatccaag

SEQ ID NO: 113389 - DNA, 439 bp, Glycine max
  Peptide Sequence Number=SeqID_230167
atgaatgataatataactttagtattgcaccatggaggaagattcactccacgtgccagtgatggaaaggttgaatatataggcggagaatttgacgtttgggaggatatatctgcagattgcctgaatgcatttatcttatatgatctggtgaaagcttgtaagaagtatagtaatataggagaatgtttttggttgattgataaggacttagattttaatcatgggttaaggagttgtacaactgatggagatatattacacttagttagggatgcttttgaaaatgagaatgagataaatgtttattttcatcatgaagtagatccaattttagaagaagtcccacaaatgttgtacttggaatgttatccaattcgaaaagctgttgagaatgaggatgatttagatgatgtacctgttgctggccatgaggaag

SEQ ID NO: 113390 - DNA, 382 bp, Glycine max
  Peptide Sequence Number=SeqID_230168
atggatcttgagacaatgttcaaagaaagctatgtctcacagccaatggacttacaagaaagctgcttgcaacctagcatgaaagatatgcttccttttgggaatcttccatctcatggattgtttcaagattttcaccatattgatcagtttcatcacgtgaatgtctcctcatccatccaaactccaaattttgatgtttttgacaatttcaccattacaggttcatcacctgatttcgatttttatgagtttaagccttttgtggaggatggtggtaatgggcatgggcatgctcatgttatggacaatttcctttatggaaattatagcttgaacctccctccaaggaatcaactagatatgatggttgcaaatcaaa

SEQ ID NO: 113391 - DNA, 840 bp, Glycine max
  Peptide Sequence Number=SeqID_230169
atggttttttcttcaagctccaaatcacaaccaaaagttgtgtgcagtgagattggaattggtaatgcccaactagcatcaagttctcaaccgtcccttcttgatcatgtccattcaaaagaagctgacatattagccatttcagagttgaatcgtgctctagacaaaaaggaacttgtattgtctgaactgaagcacatgaacgatggggtatcagagagccagaaatatggagacaactcagtaaaggattcagaaccttttaagaggaattatgcttcagtttcttctgccttgttttgcttgaggcaacgcaacacatatcaagcaagctcctctgttttgtcattaaagcccatggctaattttgatgatcctagtggtcaggccagctcttccaattgttcggcttgccacaaccaagaatctatatctcaaagtcatataactgagattgttgaaagttctagaagaaaagcaagaatgatggttgttcaagctacacaggctatgtcaaatttaagaaagacagaaagtaaggttgaaagaattgaggatgcaataaattttatcaataaccagctttcagtggacgaacctactgcttcagccacaacatttcttcctacagattctttttctctggcttctcaggatcaattgactgccagcgtattaaaccccttggcaagttgtcatgtacaagatgctgaacttaacagttcatctgatcaaaatgaaatgaaaattccctcagaactcatatctcattgcctagctacattgttcgtgattcagaacaaacagtcaaacaccaaggtggaaattgcagcattctaa

SEQ ID NO: 113392 - DNA, 178 bp, Glycine max
  Peptide Sequence Number=SeqID_230170
ggaaggtggtcagcgaggaggtgaaggttggcgtgttgtaggcaatgtagaggagtccgttgtgcaagacggagaggccgaagtcaaagacgttgaggtcgttgacggcatccagaaggatgttcatgggcttgaggtcgtagagggcgtcatcatggcagtggcagaaggaggatga

SEQ ID NO: 113393 - DNA, 141 bp, Glycine max
  Peptide Sequence Number=SeqID_230171
atggcctcagcaaacttcttattcccagaaggaaattcaataaataagcctcctatttttaatggagaggtgctaaggatatgtgggacactctacaagttacacatgagggcacaactgatgtcaaacgatctaggataa

SEQ ID NO: 113394 - DNA, 633 bp, Glycine max
  Peptide Sequence Number=SeqID_230172
atggacttcatagttgggttaccgacataccgcgacaacacctgcattctcatggttgtagaccgcttttccaagggcgttcatctcggcacgcttcctttccatcacacatcacaaagtgtggcccaactattcatggaattagtgggcaaacttcacggcatgcccaaaagcatcacttccgatcgagacccgcttttcatgagtaaattctggcaggcactattctccctaagtggcactaaactcaggatgagttctacttatcatcctcaaacagatggacagaccgaagtagcaaatagagtcattgaacaatatttgcgtgcattcgttcaccggcggccaatgcgtgggggcgtttcctattatgggctgagtgtgacctttggccgcaaaccaccgagctttctgcagtacctgacgggtacctcaaagattgaggcagtagacgaattgcttagtcaacgggaattcatatttgccttactccgtcagaaattacagaaagcccaggctcgcatgaaagctatcaccgacgaacaccgccatgatcatgagttccaggtgggagaacgggtcctggtcaaactctgcccatattgccagaccacagcctcaagtacaagctag

SEQ ID NO: 113395 - DNA, 699 bp, Glycine max
  Peptide Sequence Number=SeqID_230173
atgacttcgaagttcgacgagcttctccatcgtatgaatcaattggagacctcacataccaatcctcacgttccatcagcatttgttggcccttccttcgccgcaactacaaactctgcctatcggttgaaactggaggttcctcgcttcgatggatccgatctagagggatggatattcaagatcacacaattctttgaatatcacgtaacaccaaaccatgatcgtctcacaatcgcttcgttctacatgaaagcttatgaggatcctactggtgtattgtgtaaattgacgcagcggtcaactatttctgcttacctttcggagtttgaagctcgtgctcaccgaatcatcggccttccagcgtcgtttgtgctcagttgttttgtatcgggattgagccctgctattcgacgggaagtgcaagtcatgaggatgagtgtccctaggaactcgatcccggacccttgtcgccaattcctctttgttcctctcaagacacgtcaccagcgagttggtctcctccctgaattcactccctcaaaatacttcgacgttgcgagtaatggtgggcaatggggaggaactgcagtgcaaccagtggctcaaatcactggggcctgtcctaacggactatacatctcttactatgaaattcatttatggtggcaagttgatcgagcttacaggggatcgtga

SEQ ID NO: 113396 - DNA, 132 bp, Glycine max
  Peptide Sequence Number=SeqID_230174
atggcagggcatttgtcagatgttgatgtggctgctgttgaatggggcctctgcatccctttctccttggatcctagtaagggtctccctagtttccatgataatcatcaaaatactgatagtgatgaatag

SEQ ID NO: 113397 - DNA, 356 bp, Glycine max
  Peptide Sequence Number=SeqID_230175
atgtgtgtgcagtggcatgtcaactgcaactacattgctactggctccagtgacaaaacagttcgattatgggatgtacagagtggggaatgtgttcgggttttcattggtcacaggagtatgattttatctttggcaatgtctccggacggtcgctatatggcatctggtgatgaagacggcaccatcatgatgtgggacctctctagtggctgttgcgtcacgcctttagtcggccacacctcatgtgtctggtcactcgctttcaggtctcttctagcatctggatccgcagattgcacagtcaaattttgggatgtaactacgggtataaaggttccaaggaatgaagaaaa

SEQ ID NO: 113398 - DNA, 1155 bp, Glycine max
  Peptide Sequence Number=SeqID_230176
atgatgaatcacttgtttcagtcgtatctgcgaaaatatatcatcgtcttcttcgatgatatattgatatacagtcgaaacttcgaggaacacttgaatcatttggagaccgcatttcaggtcgtaatggacgacaaattcactcttaagatagctaaatgctccttcgcacagaagcatatagaatacttggggcacattgttgccggcgatggcgtacaacccataccggacaaggttcaagccattcaacggtggccgcaatcacgcactgcccgagccctgcgtgggttccttggccttgtgggattttatcgcaggttcataaggggttacgctactatggccgcacccctttcaaaattattgaccaaggcagaattcgtgtggtcaccagaagctggggatgcctttcaaactcttaaggatgcaattactaagtccccagtgctagcacttcccaatttcaataaaccctttatggtagaaatcgatgcttcgagctcaagtatgggggcggtactctctcaagaaggacacccaattgccttctttagtaaacaattttgccccaagttgctccgatcttccacctatgtccgtgagctcgccgtcatcactaccgccattaagaaatggcggcagtacctattaggtcatcactttgtcatcttaactgaccactggagcttgaaggaacttatgagtcaggtggttcaaacacctgaacaacacatgtacttagcacacttactagggtttgattatgttattcagtatagggcgggcaaaaccaatgtggttgcagacgtgttgtcacgctcatcgaggtcagctaatgcctcattcttcattctttcgatgccacattttgtcttccttgaagacttatgtaaggagctgcagtcacatgatgaatttgtgtctttgagggaaaagatccgcacccatcctgcagcatatcctcatcattcgttgacttcccatttcattttacatcagggtcacatttggctgcactccgattgctctttcatcaagatcttgctcactgaatttgatcaatcaccaattgggggtcacatgggccttcagaagaccttgaatcgtgtcgttaaaaacttcacttggaacaccatgaaggttgacacttaa

SEQ ID NO: 113399 - DNA, 912 bp, Glycine max
  Peptide Sequence Number=SeqID_230177
atgagtagtgtcgagttgataaagcccatggactctcatctggtgccacaaggtgagggtttgattcaagaacaacacaccaaatggaggtatgttgaacccttaacacacagaaaacaacccaaaacgagtgctgacttggtggcaaactcgagagtctaccgagtttgcatagagtttacagagaatctactaaaaagcgagttgcatacaagtcaactcacagaggaagactgtgtagataagactgggtccttgctttcagacacagaaaagggtgaaggggaaggcaaagagggagagaatgatgagattaagaaaaggtcaattgatggaggaaagcaaggtagttcaataaaaaaggcaaaaaaggacaaggctggcagtgcaacagggaaaaatgctaaaccagaagctaacactgtatctgcagcacctcgcattaaaccagagctacccttgcccacattgtattctcccaattcaactgatgtagaactttccatcctagaagatttaaggaatcgtgtacaattgagtagtgttgctctcccttcagttaacttctacacaattgtctgggatatggcgaaacttgaaaaacaacccaccacttctttttcacagggagggaatgacacatcacaaaatgaacaaaatattgggcaaaatagtgggaaaagactgtgcacattgtttcaaggtcattcagggccagtttatgcggctacttttagtcctgctggggattttattctttcctcttcagcagacaaaacaattcgattatggagtacaaagcttaatgccaatcttgtttgttacaagggtcacaattacccaatttgggatgttcagagaaattgtgttggtacaaaagataatgtaagaaagagagatgatgtgggataa

SEQ ID NO: 113400 - DNA, 381 bp, Glycine max
  Peptide Sequence Number=SeqID_230178
atggatgaagatcaaatagaaggttgtgtgagtgggtacctcaagcagaaagggtttacgcaaaacgatgaccaacttcaactcaccaacaccgattcatctcttcaacccgacactctcaatcgcgcccaattggagagaggttctgctagataccatgatgggtatggtagactaagatcatgggcatacaggtcacttgactcatacaagttctgtggttattacacattgtttgcctcttcttctttgcagcatgagctgctgcgtgtgctttttccactatttatccattgcttcatggatcttgtggcaaaagggaatcttcaggaagggctgttagcctttgctaacagcacttctctagcattagatatctga

SEQ ID NO: 113401 - DNA, 1071 bp, Glycine max
  Peptide Sequence Number=SeqID_230179
atggggggtcgtttaacagtgactagcaaagaacattgtggttctaccttcacattcatacttccatacaaggtttcaacagtttgtgatgattctgatgacccagatgagctctcagatgtggatgataatgatgacgatacaacagaaggcttcttccaattccaacctcgcactttgggctctctcttctcttctaatggacctaccaggccacaaaatgtactaccgggattcagaagctcacacaacttcaatggtttttcagagaattctttctcattcctcactaccaacataatatcaaaagggactaattcaaccgaggatgcttcttcagtcattgttgatgctccagagatgtctgaatcaacaggttcatcaagtcacagccctcaaacaaagcatgaaaatgtagttaacacaaacaaccagaatcaagataaggcacatgctcggttacagaatggtagtgtagactcttctcaacataaggaggcaatgactctaggaacaatgtcaagtgaaccacaacaaacatgtcaaggtcaagtgaagacagacataacctcccaaagtgttattaagagtaataaatatacatcatcagaagtaaccaaatccacattagggcctaagattcttcttgttgaagataacaagatcaatgtcatggtgacacagtcaatgatgaagaggttaggatacggcatggatgttgtgaataatggagtggaagccgtacgtgcagtgcagcgccatacttatgatgtcattttgatggatgtttacatgccagttatgaatggtcttcaaacaacaaaactgattcggtcttatgaggaaacaggcaattgggaagctgcaagagaagctggaattgaacaatgttcaccagcttcaaatgaatgttctgtaccacttaaaaaccggatccacatcattgcgatgacagcaaacacaatgtcagagagtgctgacgaatgttatgcaaatggtatggactcatttgtgtcaaaacctgtgacattccaaaaactgaaagattgtctagaacagtacctgaggtga

SEQ ID NO: 113402 - DNA, 345 bp, Glycine max
  Peptide Sequence Number=SeqID_230180
atgacattgaccatcccacaactttttcttaagctgttgcaggtgtcgtgggatgctaccatgtttggggtgcataatgataactttccattgtatataaagcaggaacatctttctgaaatagcacatgatggtcaatgtctgagcatctctgttatacaattgtggattttgcatatgactgaaacaagtatgcgagcagggaatatcgatgtgtatggattcctcgagccatactccatacaaaaatttgggcaatcgcaatttgaatcagaagattatattaagaaatggatgcagaattcactgagagatgtgtacctaggagcctacttgaatgggtaa

SEQ ID NO: 113403 - DNA, 237 bp, Glycine max
  Peptide Sequence Number=SeqID_230181
atgttgaatccagctcagtttcaggtcaaagaagagaaggtaaaagttgttgatgactcgcttagcgaggcagattggctaagcgagatgcatccgcttagcaggacatccagctcgcttagcgtatgggaaaccctagaagaggataagtcagatatctgcacgcccagcgcgcagccagcccgtccaacgaggacgttgtctcttctcacgcttagcgcgcccaagctcgcttaa

SEQ ID NO: 113404 - DNA, 531 bp, Glycine max
  Peptide Sequence Number=SeqID_230182
atgagaagcattcctattcctccaacaaccacaaccaatacattagcaccaacaagttctacagtggtggtggtgacaacaatgacaacgatgacgaacaaaacctctgttccttctgcatggcactctccagtgccctacctcttcggaggcctcgctgccattatggctctcatagccttggcactgttgatgctcgcttgctcctattggaggctcacacaagagagtaataacaataacaacaacaacgtggtgaaagagggtgatgatgattctgaaaagaaggaacagcctaaggtgtacgaggagaagatcctagtcatcatggccggggatcacaacccaaccttcttggccaccccttcatcctcctttggttgttgtagcaatttcgatcacaaaaaacacctaggaaattccgaggattccaacaactcctacaaagaaactgtggacgaccatgttgttttgaatgctacacatgaaagtggaagtgctcgacatgatcaacatagtgaaaatttatga

SEQ ID NO: 113405 - DNA, 981 bp, Glycine max
  Peptide Sequence Number=SeqID_230183
atggattctgcaagggatgcgagtggtgtggcagggaccgtgctaattcccatgcggtttgtgtggccgtacgggggaagaagtgtgtatctaagtggttctttcacgcggtggtctgaacttctacaaatgtcgcctgtggaaggctgcccaactgtgtttcaagttattcatagcttggtacctggtcatcatcagtacaagttttttgttgatggagaatggcggcatgatgaccttcaaccttgtgaatctggagaatatgggattgttaacactgtttcattggctactgatcctaatattttacctgttttaactccagacatagtttctggatctaacatggatgtcgacaacgaggcttttcgacgcatggtccgattgacagatggtacattaagtaatgtgttattgccaagaatatctgatgttgatatacagacctctcgtcagcgtatttctgcattcctatctatgagtacagcatatgaattacttcctgagtcaggcaaggttgttaccttggatgttgatctgcctgtgaaacaggcatttcacatactgcatgagcagggaattcccattgctcctctctgggacatctgcaaggggcagtttgttggagttcttagtgccttggattttattttaattttaagagagctcggaaatcatgggtccaatctaacagaagaggagcttgaaacacataccatatcagcttggaaaggaggaaaatggacaggatttacacaatgttttatccgtgcagggccatacgataatttgaaagagattgctgtgaagatcctgcaacatggaatttcaacagttcctattattcattcagaagatggttcatttccacagctactacatcttgcttcactttcaggaatccttaaatataagcttgatacttaccaaattgatttttcaggcatttgcagctcaagtaagttcaataccaatagttga

SEQ ID NO: 113406 - DNA, 760 bp, Glycine max
  Peptide Sequence Number=SeqID_230184
atggaaataaaaattgggcgaggcaaggaaaggcaaatgcaagccaatattgagttcgaggaaggagaggctttcttctgttataaggatgatgatgacgacgacaacactgaccttgattctctctcttacattaaattcagcactataatcgtaaagattttgaaaaataatgtattggcaactgacaaacaaaggactaataatttgcttcctgttctattcaaggatgagaggattcagcatgctctgggtcattttcgaaaggaatttgaaggaggtgtttctgctggccgtttgggtgcaaaatttggtgactatggctcctttttacctacctgtgaacactctcctcctttgcgatcttgttcaaagactccacaaaagcacaatagttcaccaaaatctcctagcaatctccacatggcggctgcatttcgtaactcaaaagcacttccaaatatgcctttttctatgagggttggaactgcttcctatgaagctccaccatttcgtaatataagagtaccttcagcagattactcagtaaagaacacagatatttcctccaatgaagtaatagagaagttcactttgaaagactgtgcaaataagtcagaaattttgactgaccaaagaacactgaagttgcgaatcaaagtgaaatcagatatcttggcaaaaaagaatgcagcaatttatagtggtcttggactcgatgactctccatctccatcaatggagaacagccatgaggaaa

SEQ ID NO: 113407 - DNA, 2159 bp, Glycine max
  Peptide Sequence Number=SeqID_230185
atgacttctttcactatccctggaggtgtgctaatatcacctctacatgacagtctcctgtacttgataagaaaggaaaaagctcttggaaacatcaaacccatgtcttctcttaatggtaattccgtgtctattaatgaatcagattcttttgtgggggatggacatttgttgaagaaaaggaaagtgacagtggtggaccaaagtcacaagcagcatatgaatggtaactgttctgagaatgatatgacattgcatacgaagaaaaaattaggaaatagaactccggatcgtaaggactttctatctaatgacctgagatgcactccactgtcaagctcaatttgtgatgctggtgaaacagctgaagtcactgttaagggttttgaagtatccaaggaggttgatggtgtgaaatgtagaatggtttccactgaagcagtgaaggaggattcactagagtcaatatctggtcaggattttgacaagattgagaagcaaaatacagggagtggctttatgaaaaatgttttagagcataaaatgataatttctcagaataataattctactaatcctaagactaatagcaagtgtaacacatttgcaatttcaaaaaggatcaagtgtgatgcattgaaatgtaaggtggatcaagatactcaaaagtgtgaaactaatcaggaaggaaaggtgaaatctgaaagcaagaatgagtcaaaaggtgaaaggagtcctggaaatgttatgactcttgctgaaaaagatagcattggtactagtaataatgcaatggtaaatgatagaaagagaacaagcattgatgttacttctttgaaaagtaaaatgcataaaataaagtcactgaaggttaataaggtcagagattgtgacagagattcattgaaaggaaaaaaatcacaacagaaagttgatagaataaatccaactgatgggcctactcttaataaggccacagtaaattctagccttgatcacgttgataagagtgcatatagggttaaaggaaatgaaagaccaagtggcaataaagttgttaaccagttgtcagctgggccatgtgtaaaagatgcaccaggtgcatttcctattgctgaaaataaaccaacttctgaaatggttctgtcatcagaagcagcaacacctcaagttatcgaagaagattgggtatgctgtgacagttgccagaaatggcggcttctacctatgggtttaaagcctgagcagcttccagagaaatggttgtgtagcatgctatattggctgcctggaatgaatcggtgtaacatcagcgaggaggagacaacaaaagcactttatgctttgtatcaaatgccaatttctgagggtcaaaataacatgcaaagccatgccgctggacctgaaactggagtgggatctgttgatgctctgcaacttggcctgaatcgcaaaaagtccagttctgatgtaatgcttgatcgaggaaagaagaaacatggtattaatgaaaagacaaggtcaggagtcaataatgacatgcatcggttgtcaaataatgctcaagagtctgttaaaaatagaagcttgaatgagatgaataagcagtctacagactcaaaccgtataaagaaatctatttctaaacattcaagcaggttgaacaatttgatagaagaaaaaaacacacctaaggtgaaagaaaagcaaatgaatggaggtgacagaaatcatgttagattgaaacgtaagatggaggataatcaacatggatctggaactcctaagaaatctaaggctgaagatgtttgctatgctgataaaccactgaatcctggcatggaatttaaaaaggtgggtctaatctcaagaaatagtttaccaacaaaggctagtgggagaaatatgaggaaatatgatgattattgttggtctgatgatctagtggacaagttggtagttccagtgaagaaaggagaccgggcacagttttcatcagatgatggttcattggatgctacaaacaccagaaaaagtggttcaattaagaaaaggaaaatggccgattggctggataatgagaaacataacaaaacattgtccttggaaggcaatatgcaatgtggtaaagaagggaatgcaaataagaaggagaagaa

SEQ ID NO: 113408 - DNA, 201 bp, Glycine max
  Peptide Sequence Number=SeqID_230186
atgacaggctctatcacgattgccccaaacctagttccattcactgctagcagctcattcgcaagtggcccattctctccaacattgaacccaagcaaatcaagagagaagcagagaaaggagtcattgtggctgcaagctgtgaataggaagttgactgcgatgaacaagctgctgatggaggagaatgataggttgtag

SEQ ID NO: 113409 - DNA, 252 bp, Glycine max
  Peptide Sequence Number=SeqID_230187
atgacgtgcgaccattctttggtcctcgtgaggtgcttggcacccatcattaggcaatttgtgaaattccaggacatgccgaaaaaccaaaaaaatattgatgcacaatcccacccaggcccacttgggccctccggaatattcctccagaagacggttgcttctggaggaagcaaccctgctcgcctgggcgagctgagctcgcctgggcgagctgggcggcaaccacctcccctattttgctataaatag

SEQ ID NO: 113410 - DNA, 459 bp, Glycine max
  Peptide Sequence Number=SeqID_230188
atggctggactacattctattctaggccttgaaggatttaacatgtctagtcatatggccccgaagaaacttgctgctaagagagctaggaaggccactgcaagggaaggatctagtgcagccccacaagcggaaattgagtttgatggatgtcgctttcgaagcgaggagcatcaacactattttgagatgattaaggattggtctttgttcaaagaaagacggattatctcagatgccatccaccagttcgtaggtattgcacctctgagacacccaatggacccagagaagtccaacagggcactgggatttctggcattgatcacaagtctctgccatttctactgggtaccagtcgcacttacaaagctcattcggcctcccattaataggtcattcattgcgaaatattgcataccaaggcaggcacagcagctagggcaaaaccaccagtag

SEQ ID NO: 113411 - DNA, 171 bp, Glycine max
  Peptide Sequence Number=SeqID_230189
atggacttgcatgttggtaaccttattgatcatgatttgcatgcgtggaagaacaatgaagtggctaccaatttcaatcaaattgatgctcaacaaattcaatccattccttttctcaacttagaggctacggagattttgaatgacgccatttccgatgaaggaagataa

SEQ ID NO: 113412 - DNA, 873 bp, Glycine max
  Peptide Sequence Number=SeqID_230190
atgcccaagggcaccatgatctacaactgtttaaggaattcattcactctagattggacaaaccgaatcattttatgttgtgcagcgcaatcagtgcttgtgcgagtctgggaagcctgggttctggaaaaatcactcttggtgtggtgtcttgggcatgaagcaagtgatgtgattgccagtgcacttgtggacatgtatgccaaatgtggttgcgttaattattctgccaaagtcttcaggagaatccaaaatccttcagtgatcccttatacttcaattattttgggtgctgcaaagtatggactagggacattgtctcttcaactgtttcaagaaatggttgttagaagaataaaacctaatgatataacatttgttgggcatgtttgtagtcattcggggcttgtagataaaggacttgagctccttaactccatggatgggaaaatatgggcataccagttagcaaagtcatttcaagttgaaggtgatgaatatgccatgttgtgggggacccttctttcagctagtaggctttatggtagggtagacattgctcttgaagccagtaataggctaatagagtccaaccaacaagtagcaggtgcatatgttacattgtccaatgcatatgcgttggctggggactgggaaaatgctcataatctgcgatctgaaatgaagcatactggagtctgcaaggaacctggcagcaacatctctaaatatactcaagggagagagatgctgagtttaccaagggagatggaagagagaatgaaggaaaggggatatgtgggagggactaaagggttggtgtttgttgatgtggaagaggaggccaaagaagaaattgagtatgcacagtga

SEQ ID NO: 113413 - DNA, 342 bp, Glycine max
  Peptide Sequence Number=SeqID_230191
atgaatgagcagtatgtgggggttggtgaatcagaggatgtgcaggccttctactattcaattgagtcagagaacaatcccaaggaggatcctctcatgctttggcttactgtggccctggttgctcatggtccccttgcatttaatcatgaggactataatgggagccttcccactttgatcttgaggccacaatcatggacaaagctattcatgattttgtcaaatgaagtttacattgggaggcgattcatactctggcatttctattccagtaattgttcaagaaattttacaagggaatcttcacttggctgtctatttagtgatggcgatggctga

SEQ ID NO: 113414 - DNA, 1383 bp, Glycine max
  Peptide Sequence Number=SeqID_230192
atggctattgggacagaggtgaaaagtgttaataaggtccagcagccaagaaagcacaacaaaattgttgcttcttaccaagctttggattgttttgatccattgagtaaggatttaggctctggacagctttcattggcagcaacttcaagctcttctaaggtttcagggtctcataaagctagaactaacgttgaagatgtcagaggctcacctttagaatctgttacctcatcacctttgtggacctccaacatggacaagcatattttggaatcaggggacacatcagaaaaacatgatactagaaaaggtggtctttcaaaaagtttgaataatagggaggggaagttatcagtaaaaatgaaggagagaatttcatatgacattcatcctgcacatggtaattatggaagcagttcgcatcatgaggagaaagtgaacaagagtaataaggaagatgcactttcttggcagaaatctggtagggttacatcattacgggttaaggaaaaggacagaatttctggttctgaggttagtagggagaagatgaaggtttcagcttcagataatgattttcacaaaaatggtgtgagttatgagtcagcagttgatccaaatcgtcatgcttctgatactgagacaagaaatgatgttaagaacagttctctgaagtctaatcacaagattgacaaccctagtaagaaaaattcttcaaggcattggtcaaatgaagctggaaaacaaactgtgctaaaacaaaaagattttgggaattcagttctgaaagtggatgctacatgtagtactaatagaaagattatctcccagcagaacctgattcaggactttgagaaagaaaacaaagctaatcaagtatgcactggatcaagagatgggaaagccaaagtgatcacatcttccgaggataaagtgaaaagggaaacattatatgtgggttctagaactgcacctgagtcgcaaaggggagatatgtctgatgggcacccattccatgcatctggcaatgatgttcccaagtttgtgagaaatccagttgatgttagttgcaaggttggatttaattgcagttcagaaagtttcatacctgatggacaactcagtgagtcaggtcctgtgacaacaaattctagcaaaactgccactagcattctggaagaagccacaaagctaaaagattctgcagatcattataagaattctgggtttgagtttgaaagtaatgagacttattttaaatctgccttgaagtttctgcatggagcatcacttctagaaagttctcatggtgagagtagcaagcatggagaggcgagtcaaatgcaaatatatgccactacagctaaactttttgagtaa

SEQ ID NO: 113415 - DNA, 375 bp, Glycine max
  Peptide Sequence Number=SeqID_230193
atggttgcacttcccatacatatcaacgagagaagagtatgcaacaaggttggacccaaaacccgaagcctcaacaagagcatgagttcttctaccagtctcaaggttggcgaggatagaacatacattaatgagagtggcaaatgtgaattcattgggcagaaccaaggttccttgcatttgatggaacagaaaaagtgccattttgggctgactctggctgacataaccagccataagcgaagtctaggacacgacattaccgtgaggtatttcgtcgaacagtttttgtgcagggtcgattctaaagagcctgagatagcagttagtgagatggttggtggcaaaagtgtcattggacaaaaccggatttga

SEQ ID NO: 113416 - DNA, 504 bp, Glycine max
  Peptide Sequence Number=SeqID_230194
atggctgcagctgctttggcatataaatgcttggaggtggtatacatgagactggtttactgtaaacattctagcataaacagggatcggcatgagttgcaatcaactctacaaatggtttctcaaggtgaatctccttcgtcttctgcatctgatattgataatttaaataacctggcggtagcggacaaggctactttgacaaggggttctaatactcatgttcctagcaatcaagtcatatctgctcggaatcgcccaaatattgtcaggcttcttgattttactcaagacataaatcttgcaatggaggcttctagaaaatgcaagaccacttacatggctgctagtttgaacatggaagattcatggaatagggattgcataacttctattaggaaggttgttgatttcagcttccaagatgtagatgagcttgtacatttggttttgactgcaacaaaagcaattacttgtgctggtcttggtggtgttagagattaa

SEQ ID NO: 113417 - DNA, 1236 bp, Glycine max
  Peptide Sequence Number=SeqID_230195
atgacttccttgactcacctcaacctctctcatactggattccgtgggaagattcctcctcagattgggaatctctcaaatttggtgtatcttgacctgagttatgtttttgccaacggaacagtaccctctcagatcgggaatctctctaagcttcgatatcttgacttgagcgacaatgattttgaaggtatggcaattccttctttcctttgtgcaatgacctccttgactcacctcgacctctcttctggattcatggggaagattccatctcagattgggaatctctccaacttgatctatcttgaccttggaggtaattatctgttagctgaaaatgtagaatgggtatcaagtatgtggaagcttgaatatcttgatttgagttatgcaaacctatccttgctcaacttcaccggtaatgaaattcaaggtccgattcctggtggtattcgaaacctcacacttcttcaaaatcttgagttgtctttcaattcattttcatcttctatacctaattgcttatacggtcttcatcgtctcaagtatctggacctaagttccagcaacttgcatgggactatttctgatgccctgggaaatttgacttctcttgtcggacttgatttgtcacataatcaagttgaaggaaccattccaacttctttgggaaatttgacttctcttgttgaacttgatttgtcatataatcaacttgaaggaacaattccgacttttttgggtaatctccgcaactcaagggagatagatttaaaatatctctatctctctattaataaattcagtggaaatccatttgaaagtcttggatcactctctaaattgtcatcgcttcttattaatggcaataattttcaaggagttgtcaacgaagatgatcttgcaaatcttacaagtttgaaggagtttgatgcatcagggaacaatttcactttaaaagtgggtcccaattggcttcctaatttccagctttcctatttggatgtgacatcatggcagataggtcccaactttccatcgtggattcagtcacaaaacaaacttcgatatgttggactgtctaacacagggattttagattctattcccacttggttctgggaagcacattctcaggacaagccaatgcaattagaatttctcaatcttgcatcaaataatctgtcaggagaaatacctgattgttggattaattggccatttctagtggac

SEQ ID NO: 113418 - DNA, 1083 bp, Glycine max
  Peptide Sequence Number=SeqID_230196
atggctactcttccagtttccaaccctcccatcaacattgatgatgtccaagaactaagaaaaattaacccaaatacaattcctgaaaggtttgtgcaagatgtcaccgaaaggccaaaccttaatggcatacctctctcactctcaccatcacctgatgacatgcccatcattgatttttctaagcttaccaaaggaaacaaagaagaaacccatgaagagattttgaagctttcaactgcttgtgaggagtggggtttttttcagataattaatcacgatattgatctggatttgctggagagcatagagaagatcaccagggggttcttcatgttacctttggaagaaaaacagaaatatgcattgattccaggtacttttcaaggttatggccaggctttggttttctcggaggaccagaagttagattggtgcaacatgtttggtcttgcaattgagactgtaaggtttccacatctatggcctcagaggccagccggattcagtgaagcagtggaagagtattcaagagaagtgaagaaactatgccagaatatgctgaagtacatagcattaagcctggggttgaagggggatgtgtttgagaagatgttcggtgagacattgcaagggattaggatgaattactaccctccttgttctagacctgatcttgttttgggtctgagtccccattcagatgcaagtgccatcactgtgctgcaacaagcaaggggaagcccagtgggactagaaatactcaaggacaatacatggttgcctgttctgccaattccaaatgcactagtcataaacattggtgacacaatagaagtgcttacaaatggaagataccagagtgtggagcacagagctgtggttcatcaggagaaagatcgcatgtcaattgtgtcattttatgctcctagttctgaattagagctaagtccaatgccagaattcgtggacgaaaacaacccatgcaggtttagaagctacaatcatggagagtacactgtacacgtctcagaaagcaggttacaggggaaaaagaccttgaacaactttgccagaatctaa

SEQ ID NO: 113419 - DNA, 1062 bp, Glycine max
  Peptide Sequence Number=SeqID_230197
atgacgacggaagcaacagtaaaagcattttcggattcggattcagattccatgaagcccaactacactctttcccaaaccctaagcggccacaagcgcgccatctcggccgtaaaattctcctccaatgggcgcctcctcgcctcctccgccgccgacaagaccctccgaacctatggcttcacgaactccgactcggactccgagagcctgacgctgtccccgatgcagcagtacgagggccacgagcagggcgtttccgacctcgccttctcgtcggactcccggttccttgtgtcagcctccgacgacaagactctccggctctgggacgtgccgactgggtccctcataaagaccctccacgggcacaccaactacgtgttctgcgtgaacttcaacccgcagtccaacatcatcgtctccggttccttcgacgagaccgttagggtttgggacgtcaagtccgggaagtgcctcaaggttctccccgcgcactccgaccctgtcaccgccgttgacttcaaccgcgacggctccctcatcgtctccagcagctacgacggcctctgccgaatctgggacgcctccaccggccactgtatgaagactctcatcgacgacgacaaccctcctgtttcctttgtcaagttttcccccaacgccaagttcattctcgttggcaccttggacaacactctgatttttggaatctcttggctttataaatatggagagggagaaaaacaaaatgaattgctttttcagaggctttggaactattcaactgggaagtttctaaagacttacaccggtcatgttaattcaaaatactgcatttcatccactttttctacaacaaatgggaaatatattgttggcggttcagaagaaaattatatatacttgtgggatttgcagtcaaggaaaatagtgcagaaattagaagggcattctgatgctgttgtttctgtgtcatgtcaccctacagagaacatgattgcttctggtgcacttggcaatgacaacactgtgaagatctggactcagcagaaagactga

SEQ ID NO: 113420 - DNA, 333 bp, Glycine max
  Peptide Sequence Number=SeqID_230198
atggataacgttggaggcagttcctctaatattgctgaaaatagtggcatcatcagggaacaggaccggttgttgccaatagccaatgttgggaagatcatgaagcagattctacctccgaacgcaaaaatctccaaggaatcgaaggaaacaatgcaagagtgcgtgtcggagttcataagctttgtaaccagcgaggcgtcggagaagtgcaggaaggaaaggaggaagacagtgaacggggatgacatatgctgggccttggggtcgcttggttttgacgactatgcagagccattgagaagctggtatctgcatccttttattgattga

SEQ ID NO: 113421 - DNA, 2928 bp, Glycine max
  Peptide Sequence Number=SeqID_230199
atgaaggatacaggctgtgtctattcttgctactttgtttgtgttgtctattcactaaaaaaacatcatcagttggatgatacagtgcaagttaatgacctgaattgtattgacgagcaatctctttctccagaatattctggtgtttatgatgtttttggtgaaccagacatatttcctcgggtgggtgagcagtaccaggttgaaattccatccttaatttcaaaatctgactattactggcttctaaggaatcctcatgaggcagagagcacagcaagtagtactctccataagtttcgagttggattaccaatcccaataatttggattaaggatggagtagagaacaataggcacgatcaccagaaaaaagcatgcaagccaaatggaggtaccaataaaattgaatcttcaaaactagaacgtataaaagagaccttgaatggtctggattgtgataaattgaagcctaaacttgggtctgtggacagtacattggccaatggaatgaaattgggagaatcagaaaattccaatatgcagcaagaaacagagattgagatgtgcaagcagcatagagataaaggtcattgtttagttcctggggctgcaagtgacacctggaatgaaattgaagaggccagtttcatccttggcttgtatatattcgggaagaacctttttcaggtgaaaagatttattggcaataagaagatgggagatatactgtcattctattatgggaaattttataaatctgacaaatatcaaagatggtctggatgtagaaaaatgagaagcagaaaatgcatttacggccaaaaaattttcacaggaccaaggcaacaagagcttttgtctcgtttactaccaattgtgtcagaggaatgctacaataaattacttgaggtgtccaaggcatttgtagaggggaaaattcttctagaagattatgttttaactttaaaggcctcagttgggctcaaagctcttgtcgagggagtagcagtaggtaaggggaaagaagatcttgcaggaaccgctatggattctatgaaatccactcaagcacttcctgctcgccaagaaataccagttggcaaagcatgttcaattcttacaccttcagaaataataagttttctaacaggtgatttcagattaagtaaagctcgaacaagtgatctcttctgggaagctgtttggcctcgtttacttgccagaggttggcactctgaacagccagatagtcataattatgctgttggttctaagcattctctggtcttccttgtccctggggttaaaaagttttcgaggaaactagtgaaggggaatcactattttgattctgttagtgatgtcctgtgtaaagttgcttctgaccctgagctaattgagctcgagtcgattgcagataatgattgcactagcaatgaaggatatggttggacaaaagatacaaaactggaccatgaaaattcccgtgatcaaccacgccactgctatctcatggtaaaaactccaaactgcagtacagatgtcatgaaatttactgttgtggacacaagtttggccagtgaacagatgactaaagtggcagaactgagaagcttgccatttgaagttttaaaagcttgtacttttgaaaatgactcagatgatgagaatacttctgcagagcaaacaaatgaatccgagtctgtcaataccacatgcttggaaagggggaagaatggcattactaaagccaataataccacatgcttggaaagggggaagaatggcattactaaagccaataataccacatgcttggatagggggaagaatgactttactaaagccagtaaatctaatatcagtaagggtgtctcttcacttttgcatggtttaaaacacaatccttcaaaagaggagcttccaaggagcagcatgggttctagtagcctatctgctgcctccaagggcccgaagacagaattcttgagtaacacactcaaaagagatggtatgaaatgcccatcactccagagaatggtatctgacaaaaaaaatgatctagtccctgttacaaaaagacggaagagattaactgcctgtagtcgtgcaaagaaagatagtaacactgccaatttctttgtggtttccagggtaaatcaggaggaggccggtttttgtccggatccagacaattcaaaatttagtgcaaatgtaactgccaaagtgtttgtggcttccagagtaaaacaagaggaagccattcctcacaagtcaaaatgtaatgagagtgttctttcatgggaaatcccaccccaggagaaaaagtcatcagcagatttgccaagcaagaaaaacaaaacattagcagatcctccgtcaaatcccagctcaatcatcaatggagaagctgttcctgacactagttcttcaggcactaaggatcaatgtgataaaacccagccccagactatgattgaccttaacctacctgttccaccagaagtagaagctggtgaaccttttgtgaatgaagtggcagagatgcagaaaaacaacacaggcaaggaatcagacgatctcagtgttgtaacaaacgccaaacttagtgatcacccagaccaacagcctgacacgcacactcggaggcagagcaccagaaaccggccaccaacaacaaaagtgctagaagcttttgccttcgggtatctagacagaaaggagaagcgcagaagtagagattatctccaggacagttcaacaacaaggccttcccgacgagtttctcgcaaagtgacaggcgctagtattggtggtactgatcttgaaaaagaggtacaaacagatgttgtctgtaatggaaatggtagccctagcagtgacagtaatgtgatacacacaggctccaagtgtaatgaaggataa

SEQ ID NO: 113422 - DNA, 294 bp, Glycine max
  Peptide Sequence Number=SeqID_230200
atggcttctaatctagctacaggtttttctactaattcctgtcgcaacgtgcccttttgcgggcgtgcgaggcaaggctcatgggtgcgctttccaaaggaggaaagatgcgcggagtcgccaccaacgtttatttgtggaaaacatcggaataaccgaaggaaaccggtcaaaaagaaaattctaagttcaggagttgtatttaagtttgaggaaggtcgacaaaagcggggcttttgctcctacgtaccctccatcgaagaggaaatcagacttacgcagttctttctttaa

SEQ ID NO: 113423 - DNA, 273 bp, Glycine max
  Peptide Sequence Number=SeqID_230201
atggcatatgtcacttctgctgaatgtaggcccataatacctcagttactcacagaacacccaggaattgaaccacagaacgaaagagatgagtcaaagcgcacactggtcaaattctttcttttacgaattagcagacttgctaatttagagaaatatgtgcagtgtgcttactgtaaaagccgttacatgtttggtattgttgagttgggccaaagctttgaataccataaagtttgggctttatatatcaagcccaagagtagagcataa

SEQ ID NO: 113424 - DNA, 294 bp, Glycine max
  Peptide Sequence Number=SeqID_230202
atggataaatctctcatatcacatagtggatatgatcgaagggtggtggaagcagcaccactcgtggatgaagtgattgagaccccagatattgcgattcagattctaacgtcaccgacacgtttcgctatcagatcagtgaaagaggaattccccaaggtaacagccgcgtcccccttcgttacccgacacgtgtcctcttgtttcctccttcccggagctcaaccctctcctttgaacttcgagccgccgccgccgccgtcgatccgtgttcatctccatcgatgcttctga

SEQ ID NO: 113425 - DNA, 312 bp, Glycine max
  Peptide Sequence Number=SeqID_230203
atgacccccggtggccaccacaagccgtccttgcttgtcggcgaaccctcacaccaagaggaacattttaatcagaccgaaatcctcagaatccacctcaagggttcggtggaaaaaattcctttaatccttccttttgtagcttctccgaggcaatcacaaccaaaagtaacaacaattacagaatcaagagatctcaccaacatgtctcttgccactctctttgggaaacttcaagaacatgaaatggaacttatgaaactctatcaacatgaagagaatgacaaaaagaagaaaggaattgcactctaa

SEQ ID NO: 113426 - DNA, 255 bp, Glycine max
  Peptide Sequence Number=SeqID_230204
atggtcaacaagtcatcacttctgcacttggatcctaaatcacctgaagctcaagcttttaatcaaattgatcagaaatccaatggtggttctatccgtccttcgcccactccttctgttgaaggaagttcccagaatggtagaaagcaggggacagatgaaacggccacagctaagaatagtgcatcttatatcgggaagagattcttagaaagtttggttgcagttgcagggcttctaatttggctttcatga

SEQ ID NO: 113427 - DNA, 225 bp, Glycine max
  Peptide Sequence Number=SeqID_230205
atggaggtgaacaaccaaatcgtggagaggagcaagagggttaaagggagagtggttttgatgaagaagggtgtgttggacttccacgacatcaaagccaacgttctcgatcgagttcacgagttattaggcaagggtgtctctcttcagcttattagtgctactactcctgatccaggtcctcttgattttctcatcatcatctttgcaaattgcaattattaa

SEQ ID NO: 113428 - DNA, 141 bp, Glycine max
  Peptide Sequence Number=SeqID_230206
atggctcgctcacttgtctcaatgatttcgctgaatgtgatccttgcactagcagccatggtgttagcagcaaactgccgcccacttgttatggagcatgcgctgaatttcctgaatgtactacccactgcaaaattttag

SEQ ID NO: 113429 - DNA, 444 bp, Glycine max
  Peptide Sequence Number=SeqID_230207
atgttggaaatgacttgttactattttccaagacaacaaacactcgagggttgtccacctcaaaaaccaattctcaaacacgaatttagaggatttttctacgaccaaagcctgttgcaaccgcctcaagcttctagtcgatcaattgatgcccttgttgcgaattcccaaaattctgatgatgatatgaatcaccaaaatgcctctcaagtgggaacaagggcaacaacaagaaaaacaacaaaaattcaggtggttaggactttgacaaaggtggttgcgatggcggtggctccaatgcggacaacaacaatagtcggagcttcggcagggtgctggcggtggcagtcgcagacagtagcagcaatggcagactccttggcaatgagtgtggcagcaaggtgctccttggattgtggcgccatgtccatatcccatatatag

SEQ ID NO: 113430 - DNA, 402 bp, Glycine max
  Peptide Sequence Number=SeqID_230208
atggtaatggttgtctggggaaaaaaaggtgaaggtggttttcgaaaaagtggaggggcatgtggagaaatagtggaaggtgttattggcggattgggcatcacttttgcaaacccaacccaagagccaaacaaaaacaatttgctgcaaattgttttccaaaatgcaagggttgaggaggacttggttgagatggaaccacatgatgacatggatgaggagacatacaaactttacgcacacaacgataatgagcttgagtgttgctatgcggtgcgtgagcgcgtaaggtgtgatgatggaaagtgtgactttcatgaagacaaggaactgtccggaaacgaccttgatgatatcttggatggtcttgaggagcaggacgacgacatcataaaagtttga

SEQ ID NO: 113431 - DNA, 231 bp, Glycine max
  Peptide Sequence Number=SeqID_230209
atggcgtctagcatggacgaatctaccgccttgctagatccaccaccatcacagattcatctctgtcacagatccaatgccttcacagatccattgccatcacaaattcgtctccatcatcgttgtggctttgccaccatcacaacatcatccttgtcctggatctactatcgtcgcgacttcatctttgtcctggatccaccaccgtctttgccgcagattcgttgctag

SEQ ID NO: 113432 - DNA, 144 bp, Glycine max
  Peptide Sequence Number=SeqID_230210
atgggtgagctgattgggctggatgaggtgatggttgagttttctgggccgacacatttgtttgacgagtggcttgattgtggagatgatggatcacataagatgaagtatgagggcatgaaaaatgaaaagaaattccattag

SEQ ID NO: 113433 - DNA, 477 bp, Glycine max
  Peptide Sequence Number=SeqID_230211
atggcaaccattcacacaatgctcagtcttgctctttctaaggcatggcccattcaccagttggatgtcaaaaatgcattcttgcacagtgaactaaaagaaacagtgtacatgcatcaacccttaggtttcaaggatccggattgtcctaatcatgtttgtcttttgcagaaatcattatatgggctcaagcaagctcctagagcttgcaagtctgataactcttttttgatctactggaacgatactgctatggattacattcttctatatgtcgatgatatcatcttaactgcttcttttgatactcttcgtaatttgctctcatggtctttcaaatgtcaagccacactttctctctctagtgctgaagcaaaatgcgaaggcattgctaatgtggtttctgagtcatgttggttatgcaatcttcttctggagctgtcctattcagaaggctacattggtttactgttataa

SEQ ID NO: 113434 - DNA, 408 bp, Glycine max
  Peptide Sequence Number=SeqID_230212
atggtgtcaattttgattgtcgttttggtgaggagggttgggttgccgccaagtggatgggttttcgtgttagggtttgtggttttgatctgcgcgagtggaatttgcttcaattacgatgcattccatgctcagaatttggggatttggttggggttgcagcaggaggacgaggagatgcttgtcccacacacggatttggctaagaataatcaccaacccatggaagggccaggtgctgtaaactttatcatagatcatggagagctggattttgtgtttgtccaagataggaaggttatccatgtagaaaaaggtcatgagcttgaccttttattggtttatggacctgtgaggagccatcttggttttcctgcatggagacttcgttacacagagatcatgtaa

SEQ ID NO: 113435 - DNA, 315 bp, Glycine max
  Peptide Sequence Number=SeqID_230213
atgtataacttcattgcggggctgaggttgatgtgcttcttggtgtccacggtggtgatgaaagcggagcgaacacttgggaggtatctacatggtgatgcgtatgttgggcacgagttgggagaaaggggagtaggcgtgagagaagatagccggtcaaggatgacatcaagcttggcggtcatctctagagtcttggtggtcatctccaaagtatgggtggtcatggtggataggttcaggttgaggtggtatacaacttcttcaaggcagtctagggtgggtatggttcaaggtaggggttctgacaggtag

SEQ ID NO: 113436 - DNA, 222 bp, Glycine max
  Peptide Sequence Number=SeqID_230214
atggctcattcacttgtctcaatgattttggcaaaagttattgtcacagtcatggtcattgttttattttcacttggtgttagcagcaagccccggtgtgttggagcgtgctctcaatttcctgactgtgctgcctactgcaaaactaagggctatcagacggggacttgtactctagatgtctgttgttgtgccaaagctgttgaacacatttttagctaa

SEQ ID NO: 113437 - DNA, 315 bp, Glycine max
  Peptide Sequence Number=SeqID_230215
atggcgagtggcacatacgtaagagcatggtgctcaaaacccaagttggagaattccttggtcaatcttctacaggggccacaaaacctaaggtctactattggcacatatgcaagagcacaacacttatgctacatacaagactcgtcaaaagcttcgcacttgctgatccttataggtctaaaaaatccaaggccagtccttggtaggactcgacacagctccgaaggctggacaaaacttaggacatacatgtccctagtccaaggctcgacaaacccaaagaccacccttagtgaagcctcacattactaa

SEQ ID NO: 113438 - DNA, 354 bp, Glycine max
  Peptide Sequence Number=SeqID_230216
atgagcgagggagagagaaatctagcggtgagaggaagaaaagctacggagagggaggtggtagctcgtgacgctgctgagagggaaagagaaagccacacttgtgcactgagagggagagagagctggtggtgtgttgagagggagagagcgttgctacgaagagagaaaaagagttggtggtgtgctgagaaagagagagctagtgctaaacttccatacaccaaggatatacaaggctatgctaaaaatatcatcctcttgcttgagtggctccaagttctcagcttctccacgaggcaaccttatgctaatatgaaaaattatgaaaactataggaatgaattgaaatag

SEQ ID NO: 113439 - DNA, 258 bp, Glycine max
  Peptide Sequence Number=SeqID_230217
atgggagaagagtggcgtgaagccgtcaaagaagaagtggacatgctcttccatgcaaacttcatcagagagaacaacgatagatggcgaatgtgcattgattacactgatttgaacagagcatgccccaaagatgtgtaccctttccccagcatcgacaggttggttgatggagcatttgggttccaggtgttaagcttcttagacgcctacttcggatacaatcagattagaatgcatcctccagacaaggagtaa

SEQ ID NO: 113440 - DNA, 864 bp, Glycine max
  Peptide Sequence Number=SeqID_230218
atgtctgatggtgaagctcttggagagcttgccttgactgaaggtgatcatcaagtccacgtaccctctagtctcgaatctttcgtctacaaagccgaggagtggaccggggaccttagacgccatgaagttcgctatgataatggagacaaccatggggttgtcttggttgatgcccttgaagtccttatgccgttttcaggactagttggactgtcctccataggaaaatctgccagcgatggtgttgattacacctctgatgtgttgggcgggttcctgccctggagtaggttatcgctcacatcgttgttgttggtgtctttgcctgcttcggtcttctgctcttcttatgtctacttcttggttccttatttggttgcgtctgaccctggcctgggaggtttcatctggggtagccggataggtaccttgaggttgaatgcttcctcaagaatcatggtgcgattggccattaggggcgaggagcatgaaattcaacgctaccttgggattgagattttggatttggatgatcgtgcgcccaaatatgtccatgaactttctaagggactcatcgtctacttgtcacagactgaccaaggcagccaaggtcatgcaatgagacctactagtggcatactatgcaatgaatcgttcaacgagggtgtcgaagctgtatatggacctacctgggagtccaccgtaccaggaaggcttttaggtgcttgtttggatctgttatctcatcgtattgctcgagtggacaaaaggatgtcaacggacagttcgtgctgttggatggtgcatgcaaggtgtgggcagattgcttgtcacccgggaatgtctaacacgagcctctag

SEQ ID NO: 113441 - DNA, 183 bp, Glycine max
  Peptide Sequence Number=SeqID_230219
atgtttggtgaaggtattgtgtgtgacccacgccatggaactgccaaggaaaggattgggtctatgacccgagtcgtggagcaaccaaggaaagcattaaaaacgggtggcgaagatgatggtggaggcggtggcttcggtggtggtggtggcaggtgtggcagcggacgccgatgccaatga

SEQ ID NO: 113442 - DNA, 1197 bp, Glycine max
  Peptide Sequence Number=SeqID_230220
atggcttccagaaaaagaaagagtattggttcaaggcccacaactcagtatgatacaaggaggttccactcctttgaggcttggacctggtacacagataatgttctaggaagacatatactacctgagaggaaggtagaaatataccatactgagctggacgagtttaaggctaaattggagaggcataacttccataaacgcctcaccaatttagttgacaacaacatagatctagctttggtgaaggagttttatgccaccctttacagctccgaagggccttcattaaagcaagtcagggtcagaggccacttggtgaggattgatgcagacaacctcaacacctttctggagacacctgtgttactagctaagggtgaaaccttacccgcatattccagatactgcaggttacccactaatattagagaaattgaggctaccttatgtatcccaggtcggggtgttctctcatactccaacctggctcctacttcccacacctcgaacttgacagcagatcgagctaggctgatctttggcttagtctctcagatggacatgaatgtgagagctctcatctctggtcagattacatctatggcccagtctaactctactagacttgggttccctgctcttatcaccgctttatgtaagtccagaggggttgcttctgatagcctggtcttcgaacgcctaagcccggtcattaacttggcatatatctggaaaaactgttggaaccctgatgatctgacagttactatcagaggggccaggagagcgaggacaaggctagctgaggccccttccacatctacaactcctcctctagcaccctggcccgggactcagttttctcttcacaaggaagatgaaggtcccacagcccaggtaccacagcagatggaggttgagtcatccaagactaccattccaaagcccttggtcagaaggaagaaggcagatgaaacacaagaagctgcagccacttctgagaaatctcttgaggccacttctgagccttcagaaccagtggcagatacaacttcacctcaacaggcagcagaatcttccactcctgaggatcagactacaccagtcctttctctgaacacctctcctacagctatccctgtgctttacttaacagacgaggaggatgttcagacacaggatactcaggactaa

SEQ ID NO: 113443 - DNA, 612 bp, Glycine max
  Peptide Sequence Number=SeqID_230221
atgggtttctcaatcgaaccctcagaatcactaccacccagtttaatggcggaatcaaacaaaaaagaagacattacggtaaacagaagtacctttgcaagttggaggaagaagaaagggaaaccagaagccagaaagcaaaagaacgagcaaggaagcaagaaaacaatgaacaatgacccgaaatcaaacgtccactccatttataggggtgatggacttttcaataactggcaagagctaaagaggtgccctaaaatttcgcaccataatgctcccccactcaaccacgaccattactccaatacatgcccactccatgctaccacgcctgacactggacaacaagcgtctatactggagggcttgacaaactcgtcaccctttacttgtcaacattactaccccagacatcagacaaacttcctcaacacaggacaagctcacttaacatgggacaacctctttcacttgaaaatcggctcacagcttgggagcttatgtactgtccaggacccacaaaatctacatggcatcctatttggcacttatagacacatgtcaacccttcacgttagtcctgttacaggagcgcagatgcctggcccttag

SEQ ID NO: 113444 - DNA, 1111 bp, Glycine max
  Peptide Sequence Number=SeqID_230222
atgtcttcttttttgtttgattccgccattaaactgggtggtagtgattctgaggcggttcctcgtctgaggatactcatcgaggtgcctctaatagtgagtcatcctccccagagagggggtgcaagaaaatttggcagcagcgaagaggtgaggtcgtctccccgcatacgacctagcatgagtgttgggttgccattgtccaccccggtcattgctagctatgagtggataagggacgacttgttgaaatataagtcctgtttgaccttggcgatgagtgttgttgcgcttcagtgccaagtgaaggcggcgcctggttgtccgcccttcttttgcatgtacaaatgcttgtttaaggtcttgggtgtcattttacccttgattgattttcaatgtgcttttcttgagcacttgaatgtggccttttcccagctccacccaaacagttgggcaatggtgaaggcatttgaagttttgtgttctttcttcaacatctggcctagtgtgctagtcttcttattattctttcaaatgaagttgtttggcaagattggatgggtctccttcaacaatgtgtctaagaagttattcgagtttgactcaaacatctttcgccatttcaaggaccacttctttaaggttctggctactgatgttcaacaacgacagggagccccgcttcttgttttactggcaggggctaacctgctagagagattggctctgctactattgctgatgaggtcacccctagcgctcctttctctgtcgggtcgcaagaagttgaaggcccctatgagccttcgtgccctaaggcaggttgtagggatagggcccattgagggtcgccttatgactgctactcatgttgttgttgaagctgttgtgccagccaccctggcttactctattatggtgccatcgtccactgttacggcccctttattaagtgacgatgtggcgaccattggtgctccctctttcttcgttggctccagtggtcttccctgttgctatttttgtggctatggcatcgccttctttgttctcgtgtccttgcgtctcccttatcatctgtgcgcctccagtgatgctgactcattgtggg

SEQ ID NO: 113445 - DNA, 165 bp, Glycine max
  Peptide Sequence Number=SeqID_230223
atgaggaaggatctggaagaagatgatctgtacaggctcactgagcgcaccacttcatctcatcaagagcactgcttcagcccatccgctgagcgagaaaagagcgctaagcaaaaattcactaatagactagagcttgaagcaggagccgttttgagagcttga

SEQ ID NO: 113446 - DNA, 630 bp, Glycine max
  Peptide Sequence Number=SeqID_230224
atggtacctacacccaagattaatcttcatcctgtcttggataaaaccacttatcatctagtcaacaaggaaagactagctaagatgaagaaggaagcaattcttataaactgcagcagaggacctgttattgatgaagctgcacttgtggagcatttaaaacagaacccgatgtttcgagtaggccttgatgtgtttgaggaagagccctacatgaaatccaggcttacagagttgaagaatgccattgtggtaccccacattgcatctgcctccaacgtaattattataaatcctaacccctataatataggcaaattccaaccagtaactagtgtccttagggcactggttaagaaattgatagggaagatcaaagggtacccagtttggtttgatgccaatagggtggaagcattcctcaaagagaatgctcgaccaccagctacatgcccaagcattgttaatgcaaaagccctagggggagagcataatcaaagctcatcctcccatgtctcttcctatattcctatatctacctcaatgcaaagagaagaactcaaagatccagaaaattctacccaatcagaacatgaacctacacaaaaacaagtcaagggggagaattaa

SEQ ID NO: 113447 - DNA, 1308 bp, Glycine max
  Peptide Sequence Number=SeqID_230225
atgtcgaaattccatgtgatgttattagtgttagtggcgttgttatggaattcaggcgcatcagaagcagaggaatgcgagaagcgatggatccacataagaaagctcccttcaagtttgaacctggatctgctcgctaactgttcggaatacccaatgttggacgacctgtgtcccttcctagcaaaccacggtctgggacaaaaaacccacaaccactcccacagttggtaccgaaccgacccttccatgctcgaactcatcttccaccgtcggatgttggagtacccatgcctcacgcaagatccgctccaggctaacgccatctacctcccttactacgccgctctcgactccttacgctatctctacggccctgaatacaactccagcgccaaacacggcctcagcctcttccactttctccaatccgacaacccccaaatctggaaccgccacatgggccacgaccacttcctcgtcatggctcgtcccgcttgggacttctcccagcctctcttcaacgaccctcccgtttggggcacttcctttctcgagttgcctcaattcttcaacctcaccgccctcacgctcgagtcccgcgcgtggccctggcaggaacacgccgttccctacccgacctccttccaccctcccaacctcggactcttcgaatcctggctcaaccgcgtccgccgctccaagcgttccgtcttagccatcttcgccggcggaggcggcgtctccgccacgcccaacatccgccgcagcataaggagcgagtgcgagaacgctactacctcctcggattcctcctacgacacgctgtgcgagattgtggattgctccaacgggatttgcgagcacgaccctattcggttcatgcggccaatgctttcggccagtttctgcttgcagcctccaggggatacgcccacacgccgctccacgtttgacgccatactcgcggggtgtataccggttttctttgaggaactttcggcgaaggctcagtatgggtggcatttgccggagtcggagtttgaggaattctccgtgtttataccgaaggaggaggtggtgttcagagggatgaggattttggatgtgttgcaacgaataccgagaactagggttaggagaatgagggagaaggttttggagttgataccgagtgtcttgtacaggaagcataatagttccccgggtctcaaaactaagaaggatgctgttgatttagccattgatggtacattggataagattcgatccaggcttcgggatcttcatcttgattttgttatgtaa

SEQ ID NO: 113448 - DNA, 132 bp, Glycine max
  Peptide Sequence Number=SeqID_230226
atggaccacaaaaaggctgcacctggagctgcgcctgagcagaatcgaaaaaaaggccttgcggatcatcaattgaagctgatccagagaagctacttgacaagattggatacacctattccttatcactag

SEQ ID NO: 113449 - DNA, 282 bp, Glycine max
  Peptide Sequence Number=SeqID_230227
atgagtcaggaatcgtttatatatggcttcgtggctcgggggacgatggtgttagccgagtacaccgagttcactggtaatttccctgcaattgcagctcagtgtcttgagaaacttccctcttccaataacaagttcacctacaattgcgaccaccacaccttcaattttctcgtcgaagatggttacggttgccatagaaacgcattggttttttgcatggccatgacggatgaaacaacagctatcagttccaaatccctgagcctaactctttattag

SEQ ID NO: 113450 - DNA, 351 bp, Glycine max
  Peptide Sequence Number=SeqID_230228
atgccacaacacctagctctatctctacgacctttcctcccaattttcccgagaaaatatcgcttcgagaaatctagctcaatctctccgcaacacctcacacttatggatcggaggagaaacacgagtccgatctacgcccggcagtggagcggtggttccagcagcaccgattcctcgtcatcgacgatgtcgccggcttatcctcagtcgcaccttagtactacttctgccaccggtatctccaccgtcaagcgcatgcaaaacgtggcagccaaagccgtcgcgcagcgacttgctcgcgtgatgtcgtctcagaattgttggatcaagtggcctcagaataattaa

SEQ ID NO: 113451 - DNA, 234 bp, Glycine max
  Peptide Sequence Number=SeqID_230229
atgtccctccaccattgtgatgctcctgcccggatatctgagtctgtttccttttgcacaagaatgagatttcgagatcccttaatggtattctttaccatggtactggacgatggtgcggatgaagaagagggtgagggttgttggcaaagggaagacatagtgttggagccacatggtcgaaaaggtaggttgatggtggtggttagatcggtgatggtgtttccgatgtag

SEQ ID NO: 113452 - DNA, 393 bp, Glycine max
  Peptide Sequence Number=SeqID_230230
atgcgtgctggatgcaggtgcgggagaggaagaggaggccaaggagaaggagggtgcagaggaagaagaagcgaaggagaaagagacaggggatggaaatcgaagaagatgtggtgggatgtagggtttatggagaagagggcaggcacggacaatgtccaagttgagcaacatctaggtgaaagtgatagtagaagcaatattaacttggttagagaaagtttaagtgatccaactttgaatgcatttgatattgacaacttggttttgaatgacaatgttaaatatcacttctcaaccaaagaagagcttcaagatgatggaaatgaagatgatggtggtggtggtggtgatattggagatgatttaattagaggattgatgaacaattga

SEQ ID NO: 113453 - DNA, 807 bp, Glycine max
  Peptide Sequence Number=SeqID_230231
atgatagagaaggtggcactagcactcattacctcagtccaacgtctaaggtcatactttcagattcactcagtggtagtcaatacaaactaccctattaagcaggttttgcaaaagcctaaattagcaggaagaatggtagcctgctttgtagaactttcacagtttgacctccagatcatccttaaaggccctgacaatgtcgctctagagcaacccctcaagctcaacttcaaagcctcaaacaatcacgctaacaagagaagtcaaagccaagaagctacaaaaactcccaacttgcctagggataggttgccaacagatactagacaaaggaaacagtgttgcttaagtactatcacatcgccaaaaactctcattgacaacttcgaatgctttgagatgtactacatacctagggataacaacaccagggtagacctgctcttcaagttggccagcaccaaaaaggctgggcacctcaagactatcatccaagagatgctccaaactcccaccattgacactaaagaagttatggttggagaaaaggaggcgccaaactggacgacccgctacaagaatttcctaattcagggggtgtcgccaccagacgagaatgaagcccgacacctgaaatggaagggctgctattacaccatctttgatggtgatctattcaaaaaagggttgaaaaaacccttactcaaatgcctgaacaaccaacaggcagattttgtcatgagaaaagttcatgaagggatctacagccttcacaccgggggcacttccttaccaccaaagtga

SEQ ID NO: 113454 - DNA, 1047 bp, Glycine max
  Peptide Sequence Number=SeqID_230232
atggacatactgggaccactcccaaaagctctaagagcagccaaatacttactcgtcatcatcgactacttcaccaagtggatcgagacaaggccactaccagaaatcacgaccaacaaggttgagacgttcacctggaagcacctcatatgtaggtacgacctcccttacaccattttcaccaacaatggcacccaattcaatacccaggcttgtgaaaacatcctgacaaagttaggcatcaagaacttcatcacctctgtcgaacatcctcagactaacggtcaagcagaggcaaccaacaaagttatcctcagtgcacttgactcgaaaagtccaaggacaacggatgaagtccaagagatggctagaatcaaagaagaagctaccaagctccaagcatcaagatgctacaatacaaaggttcaaccacgagcctttcaaccagaaatctcggttataccaaacctagacagtggagcataccaactacaggatccaaatgtcaaaagtgattccaagaacatggaatgctactcatctgaagttctacttcagttgacctactgcaagatcggatgttgtattctttttcctactcaagctcacaaaacccaaggtccgccctttgtgagcctcgattctccaaaggctcagaaagcccaaggtccacccttggtgagtcttgtttctctagaagctcgcaaaaataggctcgtcaaacccaaggtagactctccaaaggcttgtcaaacccaaggtccacccttggtgattcttgcatctctaaaggctcgtaaaacccaggtgatgcaatcctaccccgcaagggcattgggtagaagactccaagtagattgggctagagatccaagggaaggccctagggttctcatgagccttaggctaagctctagcttctcaaggaagcttctcaaggaggatcccattgaagctcaaagatccagcctccatagaagccccacaagcaagcttccatcaccagggtctacccttgatgattctttcaagctcatcaaacccaag

SEQ ID NO: 113455 - DNA, 222 bp, Glycine max
  Peptide Sequence Number=SeqID_230233
atggctcgttcacttgtctcaatcattttgccgaaagttattcttgcagccatgattatcgttctattttcacatgctgtgagcagccaaccgacctgtccttttactcctggatcatgcaaaaacactgaaggctgtgatgcccattgtaaattcttaaactatgagaaagggatatgcatcatactctcacctacatattccaagtgctgttgctcctaa

SEQ ID NO: 113456 - DNA, 261 bp, Glycine max
  Peptide Sequence Number=SeqID_230234
atgcgggcgaaaagcaaaaaggagttgtttacgcatagggaaggtattagcaccccacgcgcctgtcacaagggacgacaacctttaatcgagtgtgcacaacatgacttcaacaagggggctgcccttgctcctacgcatcctcagggaaaaagctattttgggttggttgaagctcgcccaggtgagttgatgcttagccctgaaggaatgagctcacccaggcgagttggagctcgcccaggcgagctagttgcttag

SEQ ID NO: 113457 - DNA, 759 bp, Glycine max
  Peptide Sequence Number=SeqID_230235
gtgtttttaccacaacgggttgacccgcaacagcagaaagtaaccgtcactggaagcgttggagttgagacgctgataaggaaactggtcaaagctggaaaacacgccgagatttggccggagaatctcgctgccaccggaaagggaaagagctcctgcaaagacaagatgcagcggcagaacaacaacaacaacaaagaacaaggagaaccagaaagcgtggaaaacaactctactacagtaaatgcagaacccaacagtagaaacacgagcaaaaaaaagggaattgaaaaaaatgctgaaaagcgcaacaacggcggaaacaagagcaccggaagctcaaagtccgtcggcgtagccggagaaagtgaggcagcggaaccggagaacaagggtggtcaacgtgaaggaggttctgggaagaaaaagaaaaagaaaggtcaaagtgggggtgagagagcagcatgtggtgatgcacctgcacacactggatcggaggtgcagtgttctgggcaggtgaatctgagccatacacgtcagcaatcatacatgtatccagaaagttactgttatcccccacagccacaggtgtatcttgcaacaacccagaacaacaacaacaggttatgtccttcttactatgtttcaccattgccctacatgtgtgcaggcttcgaccatgaccctccttatcgctttcaatctccacccttcgagatcttcagtgacgagaatgccaacgcttgttctattatgtga

SEQ ID NO: 113458 - DNA, 1041 bp, Glycine max
  Peptide Sequence Number=SeqID_230236
atgccttcgcctcaaatcgatttcgattcttcttctttggtcttattagcatttcccgctaaagcactatcgcattctggaattccttggatccgcaattgccactctgtccgctattttggtcggcatgggtgtcatggttgtggtatgcgtcctgcatcctcttgtcgtctccaggtaaacatgcttaattctgaaggagaacttaaaataagttttggctataaatgcaatagagatagaggtattccttgtgaagttgtcagtggctgcaaaatccttcctggagtatgtagaacaagcagtttctcctgcttgtcaggtgcagccttaagtgcaaatgctacattagcaaacacaaacatctgcaatggtaagataggagaagaaatccttccaagttgggactctcctacttcatttcgaaaggtaacctcttcgccaagtctttcaaagttggacatactatcatcctcccccccgaatagtttgtcttaccttagctgcagtccttctactgtaagtgatatccttgaatatgactcttgcacattaaaatccatgagtgatccttccagaagtgaaggttttcttaatgctaaggaagttcaggtagcaggaggagctgctggtgaagatagagttcaagcagtttgttctgaagaaaatgggtggctattctgtgcaatatatgacggctttaatggaagagatgcagctgactttctggctggtaccctgtatgaaaccatcatatcttactttaataagttaatttgggaattggagccgggttccatcaaagcttatgataaaggatgcttgggtggatccctgcaatataagttggatgatagtcttatttatcacgagaatcaatctctgtcgagatttaagggaataaacaattctaatcatggttgttttgcaaagtgtaatccttctactaagtcagaagtatcatgtgattcattttcacatggggtacttgatatccttcaacgtgccattagtcaggctgagaatgatttcttgtacatg

SEQ ID NO: 113459 - DNA, 297 bp, Glycine max
  Peptide Sequence Number=SeqID_230237
ccatgttgcaagatcgagaattcaatacttgagtcgaccgatcctacagtgcttgaatctcaatctctgtctattacaactgatcatgatcggtcgatgcttgccttaagtgagcctacagagtttgaatttcaatctgtgtctgttaccggggatcatgaccctcttctcaggattccattgacaccaactaagcgcgtatcttctgatgagttggataatgagcgaaaaaactttgagatctcacctgctgaagtttcctcgaacaaattagccaagcattctcagcctgaatga

SEQ ID NO: 113460 - DNA, 1284 bp, Glycine max
  Peptide Sequence Number=SeqID_230238
atgggtgatttaagagttaagaaaaagaaaggaagcaacaagaagaagcatgggtctgtgtctgtcaccgccatcaaatttcttcctaaggagttgcaagtggagatttttgccaaggtggccactcgctccgtatttgaccactgcatgattaaactatgttgcaaagaatttcttcgcgcagcggaggataattacgtgtaccgtcacgcctccatggagaattttgcgttggtgccgctaccatggttcaaaggcaataataaagaattcccgtttctgaaacgttgcagggagagcggtaactcggagattttgtaccgtgaaggaatggttcaatatttcacttcttcaatgatggaattgggtctcaagaatttgaaagaggcggcgctggagggtcaccatgatgccaaatatgtttattgcatgcttttgatgtgcggtgaagatgaattaggagaaagaaagcaaggctttcaagaagaagatggtcaccgtttgaggataaagaagatggcggtagtattggtatttcgtgcgaacgttgcgaaagcttcctgtcctgttagatttcaaactttaacagtggctggtttaggagtcaagaaaagaagaaatgaaaagcagcataaacacgatgggtctttcaccaccgtaaaagctcttccaaaggatatgctggtagagatttttgccaaggtggccactcgctccatcttcgacctctgcatggttaaacaatgctgcagagaatttcttcacgctgcggaggacgattacgtgtaccgtcatgcctccatggagaattatgcgttggtgccactgcaatggttgaaagaatcatcatttcttaaacgttgcaaggagagtggtaactcggaatttgcgtatcgtgaaggaatggttcaatactttacttattcaagggtagaattgggtctcaagaatttgaaagaggcagcgctggagggtgatcacgatgaagccaaatatgtttattgcatgcttttgatgtgtggtgaagatgaattaggacaaagaaagcaaggttctgatctcttatgttccttgaaagcgtcgtccacgtctcttgtgagatgcagaaagagggtaaaatcttttgttggaaccatgtggctgaataataagcctgtggttccaaatcgcaagtcatgtttctgcggttctgacacgtccgatagtgagagattgaagaagctttcaagaagcttaagatggtcgtcttttgatgccaacgttgcgctgctgatcatgaacttg

SEQ ID NO: 113461 - DNA, 1029 bp, Glycine max
  Peptide Sequence Number=SeqID_230239
atggcacatgttgctgataaaataaaattgatagatggatcaagggaagctcttaagctttctgtaaggatcactgatctttggttcattgggattcccagaaagactgaacaagccgaaatggaagttgttgattctgatggagatgaaatccattttgcttgcaagcaggatcagctgaagtctcgcatggctgatttgaaagagaattttacttatgtgatgcataattttaaagttatcaagaatgatgggaaattcagagtttgtgatcatgaatataaattatgttttactgaagttattgttgttacgcaatgtgatatggaacagttaccttttaggaaattcagatttgtttctttttccagtgtcattgctggtgattttaaaattggactcttggttgatgttattggcgtggttgatgaagtggtattccgatatgtgtcatccaaaaatacgagggttgttttgaatttaaaggatttgagtggccaggtactatcctgtacactctgggaaaattactgcttacagtttttgtcttatttgaatgatattgaagatgaaaggccgatcgttattctcttgactcatgctaggattaaggaagcacagggatcatatccggcatcggtcagtaattctttcaaggcgtccaaactcatgatcaatgacctcgtgctggaaattcaagaatttagagagagtcttttagatttagggatcgaggttagagcaattttggtgcctattggacaagggagttcacaggtttcaggctcatctcaattatcatcaaaagatgcgtttctgtcaaagactgaagtaaaaaatatctctgagattaatgtcagtttagaggagtttgtttgtgttactgtcgccaagattacaaccatagtgatggacaactattcatggtgctatccggcttgtggtcaatgttataaaaaagctgacatgcaaactgtgtcgttcacatgtccgtgtggcaaagagaatgatcaacctgtactgaggtga

SEQ ID NO: 113462 - DNA, 225 bp, Glycine max
  Peptide Sequence Number=SeqID_230240
atgtttgcactccccgacctaccgacacaacctgcaaacattaaaggaaaggccaagatggtggaagagaaaaatgacaagacgatcctcactccgaacgaggatattccagtgaagggtcttccagagaaaagggatggttgtggcaagaaggaagtgtcactagaggaagcaagtgagtttctccgcattattcagcagagcgagttcaaggtcattgaataa

SEQ ID NO: 113463 - DNA, 627 bp, Glycine max
  Peptide Sequence Number=SeqID_230241
atggcagacctagaagaagtctatggggaactctgcaggggattaggcgaaggaaagttccttggcttcatgatcactcatcaggggattaaagccaaccccaacaaatgcactgcaatactagagatgcataacccaaccaacaaaactgagctcttcctatgggacgagacctgtgaacaagccttcccgactttcaagaacaccatagctacaccgtcgatcctgagttggcctaggctaggaatacccctaatcctatacctttcggtagctgatgaagtcattagcttgacccttgtgcaagaggaagggaagcatcaactccctatctatttcactagccttatacttcatgatgccaaaaagtgctaccaaatgataaaaaaggcaagtggggtaggaatcatccttgaaggtcctagcattatcctaatgcaattctaccccgcaagggcattgggtagaaaactccaagtagattgggctagagatccaagggaaggccctagggttctcatgagccttagggtgagcttagctattagagagcttctcaaggaagttttctcaaagaagcttctcaaggaagttttctcaagaaagcttctcaaggaagctacctag

SEQ ID NO: 113464 - DNA, 354 bp, Glycine max
  Peptide Sequence Number=SeqID_230242
atgagagtcttctccttcttccatggcttattccctagtggatggcgcctcctctcacctcttttcctttgtcttccgctgcatctccatggtggaaaatcaccattaaaggacctcattaaagctcaaagatccagcctccatagaagccccacaagcaagtttccatcatatccctttagagcattccctaaagctattcttcagagcctcaaacaaccaggaagagtacgaggcactcaatgcaggtctaaaactagcaacagaagtcgggaccaagaagctatgatgctacacaagctcgtaacttgttcaaggataatggacattgccaaggccttcgaggatgcatag

SEQ ID NO: 113465 - DNA, 366 bp, Glycine max
  Peptide Sequence Number=SeqID_230243
atgtgttggccatgttgttacgcaccaggttggacggtgatgaactattcaaatgctacaaggacttgcaggaagagaagaagaacttggctggagtcagagtccaaggtgtgggctgctagagagagggaggccaataaggagcttgagaaggagctgctcatttccaagaaggaggttatggagcagcatgaaaaggggttcgacaaggttgtcaggcaggttgagttcttcaccaaggtacttgacttgggtgattttgaccctttcaaggacgtgaaggatgacattttgcttgacgaagacaatattgctagtgaagaggaggtcaacaaggaggagcaaggtgatgatgccactatttag

SEQ ID NO: 113466 - DNA, 684 bp, Glycine max
  Peptide Sequence Number=SeqID_230244
atggcgcccttgtttgttgttgttgcacctttactaaggaccagcatggtgaccaccagtgcctctgtggcgcctccgccttactcttcagctccaatagttcctccctctactatagtggctttgacttccaccttctctcaccctcgtgtttccctggatcacatctatacttcccatgatgttgattccttgtgggagacaccaaggaaagtgtcatttttggaggctgaagatgccaaatggagggcaactgctcgcactgtttggagagtggagcaccctaaggtagctggtgccttcgttgcttttgctgaggctgtgaggttgaaccacgaactgtcttctaaagttggcaatgtgttggccatgttgttacgcaccaggttggacaatgatgaactattcaaatgctataaggacttgcaggaagagaagaagaacttggctggtagggtggaggacttgcgacaaagaagggagtcaaagtccaagctgtgggatgctagagagagggagaccaataaggagcttgagaaggaactgctcatttccaagaaggaggttatagagcagcatgaaaaggggttcgacaaggttgtcaggcaggctaggttcttcaccaaggaggtcaacaaggaggagcagggagttgaggagcaaggcgatgatgccactatttag

SEQ ID NO: 113467 - DNA, 294 bp, Glycine max
  Peptide Sequence Number=SeqID_230245
atgccgatgttggatcaatttcatccatgcattcatgatttcattgaaaacattgttgatgtcaaagctgatggtatggttgaagattcatggtctttggttcacaaccatttgcttaaagaacttgcaaaatggcctaatgagtatatgaacctagtttgtggcaaagacgatgttcactctcccttatggttcctttttctccaattttcaacaaatatattcaagggaaatgaaacaccggaaagcgcaccgagtcgtcaacctaaaatactaaacctcgatccctcataa

SEQ ID NO: 113468 - DNA, 1665 bp, Glycine max
  Peptide Sequence Number=SeqID_230246
atgggcaacacaccacttcttatactcagcaaaatccagagctgtcctatgtcagggtggacatggctaaggtgggctcaaagatctcgcacgtcagatgatgagtggcctttgttaagagtacacgagggaggacttgtaaaacaaaggacttcgacactcaatggctgttacggtaacgagggccacaagcttgtcaaggccctaagcatggacaagtgttgttcagtgttgagagtggtagccttgacaagtgttgtccgggttgcttctgtcaagttgtctggggtggacaccctttttgatgcaagaggctccaagaggattgggctagagctgctgaagaaggtcctaaggcgggtgcagcatatgcatgttgttcttacttcttacatacgtgtcactcatggaatgacacatattggagacatggtgcatggggtcgtctccatcggcggttcctcctcggaggagactcgccatggggctttcgatagcaagtccgcttcctcaaagagtgtgacggtcttgtgtcgtgctggtggaggcacttctcacctccgcgggagggtgcaaccttccactacttctccagtttgggaacttgttctggtcaccatgattcttcccctagtggtggcggggacgttaaggcgttccctcgtgtgcaatgtagccatagtgttgggttgccctcgtcccccttgccgttgccgtgatgatttcccttttctaagggcgacatcgggcaattcgcccttcttttttatgtacatgtgtatgttcaaggtcttgagtcaagttctctcctggatcactttccagcatgctctgcttgagcacttgaacatggccccttctcaactccaccccaatagttgggccatggtgaaagcctttgagattttgtgccccttcttcaatatccgacccagtgtgtcggaccatttctccaagatcccggctattgtcattgtgactgatggcctgccattaacgttcaacagagaaggggagccctatttctcgttctactggaaattcgaccccaccaggttcaagtcgtttgatgaggatctattgacccttgttgagaagagaagaggtcaacttactgttgaggttggccttgcttctgaagtcgttgaggtcttccccaatattccttcctctcttttggctaagaggaagagagatgacggtgctgggacttctgctcttgcttttgctattgttccttctcctccacctccacctactgtggttgttaaagaggttgctcctactgctaaagtcagtgcaccagccacttttgctagtcttgtcgtggcaccttcatccaccgtcactgcacccttgttcagtgccaattttttgacaacaagtgctctagaaatgtggcctccttcttttttcggtccactaacaatgacccctagaggctctgagcaaggtggcgtccttagaggtgaagattggcaagtggagggtcaaaccatcaactaccttcctaggttggtagtgttcttaccaagttgttgcgcacccggctggatggacaagcttgccaaggtagtcgtggacctgaaggcccgactgaaggagtcagagtccaggatggaggattccgagttatgggcatccaaggagagggaggctaactag

SEQ ID NO: 113469 - DNA, 774 bp, Glycine max
  Peptide Sequence Number=SeqID_230247
atggccaaaatcaaagaagaggctaccaagctgcaaccatcacgaagatataatacaaaggacaattgcctccctggtcatagcaccacaggcttgtcaaacccaaggtccgcccttggtgagccttgctcccccaaaggctcgtcaagtccaaggtccacccttagtgaacctcgcttctccaaagctcaaaaaaaccgctcgtcaaacccaaggtctgcccttggtgagtctcgctcctccaaaggctcgtcaaatgcaaggtctgcccttagggagtctcaaaggcttgtcatacccaaggctcgaaaaatcccaagtccaccgttggtgagtctcactcctcaaaaggcttgtcaaacccaaggtccatacttggcaagtgtcacaagctcctcaaacctaagtttcgcccttggtgagtcttgctcctcatacccaaggtctacccttggtgagtctcataggctcatcaaacccaaggctcaaaagacccaaggtttgtccttggtgagtcttacaggctcgtcaaacccaaggcccgcccttggtgagtctcacttctccaaaggcttgtcaaacccaaggttcacccttagtgagtctcatttctccaaagtctcgtcaaacccaatgcctgcccttggtgagtctcacattaccaagggctcattaaaccaaaggtccacccttggaacaccacaaacccaaggtctacccttggtatggactctacaaaaccaaaggcgcgcccttggtaagcttactcattag

SEQ ID NO: 113470 - DNA, 459 bp, Glycine max
  Peptide Sequence Number=SeqID_230248
atgatcaggatgtttaagatgttcaagatgttcaagaatcaagaatcaagattcaaggttcaagcttccaagaatcaagatcaagattcaagaatcaagagaagacttaatcaagataagtatgaaaagggtacatcctttgtggtacaagtagagggtacatccactaggttcaaagagaacaagggagggtacatcccttgtgaatctttgcttgtaaaaggatttttacaaggttggaaaaagaaatctcaaggaccgcaggatctcaaccagaagattgcatctctagctagggagaaaggaaacaagcacaatgaaagtagaaaggtgagtgcacggattctcatgattttgtttgtagaactgatggttcttaataagttggaagagtgttggcttcatctccaaattcactacattggtgaatgttggccttgcaatggtgttgaagtgtga

SEQ ID NO: 113471 - DNA, 387 bp, Glycine max
  Peptide Sequence Number=SeqID_230249
atgcagctattcaaagagaagaataaaatggttcaaatttttaacaatatcattcagctcaaaaagggtgcaaaggatataattatcattcaaggaaatcaatgtccaaactggagaatcattcagcagttcatccaatcagaaaattcagaactatcatctatgttgcaagatggcgaatcaggaaaggaaacagcttcattagatgattcattggagatgattatcagaggtggagctggagctggtggaggagacaatatttcaagctcaagagaaggaggtggatccactactagaggttgtggtttagctggtatcggctcagtccttgctagtttgggcttaggaggaacaacctcatgggatctctccaatggaagctaa

SEQ ID NO: 113472 - DNA, 780 bp, Glycine max
  Peptide Sequence Number=SeqID_230250
atggatgaggtggcagatgcactctacaaaggctcgggttcggatggaactccagctttgttatatctgcagttttgggacattgtaggagctgaagtgactcgcttggccttggaaatcctcaacggcaacaaagatccttcaggcataaacaaaacacacattgttctcattccaaagctgaaactagtccttccagagttgattgatgagacccaagcggtgtttgtccatgattgtcagattacaggcaatgctattgcaaatgcttgcccaaatgagatatctgatcttaaagtgtgtgtctccaaggtttccttttcggtgatgatcaatggacagcctcagaaggacttcgaaccacaaaggggcctcagacaaagggaccccccttccccctatttgtttatcctctgctctgaaactttatctgccctcattaatagagctattgagagaaagcatctccatggcatcctatctctggccaacattctaaagacctacgaagtagcaccgggtcataaaggcctccccaccatcattggtaggtccaagtcccaagtgtttcaatttgtcaagaataaggtgtggaagaagcttaaagggtggaaggaaaagttcttttctccagcgggtaggggtttagcagtggtccaagccattccctcctatgtcatggaatgttttaggcttctgaattctgtttgtaaccagattgaagctctcactgtgaaatttttttggagtggcaatgtagatgaaagggagatccactga

SEQ ID NO: 113473 - DNA, 1005 bp, Glycine max
  Peptide Sequence Number=SeqID_230251
atggtgatgcaaggattgaagttgggtggtgatgtgccttttacaaagatttatttgcatcccatggttcgtgatgcacatggacgcaagatgtccaagtccttagggaatgttgttgatcccattgaagtgataaatgggatatcacttgaaggtctacataagaggttagaggctggtaacctggaccccaaagaactagccattgctatagagggtcagaagaaggactttccaaatggtattgatgaatgtggtgttgatgctctccgttttgcactggtttcatacacagctcagtctgacaaaattaacctagatattcaaagggtggttgggtatcgccaatggtgtaataaactgtggaatgcagtacgatttgctatgagcaagcttggggatgattacatccctcctgccaatttgattccagatgttctcccatttagctgcaagtggatactctcagtgttaaataaaaccatattcaaaacagtgaagtcgctagaatcatttgaattctcacaagctaccactgctgtgtattcttggtggcagtatcaattgtgtgatgtattcatcgaagtgattaagccttactttactgaattatggcagcgccttccttcaaccagggaatgcgagagagcagaatctatcatgatatgtgattatccatcaactgtagagggctggaataatgaaaaggtggagaatgatatggacattattgagtctactgttaagtctctcaggtcactagcaaaagaaagttgtgacagccaccaactagatattgcaacattagctaatctatcctctttgacagtaatcactgaaaaagatgctgtttcatctggatatgctgatgctgttgtaaatgaaaacctttctgtttatttagagtttcaaggagctaattctgcagaagcagaggggaagatcaagaagatagatgagctgcaaaagcaaatagaaaggctagagaagatgatgaacgcttaa

SEQ ID NO: 113474 - DNA, 1713 bp, Glycine max
  Peptide Sequence Number=SeqID_230252
atgagttgggtgtacgagcaatttatatgtgcatttcttgttgggtgcacgttccttagtgtattatctcatcctgataaagctccaaagtacacatttctaagagaagcagcatctgctccacaaatcttaacttatgattacatagtgattggtggaggaacatgtgggtgtccactagcagcaactctctcacaaggtgcaacagtcttagtccttgaaaggggaggctctccttacacaaaccctgagcaaatcaacataaataacttcgtgaattccctcgctgacataagcccttcatcattttcccagccatttatatccagagacggggtcctcaattcgcgggcccgtgcccttggtggtggctctgtcttgaatgcagggttctattcaagggctagctccaagtacatagtggattctggttggaatgaaactttggctaaggactcatatcaatgggttgaaaaaaaagtggcctttgagccccctatgctgcagtggcaatcagcagtgaaggatggtttgcttgaagtaggtgtgttgccttacaatggtttcacttttgatcatttatatgggactaaggttggagggacaatttttgacaaggagggtaacaggcacactgctgctgatttgttagagtatgctgatcccaagaggatttccgtttatctccatgccacagtgcagaagatactatttaagtataacacagaaaaaagaaggcaacaagcttatggagtaattttcaaagatgcattgggggtgatgcatagagcatacctaagcacaaaaggaaaaagtgagataatcttatcagctggtgcaattggaagcccacagttgctgatgctgagtgggattggtcctgctaaccatcttcaggctcatggaatcaaagtggttttggatcagcccttggtgggtcaagggatggcagataatccattgaacgttctattggttccttcccctgtgcctgttgaagtctctctggtccaaacagtgggcatcactaagtttggtagcttcattgaagcagccagtggattgagcttgggccattcttggtctgaaaggcttcaagggatttttgaatttgtgtcaaaccagtctggccagccttccatgtttcccccagttgcagacaccattagatctttagcaaatccaattctcaaaggaggagtgctacttgaaaagatcataggaccacggtccacgggtcatttggagctcataaacacaaaccccaatgataatccatcagttaccttcaactattttaaggacccagaagacttaaggaagtgtgttgaaggcatgagaaccatcatagatgtgataaactcaaaagcattctcaaagttccgctaccataacatgccggtccaatctctaatagacttgatgttgcacttgccagtgaacttgaggcctaaacatgctaatgctgccttttctttagaacagtattgcatagacactgtgctaacaatttggcattaccatggggggtgccaatctggtaaagttgttgatcataattataaggttattggtgtggaagctttgagggtaattgatggatccacttttcatcgctcacctggtacaaatcctcaagctactgtaatgatgcttggaaggtatatgggagaaaagattataaagaaaagattcttccatgggcggaagtga

SEQ ID NO: 113475 - DNA, 621 bp, Glycine max
  Peptide Sequence Number=SeqID_230253
atgcagtaccttggtcaaaatgaggcctctctagcatgccctcatgggtgttgccctacttccttattgttcaaccctccaccaccaccaccactacaaactcagaacacaacaaccaaacctaggaacagttctgctgagtgtagacacagctttgcagcaacaacagcatcctcaatcttcccaaacaccaaattcaccaaccatgagtccctcccttctctgcatgagtcattcagtgagttcaagaaagtgtaccctcaatactccgagactgatcaagtggaccatgtgagagacaaagaatattaccacctctctttctccaaccaatcatgccttgactacattggtattggcctcttctcttattaccaacgccaacaccaccatgacacctcaaaaacccaacttgcatcttcttcaacacccccatccccaccccaatattctgataatattcccttctttagcatatcctacaagactgggaatttgaagacactgttgcttcatggggggcaggaatcagagtttgagtctgcaatgaggagaagaataatgaacaaacagaacctcagctttcaagcttgtggcagactcatatccattccaatctag

SEQ ID NO: 113476 - DNA, 519 bp, Glycine max
  Peptide Sequence Number=SeqID_230254
atgagcaggttgcactgcatgcaactgttgaggaagcttgctagcttctttgtgagggctcgatcacgacaaatggcttggtcactagctgccatatttttaatcaattgcatagctttatcaggtgtctacaatttgatcttcccaccaacagaggcactgaacccatgggtgggagtcttccagagtaaaccgtggaagtggtctagagcttcacttaatgattcatcagggaatttatggaatgaagagatctccatctttccctcagcggtcttggactccggaaaacatttctccaagaatttctccaccacctcttcccatgtctacaagttatttctcttgaacgagtacaaccatctttttgcttcaccagccaaggagaaggagaacaggttgagggggatggcatcttctggaactcctgctatcttcaccctgttgcagatctctatgtatgtagcaaggtgggcatatggatcttcattaggtagcccatggaagagattgccttga

SEQ ID NO: 113477 - DNA, 447 bp, Glycine max
  Peptide Sequence Number=SeqID_230255
atgccctacacaagttgtagaagtccacaaggccttggactctcaaagattggtaactcatgccattttgacgttttgtttgtggatataaatcatcgcatgccactaagtatctatactgacctcaacatcatgttcctcgcttgtaacataacttgtcctcaccattccacaatgtggaagattgataattttaatgtttctaagggacatgggttggttaccactggcggtggtgttggaaactcgggtaaggaaaccattggcaattggttcaatattgtgaagtatgatggtgcttataactataaaattgcatattgtctcagtatgtgcccttcttgcaagcacgagtgcaagaatgttgggatggttatggatcagaatgggaaccagtgtttggcactaagtgatgttcccttccaatttagattcttcaaggcttaa

SEQ ID NO: 113478 - DNA, 606 bp, Glycine max
  Peptide Sequence Number=SeqID_230256
atgtatgatgaattttatggcgagctccaatggcgtcaatggcatggacgaatcacccgcctaccagagaagcagatagacgttgctctggtgaaagagttttacttcaatatctatgatctagaggatggttcaccaaagcagtgtagggccattgtgaccaagctgtgcactccaagagggagattgatgctgactgctgacggggctccctggaagattctgcgaaaggaccgcaccaccttggcccaaacctggagtgtgatttcttacttcaacctttcttctacctcccacaccttggacctcaacatggatcggtctagtacatcgagagtcggcttccccgctctgatcactgccttatgcgacactcaaggagtctattcatacacattgacctacgagccccttagcccggtgatcaacctggcctacattaaaaagaactattggaatccaacagattcttctatcgcatttccaggggcaaggcgggtccatgccagagccactcaggacgcaccaccaccagcaccaccactagtcatccctcctccggttgcctcctcttccgtcagcccatcttcttcttcttcccagtag

SEQ ID NO: 113479 - DNA, 1020 bp, Glycine max
  Peptide Sequence Number=SeqID_230257
atggataaggctgggcaatctctgaaatgggttctcttggatttgattcacaaatgcaacgacttaagatccttcaagcaaatccatgcgcatctattgacttcttcccttattgccaatgacttggtgaccaaagctgcaaactttttgggaaaacatgtcactgatgttcattacccttgcaaaatcctgaagcaatttgattggatcttgagctctttcccttgcaatatgctgatttcagggtatgcctctggccagttaccctggcttgcaatcctgatttatagatggactgctaggaatgggtttgtgcctgatgtgtacactgtcccagctgttttgaaatcttgtggtaagttttctgggattggagaggctagacagtttcattcagtggctgttaagactggcttgtggtgtgacatttatgtgcaaaacaatcttgtccatgtttatagcatttgtggagacactgttggtgctggcaaggtgtttgatgacatgcttgttagagatgtggtctcttggactggtttgatatctgggtatgtgaaggctgggttgtttaatgatgccatttggttgttttttagaatggatgtggagcctaatgtggcaaccgttgttagcatacttggggcttgtgggaaattgggtcgttcaagtctggggaaggggattcatgggttggttctcaaatgtctgtatggggaggacttggtggtgtgcaatgctgtgttggatatgtatatgaagtgtgagtctgtgactgatgcaaggaaaatgtttgatgagatacctgtgaaaaatattatttcttggactagtatgataggcgggttagtgcagtgccagtgtcccagggaatcacttgacttgttcaatcaaatgcagtgctcaggttttgagcctgatggggttatactgactagtgtgctttctgcttgtgccagtcttgggcttcttgatgatggcagatgggtccatgaatacattgatcgtcgccgtatcaagtag

SEQ ID NO: 113480 - DNA, 261 bp, Glycine max
  Peptide Sequence Number=SeqID_230258
atgggttggctttttcatagaagtcatctaaaagttaagctaggctccatgactcctttccatgatttgttccaattcaatctgctgacttggctacttgacttctccatagacaatggttggtgtggtgtgatgaagaaactcttggacattatatttgagggtggtgttgaagcaagaaaacatgcctccattgagcttccattattcaacatgggtcttctacacagagctataaagagaactataggcctatggtag

SEQ ID NO: 113481 - DNA, 663 bp, Glycine max
  Peptide Sequence Number=SeqID_230259
atggcacagcgtatcttcaatggaatgctttttaagaatatccgcacttggaatgcctatataggtggtctagcaataaatggatatgggaaggaagcattgaaacgatttgaagatttggttgagtctggcgcaaggcctaatgaggtgacatttctagctgtttatacggcttgctgccataatggtttggttgacgaaggccgcaagtatttcaatgagatgacaagtcctcactacaacctttctccctgtttagaacactatggatgcatgaatgttgaatttcaagatagtggaatatatgtgcttctttctaatctgtatgccactaacaagaaatgggctgaagtgagaagcattaggagactgatgaagcaaaaaggaataagcaaggctccaggttctagcatcataagcgtggatggcatgagtcatgaatttttagttggagatattagccatcctcaaacaattcaggagcaaggtggatacgtagttgccttttatagggttcagaggggaattttatcttgcatatgtgaaacagtgacaacgtttcatgtttatgattgtgagggattggtcaatggtcacctgaaccttgatgagagtagttactgtgcctcaagctctgacattgagaccgaaacagagaaatag

SEQ ID NO: 113482 - DNA, 981 bp, Glycine max
  Peptide Sequence Number=SeqID_230260
atggaagcgaatcccacccacgacggggatgacacctcggagacgccaccgccgcccatggtggacccgtccccatctccgccgcctcaaatgaaagaagaggtgatggacgcggagcaaggcggtgacacatctcttccgatgaccgttgttccggcgcatttgccggtgtcgaaggcggcggcgaagaggccgtcgaaggatcggcacacgaaggtggagggtcgtggccggagaatcaggatgccggcgacatgcgcggcgaggatcttccagctgacgcgggaactgggacacaagtccgacggggaaacaatccggtggttgctggagcacgctgagccggcaatcatcgaggccaccggcaccggcaccatcccggcgatcgcggtctcggtcggcggcaccctcaagattccgacatcctcggcagcaagacccgagggagaagttgacactccgaaaaagcgaaggaggagagcatcaaacagcgaattcatcgacgtgaacgaaaaccaggtttctgtctcttcagggctggcaccaatcgcgcaaagcgcgtatggaagtggtgttggtggtggacttgttcctctgtggcatggtaacgctgctgcttcggggcctttcttcatgtttccgaacgcttcaaacccgcctcagtattgggccattccggcgacagcggccccgtttttcaacgtccaggcccggcccatttcggggttcgtttccgccttgcagatgcagcatgacaaccaccactctttaaacggtgcagcctcggattccgttaactcttcttccactgtgggttctactatgagcacggtgactgttactaccagttctggctctggttctgcttctggttcttccgctgctacaaccactcaaatgctcagggatttctctttggaaatttatgacaagaaagagcttcaatttttgggtcaaccaccaccctcttcaaagccttga

SEQ ID NO: 113483 - DNA, 285 bp, Glycine max
  Peptide Sequence Number=SeqID_230261
atggtggcaacaagaacattgacatccttaggaacaacatcaccgcggtacatcaagcaacaacctatgtacttgccatgcctggggtcacacttggccatcatactcgcgggctcaaacatgacatttgtaatctatggcaccgacaactgctcatggttggagtggaacttagtgatatccacattgataccaccatcaaacctcaaggaagtgagcttgttgagcttggagaccagtgcagttgtctatgagttttcagaagcgatccaagcacacatctaa

SEQ ID NO: 113484 - DNA, 372 bp, Glycine max
  Peptide Sequence Number=SeqID_230262
atggaggatagcgttgtggtgtgggatactgggatggatggagcagagtctgataggttctgcgtcaacgagagagagagagagctggggtcacgtgaggttgtgcacgtgctgtatggcgggcccaaaaggattggtggggaaagtgaggtggtccgtggttcaaggtgtgatgcctcaatagggtgtgatgcctcaatattgcgggactcaacagccaccaaccaagctgagaaagatggccctcctaatatgtcagttcgatcattctatgtgattgatgaagccgaagcaaagcttgaattggtttgcccacgcacggtttcttgtgttgatataattgccatttcagctagagatgtggtagccatg

SEQ ID NO: 113485 - DNA, 117 bp, Glycine max
  Peptide Sequence Number=SeqID_230263
atgtttccaggccttgaaggttttcccaatcatactgaaaatgctactgatgtacaggatgggatggataggctatcaaaattacttgacagcataagttctgtgcacaatgaagcg

SEQ ID NO: 113486 - DNA, 120 bp, Glycine max
  Peptide Sequence Number=SeqID_230264
atgtggtctggtttagatatggtttgtgcattgggccttgttgaccacctagcatctatgacggtggaggagagggaggcgtttaggatgggcaatgcgtcttgtggtggaggaggatga

SEQ ID NO: 113487 - DNA, 3315 bp, Glycine max
  Peptide Sequence Number=SeqID_230265
atgagagcatacaaactcttgtggcttttcttgatacaattctgcttaataaactatagtgccaacatctttccagcaaatggttattttcttggccatcagtgttccgttgtcctccatttgaaaaatagcctaatattcaactctacaaaatccaaaaagcttaccctttggaaccaaactgaagattgttgccaatggcatggggtgacatgcaatgaggggcgtgttatagcccttgatctcagtgaggagtctatctcgggaggactcgttaattcaagctctcttttcagccttcaatatctacagagcttgaatttggctttcaataacttaagttcggtgattccttcggagttgtacaagctgaataatttgagttatttgaacttgtctaatgctggatttgaggggcagattccagatgaaatttttcacctcagaaggttagttactcttgatttgtcttcttcatttacctcaagtcatagactgaaacttgagaagccagacatagcagtgtttcaaaaccttacagatatcacagaattgtatctagatggtgtagcaatatctgccaaaggacaggaatggggtcatgctttatcttcatcgcagaagctacgtgttttgagcatgtcatcatgcaatctctctggacctattgattcttcactagcaaagcttctgccactcactgttctaaaattgagccacaacaacatgtcaagcgcagtgccagaatcctttgtaaatttctccaatttagtcacactagagttaagaagttgtggcttgaatggttcttttccaaaagatatattccaaatatcaacgttgaaggtccttgacatctcagacaaccaagatcttgggggttctttgccaaacttcccacaacatggttctcttcatcacatgaatcttagctatacaaatttctcaggaaagcttccaggtgcaatttccaatatgaagcagttatctacaattgatctagcttactgccaatttaatggaacacttcctagttcattctcagaactcagccaacttgtttatctagacttgtcttccaataactttacaggtccacttccttcttttaatttgtccaagaatctcacatatttatccctctttcataatcatttaagtggggtgttgccatccagtcattttgagggccttaaaaagcttgtcagcattgatttggggtttaattttttcggtgggagtcttcccttgtctcttcttaaactcccatatctgcgagaaattaagctaccttttaatcaattcaatggttccttggatgagtttgtgattgcctcccctgtactggagatgcttgatttaggtagcaataatttgcatgggcctattcctttgtccatttttaatctcagaacccttggtgtcattcaacttaagtcaaacaaatttaatggcacaatacaattggacatgattcgcaggctgagtaatttaactacgttttgcctctcacataacaatttgtcagttgatatatacactagagatggtcaggacctgtcaccctttccagctctaagaaatctaatgttggcatcttgcaagctgagaggaatccccagtttcttgagaaatcaatcttcattactatatgttgacctagctgacaacgagattgaaggaccaataccttattggatttggcaacttgaatatcttgttcacttgaatctttcaaaaaatttcctgacaaaattggaaggaagtgtctggaactttagttctaaccttttgaatgtcgatctaagttccaaccaactgcaagggccttttcctttcattccaacttttgtaaattatttggactactcaaacaatagattcaactctgtcattccactggacattggaaatcgtctccctttcgtaatatggttgtctctttcaaacaacagttttcagggaggaatccacaaatccttttgcaatgcttcaagtcttcgcctgctagatctttcccaaaataattttgttgggacaattcccaagtgtttttctaagttgagtatcactcttagggtgttgaagttaggtggaaacaaacttcaaggatatattccaaacactctgccaacttcatgcactctaaagttattggatctaaatgacaatttcttggagggtaccattccaaaatctttagccaattgccagaaactacaggtcctaaaccttcgaagaaacatgttaaatgacaaatttccttgtttcttaagtaatatttccaccttacggatcatggatttacggttaaacaaacttcacgggtcaattggatgcctaagaagcagtggtgattgggaaatgctccatattgttgatgtggcctccaataattttagtggtgcaataccaggagcactattaaacagttggaaagcaatgatgcgtgacaatgttagaccagaatttggccacttattcatggatatcattgagggctatgatcccaaaaattttaaggatttattggcacatttggacaaaaatattgtagcaaaattagttaaacttgttacaaacatatctcgctctatccttgaccagggatcctcggattcatatgcagtggatctttctcgatatcaaaattcaattcttattactaacaaaggtcaacaaatgcagttggacagaatccaaagggccttcacttacgtggatatgtcaagcaacaattttgagggtccaatacctaatgagctaatgcagttcacggcaatgattggacttaacttgtcaaataatgccctctcaggtcatatcccacaatctattggaaatttgaagaatcttgagtctttagacttgtcaaacaattctttcaatggggaaattcctacagagcttgcaagtctatctttccttgaatatttgaatctctcatataatcacctagcgggtgaaattcctactggtactcaaattcaatcatttgatgctgattcctttgaagggaacgaagaattatgtggatctccactgacccataattgcagcaatgatggggtgccaacaccggaaacgcctcattcccatactgagagttcaattgattggaatttattaagcatagagttgggatttatctttggctttggaattttcatcctcccccttattctttggaggagatggagactgtggtattccaaacacgtagaagagatgcttcacagaatcatcccccatcttgattttgtgtatgaacaccaaggagggcatagttacagaactctatggtggaggtattga

SEQ ID NO: 113488 - DNA, 204 bp, Glycine max
  Peptide Sequence Number=SeqID_230266
atggcagaaatcaaccaaggtaagacgatgaccggtcacgattggtcgtatatcatttggctcttacgtgcagttgagggtttgaatgagaaggccttaggcctaggttgtattctgaagcaatggggcatgccacattgcccccattctcttgcaatttatgtccaaacatgcgcccaccaagtgctcggtgaaatgccttaa

SEQ ID NO: 113489 - DNA, 240 bp, Glycine max
  Peptide Sequence Number=SeqID_230267
atgccaacgtcatcacgtcggcttggtgactcctcacccgaatcttactccctacaccctgccactgtcattctgctcccacgaacaagaatgatgcatgcacctgactcaacactcagacgcaatgtggtacgtaccaacaacaaccaaacctcaggaaatagcctaagcatgtccacacgacactctcacttagggaactgtgctgagtttgtcgagaccacccggttgtgcacgtaa

SEQ ID NO: 113490 - DNA, 375 bp, Glycine max
  Peptide Sequence Number=SeqID_230268
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgttactccccattgcagttactttttgtgcatttatgtctcaaggaaatttcaatgggggtttatcgaaaagtgcactagatcgtcaacctaaattactaaaccctcgatccctcgttaggctgaatatccaaccttcgtctgtagatccctcatgtaagactgcacctgatttagacaaccttcttaggtttaggctaacttaa

SEQ ID NO: 113491 - DNA, 270 bp, Glycine max
  Peptide Sequence Number=SeqID_230269
atgacgggaatagctgtaagcccactatttcgagctgcatattcatcacaagctacaaagcagaaactcactctgctagttccatggctttgcaaatcaaatgaagaactggcttatcccaccaatctcaattttactttaccagaagaactggtggagtataatacttggtggagagattgctgtcaatttataccatccagggatgttggcattgctatcctggaagaaccagaacatttgaagtggtatcctactaagcttggatga

SEQ ID NO: 113492 - DNA, 309 bp, Glycine max
  Peptide Sequence Number=SeqID_230270
atggtctgccatgaccatgctgacatgacaggcagattgctcgctgggtcatttacctttgagtgtcacatcatgcactgtattctttgtcgaattttgcttcctaggtccattaatcttgcccaagcctctgaggaggatttaatcttgttgtgggctcttcaaactggtcgtcagattgactgggcccatctttgggtgcacaagcaagacctaccacctcccattcccagtgagcatacaccatctccaccaccgcaacgggatacctcttcttctctcttgactgacgtcctcactgaactctga

SEQ ID NO: 113493 - DNA, 269 bp, Glycine max
  Peptide Sequence Number=SeqID_230271
gttggtcagcgctttggacggcattttgatgcaagtgttgatcttggagatggaaaacgcacttattatactctactagtgtatttgagtggtgggcctggtgaacttaaatcaaagcccaaaaatgattccagcaacccctcagtttcatctgttgatcctttagtcggaggagaaacagtggctcctactgaagggacagccctactgcaccttcatggagataaatgtttcttgcatgaagccagaaacgttaccaagggtgttaa

SEQ ID NO: 113494 - DNA, 810 bp, Glycine max
  Peptide Sequence Number=SeqID_230272
atgcttgtttttcctataaataggcgtggagggaggctgatcaaggggttggaaggtccagaaggtcaggaattgagagaagagagaaagaaaaagaagaaagaagaggaaacgaggccgaatcgcgatcgcgatcattccttactttgtttcttgttcggcgttcttcgtgcaaccaccgactctcctttggcttttcgcccgcattcctgtcaaagggtaggttgcgacaatagccaagatgaggctactacttcaccttcctctagtgaaagtgaagaagcaaaagaggaagaatctagtgaagaaatctacccccaagaagaaggacaacctttaatggttaaggatgagtgtaaggaggtaagtgtctcctccaagaggttagctaaaaaggaaagtcattttgcactaaagacaaacattaaagaaacttcccctcttagacaacctccacatcttcgcctttgtaaaaagacacttgttagcactgccacacctgttgggcttggggttattcctcaagtaaaggagttgttggataagagtttggtttgtaagagcttaaatccttatgctttgttggtgcccaaaatagtgatcccacgggttaccatgaaccctaagagaataaaggtcattcttgagtggtccactccaccaagtataaagaaaatctggggcttccatggcttaagaaacttttacaaaaggtttatcccatatttttctatacttgtagcaccacttattgagttggtgaggaaccatgttctctcatgggaagatgcccaagaaaggggattttag

SEQ ID NO: 113495 - DNA, 675 bp, Glycine max
  Peptide Sequence Number=SeqID_230273
atgatgacaaaggtgatgacaaaaagctcaaaggtcaatcaaaggatgagttcaagatgttcaagaaggaatcaagaacaattcaagatcaaggctcaagaggaaaagttgaagaacacttcaagattcaagaagaaggatgaattcaagattcaaattcaaggatcaagcttcaagaatcaagatcaagattcaagattcaagattcaagaatcaagagaagacttaatcaagataagtatgaaaaagatttttcaaaaactgagtagcacatggagtttcacaaaacatgtttaccaaagagtttttactctctgtagagggtacatctacttgggtttgactgagaacaagagagggtatatctcttgtggatcagttctagtggagggtacatcgactagggtttcaaagagaaacaagggagggttattcgaagatcatgatgaagaccaagtcaacttgtgtctcatgacaaaatctgatgagaataacaaagaagattctgtgttatgcaatagatacactaagactcaatcctatatgcaatgtggtaccatgttagtgaaaaacctcgtcgagcgcctaggagaacatgataagacagatcacacactggatcagcacatgcttaaaggagcactcaacccaggtgtatttacctcgaaggcctag

SEQ ID NO: 113496 - DNA, 273 bp, Glycine max
  Peptide Sequence Number=SeqID_230274
atgtcagtgaaaaacctcgtcgggtgcctaggagtacatgacaagacaaaccacacactagtaagtcaagtcactctcactagctttaactcgtcgtccaaaaagggacttaacattaattcgtcgcccttaaagggacttaacattaactcgttgcccaaaaagagacttaacattaactcgtcgcccttaaagggacttagcattaactcgtcgcccttaaagggacttagcattaactcgtcgcccttaaagggacttatagtcgtgtga

SEQ ID NO: 113497 - DNA, 519 bp, Glycine max
  Peptide Sequence Number=SeqID_230275
atgggtgaaataaagaaggtgcaagagtggatgaaggccaacatggaggccatgaaagagcaaatggccacaatgatggaggccatgatgagtataaagaagatattggaggtcaatgcggctgcagttaccgctaccaacgccgttgctgaggggggcaaagaattaggaagtacgggcggcccccattttgtgcaagttcagaacaagcatgcctttctgccatatggcttgcctcccaactatatgccacccaatgttgcgcacactcccgatgagattgtcaataactccgcaaccatacccgttgagagtcaacaacttcaagctgatcatgcacatgtctttcaacccatgggggagacacatgaaataccccaccacaacctagccaacttcgagcctcgcctcgaatacgccactaaggggcaaacagttggtggtgtacccctaccaaacactttggagggccctcagtttcgcccacaaccacaacccttgcattttgtgacggggaaa

SEQ ID NO: 113498 - DNA, 810 bp, Glycine max
  Peptide Sequence Number=SeqID_230276
atgggtgaaataaagaaggtgcaagagtggatgaaggccaacatggaggccatgaaagagcaaatggccacaatgatggaggccatgatgagtataaagaagatattggaggtcaatgcggctgcagttaccgctaccaacgccgttgctgaggggggcaaagaattaggaagtacgggcggcccccattttgtgcaagttcagaacaagcatgcctttctgccatatggcttgcctcccaactatatgccacccaatgttgcgcacactcccgatgagattgtcaataactccgcaaccatacccgttgagagtcaacaacttcaagctgatcatgcacatgtctttcaacccatgggggagacacatgaaataccccaccacaacctagccaacttcgagcctcgcctcgaatacgccactaaggggcaaacagttggtggtgtacccctaccaaacactttggagggccctcagtttcgcccacaaccacaacccttgcattttgtgacggggaaagtccctcctactatggcggaaaaagggaaattggatcatataaaggaaaggctgagggccattgaaggaggcggagaccatgcttttgctgacatggcagagttatgcctagtgcctgacgtcgtcatcccttcgaagttcaaggtgtcggatttcgataaatacaaggggactacttgtcctaagaatcacctaaagatgtgctacaggaaaatgggaggatatgccaaagatgaaaagttattgatgcatttcttccaagaaagtcttactggggcagccgtcacctga

SEQ ID NO: 113499 - DNA, 1098 bp, Glycine max
  Peptide Sequence Number=SeqID_230277
atgatgttcgtggttgaattccatagacatggggtgcttccaagaggtattaattcatcctttattgctttgatttccaagcgtgataaccctcaaaacttaggccattacatacctatttggtgggttgtctatacaaaatctttgttagccaataggatgagtaaggtgcttgacaaggttattgatccttgccaacgtgcatttattagaggtaggcaactccttcatagtgcacttgtggctaatgaggtgactacacatgtgagcccgcttagagttgtggcggaagatttgagtgggttgatgagagaagtgaaggcaaagaatttgtatggagagtataagaagagttgctttggagatttaggggtggatgaaaggatggtagaaagatatgctgatttattgaatttaaaaatgtttaatctaccatttatctatgttggcctaccaattggagctagtcataggagaaaagggactgggaaaccaatcattcaaaagttctcaaagaagttggcactttggaaacataaacaagtgtcctttggggggaggaacttagtggcgatacaaagaaaatccaatggagtggtgggatgtggaggtggaatttgtttcaccaaaaggattgtctatgggaagatgtactcaactcaaaatatgagaggtgaaaagggggtaggaacatcaattggtttgatgaagggggtaggagagggagaccaatgtcggttttggaagaatgagtggcttaatgggaagagtctagctaatctatttcctcgtttgtacctcatttcggttcaaaaaaaggatctagtaggagaggtgggcttttggagagagaggtggtgtggggatttaaaatggaggagggatacttttgtatgggaaatggccctcattgatgattcacaaagtttgttaggtgttgtacaagtcaagagaaattcctcggattcttggagatggagcaatatttctggaacatattctacgagttcggcatacaagattctaatcaaggaagctgaagtggagatggataaagacttctacacattgatgtggcagttaaagattcccaataaa

SEQ ID NO: 113500 - DNA, 279 bp, Glycine max
  Peptide Sequence Number=SeqID_230278
atgtcttcaaaaggcgacaatgccttcatttactttttgaagacaaaaatgtcttcaaaaggcgacaatgtcttcatttacttttcgaagatgacaatgtcttcaaaagccgaattgagctgcttaatgccagttgctgcgcaatctgtaaggttttttgacgtttcggaagagaatgcggaaattactcaaaagggagggcaaaagtgtcattttacaccttttcagacccctggctcgcccaggctagcctctggctcgcctgggccaccaaaataa

SEQ ID NO: 113501 - DNA, 204 bp, Glycine max
  Peptide Sequence Number=SeqID_230279
atgacaaaggaggaaggtcacgaaatgagggatttcgataaccattgccacaaccagagccactggccagcatgtccaccagtgcagatccgccttgccatgctagattggagcagtgatggaagcttcgtaggagcacctccactcgagggcgagggaaagggtgagggaaaggacgaggatggccaccatacacatctgtaa

SEQ ID NO: 113502 - DNA, 306 bp, Glycine max
  Peptide Sequence Number=SeqID_230280
atggatgccgtcaacagtactggcgagaaacgcgtgtcgccattgtcaatggcgagaagcatgctgacctggctaagagaagagggtgccgccattgtgcttggcgagacagttgacgtggatgttgtctcgctgctcccactggtgagaagcatgctgtctcgctgctcccaatggcgagaagccttccacgtaagcaatgccgccattgcttcctgcgagacaccttcacgccatgcatgccacagttctgaagatggcagtgtaggcttgcagtgtttagggttagggtttgtagtgttctga

SEQ ID NO: 113503 - DNA, 662 bp, Glycine max
  Peptide Sequence Number=SeqID_230281
atgtcgagccccgcttcgatcgcggcggcgatgaaggccttgcgcgcgtcttcaggctttttcctgccggcatccacggcggcgcagaccagcagcgccttgtctagcgcctcgccatcctccaccggccagtcctcgatcagggcccaggaggcggcctgggacgggtttctgccagcgcgtgttcatcgctcatccatgttggtttcgcgcccggctctaaacgaagcaggcgggatgcgcaatccgtttcggagccgaccggtgcggtcagtcgtcgcgtccgaacagccattcgcgaaggatgcgccggtttccaccgcccttgtgctgctgtctatgcggaactcatgggtgaagggtgccggaccggcggtcgtgcatcccgcaagcgcgagcgaaagggctattgcggccgatgatgcgagcgttttcatcctgtcctccgaggtccatctgcaaaaacgatatggaggcgcggaggttcccggaagcggcggatgcggcacgaaagaaaaaatagacgaggaagccaaagatgaaaagcgggatgaggttcgcaaaaccggacatatgattctcgtttctccctcccgttacgggggtctatccggagaggctgagacgaggcaaggggtagcacacatggtcgtcggtcacat

SEQ ID NO: 113504 - DNA, 1104 bp, Glycine max
  Peptide Sequence Number=SeqID_230282
atggcctctggaaagagaagagcttccacctttcgacctcaggaaccctatgacacctcacggttcgtttctgaggtcgcttgggagagatatgagcagaatatccatgccagaaacatccttccagagaggaatgttgagctacaggttactcagtacgacgagttccgacaggagctcgagcggtgtaggtggcaccgggtcttgactaggcagctagataaccacattgatgtggccctggtcaaggaattatatgctaatgtctttgatccagaagaaaagtcccctagacagtgcagagtgtggggcaagctgattaagttcgatgttgtgatattgaacgagtttctagagacccccgtggaccttaccacattggctcagacctggagcgtcttatcttattctaacctcgcccctacttctcacacgtctgatctgaacatggatagggcgaggttagtctatgctctagtgatgaagatggacatggacgtgagctatatcatttctagacagatatcacagatggcccagtccaactcctctcggctcagatttcctgcactcatcacagccttatgcatcgccagaggagttgtccctgattccctcacctttgagtccctgagtccaaccattaacttggcctacttcaggaagaattgttggaacccaaaggatccaatgatcaaatttcctgggtcccgcaaggccagggctcaaggtccttcagatacttctacttttgcccctgctcccactctagcacctgcaccagcaccagttcctcctccagcaccctccagcccctccacttcgagcatagatgtgatagtgctaatgctgcagagcctctaccacggcttatgcttggtgatgcagagtgagactcctacagcccagcagtcgcagccagaggcagaggcggaggagacgtcagatgacacacctgcggccacgcccatagaggtcactgatgaggatggcgcagtagagaccagcgttgatacagactatgtagcggatgacactttgatgccagctcaggatgcccccactacacctcatgatgacccagcaccagcccaggatgattga

SEQ ID NO: 113505 - DNA, 319 bp, Glycine max
  Peptide Sequence Number=SeqID_230283
acacgcaaagccacacagctatgatccttggcccctagaccactggggcagagagaccggtggtccacgtcgatctgagactgggaaggctgacagtccctacaagaagaaattaagaacatatttggggattgtcgctcatgataaggttgacgtgacatacgagacttcaaaggaagtccctgctactcagaaggacttgatatgggaggatattcagtttaaatctgatttgacgaggaaatgggcacttgcagccgacaaggacaatgtggacgatgctgtttgtgaaaagtacgacattagcaaggagaaatag

SEQ ID NO: 113506 - DNA, 127 bp, Glycine max
  Peptide Sequence Number=SeqID_230284
atgataaaagcctcgagggtccgtcccatccctgaaaatgctatgaggtgttgggaaatggttgaagttggtccggtctattactcttccccttgcgcctatttcgccttggggggttggttcacag

SEQ ID NO: 113507 - DNA, 135 bp, Glycine max
  Peptide Sequence Number=SeqID_230285
atgggattcagtggaaatatcttagtattactgcaaagggcagaaggccagaaacattcgtacttactgaaggatgttaagattgcttaccttggtaatttggttgatgagtgtgtggtggaagtgaatgtttaa

SEQ ID NO: 113508 - DNA, 141 bp, Glycine max
  Peptide Sequence Number=SeqID_230286
atgcctcatcctggtcctaaagacaacatagccctgcgtccaattccctatgcttggggcagagtccaacaaggaagacacatccaaccacatgcgtatggtgcagatcttgcatccaacaaagatctacaaattcaatga

SEQ ID NO: 113509 - DNA, 330 bp, Glycine max
  Peptide Sequence Number=SeqID_230287
atgggatatgcacataacagaattggtggtgggagacaaggaaactgctgcagcttggttaaccatctacacaaagtcatggtaatgggctgccctcttggtgatccttttgggtctgttcgtagtcatgggtatgttgctatcatctccccgcactgggagaacaaccttgtccccaaggttgtaagaatcacgcaaggagtcccaattcttccatgtgctgatgaatccaacttccaatccagcagggaaagtggcttgatgactaggtggttgtcgaaactggcgggagggagattgaatggggaatcgagcaaggggccatggtaa

SEQ ID NO: 113510 - DNA, 1259 bp, Glycine max
  misc_feature (94)..(94): n is a, c, g, or t
  Peptide Sequence Number=SeqID_230288
atggttaacgggcgctataccctgccgggcattaacggtggcagccctgaagtggtcaaaccggaaaccaccatcccgctgcatcagtcgctgncggttctggacggcgtctggctccccgtgcctttcctgcgcttcaacccgccgcggacttttgtggaagggccggataactgggcccgcgtacaggtgcgcaagcttgacacccccgacacggcaggcaatacccaccgcgtgaccctggcgcttgacagccagattgccggacatgccacgtccgccctctccccggtagagaacgatatcctgaatgggacccgctttgccctggcatggcgcgatgcagaagttgaaaatttcctcgatcaaacctggattgacggctggctgcgcgaggcgtttacccagtatgccgatggcgtagaaaaccgttccgagcgcgatctgcagcaggcgatgcgcagttttgaatatcaggcgcactggcttaacctgttgaccatgctcggtgaacagctcaccgtgccggaagtcaaatttgttacccatacgctcagcaccccggccattccggtcgacctgatcctcgacgtggggaatacccacacctgcggcgtgattattgaagaccacggcgatgcgaacgatggtctacgccagaccgccgaactgcaggtacgctcattaagcgagccgcaattccttaatgagccgctgtttaccagccgtcttgagttttcggaggcgcgttttggcaagcagcacttctcggttgaaagcggtcgcgaagatgcctttgtctggccgtcgattgtccgcgtcggtgatgaggcccgcaagctggcgatgcagcgtctcggaaccgaaggtaacagcggcatctccagcccgcgtcgctacctgtgggatgaaacaccggtggtacaggactggcgctttagccagatgaacagcaaaacccagcgtgaaccgcttgccaccgcgttcccgctgatgaacctgatgaacgatgacggcgagccgctcttcacgctgccgcaggatgagcgactgccggtcttctcgccgcagtacagccgcagcacgctgatgacgcacatgctgtgcgaactgctggcgcaggcactggggcagatcaacagcgtcgccacgcgcctgcgtctgggcttcccggcgtcgccgcgccagctgcgtaccctgatcctgacgctgccctccgccatgcctaagcaggagcgcgaaattttccggcgccgcat

SEQ ID NO: 113511 - DNA, 357 bp, Glycine max
  Peptide Sequence Number=SeqID_230289
atgatgcaaaagaacttctttctggattttaagctcctgttgtccaagatccagagtttattcaaacaagcccttggtccccatagcaccaaatatggaatagaagaaaagtttaggactttaggttggggacttacatcaaacaggaacttgacacgacacgagccagctcttagcatcacgactcaatgtgacaccactggcgactacacttctgatcgtagccacaacaatgcactctgccagagtgcttctacattaggaacagtgctacttcttccaccgcctaaagtcacaatgcaacaccaactacgcatttgtgtttatgtccgatcaacggaaatgagagagcgttga

SEQ ID NO: 113512 - DNA, 492 bp, Glycine max
  Peptide Sequence Number=SeqID_230290
atggtgtcacacacaagaaccctccaagatttttatgatcgaattgagagattggatagtatcacactattttgtctctttgaagattgtgaactagtggactttgaagaagttgtgcaatataaaagatggagaaatgcgatggacgaagaaattagatccatcaagaagaacgccacattggaactcgtctcccttccaaaagggcgcaaggctattggtgttaagtgggtgtacaaaacaaagaagaatgccaagggagaaattgaaagatataaggcaagactagttgtaaaaggttatagtcaaaaggctagctcaacacaagtggagaattctttagatggacatgaagtttgccttcttgaatggagtcctcgaggaagaagtatacatcaagcaactgttgagatacaaggtgaaagaagaagaagacaaagttctcaagataaagaagacactttatggactaaaacaagtcgctcaagctag

SEQ ID NO: 113513 - DNA, 894 bp, Glycine max
  Peptide Sequence Number=SeqID_230291
atgttattgatggcatgcatagacgtgactaaggcaaatgaagaagttgtgtggtttcttgactctggatgtagcaatcacatgtgcggtaagaaggaatatttctcagatcttgatgaaaattacaaagattcagtcaaattgggcaataattccagtatggctgtaacgggcaaagatttgaggaataacttactaagtattgggcaattacaagaaaagggacttagtattctgtttcaacatggaaagtgcaaggtgtttcatcctgaaaacggtttaatcatggaaaccagaatctcttccaatcgaatgttcatgctacatgccatatctcaacctaccaaatccacttgctttcacacagttacagaggatatagtgcatctttggcattgcagatatggacatttgagttttcggggtttaaatacgctttaccagcagagtatggtatatggtttgccaacaatgaaagcaccaacaaaactgtgccaggactgcttggtagggaagcaatcacgagcttcattcccaaagaagagtacttggagggctacacaggttctacaactaattcatgcagatatttgtggaccaatcacacctatctccaacagcaaaaagaggtatttgctcacctttattgatgatttcagtagaaaaacttggatagatttcttgacagaaaaatcagaagctctttctgtctttaagaaatttaaaattcttgttgagaaagaagctgactcattaatcagaagtttgcgcactgatcgtgggggagagtttacatcacaggatttcaccaatttttgttgtgacaatggtattcgtaggcaactaacagctgcatacacaccacaacagaacggaaaaatagaaccatcatga

SEQ ID NO: 113514 - DNA, 762 bp, Glycine max
  Peptide Sequence Number=SeqID_230292
atgacgggttttattaaaaaaactgtcgttatctcaattgaatttaaaagccctatgagtggtccatatgcacttgatctctcgaacttccgcggccgccctccgtcaacaagtttgccttccctcggtgaagagctccctcagatagcatacgcattgaactatgtgcctgatagtgcactttcattgagtgatagagtggaaagtagtagtaaccagaaagtgaaggtgcttagtgttcttgataccttgcctcctattgcggcaattaggagttctgttatgatggagaggcatggggttaggcctgagcatggtagtgtggaacatggaggagggttgtctcgtgggaaattcagagttgaggggaatgggaaattgtcgcagaaggcagtggcacagattgtaagtagaaaacatgttcctcctagtattggtaaagatgcatctatgacttatgcggtttctattccattcaatggcttgcaatggatcagggcatttcatcataacagcttgcatggaaccattcctaatgaacttaccaattgtactgagctaagagcactcatggatgacacggtggtgctgactactagaggagatgatggtggtttgtgcaacgaaaattatcttgaattgtttatgcgtgatggatgcttacccaagacggagattgcaaatccagtcacatttgcaattgcggcagaatgtgttcatatctcagaatgccctgtccttgttatatctggtgctaaggac

SEQ ID NO: 113515 - DNA, 1801 bp, Glycine max
  Peptide Sequence Number=SeqID_230293
tatcaaaagcatacaaactttatgatccgatttcacaaaagatcataataagcagagatgttgtctttgacgaagataaaagttgggattgggataagcagtatgaagaaaccatcttatgtgatttagattggggtgataaggatgtggaagctgttgtagaagaagaacatgaggtacgacacaatactgataccccagaagaggatattattatttcctctgattctatggccgaagtaaacacttctagtcccgttcaacgaaggtgtagaagaccacccctttggatggaagattatgaaactggagaaggactttctgaaggcagtacagaagctaatctgactatgtctgcaactggtgaaagtgatcctactcactttgatgcagctgttcaaattgcaaaatggaggaaagccatggatgaggagatggaagcaataaacaaaaatgacacatgggaattgatggaattacctgatggagcaaagaaagttggagggtatgcacaagaatatggggtagactatacagaagtatttgcaccagtggcacgtatggagacaattcgtttggtggtagcacttgcagctcaaaagggatggccaatctatcagctggatgtaaagtcagcatttttacatggagagttggatgaaacagtgtatgtggaccaaccttgtggttatgaacaaaaaggggaagagcataaagtgtataagttgaagaaagccttttacggacttaagcaagcaccacgtgcttggtatagtcgcatagaagcatattttctaaaggaaggatttgagaagtgtgactatgagcatactttgtttgtgaagagagaaaaggaagatataatattaattgttagcttgtatgttgatgaccttatttttactggaaatgatgagttgatgtttgcaaaatttaaaagctccatgaagcatgaatttgacatgacagatcttggtaatatgatttattttctgggtcttgaagtgatgcaacgaatagatggcgttttcttatgtcaaaagaaatatgcattagagatgctgcaaaggtttggaatggataaaagcaattcggtgcaaactccaattgttcctggtgttaaactcacaaaggacgacactggtgtaaaggtggataagacttactataaacaaattgtgggaagtcttatgtatctaacatctactcgacccgatatgatgtttgtggtgaacttaattagcaggtacatggagaatcctactgagctgcatttactagcagccaaaagggtgctgagatatttaaagggaacaactgagtttggaattttctacaaaaagggaggaaacaaagagtttcttgcttacactgacagcgattatgcaggggatttggatgacagaaaaagtacttcgggttatgttttcttattgtgttcagctgctgtttcgtggtcatcaaaaaaacaaccaattgtgagtctatcaattacagaggcagagtttataggtgcagcatcatgtgcttgtcaagccatatggttgaaaagggtgttgggaaaattgtgtaaaatgcaagaccaggctactgtaattcgttgtgatagtagctctgctattaagctttcgaagaatccagtgatgcatggtcgttgtaaacatattgacgttcgatttcatttccttcgagatcttacaaaggccggaactatcaagatgatgcattgtgggacacaagaacaagtggctgatattatgaccaaaccacttaagcttgatactttcttaaagctacgcag

SEQ ID NO: 113516 - DNA, 3342 bp, Glycine max
  Peptide Sequence Number=SeqID_230294
atggatgccaacatctttccagcaaatggttattttcttggccatcagtgttccattgtcctccatttgaaaaataacctaatattcaactctacaaaatccaaaaagcttaccctttggaaccaaactgaagattgttgccaatggcatggggtgacatgcaacgaggggcgtgttatagcccttgatctcagtgaggagtctatctcgggaggactcgttaattcaagctctcttttcagccttcaatatctacagagcttgaatttggctttcaataacttaagttcggtgattccttcggagttgtacaagctgaataatttacgttatttgaacttgtctaatgctggatttgaggggcagattccagatgagatttttcacctcagaaggttagttactcttgatttgtcttcttcatttacctcacgtgataggctgaaacttgagaagccagatatagcagtgtttcaaaaccttacagatatcacagaattgtatctagatggtgtagcaatatctgccaaaggacaggaatggggtcatgctttatcttcatcgcagaagctacgtgttttgagcatgtcatcatgcaatctctctggacctattgattcttcactagcaaagcttctgccactcactgttctaaaattgagccacaacaacatgtcaagcgcagtgccaaaatcctttgtaaatttctccaatttagtcacactagagttaagaagttgtggcttgaatggttcttttccaaaagatatcttccaaatatcaacgttgaagttccttgacatctcagacaaccaagatcttgggggttctttgccaaacttcccacaacatggttctcttcatgacctgaatcttagctatacaaatttctcaggaaagcttccaggtgcaatttccaatttgaagcagttatctgcaattgatctatcttactgccaatttaatggtacacttcctagttcattctcagaactcagccaacttgtttatctagacttgtcttccaataactttacaggttcgcttccttcttttaatttgtccaagaatctcacatatttatccctttttaataatcatttaagtggggtgttgccatccagtcattttgagggccttaaaaagcttgtcagcattgatttggggtttaattttttcggtgggagtctcccctcatctctacttaaactcccatatttgcgagaacttaaacttccttttaatcaattcaatggttccttggatgagtttgtgattgcctcccctttgttagaaatgcttgatttatgtaacaataatattcgagggcctattcctatgtctatttttaacctcagaacacttcgtgtcattcagcttaagtcaaataagtttaatggcacaatacaattggacaagattcgcaagctgagtaatttaattgaactaggcctctcacataacaatttgtcagttgatataaactttagggatgatcatgacctgtcaccctttcctcatatgacgcatataatgttggcttcctgtaagttgagacgaattcctagtttcttgataaatcagtccatattaatatatcttgatctatctgacaacgggatcgaaggaccaatacctaactggatttcgcaacttggatatcttgctcatttgaatctttccaaaaattttctcacacatttacaagaaagtaatactcttgttcgtttgacaaaccttttacttgtcgatcttagttccaaccaactgcaagagtcttttcctttcattccaagctttataactcatttggactactcaaacaatagattcaactctgtcattccaatggacatcggaaatcatctccctttcatgaatttcttgtctctttcaaacaatagttttcagggacaaatccctgaatcattttgcaatgcttcaagtcttctcctgctagatctttcccttaataactttgtggggatgattcccatgtgtattactaagttgagtaacactctaaaggtgttgcactttggtggaaacaaactccaaggttatattcctaatactctgccaacttcatgcactctaaagttattggatctaaatgacaatctcttggagggtaccattccaaaatctttagccaattgccagaaactacaagtcctaaaccttcaaaaaaatttattgagtgacagatttccatgtttcttaactaatatttccaccttgagaatcatggatttaaggtcaaacaaacttcatggatcaatcggatgcccaagaagcagcggtgattgggaaatgcttcatgttgttgatctagcctccaataatttcagtggggcaataccaggagcactattaaacacttggaaagcaatgaagcctgaatttggtcacttattttttgatctcgttgattactatgaccaaaagaatttcaaggatttattgacacatacgaacaaaagtattgtagctatattagctaaacttgttacaaacgtacctcgctctatccttgaccagacatcttccgataattataatacaggggagctctctcgatatcaggattcaattattattacctacaaaggtaaacaaataaagttggtaagaattcaaagggccttcacttacgtggatatgtcaagcaacaattttgagggtccaataccaaatgagctaatgcagttcaagggattgaatgctcttaacttgtcaaataatgccctctcaggtcatgtcccatcatctattggaaatttgaagaatcttgagtctttagacttgtcaaacaattctttcaatggagaaattccaacagagctcgcaagtctatctttccttgcatatttgaatctctcatataatcacctggtgggggaaattccaaagggtacccaaattcaatcatttgatgcagattcctttgaagggaatgaagagttatttggacctccactgacccataattgcagcaacgatgaagtgccaacacctgaaacacctcattcacacactgagagttcaattgattggacttttttaagtgtagagttgggatgtatttttggctttggaattttcatcttacctcttattttctggagtagatggaggttgtggtattccaaacacgttgatgagatgcttcacagaatcatcccccagcttgattttgcgtaccaacaccgtggagggaagcgatacaaaatccttgtgtggagcatttggaagtactctgtcttggagattgatgctagacagacagaagccgctctactcaagaaggggctaaagttgaatgttgttacgagtttttaa

SEQ ID NO: 113517 - DNA, 456 bp, Glycine max
  Peptide Sequence Number=SeqID_230295
atggagttggttaaaatttcgacaaccttcacatctattgatttctcatccaaccattatgaaggacctgtaccaaaggtgctaatgcatttcaaagaactctatatcttgaacatgtcaagtcatgctttgtttggtaaaattccatcatccatagttttcagactaattcctcagccgcctccttcgtctctcaatctcgttttcccttctcaacctctcttttcccgcagaccatcaaacatgtctcagaaaaatgatgatctcggactcattcaccgttggatcgtcgtaaaatttaagcatcaggttcgcaatccaattccgagtattctcaccattgggaatttcgaaatcatgtctgagcttagaggaaaacccttcgcattggacccttttatctttccgcaaaaacccaaaactgtcttgctaaaaatacgatcctggattcattaa

SEQ ID NO: 113518 - DNA, 764 bp, Glycine max
  Peptide Sequence Number=SeqID_230296
atgacttacttgaaaaagttttcatttctcattttcgttttgcttttcatcctgcatgtccacttgtccactgcacaagtaaatcttaacgctggtgttggcactagcaatgacaatggggtcgtggttgttgaacttggtgatgacacagacacgtctcaagaagctgtcgttagtgttgaggtcaacgtcgacaatgacaatggcacatctaatgaagctggtgttgaagctgatgtcacaattactgttaacgttgagcctgacactgaggtacctgatgaagctcctgtcgaagttactattaacgttgatgctgactctgacactgatgctgaccctgacactgatgtacctgatgaagctcctgtcgaagttactattaacgttgatgttgatcctgacactgatgtacctgatgaagcttctatcgaagttactattaatgttgccggtaatgacacagacactaatttgggagcagtatccatcaatggctccgaacctgagacagcggttaacattcatggagggtacatcctttgtggtacaagtagagtgtacttctacttgggttgtaatactgagaacaagagagggtacatctcttgtggatcagttcaagtggagcatacatccacttggttgttcaaagagaacaagggatggtacatcccttgtggatctttgcttgtaaaggattttataaggttattggaaatcttaagaaccggtggttgcttggggactggatgtaggcacag

SEQ ID NO: 113519 - DNA, 651 bp, Glycine max
  Peptide Sequence Number=SeqID_230297
atggctctcactttctgcacagtgatttacctatttaccaaggtgaaaagcttttcctctctcaatccctttgagagcaatagagaatttggaagtactcgtgatctcataaatcagaatagactttggctctactataaattcttctgcaagaagtcactcccagtgtcaatttcagagacacattatcttcacaatgtggtgggagacacaaaaatcaggaagggagaaggaatggaactggatcagctctgtaaaaacatggacacgagtgagaaaaaaacttgcatgtgtccttttgacttggatgtactaagtgaagctttccatatgagggatatgaatccagtccacctttcttctacgtgttgtgctgatgtgttatacaaaggccagaaggggctaccaaatgcagtgcccaaattagagaaccagtctagagatcatgagaggaagaacaaaaaggtcaaagataaaggtgagaagtataggaagcagaagcatagattacatcgaataaataatggaagttgtatagagaacatcagaattagaccccatgatcctcatcccttgcagttgaagaaccaacaagacaagaaaaggagggcagagaaaagcaacaatgatccttctgtttgcaagcgataa

SEQ ID NO: 113520 - DNA, 531 bp, Glycine max
  Peptide Sequence Number=SeqID_230298
atgaaacggaaacgggcatgccgtactacgacgttgcgtttcgttgttttctatgagaccagttctagggtggaaaacataaacatgtttccactatggggaagttttattggaccattagatctttctgcttctaaattaatgccctccattgtccctacgaaatttataacaatgacagactcaactcaaccgcgaaggaggaacacagatgtaagagaaactcagcaaaagagctcaaaatcgaagtggtggaaaggtagcctttggtgttcaagtggtcgacgaaggagacccattccagctaggggtggtcgacggagggtagggtttctgcggcggcgggaagggaatgggtttgaagaagataaagggagagtgggagttgcgggtgcggaacagggtggcacggtggtggtttgggcgaatagatctggtgaggatgcaagcgaagttgtaattaccaatgacgtcgtcgcttctggtggcggcctaaggtccgatgccgccgccgccgcctctggtggctaa

SEQ ID NO: 113521 - DNA, 1026 bp, Glycine max
  Peptide Sequence Number=SeqID_230299
atggctaattcacacaacatctcaattcattcaagccaatcacataatcaaataacacgaggaataaatttaaacatcgatttacagttagcgaaatttcatggcaatacaatttatgctttaaggaagattagtaatgatgcagctgattggttattatctgatgttcaaccaaagtgtatgtgggctagacacacatatgattcaccttgtaagagtgaccatgttacaaataatgcctgtgaagtgttcaatgcttggattggtgattataaaaagtatgaaaaggaaagtactgttaattacatggtgactcctagagtaagggtgttgttagataaaactatgcaagatgaaatattgcaccccatgcctgagctggatgttaagaaaaggggaggttaccctaatattgatcctcctgctttgaaaaggttaccaagaaggcctaggaaagctaggaggaagaatcaggttgaaggacaatttgttatccaagcaaggaggtccaatattgttcgatgttcaacttacaaagagtttggtcataattataggacttgtcaaagggctctagtggggaaaccaataaagaacaaaggtgctggaaatgttgaatctgtccaagctaatgttgcatgttcacaaaaatttgaagtcaccactcagagaaaagaaagaagaaaagaagttggaattggagattcagataagataatcttccaagttggaaacttaagcagaagtacttatagtttaagggaccttagaattgaggaaaatcctgcattagctgctgttgccaaggatgattatgtgttccctgtctatatttggtgcctcaaagaggaaggacaattttatccgggtcaaatgtcgaggtggtggctgaagcagtctcttgcccacttggataagtggttgaaatcacttggagctgaactagtgctgatcaaaactgacagagggattatttcctcgtctagatgccaaccttatggttatgccaagcttcatcctcattaa

SEQ ID NO: 113522 - DNA, 2052 bp, Glycine max
  Peptide Sequence Number=SeqID_230300
atgaagagagcgaaaagtgatcctcccaactcgaggaggtttagattgtctcattttttgtttggcattggggtgttgtacttgttgtttgtgtcatgcaagtttccacagtttttgagaattgtatcaacgttaagtggggatgagagtgaagataggttggagggggcagctgttggggactctgaagattcagatttgagcaagtcttttgtgagttctgtttataaagatgcatttcataggagattggaagataatagggaccagggtgcccccttgagaccaaacacggagccaaggaaggaggaagagcgttttccggagtctccgaagcagattccaccacgatatggtaggataactgggaagataatgcgggaatataagaggaccaatgatttgtctgtgcttgagagaatggcggatgaggcgtggatattagggttgaaggcttggaaggacgtagataaggttgacgagaaggggtcgataaaaaactccatccttgatggaaagcccgagtcatgcccttcttgggtgtcaatgaatggggatgagttgattaaaggagataatttgatgtttcttccctgtgggcttgcagctggttcttcaatcactgtggtggggacaccccattatgctcataaggagtatgttccccagcttgccaagacgaagagaggcggaggattggtttcagtttcccaattcatggttgaattgcaagggctgaagtcagtggatggggaggatcctccaaagatccttcacttgaatccccgaataaggggggattggagcaaacagccagtaattgagcataatacctgttaccgaatgcactggggaacctctcaaagatgtgatggtctgccgtctggggatgaagaagaaatgcttgttgatggatacaaacggtgtgagaaatggatgcggaatgacattatagactctaaagagtccaagacgacatcctggtttaagcggtttatagggcgtgagcaaaagccagaaatgacctggccatttcctttagtagagggcagaatgtttgtccttacattgcgtgctggtgttgatggataccatattaatattgggggtcgccatgtaacttcatttccatatcggactggatttacactcgaggatgctacaggattggcaattaaaggggatgtggatgttcattcaatttatgctacttctcttcctacttcccatccaagtttctcacctcaaagagtactggaaatgtcagagacctggaaagccagacctttacctaaacatcctattaaactttttattggagttctttcagcttcaaatcactttgcagaacgtatggcagttagaaagacatggatgcaatcagctgcaatcaagtcttcagatgtagtagcacggttctttgttgcactgaatccaagaacggaagtaaatgcagtgctgaagaaggaggctgcttactttggtgatattgtcattttgccctttatggaccgctatgagcttgttgtgcttaaaactgtgtccattagtgagtttgggattcagaatgtgactgctgcatatgttatgaaatgtgatgatgatacatttattagggttgatactgtcttgagagaaattgagaaggtaccccaggaaaagtccctttatatgggcaatctcaatcttcggcatcggcctctgagaaatggcaaatgggcagtcacttatgaggaatgggcagaagaagtatatcctccttatgcaaatgggccggcatatgtaatttccagtgatattgttactttcatcctatctcaacacaaggataggaaactaaagctgtttaaaatggaggatgtaagcatgggaatgtgggttgagcgatataacaataccatggcagcagtccagtactcccacaattggaagttttgtcagtatggatgcatggagggctacttcactgcacattaccaatcaccaaggcagatgatctgtctttgggacaaattgtctagaggccgagctcgttgttgcaacttcagatga

SEQ ID NO: 113523 - DNA, 528 bp, Glycine max
  Peptide Sequence Number=SeqID_230301
atgttggagaaaaaaatcgttgttaaagaggtgtatgaggctatgatcaattcgtatgacccagacaaggaggagttctacaacatcttgtggaagctacctgtgccatctgagaccaagggccttgtgtggaggcttgctcatgatcgacttcaaaccaaagataatttacataagagactaattcttccaccgggtttccaggttcaatgtgtcatgagaatgtgctatgtatggatcggggacatcagggtgctgccagcaaattatctaatgcacttttggcaacatctaggaggaattgatggcaacaaagcaaaattggtttggggagcggtgtggatatcgatcgtttggtctatttggaagctaaggaatgatataatctttaataacgccgcttgtaatcttcaaagtctgatagatgagtcaaggtacagggcttggttgtggtgtaaaacgtatgttaaagacttcaattttaccttgtatgtgtggtgcatggaccctgtgaattgcataagctag

SEQ ID NO: 113524 - DNA, 361 bp, Glycine max
  Peptide Sequence Number=SeqID_230302
cccccagctccgccgcagtagcaagaataaccagcacttctggccttcctcgatgccccccggccccctcaacgtcgccgaccgcaccttcaggaccggtggaactgagcttccctacgagatccgcatcagtgcgtcatagtgcgacgggaaggtcacacaagagctggccgacgtcgacgcccttgctggttatggtcgtcaacattaatggtgtttgtggtgttggtggtggtgtgacatttgttgcgctgtggtctgatggtggatctagtggatgggttcagaaggggcacggtggcaatggtggatggggttctacgtttgtggtgtcgaagaagatgaagaagggtagatgggg

SEQ ID NO: 113525 - DNA, 498 bp, Glycine max
  Peptide Sequence Number=SeqID_230303
atggagagaacacaattgttctactcctacccttcattcgcttccaaccctcctcaacccccaccacccagagttcaaatcttcaacccaatacttcatcatacaacaacgcttgaatcaccaatagcaagtaacacgctccagcaccttctttttacccttttttctatatcaccaacaaattttggcaacaacgtgaaaaaccaaacaagcaaagaaactccaaaacgaaacagatctcagcgaaaggagctacaaatcccaaagggtaccggatctcaagcaaacccgggaaaaaagcgcaaaatggacttgggaatcagcacaagcactcactccacagcacaaaaaaccgaagcaaacgttgcaacggaaaacgaccacggttacaaacgtagcagtttcggcggcgactatggtcgtgctactgttgctttttctctttctatgcttgagagaatgaagacagaaccgccattgtttttgggtgttttttaa

SEQ ID NO: 113526 - DNA, 822 bp, Glycine max
  Peptide Sequence Number=SeqID_230304
atgacattgggatggggttttgcaggagaaaagcgagttctagattcagaactttggcatgcttgtgctggtcctcttgtttctttaccagctgttggaagccgagtggtatactttccacaaggtcacagtgaacaggttgctgtgtctaccaacagggaagtggatggccatatacctaactatccaagcttaccaccgcagcttatttgtcaacttcataatgtgactatgcatgcagatactgagacagatgaagtgtatgctcagatgaccttgcaacctcttaatcctcaagaacagaaggaggcataccttccagctgagttgggcacaccgagtaaacagccaacaaactacttctgcaaaattttgacagccagtgacactagcactcatgggggattctctgttcctcgcagggcagctgaaaaagtttttcctccattggacttttcacaacagcctccttgtcaagagttaattgcaagggatttgcatggtaatgagtggaaatttagacatatcttccgtggccagcccaaaaggcatctacttacaacaggatggagtgtctttgtgagtgctaaaagacttgttgctggtgattcagtgctgtttatctggaatgaaaagaatcaattgcttcttggcattcggcgggctaatcgacctcaaccagtgatgccttcatcagtgttgtcaagtgatagcatgcacttggggcttcttgctgctgcagctcatgcggctgcaactaatagtcgttttaccatcttttataacccacggtacaactgtcatacattagtagagttttaa

SEQ ID NO: 113527 - DNA, 665 bp, Glycine max
  Peptide Sequence Number=SeqID_230305
tgtcggcccagcagagtgctttcgccgttggtgttctttccgatctctacgcatttcaccgctccaccggaaattccctctgcccctaccacgctttacgcccaatcattccggataacgcttgcatcctctgtcttaccgcggctgctggcacagagttagccgatgcttattccccggataccgtcattgcttcttctccgggaaaagaagttcatgaccctcccagtgtggctgatcatcctctcggaccagctactgatcatcgccttggtaagctattgcctcaccaactagctaatcagacgcgagcccctcctcgggcggattcctccttttgctcctcagcctacggggtattagcagccgtttccagctgttgttcccctcccaagggtaggttcttacgcgttactcacccgtccgccactggaaacaccacttcaccgtccgacttgcatgtgttaagcatgccgccagcatcggacgcaccagccagcagagagtcgcagacccgctgccccggctgggcaacttcactatcttacctcgccgtagcgactccgtcaaaccgaccggcgtccttccagcgagtcccccacgagtccgacgagcggaagacccgcgaacggatcttggtttgtgggaggtggttcgctgcttga

SEQ ID NO: 113528 - DNA, 240 bp, Glycine max
  Peptide Sequence Number=SeqID_230306
atggccttacaaagtggaacctggggtatgctcactaacttatggtttcttggggatatggcatcgacttcgtggtcgtgttttcatagtaccgacttggaaatcctaacaaatgcgaggcataaccagtcggggcagatggagccaaagcttcttcttgagcttaaccgtggagttgggagatggttcttagatgtggcacagggcgtagaccacttcgtcgagtaccttatatggtag

SEQ ID NO: 113529 - DNA, 330 bp, Glycine max
  Peptide Sequence Number=SeqID_230307
atgactgttgataagttgttgttggatttgtccaccgtgagtgatcattatgaatgtgttgttgttggattagtccacgtggatggtgactgtggatacgagttaacacatgagcagccacaacctaatgtcagaaaaaatggagggctcgtgtacaaagggctgagagatgggacagacaggcaattccacattgaggtcaagggatttgattgtgccaatctcttggctggtgaaaatctccatggaatcatgcctttgatcttcttcatcaatggagtcatctacttcttgaagatcaatggcagtgaaatgaaggagaaaaggtga

SEQ ID NO: 113530 - DNA, 423 bp, Glycine max
  Peptide Sequence Number=SeqID_230308
atgacaagtttatcattacagtctttgacctttggtagttggtactatgttgttggagataaccctactagaattgactgggttcttaccgaaaaagaccttcttgccgattcatactcggatcttgaggcttctattctagatgagaaagagtttctcctattgaagagtatatcaaaggcacttcaaactctttacctgactatcttacccgtgaattcttacagagaaattctcatgccacctagggcatccggcacctctctaaggggaggaagaagcacaggtaaaggattcaaactggctctaccagagccatctccaaaagagttcaccatcatcatctgggtcaccaacccaggctgggtcatgcacccagaagccaaaaccagaagggtcatcgacccaaataatctcaattaa

SEQ ID NO: 113531 - DNA, 469 bp, Glycine max
  Peptide Sequence Number=SeqID_230309
gaatcaagttattgtcaagattgctacatggacaaatgaaaatgttataaatgtttcagggtgcttcaatctattcttgcaactcatgaaagcttcccaatttctcattgagcctggtcaatgcatgttgaggagcaatttagtcattgggaaccagttgaccaaggggaggtttgatggcactatcaatgtagatattactgagttccacaccaaccttgtgccataccccagggtccacttcatcatttctttgtatacttcagttatctctaccgccaaggcctaccatgagcagttgtcgattttagagatcacgaatgccatgttcgagcccccgagcatgatggccaagtgtgaccccagacacggcaagtacatgggttgctacttgatgtaccatagtgatgatgttcctaaggatgtcaatgccattgttgccaccatcaagattgagaggattgtttag

SEQ ID NO: 113532 - DNA, 381 bp, Glycine max
  Peptide Sequence Number=SeqID_230310
atgtgtccagacatagcctttgctgtaagcatggtaaatcagtttatgcatgcaccaggacatgaacacttggaggcatttttcagaatcctaagatatttgaagggatcacctggaaggagacttctttataaaaaccatggacatcttcagagtgttgtagcaaggagtagtgcagaagctgaatttagagcacttgctcttagaatttgtgaaacattatgggtggaaaaacttctacaagaattaaaggttcatagttctcctctaataaactatattgcgacaacaggtcagcaatatatattgcacataacccggtcctacatgataggaccaagcatgtcgaagttgataagcacttcatcaaagagaagatag

SEQ ID NO: 113533 - DNA, 1440 bp, Glycine max
  Peptide Sequence Number=SeqID_230311
atggtgaattatcaatcagatatgtaccaagctatggctgccgctgcacttcaggatatgtggacttcagatccttccaaacagcatcctacgtccgcaattcaatttcagcaacagcagaacttccccaacaggacttctgccttaatgcaaacccaaatgttgcagcagtctcaacctcagcaggcttttccaaatagtcaagaaaattcacatccatctccatctccatctcaatctcaggctcaaactcaaacacactttcagcagcatctacagcatcagcactcattcaatactcagaatcagcataatcttctgcagcagcagcaacaatcgcaattgcaacagcaacaagtggtagatcatcagcagatttcaagtgccgtctctacaatgtctcagtttgtttcagcacctcagtctcaatcaccaccaatgcaagctatctcttcacttggccatcagcaaagcttttctgattcaaatgggaaccctgtgactactgctgttgtttctcccctgcatagtatattgggttcatttccccaggatgacacatctcaccttctcaaccttcctagatccacctcttgggttcctgttcaacattcaactgcatggccgtcctccaagcgtgttgcagtggatcctctcttttcttctggagcatctcaatgtgttctacctcaagtggagcagttagggcagccacagagtaccatggctcaaaatggcattgcattgccaccctttcctggtagggagtgtacaatagaaggaagcaatgatccacaaaatcatcttttgtttggtgtcaatatagagccctcatcactcctaatgcataatgggatgtcaagtcttaagggagtcagcagcaacagtgactcacccaccataccttttcaatcatctaattacctgaacaccacagtacctgattcttcattgaatcctggaatgacacacaatattggtgaatcgggcttcctgcaaactccagaaaatggggggcaaggaaacccaactaacaaaacctttgtgaaggtttacaagtcagggtcctttggaagatccttggacatcactaaattcaccagctaccctgagctacgcagtgagcttgctcgtatgtttggcctggaaggtgagttggaggaccctgtgagatcaggctggcagcttgtattcgttgaccaagagaatgacgttcttctccttggtgatggcccgtggccggaatttgtaaatagtgtagggtgcatcaagatactttcccctcaggaagtgcagcaaatgggcaacaatggccttgagcttcttaactctgtccccattcagaggctctctaacggcgtctgtgacgactacgcaggccgtgaggacccaagaaatttaagcactgggataacaattgtggggtctttaaactactga

SEQ ID NO: 113534 - DNA, 364 bp, Glycine max
  Peptide Sequence Number=SeqID_230312
atgataaagctcattgatgaggaagcagattcatttgcaaggagggcagaaatgtactataagaagcgtccggagctcatgaaattagtggaggagttctaccgagcataccgtgctttagctgagagatacgatcatgcaatgggagagctacgccatgcccacaaaacaattgcagaagaacattacatgctgaccgatgattcgtcgccgtgtgttgaatcacacacaccaggagtgccttgtccgaattattgcgagtctgagcatgcggagaaagcagatagtgaagttcaaaccttgaggaaaggcctggccaaaatacagtctgacaaggatgctatctttcttcagtatcagaaga

SEQ ID NO: 113535 - DNA, 1269 bp, Glycine max
  Peptide Sequence Number=SeqID_230313
atgctgggacaactacagactttaggcttggatcctaaatgttttgcagcatctgtgaaagatttgcaaaatgagaactcaaatctaaaggaggtctgcaagatggaacgtaatgcgaaagaagctcttcgtgaaaagtcaaaggacatggatgaacttttgatagagaatgaatttatggaattttctctctcaagattaaatgatgaattggatggattaagagcaacagtgaggaaatttcaagagtcctgccaagttctccaggaagaaaaatctatggccgttgatgagaaatcagctctattttcacagttacaaatagtcactgaaagtatgcagaagctattggagaagaatgccttgttggagaagtccctctctgattcgaagattgagctggaagatttgaaggctaaatcaactgacttggaagaattctgcaagttgctaaatgatgagaagtacaatctcctaagcgaaagaagcatcctggtatctcagttggaaagtgttgaggctaaactaagtaacctggaaaagatgtttacaaaattagaagaaaaatatgctgactcggagaaggacaaagaaagcactggcaaccaagtagaagagatccgtgcttcaattttggtgcaaaagcaaaagcatgcaaatcataaacacttgagcgaagtccgactgacaaatttggagaatcttttccatgcactacaggaagaactgcggttggggaagattgaatttgaaaaagaagttgacaaagctgtaaatgctcagatggagatgttcattttgcaaagttgtatagaagatctggagcagaagaacttggctttgttaactgaatgtgaaaagcatgttgaggcatcaaaattttcttacaaagttatttctgagttggagactgaaaactttatgcaactgatggaagaagagtttttgttacatgaaattagaaagcttaaaatggctattcatcaagtgtgtggggctcttcagattgatccatatggtgtgcacgacaaaggaatcaagcaagaggaaatgcctatattgcatattttggacaacattgaggacttgaaaagttcttatgtgaaaagccaagaagagaagcagcagctccttgtagagaattctgtcctcctaacttcacttgagcaaaatcgatctgagagagaaaaaatggagtcagagaaaaagatcatggagcaagacttcgagaaaacgagacagaagaattcaatgttgcagaaagcgaag

SEQ ID NO: 113536 - DNA, 1503 bp, Glycine max
  Peptide Sequence Number=SeqID_230314
gacaaaacaaatgaatgccaacattgtgaggctgaggcagcttcgttctatttggagcttcagatttcatccattagtgaagaactgctgaaaggcaaggtcactgagcttactggagtttgcaagagacttgatgatgaaagtgcagggaaaggcttggtgattgaacaaatgatagaaagaatcggtttactggaaaaggaaattagaggactgaaggggcagctatctgcatacactccaacaattacttctttgaaagaggattttgcatctctagagcacacttactttcttttgaccaataaaacttttgccgtaggcaacatagaacagaaggatgtagtgactgagatttgtctccaagaagcaaatagctatcgaagtttaaaaggaaatgaaagcaccttaacaccagatggggttacagatttgctgagcatgcagacaaggattagagcagttgaaaagttaatgatggaagaacttgaaagacatgtggaggaggaaagtttgaccacaaatgtcaaagcagaagctgttacagaaatgactgagcattcaaatttggaagttggcacgtatccagaaattgacgacagaaaagtggtgatgaaaattaagaaagacaacagcaaacgtggcaataatgcatggagaacaaaatctcagaaaaggttgataatgatagacattcctcttgatgactacaaggatgatccagactccaacaagtattgcaagagagatcacactaggtgcaatgatcatatgcttgagctatgtgaaactgatcagcatgatgttacagaagaaagtaaacataattctgtttcaatagaggatgtaattacatgccatgagtcagaaagatgtcaaaattactcttcagaattggagacagagaaggaattaggggttgacaagctagagttgtggaagactcgaaaagagacgacaagtgaagatagcaagaggaaaattttggagaggcttgcctccgattctcagaagcttgccattcttaaaatgacactacaagacttgaagaagaaaccagagacacagaagaaaagcagcaaggtaaatgagattgagtatgaaacagtgaaaaggcatatagaagatgttgaggaagctgtcatgcaacaaataggcatatatgatcaactggcaaaggatattgaagagtgcacatcctcatcttcagacacaaacacaatgcagatggaaaagcaaggaggacacgggcaaagaaaaaagctaacagaacaggctcgaagaggttctgaacagataggaaggttgcagtttgaggtgcagaacatccagtatattctgctcaaattggctgatgtgaagaacaacaaatgcaaaaacaaaaacactagaccaacaggtgtgttgctgaaggactttattcgcattggaaggaaaaataacagaaggcgccgtaagggatgtgcttgtggatgttcaaggccttcaactaatgaggactaa

SEQ ID NO: 113537 - DNA, 174 bp, Glycine max
  Peptide Sequence Number=SeqID_230315
atggggtgtaataattggacccaacctaggcccatgggctcaaaaatctatcataaggttcatgagaaccctaggactttcttcagcagctctaacccaatcctcttagagcctcttgctcatggctctagtgactggtcccttcctagggaagattgcatcaatgatgagtaa

SEQ ID NO: 113538 - DNA, 552 bp, Glycine max
  Peptide Sequence Number=SeqID_230316
atggtagaaccatcaaggaagagaaatggttcatcctccacaaccactgctgtaggacaacaccgccacagcacatcagatgacccaccaacaccacctaatccttctttttcttctcaacggtcattgactctattttcttcagatgaacaacatcaaaggtaccgtatgcataaggcattatgggccaatgcatcttttccttatcctcatcttgtcactctatttcttcagcattttaatgttcctttagaggatgaaccttttgttaagcgaaaggatgtggatggccaatgggtgcataaacatgaccttccacctccaattcctgatgaacacacacccttcctgccaccgcaacaggattcctcatctttcttattgaatgacattctcattgagcttaggtatcttagggctttcgccggtgatcgtttcgatgctatggactcacgcatcacgcgtcttgaagatgacatgagcttcattcgtcgttgctttgatcctcctgcggatccagagaagtttcttttacatcctacttttatctag

SEQ ID NO: 113539 - DNA, 171 bp, Glycine max
  Peptide Sequence Number=SeqID_230317
atggagtgctatcagagagcctatggctcaggaaaatctattctcctcgatgcactttctagtcgtttagctgcaaatgccttcctctcatgcaccattctccttaatggtcgcaaagcaaaactctcttttggcactgctgtgagtcttttttccttttttttgccttaa

SEQ ID NO: 113540 - DNA, 846 bp, Glycine max
  Peptide Sequence Number=SeqID_230318
atgtggtgggcatgggttatgttggcggtaaatagatgggagattccagagattccaaagtactccatatattgtgtccttacttgggtttttgtgaatgacgttgaacagaaagagtgcactgatggtgatttgcaagacaaaacaccattgggaacagtccaagttttgacacctagcaatcaagctaacactccccagttctctaagccattgaaatcagataccatgaacaaagatgctatcatcagatcagatgatgctgaatttggagaagcagatcaagaagagaaaaaatatgtagatccattggataaatttctccctcccccatcaaaagctagatgctctgaggagttacaaagccatagattcatctttatgttcttggtaatgggtaggattttcaccaatgcggggatcggagttgcagagggcttggatctggaggccttggtcgtagcaggagatggatctattgacctggtcgagcatggagaagatgtcgtcgagctgcatgtagccagagaaggcggcgagggcatgatcggcgccgcgtttgatgtcgggaactttgatagcgcgttcgaggatggggacgacttcttcaaagcatccaaggctgcagtagatggcagcgaagatgtggaggctcatggcgaggtcgaggctgggctctcccttgacgatgcaacgctcaaaggacccggaggcccgaatagcgaagtcgaggaccttggagggcccatcgcccgaggcaatggtgtcgcgggccaacttaaggaggaatgggctgagatctgggttgttgagagaggcatcagagagaagcggaggggcttctag

SEQ ID NO: 113541 - DNA, 843 bp, Glycine max
  Peptide Sequence Number=SeqID_230319
atgaggatccgcatgccgttgttgaatggtttaacaacatattggttgtgtctgaaaacaagttgctccaatgtgaactttgcttttcgtggtgcttgtaatcactgtggaactgctcgtcctgctggtgcttctggaatttcaggggctggtggccgtggcaagggatgtgctgcacaagaatcagggggtattggccggccagctggtggaggactctttggtcccaatgattggccttgtccaatgtgtgggaatatcaattgggcaaagcggactaaatgcaatatctgcaatacaaataagcctgggcataatgagggtggtgtaaggcatgtagctgtagtttcattgctgctatcctctttggtccctaaactggtggatcctgctgttgatcctgatgcctacaggaatgtcgtctctaccgttaccttatttgctggaatctttcaagctgcatttggtattttcaggttggggtttcttgtggattttctttcacatgctgcacttgttggattcatggcaggcgcaaccatcatgattggtttttcattcaggagtgttcaccaggagacccttataactaataactatgttatgcgtattggtgctgcaactccaaggaaatcatctagccatcaacaaggtgattatatttggaatgggcaacgagtaatgttgacagccgatcttggggttagattggaagatatcaagcattgcctcggaggaacgatcatcgtcgtgttggagagcgaaaacaaaacatacacaagaaacccttcatggacatacaaagtgagaccaagagatttaggcaagatgttttcaatttaa

SEQ ID NO: 113542 - DNA, 789 bp, Glycine max
  Peptide Sequence Number=SeqID_230320
atgtttccgatgacaaccctaggaagattgaattggccacgttccaatctgagggttccgattactccacaatcaagctcgaatgaaccacaccaagcaaatgaagcagttgaaggagatttgcgccagagaggagggctcgcctcacgccgcgttcgtcaaccaagtccaaaacctaatgtgcttcaagatggcgatggtcatcaccaacctgagctcaaagcagcgacatttgaggaatgcactcaagttgttgctctttcggagaacttgtttccccgggaggcagatgaagagcatggtggagtcgaagatatgatgaggttggcttacttgaacgagcatggcagagcccaagctggagcagatgttgtcagtcctagtgatatgatggatggtcgggtaggagcactacgtgcaactctggatgttgaaggctttcagcatgtttctataatgtcctatacaacaatttttacattattgattgttggtttgctcattaatttggcatggctgaacaaaagttatcagatgaacccaactaattacagagaggctctgactgagatgcgggaggatgaatctgaaggagttgacattctcttgctatttcacacttccctcatgctcaaatcaatattgaatataccaagatatgactttccagttagacgtcacaaccagctactcataagctggtaccacaaagctgatatgaggacaggaagagcaaacttattggcaacttacaagccttcaagcattttggcttggcctacaggctag

SEQ ID NO: 113543 - DNA, 228 bp, Glycine max
  Peptide Sequence Number=SeqID_230321
atgccaaagatttttcaggaaaatttgtttatggttacccggcaagtgagaaaagccgcgccgtcgcggcacggcaatagcaggtatagttctggttacgaacaccgtcatcgttggacaagcaaaagagaagtgcgaggaagggaagaggaagaaagtcgcacagtgctcctggtcctggatgctacaatgaagattctcgacgacggcggcggcggcggcgcatag

SEQ ID NO: 113544 - DNA, 354 bp, Glycine max
  Peptide Sequence Number=SeqID_230322
atgaacgactctgatattgccatgtgtctcttttattctctctctcctttgctcacactttactcttccaagagcgccaccgtcgaaacgatagataaaacactcttcctaccgtcgagaaacgggctgtcactgcctcagccagtgagcgacaaaatacggcggtgcgtgagagacatcggacgtccggtaggaaggtggtgccatgctagtgcacagtcgaggaattcgccgagaagagtctcggaaaaatgtgaatcgtccggcggaggtggcggttgtcgccgcactgacgatgatgagagcgtcggaaataggatgatgtataagaacctttgcccctctcccatttag

SEQ ID NO: 113545 - DNA, 2730 bp, Glycine max
  Peptide Sequence Number=SeqID_230323
atgctcaccatcggagtaatccaacccagccatagcccattttcttcccccatcttgcttgtaaagaaaaaagacgggtcatggagatgctgtgttgattatcgagcattaaacgcggtcacagtgaaagacaggttccctatgcctaccatagacgaactgctagatgacctgggccaagcttcgtggttttcaaagttagatttgcgccaagggttccatcagatacgaatggctgaagaagatacgcataaaaccgcctttcgaactcaccagggtcattacgaattcctcgtgatgccctttggattgtgcaatgcaccctcaacgttccaggccgccatgaacgccgcgcttcaaccatttcttcgccgattcgtcgccgtcttcttcgacgatatcttagtctacagtccggacctgcagtcccacgtgtcacacctagaatccgttctatccactcttgctgatcgagagttcttattgaaacattccaaatgttcctttgcccaacgtcaactcagttacctgggccatatcatttcctcgcagggtgtggcaccagaccccgataaagtcgctgcaatgctcgagtggcctcggccaacatgtcccacaaccctccgtggattcctgggtttgacggggttctaccgtaagttcgtcaagggatacgccgccattgtagcgccccttaattccctcttaagaaaggacagcttcatctggtcccccgaagcccagcatgcctttcatcaattacaacaggccatgactcagactccagtgctcgccaaccccaacttcctccttccttttacgctcgaaatcgacgcctccggcacggcgatgggtgcagtgcttttgcaggaatctcacccaattgcgtattatagcaaagttctctgccccaggttacagcgcgcctctgcttatgtgcgagaattgcacgccatcacctccgcagtgcgtaaatggcgccactacttattgggtaactccttcattattcttacggaccacaaaagcttgaaagatcttatgtcccagacgatacaaacgcctgagctacaaacatacttgtcaaaacttttgggctttgattattccattaaatacaaacccggcccagcaaacgtggtcgccgacgcactctcccgtatcgttccgacggaggccacataccttaccctgactatgccccactgtctcttcctccagaagctccgccacgctctgttgcaggacccacagtatgagcagctccttcgggacgttcgcgagcacccaacggagcatcccgaccttacaactcaccaggagcttcttctccggcagggtcaaatttggatccccttcgcgacaccattcacagattccttattggaagaatttcactcttcccctctcgccggccacccgggcgtcgccaagactctccaccgtctccgtcagaacttcgactggcccagaattaagaccgacgtccgccgctatgtcgcccagtgcgccacgtgccagcagacgaagtacgaaacaaagaaaagcgccggcctcctccaacctctccctatccccacccacgtatgggaagatttgtcattagacttcgttacagggcttccatcttctcaagggtacacaacaattctcgttgtggtggatcgattttcgaaggcggcccacttcggagctctgcccacccctcactccgcctacaaggtggcaactctattcttagacatggtgtgcaagcatcacggatttccgcgcagtctagtatcggacagagatcccattttcgttagcaaattctggcgtgagctcttccgtttaagcggcaccaagctccgaatgagcaccgcctaccacccgcagaccgacgggcagacggaggtgctcaaccgctctcttgaacagtacctccgcgcgtacgtacatacacagccctccaactggtaccgtttcctttctctcgccgagtggtcgtataacacatccctgcattcggctatcggcatgactccgtttgaggcggtctacggcaagtctccaccaaagatagctgactaccttcgcgttcaatcttcgaacgacgcagttgactcattgctttccacccgcatccaaattcacgatcagctaacgcgtcgcctacaccgcgcgcaggagcgtatgaagctcaccgcagataagcaccgccgcgacgtttccttcacaataggcgactgggtgtatgtccgtcttcgtccctatcgtcaaacgtcaattgctcctatgtattcgaagctcgccaaacggttttacggcccattccaaatactggagtgtattggacccgtggcttataaactcctcttgccggaatcttcccgcatccaccctgtctttcacatatcccttttaaagagtcatcacgaccctcttccggcctcaccagcttccctgccagtgaattccaacgataatcaccctgtcgttcttcccttcgcaattctggattggaagctagattcctcggtcacaccgccagtcaaacgcgtcttggtgcaatgggagggtcttcctccggaggatgcctcttgggaactttgggacgagctgcgtactcttcccaaccttgaggacaaggttgtttttgatgacggcggtgttgttagcatcacagcagaccaacacaggcccaagagagaacgcaagaaaccagcatacctgcaggactttgtatag

SEQ ID NO: 113546 - DNA, 580 bp, Glycine max
  Peptide Sequence Number=SeqID_230324
atggctgggttggattactccgatggtgagcatagacgcgatttgtttctcaatttcagatttttggaaatggggataacggaaggtggtagtgaggaaggttcggcaaaaatggctgagtatcggcggagaacggcggcaattggggttggggtggagtcggtggtgaggcacgtagaagaagggggagatagtgaagggggtgcatctgcccgaagggaaacgtgccaacctggattgaatgaaattatgagtagagccaccatctaccaagatgactactgggtgacggcgcaccgtaccgagaagacggaacgtttgaggggccggggtaccctccatcgcgttcaagctgatgtgtggagtaatagggagatccggtccggaaggaggtgggtcgttgttagggtgcaaacagggtttgcagcggtggccgtgggaccacttttcttcacagtggtagcagagtccctgttcgtggcggaccgcaagttcctcggaggtgaggcgttttatggggacgcgagtggaaggaagagggtgattggtcgtgggtttaggggagaaggaagtggaagag

SEQ ID NO: 113547 - DNA, 276 bp, Glycine max
  Peptide Sequence Number=SeqID_230325
atggcagtcttggttgaacacaatttccttgatgcatatgctggagaatcaagagatggatctttaagtgtaaagttcagcactggtgacataatatccatgaactcagtaatcacaactactaaggaccttaatgacctgtgctatgcagtcctagcaatatttaggtctcgttttcccaaaacagaaggcataactgcgggcctttgcatgaaaggccaatgcttaccaagagtgttgaaagatattgaaatcttaaccaaaaataactgctaa

SEQ ID NO: 113548 - DNA, 300 bp, Glycine max
  Peptide Sequence Number=SeqID_230326
atgtcgcaacacctgttccacttcctctctctccctcctcccagagccatactctcgcgtcacttactctgcccaccctgccacctgcagcacccgccccctcaccatcacctgcagcctcctctacaacaacaaccttttcaattgaataaggaaaacaagaacaacaacaagggcaattacaattactatgtttttcgtggtggtggcgtggtttgcgctgcacctggtggaggaagtaattttggaagagaatcagaggctgagataagttgcgaagtggtccagcttatcaagtga

SEQ ID NO: 113549 - DNA, 324 bp, Glycine max
  Peptide Sequence Number=SeqID_230327
atgacggttttagtgtcaaaattcctttttatgaaggatgcaacaaatgttgctattgtcactaactatgagtttctatttatgtgggttaggtgtcagggaatcaagaatttacggcctcggccggaagacgctgacatctcctggaagggtgcagatgaccacgttggtctctacgtgtcaacgggctcgcttgcctctggtcacgatagcagaattgagacttttttgcggtctcggccggaagacgctgacctcttcaggaagggtgcagatgaccacattggtctctacgtgtcaacgggctcgcttgcctctggttga

SEQ ID NO: 113550 - DNA, 527 bp, Glycine max
  Peptide Sequence Number=SeqID_230328
gggcaaacgagcccgttgatgcgcagagactaacatcgtcttttgtaccttttgtcattcagggacagcgagttaggtggcaggcggagataccttatggttatccacacctttcgtcaaccgaggcgaacggattcgacgacatgcaagcccggcaacgcacaagattcttctctgctgggcggggggcgatcaagttcgatggcatggggaaatgtcgtggttccgctggtcaagatattgatcggtcgaatgatgggcaactgtcataccctaatttcgtctggggaccattgtttggtggcatgcaaccttcgcttgaccgactcaaggggggggtgaaaatagcaaccaagcccacttgggccttccatggggttccaacagaatgcggtgccttctggtggaagcaacccagctcgcctgggctagctgagcttgcctgggcgagctgggcggcaaccacctccctcttttctcctataaataggggaaagagggcagagcaaaaatgttcagcccttctg

SEQ ID NO: 113551 - DNA, 864 bp, Glycine max
  Peptide Sequence Number=SeqID_230329
atggcggtgtattataaatttaagagtgcaagagattatgattcaattcccatggacggtcctttcatctctgttggtacattgaaagaaaaaatatttgaatccaagcatttagggaggggtactgatttcgaccttgtggtcaccaacgcccagaccaatgaagaatatcttgatgaagaaatgttgattcctaaaaatacctcagtgttaattcgtcgggttccaggaaggccacgtttaccaattgttactgaaatagagtactatctcaaacctttaatctcattactgcagttgaaaatttcagaattaatcatacaaaaggtggaaaataaggtggtggaatctgaacctgaaaatggaagcctaccagctgaagatacatctgccatgaaatatcctgaagattcagattgggatgaatttggcaatgatttgtattcaattcctgatcaagtgcctgttcaatcaagcaacttaattccagaggctcctcctcctagcaaagctgatgaagacagtaagattaaagcctttcttgatactccagccttggattggcaacgtcaaggttcagactttggcactggtagaggctttggaaggggtacagggggacggatgggtggtggacgtggttttgggatggagcggaaaacacccccacaaggctatgtatgtcacagatgcaaggtgcctggacattttattcagcactgtcctacaaatggtgacccgaattttgacatgagaaaagtcaagcaacccaccggtattccaagatccatgctgatggtaaatccacaaggttcctatgctttaccaaatggttcagtagctgtcttgaagccaaatgagtga

SEQ ID NO: 113552 - DNA, 926 bp, Glycine max
  Peptide Sequence Number=SeqID_230330
gtattagggactatattatctccaagtctatctgtgtatgtggtgcaacaaatattcttgcagatgatctcttaccgaataagacattacgagataccattaatcgtatattggagtcgggcaatagcagtgctgaaaatgctgggagcactttccaagctcaagatatggagtctgctcgctgtccgcagcctaagattccatccccaacctcatctgctgcatccaagggagaactaaaggtttcacctgttaatgaaaaaacaacaaatatacaggaaacaactgatgatagaaaggctgtttctgctccacagcagacatccgagcaagtaaggaaccccagagctgctgatatatctgaagctactcacgagtctatgagtgtgaaggagccagcctcacaatggagtgctcagcaggttgaggaagaagtgcagcaaaagttggttcctactgaggctggaaagaaaaagaaaaagaagaaagtccgtttgctgccaaatgatttgcagtggaaaaccccacatgacttcggggcagagaactatatgatgccaatggttccacctgctggctataattcgtactggaatggcatgcaacccatggatggatttatggcaccgtatggtaatccaatgcaaatgatgggttacggcctgggccccttggacatgccatttggtggtatgccacaagacccatttggcatgcaaggttacatgatgcctggtttcccacctcatagggatcttgctgacttcagtatgggaatgaatgctccagccccagtaatgagtagagaggagtttgaagcccgtaaagctgatatgaggaggaagcgtgaaaatgatagacgtcctgaaaggtacacagaatctctctttgatggctggctgtcatgttctgatatatgtggttga

SEQ ID NO: 113553 - DNA, 136 bp, Glycine max
  Peptide Sequence Number=SeqID_230331
ggacttctctaaagatcgagactttggtagggaagtgagcagtgttggggatgtttcttcaatgaaatcaaaaacttgtcagagcatctctcgcggtcattttatccagacttatggacataatttaaaaccttaa

SEQ ID NO: 113554 - DNA, 393 bp, Glycine max
  Peptide Sequence Number=SeqID_230332
atgtacttggttgttcttcatggatgttcgttcatatcagatgcaggttttttgcaaaggctattcacaaaggctcctggccttaatgctattatcaaatggtgcatggccactgcggaggtcaaggtttcaaatgttcaatgcaacctttacaaaatgcttcatgaagtggtgaggtctgctagtggcaaactacatgctgaagcaggtggccaagttagtggcctttggcatgatgaagatgcatttttgagacctgagcttgtagccttttcacgatcgaggacaagttgtgatgtagctccatgtggagcttataggccatggatcttcttcatcaatggagtcctttgctttttgaagtttaatggcagcagaatgaagaaagaataa

SEQ ID NO: 113555 - DNA, 285 bp, Glycine max
  Peptide Sequence Number=SeqID_230333
atgggggttcaggaaggaaaaaggcgtgtaggaagtaaaaactatgatgctatagaattggaagaagaagaagaagaaaagagaagaagcttcttcttggttaccttgacagacagagagtggagcaaacgacaaatcagcgagttggaacattttgtgtttggtggagatgcctattcggagcttggtagaagtggagccaccaagcccactgagatacttgatcggcgccgccgttatgatgatcggagttgtgttaccagtcggttacatgatgttccgtaa

SEQ ID NO: 113556 - DNA, 486 bp, Glycine max
  Peptide Sequence Number=SeqID_230334
atggtgacaaagtaccagagtgatccttcgctgatgcagcttatatctaagcatttctactcggagaggatttttgatgattcaacctctaataatcctaaattaagatggagataccggaatttctttagcgataatgcagtccatggtcataggacacatgatcgtgaatctaatgacaaatcccaagagcactcccataatgattccaatgacaaatccctaggctggtctgaaaatgtcacccacagcaaaagaacaaatcttgagaccaagcgtacttttgaaaacgctgatattatgtcggagggtgaccctcttgattgtctttttagttatgctcctccggtggaagatattcatcattcaaattccccaaataaaccatcaggaatacataatcgggctcgtagaagatctcaccgtaggcgtcggatgcgtaatcatgatgacctttcaaattctgagtctgcagcagctatttga

SEQ ID NO: 113557 - DNA, 1122 bp, Glycine max
  Peptide Sequence Number=SeqID_230335
atggctgttgaaaggtccggaattgccaaagatgttacggaattgattggtaaaaccccattagtatatctaaataaacttgcggatggttgtgttgcccgggttgctgctaaactggagttgatggagccatgctctagtgtgaaggacaggattgggtatagtatgattgctgatgcagaagagaagggacttatcacacctggaaagagtgtcctcattgagccaacaagtggtaatactggcattggattagccttcatggcagcagccaggggttacaagctcataattacaatgcctgcttctatgagtcttgagagaagaatcattctattagcttttggagctgagttggttctgacagatcctgctaagggaatgaaaggtgctgttcagaaggctgaagagatattggctaagacgcccaatgcctacatacttcaacaatttgaaaaccctgccaatcccaaggttcattatgaaaccactggtccagagatatggaaaggctccgatgggaaaattgatgcatttgtttctgggataggcactggtggtacaataacaggtgctggaaaatatcttaaagagcagaatccgaatataaagctgattggtgtggaaccagttgaaagtccagtgctctcaggaggaaagcctggtccacacaagattcaagggattggtgctggttttatccctggtgtcttggaagtcaatcttcttgatgaagttattcaaagggcgagccctggtgcagcggtaaagttgtgccttggtgacttgttggtcatgggttcgaatcccggaaacagcctctttgcatatgcaagggtgggaatatcttccggagctgcagctgctgctgcttttcagattgcaaaaagaccagaaaatgccgggaagcttattgtttcacaaaaattccaagagttgtcaggtgaagaaatcctggatccctttgccagcaaaaactcgatcagaaagatcggccaaaacggcattgacgctggaaccaaaaataacgctgaggacatcgccggtggtacccgaacaacaagtcggagaggagataatggtaactgtgactgtgatgtcagcggtgaccgtaagtggtag

SEQ ID NO: 113558 - DNA, 1464 bp, Glycine max
  Peptide Sequence Number=SeqID_230336
atggagaagagtaatggtttatggaatttacaagcagtggcaccggaagtatccggcgagggatttccatacgcaccggaaaattggccggaacagggcgacatttggggatggagaactgggcggagagttgtcgcaaatcgtagccactttaaggatcggtacctgtatctgccgaatcgactaatccgtgccttgaaagaggagaaggagaaggagaacgctgctgactcaggctcaagctcaatccgcagcaggcaacacatctttgcgagcaaacttgctgttgaatgctacatcaagaaatattatcctgaagcggatcttgatgccttttttgcttccttctcctggaagattccagctctaccatcgtcttcaaccaacggcaatgaggtgcctatagctgctgtacctcttctacagatagcacaagaagcatatgactctgactctggggacgttgtcaagtgtaaagcaagtaataagaagtgcactagtctggtgttagaagaagttgaaaaatattcaccagccatgccttgtgatatctgttgttctgaacctgggttttgccgtgattgtgtttgcatcctttgttgcaaaactgtttcttcagcttatggtggctatagttatatcaagtgccaagtgaacattggtgggggcatctgtggccatgttgctcatatggaatgcgctcttcgatctctcttggctggcaaagttggaggaagtattgggctagatgcccagtaccactgccgacgctgtgatgggaggacagatatgatttcgcatgttaataatctcctacaaacatgcagagctgctgatttggatgatgaaattcggaagaaaattttgaatcttggtgcttgtctcttgcgtggttcacagaagcctgttgcaaaggagctgctgtgtcgtattgaattggccatctcaaaggcttatgaccaatttgatagtttatatcagcttaaatgtggaactaatcttgaagaaatctggaaggaggatgacagtcttatagctcattctttggataacggcaatgatgtgatggaagttatggtcaatgacggcccttttgaagttaggacagggttggaatcttatgattttcaacctcgttcattaaaacttgagtctgaggttgatcaggttctccaggctcttagaaagtcacaggagcttgaatataaggtggtggaagaaacacttcaagaccaaaagacttacttaaaaaatttgtatcagcaagtggaatgtgagaagtatgaattggcttgtcaaaactcatctacctcagatgtatcgtctagtgctgtaagagacagaaagaaacagataagacgggaggtggaaaaatttgaaatcatgaaaaaggttgcctatggttttggcaggacatccaatgatattgtaaaggaacactttggcttgaaagtgatagattga

SEQ ID NO: 113559 - DNA, 2429 bp, Glycine max
  Peptide Sequence Number=SeqID_230337
tcgcatcgctctcggatcactttgggtttttcagcggagacttgcgtcgcactcgcatgcaacaatttactgcgaggtacggaatccgtgaattttccggcgagatggaatcgggggtgagatcgggtggttctggggttgtggtgaagagcagaaactcctcgggttgtttaattgtgcgaaagaagggggatgtgttgggtgctactgcttccacctctcggaagctctatgaatccaagaataggccaaacatcaacgtgccattgagtgattctggatcaagcgacgagtcaccagtgcctcctggtagaaggcttggtcccgagactattcgagttttcaatggtttcgctgctgcctctgagcggggtgggagtgaaattagtcgaaagaggtatagagtacaacgaattaggggtaatggtgagggtattgctgcggagaaagggttggagcagtgggaaagaaagcgtagtaagttggttgtgtacgatttcgatgattacaatggcatggatgtggagaacatgaggaggaggcatttggatggtcatggaggaggaaggtttatgggttcagtgcatgctgctagaattggcattgatagggaattcaaaacaggttcaagtggacgaatccttgataagagaaataactcttatggtgataggcctggtggcttgtatccaggggataatgttgatcacagtaggtacaagataaacagggatggactccgggtacctctacgcttgcagagggagaagtttaattcagatgagtccattagggttcaggggagaaatggtgttttgaaggtaatggttaataagaagaaggtgggtgggccatcagaacagtattatgatcatcacaaaccagtggaaagaaggcaaaggttgaagactgaagagactgctaagaggctgatgactgaagagactgctaagaggttgaagaccgaagaggctgccaaaaggaatgtaaatgttccaattcgtcctttgtcatacttggaaatgaaacctgttgagaaaacaggattactcaagaggccagagaagaaaaggatagcatcaagaaaatcattgtcaagcaaggacagtaagggtgatgagggggattcagataacagtgacacatcattgaatctgggaataagaaatactgaagcacggaagccagcaaaaaaaataatatctgaggatgagcagactcctgtgcatgaaaaactcccaaccacaagaacaaaagaaggaaaaatcaagcgtggtagtggtacagaaaaacagaaactgcgtgaacgaataagggagatgctgctggattctggttggaccatagactatcgaccccgaaggaacagggactatttggatgcagtttacattaatccagcaggtacagcgtattggtctatcatcaaggcctatgaagcacttcaaaagcaattgaatgaagatgctaatgaggccaagcccaaaggggatagttcttcttttgctcctattgcagatgaagtgctcaatcagctaactaggaaaactaggaagaaaatggagaaagaattgaaaaagaagaaaaaatatgatagtgaaagcgataatgaaaaagagcctcaaataagatctgccagccacaagcgtgatatgaatagtacggatggtgataacaatgaggagaaattaagctcctttataaagcagggtagtaagtcaatgaaaaataaaatgtttgaaaataccattatcagtgctccctctaaaatccagaatgctaccaatcactcaggtgatggaatagaaaaatcattatttggatgtgatcctcagatacacggacggaagagtaaaaaacatggaagatgtaccttgttagttcgcagttctaacaaaggatcaaattcagaatctgatggctttgttccatatacgggcaagcggacagttcttgcctggttaattgactctggaacagtagagttaagccaaaaggttcagtaccgcagacggaagaaagtcatgctggaggggtggatcacaagagacggcattcactgtggctgctgtagtaagatcctcacagtttcaaagtttgagcttcatgccggaagcaaattgccgcagccgtatcaaaatatatatttggaatctggagtttctcttctacagtgccagatagatgcatggaatagacaagagcatgctgaaaaaattggtttccattcagtggatattgatggcggtgatcctaatgatgatacttgtggtatatgtggagatggaggggatttaatctgttgtgatggctgtccatcaacatttcatcagagctgtttggatatacagggagcggttatatctcatagtttggagctttgttgttttgaagtcaaggggactgaagatactttcttgttattatga

SEQ ID NO: 113560 - DNA, 990 bp, Glycine max
  Peptide Sequence Number=SeqID_230338
atggtgtccgtgctcgctaggaagggtgcatccttatacaaaagaaactttctctccaggacattcaatctctgcttcaagtccctcaccaccattcccaacaaagatgttgaggctgcagcgagtttaccttctgaatactctaccagcccccatctttccccatttttctccgacttcaaccacccctcgactggttttgatatcgagcttgtggatcatgatgcttgggcggtctcatctggggttgcacaagcctggcgagaaccagcatcaagagctactacttcttttggcccgcaagtgactggtgaggcccttgatgaccatgttgagggtgagcttgattttgaggacatagataatatgagagttcgtggcaatctattctacaagcttgagcgcagttccaaggagtttgaagagtataatttagattttcacaggaagaaatcttctaagagaaaagaggaggtaaacaaagctaaaacaactccaaatgtggtttccaaagatcacaagcttcccaaagttgatgaattgacaagaagtaaaagtgttgtgccccgggtggatgacatcaatgatgggtctactgtgaacaagaggcagaggactcccacgtttaaccagcttacaggtccttatcacgaaccgttctgcttggacattttcatatcaaaagcctctgtccgtgcctgcgttgttcatagggtaactagcaaggttgttgctgtggcacattctatttccaaggacttcaagtttgacctggcttctaccaagaacaaaaccacttgtgctgctgtgggagcaattcttgctcagagagcattggctgatgatattcatgacattgtttacactccaaggaaaggagaaagggtggaggggaagcttcagattgttcttcagtctatcattgataatggcatcaacgtaaaggtaaagattaagcagaggcccaagaagtcattcaaccgcatttga

SEQ ID NO: 113561 - DNA, 330 bp, Glycine max
  Peptide Sequence Number=SeqID_230339
atggtattagagcaaacctccctcctagtacagtatagttcgaggatgaaccaggcagaagttggtgggaatgtaacaccccaatcgaatcacatcaaaatgagagagatccagaagttgtgcattgtgagagccactaagaagttggaaatcagggatgttacacactcactcactagcaacaacacttcaatccattcattgcgacattccctgcgatggcacttcactctcctttgtgtgtgtcctcgttgtcgtcgtcatgtgccatcatggtggcttcactcttcttcattggaactcgccttctctgacaacatctacttctag

SEQ ID NO: 113562 - DNA, 444 bp, Glycine max
  Peptide Sequence Number=SeqID_230340
atggcaagccttcagttaacaagaacacccttgagtcttttcagacaagaaaggcagcagcaccccagaaagaagaactccactgcttttgagctgaaggctcctcggccacgtctcacactcagtgtgaggtcctataaagtggtgattgagcacgatggagagtccactgaggtggaagttgaacctgacgagaccattctgtcaaaggcattggactctggcttgtctgtgcctcatgattgcaagcttggagtctgcatgacatgccctgctcgtctcattagtggatctgttgatcagagtgatggaatgctcagtgatgatgtggtggagcgtggctatgcactcttgtgtgcagcctaccctcaatccgattgtcatattaagattatccccgaggaggagcttttgtcattgcagttagccacagccaatgactga

SEQ ID NO: 113563 - DNA, 225 bp, Glycine max
  Peptide Sequence Number=SeqID_230341
atgatcaagctgtgggagtcttgtttctggttctttcgctgcttcactgtgatcaagaacactcaagaaatcatgtcaaacacaatcaggattgagaaattcaatggaaagaacaatttcaatctgtggcgcatcaagatgcgtgctctgttgaaggaacaatgtgtttgggctcctgttgcttctacatctgtgaagaaaccagtgacttctgattcaaaataa

SEQ ID NO: 113564 - DNA, 1437 bp, Glycine max
  Peptide Sequence Number=SeqID_230342
atggacgagtcacagagaattggcatcggcttaatgcgtagtttccctcgccggagatcggtcgaggaccggtcatcttcccggcggcgacgctccatcttctccggcgcgggcatttcggaatctgtggacgccgacgactttgccgacgtctttggtggcccaccgcgaactctccttgcgcacaaattctcgagctccgggtcgttttacgaggaagttttccggccgccggagtttacgtgtccggcgccgaagggtggccggagcttgccggtgttcaggattccggctaggaatgagggattttacagcgacatattcgggtcggacgatgaacggagatcgagagagcggtcgaggtctctgtcgaaagagaattcgtcatcggcgatgagttcggaggagttaagccctcgccggccggcgattggagatgacgtggcactgtctggttttgcttcaaagctaaggccaatcaatattccatggagatggaactcatccactgtgatgcctgaggctgaggaatacccaagtaaacttggggtgcctctttttgcatgcaaggaccagtcatttgaaattcagcatcaggacaatgaatacaaggaaaacttcagaagcccccatttaggatcctcaagaagagtctcatccccagaaaccattagtctcgaatccaattcatatcaaagcatcaaagtgttcactgatgactgggagctcaattccccattttctgatgtctcttcgctttatcaagaacctggggcaaaattttcagtgcatgatcgtgtgctttcagaacaaattatagaaggtgatgatgacgacgacgacgatgatgaaattatgagctcctatgtcattgaactcaactccaacctcagaagagaagagtgtggagaatcagccattgatgaagcaattgcatgggccaaagagaagtttcaatcacgaagctctgatgaagaatcaagcgtgagaaactatggcaaagagaaaactgttggaataggaagctctgatgcaagtgaataccatgatgatggaattgaaatagttcaaactcaggagaagcaacagacagaaacagagaagttggacagagatataagattgtggtcatctggcaaggaaacagatattaggctactactttcaacactacatcatattcttaggcctgagagtggctggtatgctattcctcttaagagtctattagaaagctcacaggtgaagaaggcttatcagaaagcaaggttatgcctgcatccagacaaactgcaacaaagaggagcaacactccttcagaagtatgtagcagagaaggctttctcaattcttcagttttgtcttgagatttgtggacaaacaccaagcttgacattcggaatgtcgggagcgttggttgacaagcagcagatatag

SEQ ID NO: 113565 - DNA, 175 bp, Glycine max
  Peptide Sequence Number=SeqID_230343
gatctctgaggcagaccctccctttcacacggttgagattcggaagactggaggcgatactctggaatttgacaatttctgtaaggatctctctgctgggctgcaagatatcatttggaaagaagagcctgtcaacacagaaaaagatggtgcgagtacatcaagtgcaaaataa

SEQ ID NO: 113566 - DNA, 150 bp, Glycine max
  Peptide Sequence Number=SeqID_230344
atggcgcgtttcatgattggccacaacacaaaacccaacacaaccccaaaactcgctcacaacacagcagaatggagcgggaagtccaccttctgcgaagaagttatgggttcctctactcgcccttgggttcgcgtttgccaggtttag

SEQ ID NO: 113567 - DNA, 378 bp, Glycine max
  Peptide Sequence Number=SeqID_230345
atgtgtatgagtgttattttgccgagccagacaaacagcaggtcactgacagaactggaagcaagaaaatattttcagcagcttatatgtgctgtggctttctgtcacagtagaggtgtttcccatggaaacttaaagccagagaatttgttgctggatgctaagggggtgcttaaagtatcagattttggaatgaggccactgtttcaacaagttccacttcacacaccgtgcagtaccccacattatatggccccagaggtggcaagcatcacttgctatgagggtgcacaggctgatatatggtcatgtggtgttattctttttgttctattggccggttatttacccttcaatgataaagacatttatctaaag

SEQ ID NO: 113568 - DNA, 1545 bp, Glycine max
  Peptide Sequence Number=SeqID_230346
atggctatgaccggtaaccattcccctcgccattcctctgataacctccgatcgcgtcgcgccacgcgcctccctgcttcctcgccgtggaaccaggtcgtccgcggcgaatcggagcccgttgctgcggctccgtcttcctcgacggaggatttcccctccgccgccgttccggtggacgattttagctcctccgccgcggagagctccgacaatggcggcgctgccttgaggcctgtctggaacaagccttctcctaatggcgcggcggcagcggcttcggatgtgaggccggagatggacgcgaactcgtggcccttgccgtcggagtccacaagagctgctacgaaatcggaatcgtccaagggtttgttggatggatcttctgtgccacaatcgcagggtttgggaagtacgtctttttcctcttcacagagggaagtcagtgacaatgcaagaaccaacaacaccaacagtttggtgccggctcggcagaaatcaatgaaacatcacagttcgaatgcatcttctaatggtggccacgcgcaacactctgtgccccaggtctcgatagctgcaactgggtcccggaactcctctccaaaggaccacacacaaagaagtggatttgcgtctaatgatcatccacagcagcgtaattcgtttagaaatcgtaatggtggtcaacaccagcgaggagatggttctcaccatcacaactatgggaacaggcgtgatcaggagtggaataataatcgaagttttggcagtagagatacacatgtgccaccaagagttgctcctagatttatacggccacctccacctccacctcctaattctgctcagttttttcatccatcaccaatgcggccttttggtagtcccattggtttccatgaactagcacctcctctggtatttgttgcagctccacctccacccccggattcactgagaggtgttccttttgtgcctcctatgccacatcatcccctgttctttacaggtccagaccctcagttgcacagtaagatagtcaaccaggtcgactactattttagagagttgactgtagtcttaccacaacttgtctattgcagtaatgagaatttagttaaagatgcattcttgaggcagaacatggatgaccagggctgggttcccataaaattaattgcaggcttcaacaaagttatgcatttgactgacaatatccaggttatattagatgctattcaaacttcatctgttgttgaagtgcagggtgacaaaataaggagacaaaatgattggaggagatggattatgcatcctcctgttcaattttctaatgctacaaccataggagtgttgaatcctgacaagctggcagaacaagtacagaatattgctctggagacaagtaactatgatggtgcaggaggactggatgttcagccagatacttcacaacatagatctacatttggggatttgcagcagctctccactagtcaagttggtattcaaggctcagatcacttcattccagcaagaaattag

SEQ ID NO: 113569 - DNA, 174 bp, Glycine max
  Peptide Sequence Number=SeqID_230347
atggagatgacaaggtgtatgttgcatgaaaaggagttgccaaagaagttgtgggtagaggctgttaaaagagacaagttggacaagaagggatgtcaagttcatggaaggaaaacaatggagttgggaggagtcaataaagaagcaactaccagaaattccacaattcattga

SEQ ID NO: 113570 - DNA, 357 bp, Glycine max
  Peptide Sequence Number=SeqID_230348
atggggaatctgaataagggcaaagttctagagctgctaaaagaagctgagtattggtgggatgacactcgccaatgcttggaggctaaaggtcaagctatgacctgggaaaccttcaagagggtatttctagataaatactttcctaaagatgttaagaacaacaaggagatggaattcctagagctcaagcaagggagcatgactatggctgaatatgcagccaagttcaaagagctggtgaggtactttcctcataaccaaggaaaagatggtgaaagctcaaaatgtttgaagtttctaaatggcttgcgacctgaggtgaagcaagttataaactatcaaggtgttcattag

SEQ ID NO: 113571 - DNA, 663 bp, Glycine max
  Peptide Sequence Number=SeqID_230349
atggaggattggaatgatgaacagtgtgatgacaccctcaccatgaccaccgtttctcagcactttttcggcgatgattctgaaacgccaagcttctccatctccatcatcgagaacatgaaggaagactatggcctattcgtgtggccctgcagcgtagttctcgccgagtacatttggcaacacaagcatcgattttcaggagccaccgttgttgagctaggtgctggaacttccctgcctggcttggttgcagcaaaactcggtgcccgtgtcactcttactgatgactccaccagattagaggtgcttgacaacatgagaagggtgttgggattgacatggggagtttgggattcatccatattcagtttacagccaacaattattctaggggctgatgtgctgtacgattcaaaagcctttgataacctctttgccactgtgactttcctgctccgaaattctcctgggtcaacttttataacctcataccataaccgaagtgggcatcaccttattgagtttttgatgggaaaatggggcttaaagtgtctgaagcttcttgatgggttttccttcttgccacctgacaaagcatcactgctaagtggtaacattcaattggcagagataggtcttatctcaaaagataatgcttga

SEQ ID NO: 113572 - DNA, 534 bp, Glycine max
  Peptide Sequence Number=SeqID_230350
atggaagacaaaaggtgtggacaagtcatagagaaagaaattaatatcatcaagaagaatgatactttggagttttcaaaacgtcctaagggtcatgaaataattggaatcaatgtttggacttgttgcccgtatggagataattcgtcttcttgtctccaaggactcaaatgggatgacatagatatagggcttatggactactacttgggactagaaatgaagcaaatggagaatgacatttttgtttctcaagagagctatggaaaggtgttaaagaaatttcaaaagtttgattacaactttctgaacacaccgatggaaggtaacttgatattgtcaaggcttgatggtggaaataaagaagatcctaattcgttaaagagtcttgcagggccttcaaatgagttcaagcatacagggttttgtgatagtgattttggcttgttttactctccttctatgatgagtggccgaatcaacttggagtcactagcatctcctatcaagattcagatacaaaatacaacctaa

SEQ ID NO: 113573 - DNA, 333 bp, Glycine max
  Peptide Sequence Number=SeqID_230351
atggctgctgatatcaatgttctgccacccatgtgtccatcaaacacagaaacttcaccactaacaccattttctgcagttgctccgaattatttggtcccattttccaaggtacaaatcaaaataacattggaaaccatctacgaagaagaagaagatgatgaggaggaggagaaagaggatgaaatggagaaaagttctgagacgcatgcgtcctcttcacccccaatattcttcccaattattcaagctgctgcagcgacatgttcgtttgaaatcacagggttttttcactttttggtgtcgttcggtcataactaccagcatgcatag

SEQ ID NO: 113574 - DNA, 1200 bp, Glycine max
  Peptide Sequence Number=SeqID_230352
atggcagaagaaggagctgcgggaggaggtgaaagaagaagctacgcgaggaagaaggagcctgaaggaggagctcgtggaagaaggagaaacgagaagaagaggaaatggaagaagtggggtgctgccatacctgtaccaaacccacacacacttagccattctcaaatgaagcttgatgtcccacgatttgatggttcagacccttcaggttgggtattcaagattacccaatttttcgaatatcatgctacacctaaacctgaaaggcttaccatcgcctcgttttacatggaggggccggccttggcgtggtttcaatggatgatgcgaaatcaccaactcaccacttggcctggtttcctacaagccatagaggctcgtttcacccactccccatacgaggatcctataagactcctctgcaaactcacacagacagggtctgtcagagattacctgaaccaatttgaagccctcgccaactgtgtcgtagggttgcctccttccttccttttgagctgctttgtctcaggtcttgatctcgatatccatcgtgaagtgaaagcgcttcagcccatgaggaaaagctcttggagggtcgtagagctccgcgcaatcgagtctctccggtgctcaacccttactcaccctcacccacccctgtgcccttacccagccctaatctttctctttcaccctctccacctaaaccctcacccctcccagtacggcgcctcaccccagaagaacttgcaagccgtcgtgaacgaggcttatgcttctactgtgacgagagatttacacgaggccatcactgtgcttcgtgattttctctcctcatcgccgatgaagaacaaccaaacagcacccgagaccctgcgtatggttggccggattgcttatcatcctgtcgtaatcctcgtcgatggtggaagcatgcataacttcgtgcagcaacatttggttaaatcctttggcctgttagctcaagacaccccaaccttgcgtgtcctcgttggtaatggtaaagaagttcaaagttctcatgtttgtcgcgatgtcgtggtgcaggttcagggcagagttttcatggtggaccttcacgtacttcctctttgcggcgctgacgtggtcttaggggttcaatggtttaaatcccttggccccgtgctgactaattacaacattcgaccatga

SEQ ID NO: 113575 - DNA, 333 bp, Glycine max
  Peptide Sequence Number=SeqID_230353
atggtggttaggatcatgattagaaccagaggttttgggcgtgcattaggtaggggtataggcagaggcttggttagaaaggatgagtatcatgcagatgatgttccccggcggcgtaggcctaccgcatctgcccgtaggcaaagggtacatgttacagttgctgaggatgttcctcatatggctgaggatgcacctcagatgaccaccgaggatgtagctgcggctgttgctgaaggcttggctggtgatggtgctgaggggtcacctgctgatgatgctgagggatttcctggtgagccaaaattgtttccaatagttagactgtattaa

SEQ ID NO: 113576 - DNA, 1125 bp, Glycine max
  Peptide Sequence Number=SeqID_230354
atgaaggaactcgcagatcagaagcgtcgcgatgtgagttttgaagttggagacatagtgctgtggagaggactatttcttgaagatagctcatgggagaagtgggatgagctaaggcagaactacaaccttgaggacaaggttctaggcctcataatcctagagttaattgcttgtgcttacatcagtaggtcatatgggctacctgttattacaactcgtggaaacaatgtttatgggcccaaccagtttcctgagaagttaattccaaagttcatcctcctggctatgcagggaaagaatcttccaattcatggggatggttcaaatgtgaggagttatttatattgtgaagatgttgctgaggcttttgaagttgtcatgcacaaggtgaggaccacttgggaagaaggattgaagaaaaccatggattggtatatcaacaaccctaattggtggggtgatgtcactggggcattgcttcctcatcctaggatgctgatgatgcctggcgggttggagagtcatttcgagggatctgaagaggaaaaacctgcatcttttggctcaaggtggattgggggtttgctggggaaattgtgtgaaaagcaaggaattccgtatgaatatggaaagggtcgcctggaggaccgctcctcactcttggctaatcttcagaatgtgaagcctacacatgttattaatgctgcaggagtgaccggcagacccaatgttgattggtgtgaatcccataaaacagaaaccatccgcaccaatgttgctggaggaagcaagcccaatttcattggctctttctattccaaaactaaagctatggttgaggagctcttgaaagactatgacaatgtatgcacactcagggtttgcatgccaatttcgtcggacctgagcaacccgcgcaacttcataacaaagatttctcgttataacaaagtagtcaacattccaaacagtatgactattttggatgaacttctgcctatctcaattgagatggcaaagaggaacttgaagggaatctggaacttcacaaatccaggggttgtgagccacaatgagatccttgagatgtacagggattacattgaccccaacttcaagtga

SEQ ID NO: 113577 - DNA, 753 bp, Glycine max
  Peptide Sequence Number=SeqID_230355
atggctacggaggatgtaagcaaaacggcgtttagaacccaccatggccactatgaattcttggtgatgccatttggcctctataacgtgccattgtccttccaggctactatgaatttgactttcggtcccattttgcgaaagttcatcatcgtcttcttcgacgatattttgatctacaacaagaccttttcggagcatatcaagcacctgcaaattgcttttcagactttgaaagaccatagcttcttccttaaattacccaaatgttcctttgcaacccaacaagttgaatatttaggacatattgtttcagaacagggggtcgaacctgtcccaaccaaagtaacatcagtgcatcaatggccgccaccaatgtctgtcagagctttacgcggctttctgggactctccgggttttatcaccgttttattaaaggctatgctacactcattgcaccactcattgccctgttggccaaggattcattccactggacgcaagcggcggaccaggctttccgcaaacttaaggaagctttttgcacaacactagtcttgaggctgccagatttttccttaccctttgtacttgaaacagatgcattagggactggtatgggcgttgtcctctcccaacaacaccatccaattgcattttttagcaagtccttctgcccgaagttgcttcgcgcctccacatacgtccgtgagctggcagcaatcacggtggcagtgaagaagtggcgttaa

SEQ ID NO: 113578 - DNA, 1689 bp, Glycine max
  Peptide Sequence Number=SeqID_230356
atgtcaacattgtttgtggagcaaggaacaatgatgaacacatgcattggttccttcaaactgcccctctcaacttttgatgtcatgagtgtggttttgtgggtccctctctatgacaggataattgttccaatcataaggaagttcacaggcaaggaaaggggcctctcaatgctgcaaagaatgggaattcgccttttcatttcagttctgtgcatgttatcagctgctgttgtggagattatgcatctgcagctcgcaaaagagcttgaccttgttgataagcatgttgccgtgccccttagtgtactttggcaaatccctcagtatttctttttaggggcagcagtagtattcacatttgtggggcagcttgagttcttgtatgaccaatctccagatactatgaagactttaggcaatgagtgttgtgaacgtttggccttctttggaattgcaacaaatcttgttacctatcttaccaccaaggtgcatgaaggaaacgtttctgccccaagaaacgttagcatctggcttggcacttcttatctcacacctctcattggagctgctctaggagatggttactggggtcgatactggacaattgctgttttctctgtggggatgtgtaccttgacactttctgcatctttaccagcattgaagcctgctgaatgcttgggttctgtatgcccttcagctactcctgcacaatatgctgtgttctactttggtctatacgtgattgcacttgggatcggtggtataaagtcatgtgtgccatcttttggggcaggtcaatttgatgatactgatccaaagggaagggttaagaaggggtcgtttttcaattggtattacttttctatcaatctaggtgccattgtatcgagcagcatagttgtgtggattcaagacaatgcaggatggggtcttggatttggcattcctactttgttcatggtattatctgtgataagcttctttataggcacacctctctacaggtttcaaaaaccagggggaagtcctgttacaagaatgtgccaggttttgtgcacgtctgtccggaagtggaattttgttatccctgaggatagtagtcttttgtatgagatgtcagacaagagatctgcaattaaagggagtcacaaactgctacatagtgatgatctaaggtgtcttgatagagcagctacagtgtccgattatgagagtaaaagtggtgactattctaatccatggagactttgccccgtaacacaggtggaagaattgaagatcttcatctgcatgtttccaatgtgggctactggggctgttttttctgctgtttatacccaaatgtcaacattgtttgtggagcaaggaacagtgatgaacacaaacattggttcctttgaaatacccccagcttccctcgcaacttttgatgtcctaagtgtggttttgtgggctcctgtctatgacaggataattgataattgttcccaaaggggaatttcagtgttgcaaagagtaaccattggcaacttcatttcagtcctgtccatgttagcagctgttgttgtggagattatgcgtctgcggcttgcaagagaccttgatcttgttgatgaacctgttgctgtaccactcagtatactttggcaaaagactactattcgcattcgtgggactgcttga

SEQ ID NO: 113579 - DNA, 1695 bp, Glycine max
  Peptide Sequence Number=SeqID_230357
atggagagagttggggtcattcctcattcgtattgctttgctgcttacattgaggggctctgtaataaccataggtctgatttggggtatgaggttctgcaggcatttaggaaaggtaatgcgcctttagaggtttatgcgtacaccgcagttgttcgtgggttttgtaatgagatgaagttggatgaggctcagggtgtgtttgatgacatggagaggcagggggtggttcctgatgtgtatgtttattcttcactgattcacgggtattgtaagagtcataatcttctccgggctttggctttgcacgatgagatgatttcgaggggtgtgaagacaaattgtgtggttgttagctgcattctgcattgtttgggggagatggggatgactttggaggtggtggatcagtttaaggagttgaaggaatccgggatgtttcttgatggggtggcctacaacattgtgtttgatgctttgtgtatgttggggaaagtggaggatgcggtagagatggtggaggagatgaagagtaagcgtttgggtttggatgttaagcactacacgacacttatcaatgggtattgccttcagggtgatcttgttactgcgtttaacatgtttaaggaaatgaaagaaaagggtttaaaacctgacattgtgacgtataatgtactggcagccgggttgtctagaaatggtcatgctcgtgagacagtgaagcttttggattttatggagagtcaaggcatgaagccaaactctactacacacaagatgatcattgaaggcttgtgttctggaggcaaggttttagaagctgaggtgtattttaacagtctggaagataagaatattgaaatctactctgccatggtgaatggctattgcgaaacagacctcgtcaaaaaatcatatgaagttttccttaagctgttaaaccaaggagacatggctaagaaagcttcctgttttaagctacttagtaaactctgcatgacaggtgacattgagaaagctgttaagttgctggacagaatgttgttgtcgaatgtggaaccaagcaaaataatgtattccaaaattttagctgcactgtgccaggctggggatatgaagaatgctcgcactttgtttgatgttttcgttcatagaggattcactcctgatgttgtaacttacacgattatgataaatagttattgtaggatgaattgcttgcaagaggcccatgaccttttccaggatatgaagaggagagggatcaaacctgatgtcattaccttcacagttttacttgatgggagcttaaaagaatatttaggtaaacgtttctcttctcatggaaaaagaaagacaacatcactttatgtttccaccatcttgagagatatggagcaaatgaaaataaatccggatgttgtttgttacactgtgttgatggatggacacatgaagacagataactttcaacaagcagttagcctctttgataaaatgattgagagtggactagaaccagatactataacatacactgctttggtctctggcttatgtaacagagggcacgtggagaaagctgttacactgcttaatgaaatgtcttccaagggaatgacaccggatgtgcatatcatctcagctttgaaacgtggtattataaaagctagaaaggtgcaatttcataagtag

SEQ ID NO: 113580 - DNA, 234 bp, Glycine max
  Peptide Sequence Number=SeqID_230358
atggtatgggagaaaccggtgtggcggagggtttggagaacgtcgaaggtggagaaagaagagggaggtgtgaaaggggtgttggatagggcgcgtgtggccgaggaaaatgggtgccaaaggatgctcaaggaaagcttgaaagcgcaaagccgcatgagcatggagagaagaacaacatgcggcggtggtcgtggcggctgcttcaccctgcaacattcagcaaggttttaa

SEQ ID NO: 113581 - DNA, 2629 bp, Glycine max
  Peptide Sequence Number=SeqID_230359
atgagtgaaggcagtagcaatttcgtccagccagccataccacgctttgatggagtagctgtgactgaagcgcagcagaagacacgggaggatttgaagttgaaggacctgaaagtgaagaattatctgtttcaggcaattgacaggactattctggagataatcctggagaaaaatacttcgaagcaaatctgggattccatgaaaaggaaatatgaggggaatgcaagagtgaagcgttcagttcttcaatccctgaggaaggattttgagaccctcgagatgaaaacaggtgagaatgtcactgagtactttgctagggtcatgtctgtggcaaataaaatgagggcttatggggagcagatacgagatgatattgatgtgttatcaatagatgagttgcagagctcactgattgtgcatgaacagaagtttcagaaacacaacggggaagaacaagtcttaaaagtgacatctgaagacaggtctggtgctggaggccgaggccgaggcagttttagaggaaggggaagaggaagagggcgtcaaacctcgaacaaggatacaatggagtgttacaaatgtcacaagcttggacacttccagtatgaatgtccttcttgggacaagaaggtaaactatgctgaattggatgagaaagaagaaatgctattgatgtcttatgtggagttgaatgaaactaagtgtgaggatgcatggtttttagattctggttgctcaaaccacatgtgtgggaacaaggctatgttcagtgagataaatgaggattttaggcatttggtaaaacttgggaacaacacaagaatgacggtgctcgggaaaggaagtgtgaagctgcaggtggatggattctctcatgttgtcacagatgtgtactgtgtacctgagctgaagaacaatcttctaagtgtggggcagttacaggaaagaggcctagttattctcattaaatcaggaatgtgcaagatttaccacccagtaagaggcttgatcattcaaacctctatgacagccaacagaatgtatggtcatcctagtcataaaggactaagaaccctgcaatacaagaaaatggttcaaggattaccacagctccctacaccaactacaatgtgcactgcttgtgtaattgaaaaatcagaagcatttcagtctttcaagtattttaagaatcttgttgaaaaagaaactggtcagtttatcaagtgtttgagaacagatagaggtggtgagttcaattctgagaaattcaatgagttttgtaaggagaatggaattaaaaggcagctcaccacagcctacactcctcagcagaatggagtggccgaaaggaagaataggacagtaatgaacttggtgagatccatgctttctgacaagaaggttccaaaaaccttttggcccgaggcggtaaattggaccatgtatgtgttgaacaggtgtcccacttttgcagttagagatatgactccagaagaagcatggagtggagataagccctcagttgaacactttagagtgtttggatgtgtgagtgagaaatccaaaggttacaggttgtatgatcctattgcaaagaaagtggtgattagcagggatgttatttttgaagaagagaaacaatgggactgggatgtgagttacaaggagcagatacttatgcacttggaatggggagaagaagataatggtactaatgagaatgaagcagaagaagatggcagtgaaggtgatgagataggtgggaatgatgctgaagagttaggcaatacttcttcaactacaacaagcaaagatgatgtcaatccaattgagaaaagagagacacatgctcctgtttggatgagagattatgtcactggagaggggttatcagaggaagagaatgagttgaatacgacacttacagctccttctgatccactaagctatgaagaggctttacctgctggagctaagaaaattggagtgaagtggatatataagaccaagcttaatgagtttggtgaggtggataaactcaaggcccgattagttgcaaagggttatgctcaaaaacatggtatggactacacagaagtgtttgctccagttgcaagaatggatactgtgcgcatgatcattgctgtagctgcccaaagaagctggtctatctatcaacttgatgtcaaatctgcttacctacatggagaattaaatgaggatgtgtttgtggaacaaccaagaggctatgagcagaaaggtggtgaacacaaagtctacaagctgcataaagccttgtatggactaaaacaagctcctcgagcttggtttagtcgcattgaggctcattttactcatgaaggtttccagaagtgcatcagtgaacacaccttatttgtcaagcaaaacagtggaggtaaaattttaattgtcagtgtctatgttgatgacttaatttatactggtgatgatgagcaaatgatgttagagtttaaggagtcaatgatgaaggtatctgacatgactgatctgggaaaaatgaggtttttcttgggtatagaagtgttacagatggatcttgggatttatgtctgtcaaagaaaatatgcacaggaaatactgaaac

SEQ ID NO: 113582 - DNA, 633 bp, Glycine max
  Peptide Sequence Number=SeqID_230360
atgggtgccaagtacctcgaaacagtcaagcaaaggttgcatgccatcaaacaatggtccccggatgaaattaggggtgagaacacagcagaagtaatgacagacacaggggagaacacactaagcaagaaggcaacagcaatagggtcatacaaatctatcctcaaatattgcaatttcatagttgaagaaacatctaaaaaatgtgatcatgtctatagttatgcggttaactatgaatttggaaatatagaccagtacaacatctatactcgtatgtgcacaacatcacaaaacaatactgtgaggcacatgcgattcaagaatcttcatatgatttctgggtatgatccatgtactgaaaattatgcagagaaatactataaccttccagaagtgcagatagcaatgcatgcaaatgttaccaacattccttacaaatggaatgcttgcaggtttggtttttcacttgctatactgcttagaaaagatgaacaaaaacactgtgctttaatttacaacttacaatcaaaatccagatcttctaaattctatgaaatgacaagttttaacacatggcttgacacaaggtccatggagagtactaatcaccatcatgatcagcactcataa

SEQ ID NO: 113583 - DNA, 315 bp, Glycine max
  Peptide Sequence Number=SeqID_230361
atggtgtgcaacaatggaggagacaggtgttataagacggtgcaggaggccgtaaacgccgcgctagcgaacggaacaaagaggtttgcgatatacataaaagaagaggtttacgaggagaccgttagggttccgttagaaaagaggaatgtggtgttcacatgtccgtttccgtgtcatgtccagtgtccgtgttggtgttcgtgcttcatagtcgacaagatcgtcatcaccggtaacgccaacgtggggcaacaagggatgacaacttacaactctgccactgtcggtaataataatttgattgttggataa

SEQ ID NO: 113584 - DNA, 906 bp, Glycine max
  Peptide Sequence Number=SeqID_230362
atgtctggttcaactcgagacctagttatacttgttgatgagacaataagacaattcaaaggatcagaaaaagacgcttacaatgaatggaactacaacaagttccgtttgtggcagcttacagattatgacaagataatattcattgatgcagatttgctcatcctaagaaatatagatttcctatttggaatgccagaaatcactgcaactagaaataatggcactctattcaactcaggagtcatggttgttgagctatcaaattgcacattcaagctcctaatggatcatattaatgagtttgagtcctacaatggaggggaccagggatacttaaatgaaatattcacatggtggcataggataccaagacacatgaactttctaaagcatttttgggttggtgatgaggaagagaagaaacaaatgaagactttgttatttggtgctgaccctccaattctctatgtgcttcactatcttggaatgaagccatggctgtgcttccgggactatgattgtaactggaactgtgatgtctttcacgagtttccaagtgatgttgctcatgaaaggtggtggaaggtgcatgatgtaatgcctgagcttttgcaacagttttgcatgttgaagtcaaagcaaaaggcacaattggaatgggatcgtaggcaagctgaagttgctaattacacaagtgggcattggcaaattaaagttaaagatacgaggttgaagaaatgcatagacaatttgtgctcatgggaaaacatgttgaagcattggggagagaccaattggactgatgatgagtctcacactccaacacctcctgctattgccacatcatctctttctgatttgcgacttgtgaatttagctttctatcatccttgcaaatgttaa

SEQ ID NO: 113585 - DNA, 237 bp, Glycine max
  Peptide Sequence Number=SeqID_230363
atgcagaaaaggaagaaattggcactgacccgtttgcagcccagtagttgtttttcagcaacaactaacttgtcacctgcgtcttccctacaagacgtgaagcggctaggttcgagttggattggtcaagctaggtgcaaaggaagaacaacgaagaacaaggctagggttcgagtcgggttagcagtcaaggtgcaaaggaagaaggaagaaaggctacctaggagtgaactttga

SEQ ID NO: 113586 - DNA, 456 bp, Glycine max
  Peptide Sequence Number=SeqID_230364
atgtcgggcgtcaagttcgacggtacccctcccgtacacgcgaggccacccgagcccacagcctcccagaacccttcgcgcttcgttattgggggcttccacgaagccgtgtcatttccgaaggcgtcaaaggaaaacgctatgctgagtgtgttgctggattgtcggcgaggtggcggtggtcatggcgggcttggctggtggcttggccgcattttaaaattttggtgttgttacgtggagtatctggtcattatagtggctgtgattttggtctggtggccgtcaactgagaaatggtgtcaaggaatggggagacatgaggagatggtggttttagattattggatagaaatttggactgttggaaaggaaagagtgaatgcgacatggattataaagaggtggaagactcaagtcaataaaggttcagtgcgtcatggacgtggcttgtga

SEQ ID NO: 113587 - DNA, 237 bp, Glycine max
  Peptide Sequence Number=SeqID_230365
atggcggaagaaggagctgcgagaggaggcggaagaaggagctgcgcgaggaagaaggagcttgagggaggcaccaacggaagaaggcgaaacaagaagaagaggaaatggaagaagtgggtgctgatttattcagacgaagattaccaaaaagtaatgcaaaagatgttgagaatgagaagcctatccagttatccgtccaagatagaagctcaagatgcaacttttctttcttaa

SEQ ID NO: 113588 - DNA, 655 bp, Glycine max
  Peptide Sequence Number=SeqID_230366
atggagttaagaatagaatcaactcatcgtgtcaaatttatatcatgcaggcaaaattttgtgaacaggtgggtatggggtggtttagatcgtggttatatatcgaatgtagatattaactggggtgatatattgcaaattactgcgaaactgacagggaaaaaagagtttcaaggggttggccttctaaacttcaacaatactgaactagaccattgggaacagcttattcctaatgtcacacatgttgttctggagctggagtatgctgcaaaaaatatgacatgggaatcccaatacccggaatggattgatgaggaagaggaaaccgaagtccccgtttgtccttctcttccaagtcttagatctactggaataaggctcaatctcatagctgtgaagcttcctcatgcaaatggggggaattggtctagagatgttgctaggttgcacttgcagctagcagtagctaggcttacaacttctttcaaaggaaattatcccttgtatgtgctttttgttaccaacttctttccaatacctaatttgtttacctgcaaagaacttgtgggacatgtgaagggaatgtttttgggagaaaaactccaccttccactaggatcttgtgaacttgcatttcctttgaggggcaaag

SEQ ID NO: 113589 - DNA, 1527 bp, Glycine max
  Peptide Sequence Number=SeqID_230367
atggcgtgtcaccgttggctctgtatatcactgttgctgctgctgctgctgagtttagcttcgcagagttgccacgctctccattcgttcgggttcgacattcaccaccgtttctccgatcccgtgaaagagattctcggcgttcatgatttacccgacaagggaactcgacaatactatgttgctatggcccacagagaccgaatattccggggccggagactcgccgccggttaccactcgcctctcacttttatcccctccaacgagacttatcagattgaagcctttggattcttgcattttgccaatgtttctgttgggactccaccattatcgtttctggtggcattggatactggcagtgacttgttctggttaccttgcaattgtaccaaatgtgtgcatggtataggcttatcaaatggagagaaaattgcttttaatatctatgatcttaaaggatcatccacaagccaacccgttttgtgcaatagcagcttatgtgagctacagagacaatgcccttcatctgataccatctgtccatatgaagtaaactatctatcgaatggtacttcaactactggattcctggtggaagatgtgttgcacttaattacagatgacgataaaacaaaagatgccgacacacgaattacttttggttgtggccaagttcagactggtgcatttttggatggggcagctccaaatggtctgtttggactaggaatgagcaatgaatctgtcccaagtatcctagccaaagaagggctcacttcgaattccttttcaatgtgttttggatctgatggtcttggaagaatcacatttggggataatagtagcttggtccaaggaaagacaccattcaacctcagggcattgcatcctacttataacatcaccgttacccaaattattgtgggagaaaaagttgatgatctcgagtttcatgcaatatttgactctggtacctcgttcacatacctaaacgacccagcttataagcagattactaacagttttaattcagaaattaaactacaacggcattcaacttctagttctaatgagctcccctttgagtactgttatgaattaagtcctaaccagactgttgaactttccattaatctgactatgaaaggtggagacaattatcttgtcacggaccctatagtaacggtcagtggtgagggtattaacttactttgtttgggagtcctgaaaagcaacaacgtgaatatcataggacaaaatttcatgactggttaccgtatagtctttgaccgtgagaacatgattcttggttggagggaatctaactgttatgatgatgaactctctactttacctattaaccgatcaaatacacctgctatttctcctgccatagctgtgaatcctgaagcaagatcaagccagtctaataatcctgtgctgtcacctaatctctcatttaagataaaacctacttctgcgtttatgatggccctttttgtgcttttggccatattttga

SEQ ID NO: 113590 - DNA, 201 bp, Glycine max
  Peptide Sequence Number=SeqID_230368
atggcattacaaggggcggttttcgggttttgcatgttggagccatttggaatgggcaatggtctttggggttgttgtgttgtgatgttctcctatttttcctttacagcatgtgaaagggagggtcaagcactaagtcttgagaaaagcaggaaaggatctaatgggagggttaaacttgtgtactcttatcgtaattga

SEQ ID NO: 113591 - DNA, 519 bp, Glycine max
  Peptide Sequence Number=SeqID_230369
atggattttgcgccgaatccgtgccctttgcgttcttcttcgttcgtgaatctcgttgagaggattaaacagcttggtaccctcgccgtttctgcagtcattgggaacatcttctccgcgatcttgaccttctgcttcgcattagttggcactttgttgggggctttgactggagctttgataggacaagaaactgagagtggcttcattcgaggggctgctgttggtgccatatcaggagccgttttctccattgaagtgtttgaatcctctcttgttctctggcaatctgatgaatctgggattggttgtgtcttatacttgctagatggaattccaattctgattgaagaacaagaccgaaaaacatttaaagaatgccatattgatgttattgtcagcttactgagtgggagacttgtgcgtgagaggattggtccggccatgtttagtgctgttcaaagtcagcttatgcgtgcccaggaaactcagtttggtgatatgtttagtttcccttaa

SEQ ID NO: 113592 - DNA, 192 bp, Glycine max
  Peptide Sequence Number=SeqID_230370
atggccaagaagggttcttttgacgatctcaggcgtcccaaagccaaaccaaccacgaaggaagggtcacgagaatttaagcgtgctttcaagcttggggttggaggctttcattggccactattttctctgcaagtgatgtcgtattggtgtcgcacaaaggggctggagtgtccgtgctttatgaggtag

SEQ ID NO: 113593 - DNA, 294 bp, Glycine max
  Peptide Sequence Number=SeqID_230371
atggccctgaccactacgagatggatgaggacgaaatggaggagagagctcgacaacaagaaggacttcgacatcaagtacaacctctttatccctgttgtcgccactatcggcaccggcgatgataacattgtcgttgctaagagcaagagcttcgtgtccatgcagggctgggactttgacacaattttctgcctagtcgattgcgacttcttaattcgcaagccccccgaccccgacaatgatgtctatgattttagagaggttcctaaccctaataataccacgctttga

SEQ ID NO: 113594 - DNA, 183 bp, Glycine max
  Peptide Sequence Number=SeqID_230372
atggatgatcctgttgttgatcctaatattgtgcatccttcaaatgagcattttgttcatgaagaacagcaacccatcaatgaagaacctgacattgtaaatctcagtccatgtcttgatgaagttcatacaaccaatgaggtagatcttgatgaagaatctaaagctcctatgtcactttga

SEQ ID NO: 113595 - DNA, 138 bp, Glycine max
  Peptide Sequence Number=SeqID_230373
atgtatgttactcctctagatacaaatgtttattcaattcccaaggttctcgctccaatgccgcagaagtacattagatgttcacaaagtgattatggaagctacaatgtgacaaagccacctattgatgcgccttaa

SEQ ID NO: 113596 - DNA, 2586 bp, Glycine max
  Peptide Sequence Number=SeqID_230374
atggcaaccccaccagcgtcccctccgaagtcaaatattcagtcaccaacgaagtctaggaatactagaaaatcaacacggctacggaggttgactgtaagagcattggatcagccaaaaccaactgtttacgtggatgccgcaattggccgaggatcgggtccattcaaagagaaattccacaattatcttggggtcgtggccagagagaaaattcccattgcacataatagctggaaagatgttccagacacgctaaaggacctagcaaaatttgatatcccagaagcattgaatgcaaagaaaaaggtcatgtccaccgtggccagtagatggaggcaatttaaatgtaacctgatgactagatttgtgtatggtaactctgaaggtcaacatgaacatgatcctccggtcaaatatgacgtagataaagaaacttgggagcaatttgctgcaagccgcaaaactcctaattggcagggaatcaggaagaaaatgcaagagattcaaaaatacaatgaatacccccatgtactttcttgtggggggtatgatttgcttgaaaagaagatgatggacgagaagatgaagaaaagacaacatgacgcaatgacaactgagaatacaccaaactctggggatcccccatctctcattcaaagacatgccaagtgggtgttggcacgcactaagcaatatggacagatgacatctcattcggcacaagaaatatctgataaaattggtacctttgtcccccatggtcgtgaaggcatactgaacactgccatcgggccaccggatcatggaggccatgttcgggcagtggggtctggggtcacaataagtcaatactttggaagggtagcacgtggctccagttgctcatcagggtcgatcagccatgtacaatgggctgaaataattggaggcctacaggaacagtggaaaaatgaaatacagccagatatacatgtgctaggagcacgagtgagcacaaaagggagcaatgcagagagtgttgtcaacccatgtctacctaatgatgttgctcctgtcgaaccccctatggggttgtatgtgcagcgccaagattcaattgagttagtggccttgggaaaaacatatgacggaggctcgaccatacacaatgtggcttatacagacgatgtcgtaagggttagtgttgagcaagttattaacagtgatgttgaggtcccattcccaacatcagagattaagtgtgtcaggcagacccttcacacattcattgcatggacaacaccacttgttaaaaaaatctttattgagcatgagggcagcagtccaactaaagacactgaagctgttgaagcggtcaacgatgttgttgtagatgaccccttgcgcgagttgattaagagcctagttgacatttatgagaagcctgtagagttagtgtgggatgtaactaaatttggaattccaaatgcagttgcatcattgttcgtaacctgtgctgatgtgaatgaaataatatcaggcgtacagtgtttgaacatagttatactacaattgtggaccattcaaagcgacggtctaggatcagtgtatggattccttgagccgcaggctatactgaatgcaaatgatagacgtggacaatgtgaagaatacattgaaaaattgcttaaggaatcgaaccgagatgcctatctaggcgcttatttgaatcagccagatgttcatataaaagctgcaattaacaatgcatttaagactttggaaaccaagagtgatgggaaatttggtcacaatacaccacggtggattgaagtgaaggttagtctgaatgaaactgctaagaattttggtgatgaaaagcaaaacccttcagatgaggatgatgttgctgcagatggaaacaaggaaaatcctactaatgaagctgaacaaaaagagcctgagaataaggagatgactctcgaggaatatgaaaaagtactagaagagagaaggaaggctttccacgcacttaagactgaggagagaaaggtagatactaaagttttcgaatccttgcagcatctctcgaacaagaaagacaatgatgacatctttattaagctgggaggtgataaggacaagcgcagagagacacttgacaaggaggataaattaaaaaatctaagagctaaagggagggttgatgaaccagctgtcaggttgtatgaggatatgttgtctgtttacaacaacagcagtgatgcagctacagaattaatgaacgaccctgtcattgtttcaacgggacaggaaaatggagaggagagctttgaggagttgcaacagctttttgaagacatgtttcaagcggatattggattggatggaggcccttctcttgcttcttctgattcctcaacttcatctgcttacatgacttatagtgaaagttctagttcaaataaacgcaattcctctgagatgaatttcgggaaggcagagaattcttctgtctttgatgccaaaagcgcatcttactacatcagtgcctacgtcaccactgatgtagaagtttccatgttcaacatcgttgctttctga

SEQ ID NO: 113597 - DNA, 243 bp, Glycine max
  Peptide Sequence Number=SeqID_230375
atggagagagaagctgcctcgtcaaggccatctttccacaactatgttgctgtaatgtttatcttcagtgtggttacccggtttgcttgtggactagcagcaattgacactggactcggcaatggcatgaatgccatctcgcttgtggacagcgcatattactccgctcttggaattctaagctataggaatagtgcttttgaaattgatcatatttttattaaccaaggacatacttactaa

SEQ ID NO: 113598 - DNA, 279 bp, Glycine max
  Peptide Sequence Number=SeqID_230376
atgctaaattccgaaaaagttattgctgttggccctggctttcacagtaagaatgggaagctaattcctgtggctgttaaggaaggtgatactgttcttttgcctgaatatgggggaactgaggtgaagcttgataacaaagatttattttataccctcattcaattcttcaacttcatcctgaagtttaatatgcaaattaagagaaagatgaaaggaagagaaagccttaccataagggcatgcaagaaagatatgaaatggagagaaagaaactga

SEQ ID NO: 113599 - DNA, 324 bp, Glycine max
  Peptide Sequence Number=SeqID_230377
atgtcttgggttgttatttgtgctccaaaatgtaagggaggtttgggattgaggaagatgatggaagctaatcttgcctttatgatgagggctatttggcagttatcctcttatgagatgtcctatgttcaagaaatgttagagagaaatacagatgtggttcctataaatgctgctggtttgatcagatataggtggcgccaccccttttttgctcactgctgcagctatgaaagattggagatactggaaggacttcttgaactactagagaataaagaatgtgctcactggaaagctaagtatgtatctggctggatctaa

SEQ ID NO: 113600 - DNA, 483 bp, Glycine max
  Peptide Sequence Number=SeqID_230378
atggaacagggggaaaattgggcgtgctcgggttcgcagaggaggaagacaatggggaagatggaaaacgcagcaagagggcatcaaacttctgagccatgttgtgaacggtttcacccagggaagcatggagaaaagacaagcatggaaaatggaaaatatctaatggaatattctatgcaaatggttggttattgctgtcccctgatcatagacaacaaccctgcagatgatcccttgagcccactcagcagcccctttacacgtagtcccgcagacatccttcccattgtttgccatctgattttgatacaacgaatcttgccatacacgagttggaatagttctatgatgcaagctccattggagcttgtaggcctaggatcttcttcatcaatggattcctttgcttcttggaagatgaatgacagcggaatggagaaagggaaagagagaggagacgccacttcaaggagaagatga

SEQ ID NO: 113601 - DNA, 165 bp, Glycine max
  Peptide Sequence Number=SeqID_230379
atggaggtgaggcttgtgtttgaggagcctgaatcgggtgttacggttgttaagctaacacatactgatgtgcctgaagaggatagtttaaattcaaggagatacaccttgcacaaaggtgcaataagagcagcaccattccatgcagcaggttgtttgaagtga

SEQ ID NO: 113602 - DNA, 138 bp, Glycine max
  Peptide Sequence Number=SeqID_230380
atggtgttagaagtcattgccaaagctgtgaagatgcaaagcaagagttattgtgagacccgtaggaatgttcattatcaccaattaaagttgtcaaacaaattagttgatagaatagaaggatcaagtcaaaagtaa

SEQ ID NO: 113603 - DNA, 4026 bp, Glycine max
  Peptide Sequence Number=SeqID_230381
atgagcaagaggctccaagaagattgggctagagctgctgaagaaggccctagggttctcatgaaccttaggactcatcttctccttgaagtggcgtctcctctctctttccctttctccattccgctgtcattcatcttccaagaagcaaaggaatccattgatgaagaagatcctaggcctacaagctccaatggagcttgcatcatagaactattccaactcgtgtatggcaagattcgttgttttggtcctcaaaaccagagtagcttgcccctaacatttggtgctcttgttgccatgcctaatcctccccctaaccccctcgaagttgccctcctcaaactcactgacctccatgcttccctgggtgaaaccgttcacaacatggctcagaagtttgatgccctcttgctgcgttttccatcttccccattgtcttcctcctctgcgaacccgagcacgcccaattttccccctgttcctgcatcccaacacaaaatgaaactcgacattcccaggtttgatggcactgacccttttgggtgggtgtttaaaatcaatcaatattttaagtaccatgctacccctaagcacgatcgacttaccattgtttccttctacatggatggtcgtgctctcgcatggttccagtggatggctaacaatgggcagttcacgtcgtggcctgccttcatccaagcccttcaaaaccgctttgctccctcgcactacgacgaccccacgggctcccttttcaaattgcaacagaccggcaccgtggcccaatacctttcagactttgaggatttagccaaccgaattgttgggctacctccccaatttctcctgagctgctttatatcaggactgtcgcccgatgttcgctgcgaggtgcaggcgctgcaacccttgacattggtgcaagccactggcctggctcgcctccaggaagagaagcttctagacatgcagccttcccttcgcaaccgtgctcttgtggtggtgcccgtttcaccgcgacctgctccctcccctgcgttgcttcctcttccagtttcgcgcctaccaccaccatgtctacctcccaccttgaagagactctccccggaggaaattagctctcgcaaagaacgaggtctctgcttcaattgtgacgagaagtaccatagaggccaccgttgtgcctctaaggttttcttcttggtcacggaggaagatgaagctgttgaccctcatatagagggaattgacccgagccccgacccgttcgatatccactacccgggcccggcccaaattagttttaattcactagcgggccagctagccccagaaatgttgcgtttgataggcacggttgccggcaccaccgtagtgatcctggtggacggtgcaaacatagttttgggtgtgcaatggttgaagatgctcgggccagtactcacagattataatactatgagcatgaagttcttttcggagggccagctcattgaatttcaggctaccccagtgaacatgcgcccctataggtatcctcactttcagaagcgcaaaattgaactccaggttgaatccatgctccagaagagactcattcgccccagtacgagccccttctcatctcctgtgctactcgtgaagaagcaagatggctcttggcgtttttgcatggattatcgagctttgaacgcggtgactgtccatgatcggttccccattcccaccattgacaagctcctcgatgaatcgggtaaggcttgttggttttcgaaattgaatttgttgcagggctatcatcagatcaggatggattcctccgatattgccaaaacagcattttgcacccaccatgggcattacgaattcaaggtaatgccttttggtttatgcaatgccccctcatcgtttcaggcaaccatgaatatgatcttcaggccattccttcgtcgtttcctgatcgtcttcttcaacgatatgctgatatacaacaccacaattgaggagcatgtaacacatgtggaacaagcttttcaagtccttttggataatcattttgttcttaaattatccaaatgttcattcgcacaacaacaagtggagtatctcgggcacatggtttccaaaaagggggttgaaccagtggtggccaaagtagaggcagggtatgcttcgatagcttccccattggtggcagcaaccacggtggagcctttccagtggaccgcggcggctcagctcgcatttgacctcttgaagaaagccttgttcgaaaccccgggccacacaattgcatattttagcaagccatttttgcctaagcttcaacgatcgtccacttatgtccgagaattgttcgcagtgatggcggcggtcaagaaatggtggcaatacctcctcggtaaccgtttcatcatccttacagatcatcccagtttgaaggagctacttacgcaagttattcagaccccagagcaacatatgtaccttgcttggctgatggggtacgattaccaaatccaatttcgttctgcattccacctctctgttgcttaccttgtcgatgccctcttaacctttttggaggaattgcgagctcaattagctcagaatcaaccttaccatgacagacttcaggcgattcaatcctccccaaccaagtaccccgagctcactataaccaatggcctgatactcaaaagaggccgcatttggttaccaccacaattacccttgatcacaactcttcttcgagagtaccatgccactccgacaggcggtcacttgggaatcgcgaagaccattgctcgggtaatggataacttcatttgggaagggctacgtgaagatgtttccaagtttgtacaaagttgtgtggactaccaatatgctaagtacgagactaagagggtggcggggctactttgtcctctcccggtgccacatcggccatgggaggacctctcattggacttcattatggggttaccttcttttcaggggaacactgttatcctcgtagtggtggatcatttttcaaaaggcattcacctgggcatgctgccagcctctcacatggcccacgtggtggcctgtttgttcatgaacattgtcggaaagatccatgggctaccacgcagcatggtctctgaccgggaccctctctttatcagcaggttttggcaagaattattccatctgaggggaacacagcttcggctcagctctgcatatcacccacagagtgatggacagactgaatttcttaatcgagtgattgagcaataccttcgctccttcgtgcattgccggtcgggatcatggggcaagctgttactgtgggtggaatggtcccacaatacaacatggaacgcggcaacggggtctacaccctatgaaatcaccttcagaaggaaacctttcaatttcccggagtacctcacgggcacttccaaggtggacgcggttgatgaaatgttgactaatcgagaagaaaccttcctgctcattcgcaagaaattgcttaaagctcaagagctcatgaagaagtatgttgatcgcaagcgccgggaggtggtctaccagttgggggagtgggtgatggttgaagattgtgtggggcctgtagcttatcgtttgaaactccccgagggcgccaacattcatccggtgttccattgttcccttttgaagtcctttaaaggttcctcgaagatgactaactcagccccattgcctgatcaagttgttcataaccaacctctgatagccctattagcaatcctggattaccgccaagctttagctggagaagaggctcactgggaagttctcgtgcagtggtcaggacttcccccggaggaaacttcatgggaacgctggactcaattatgtgaggaatatcaccatgaggacaaggtgcatttgcatgggccgtggaatgataaacaagcagaggggctgctgagtgggctcaagggatcatctgtagggttgttgtctatggtcaggggacaacaataa

SEQ ID NO: 113604 - DNA, 597 bp, Glycine max
  Peptide Sequence Number=SeqID_230382
atgacatgctcttcactttgtgattttgttttcgatcctgttaaatggccacgggtgcaaatggaggaggacttcctaaagctttcacaaacattcaaagcaataagatctgttgtaagggtgccagctctggatcctaaatataagatagcggttcttgcatcaaagcaggaccactgcctggttgatttattacatggatggcaggatggaagacttccagtagatatcacttgtgtaattagcattgatttatatgcaaagatattatctggaaactttttaaggagctatgggaacgatataattaacattcaccatggtcttttgccatcattcaagggtggtaatccatctaaacaggcctttgaggcaggtgttaaattaattggtgcaacaagtcactttgtgactgaagaacttgatgctggacctataattgaacaaatggttgagagagtttctcacagagataacttgcagagctttgtgcagaaatcagaaaacctagagaaacaatgcctttccaaggctatcagatcttactgtgaacttcgggtgttaccttatgaagaaaagaggactgttgtattttga

SEQ ID NO: 113605 - DNA, 264 bp, Glycine max
  Peptide Sequence Number=SeqID_230383
atgtcttctactccagaagcaatgagcatcgaacctaagtcttcatgcatctacccaagaccaatgaagtttatactattctatgcagaatcgtctttgttgttggggttctcgctactacccatgatacagcccaacacacacaacaaagagagagagcaagaatttgagtgtctcgggtttgaatggtggctggctaagcttatgttgtgttttgctggctgtttggtggcactaaggacaagcgcactccccttaatctaa

SEQ ID NO: 113606 - DNA, 750 bp, Glycine max
  Peptide Sequence Number=SeqID_230384
atggtctataacatgtatccctttaccaacgcttttcctcccattgccaaagaaccaaagcaaaagggaaagaacaaacataaaaagaagcatcgtgataagaggcatgttgttatcgaaccctttgatcgtgaaggttctaagaagatgaagcgacaaatgttggactttcctagtactcatcctttgaccaacatcttagctttgatgaatggtggtttcttcaccaatgagttttttctaagttgtctaattgatttgacacatatctcatatcacgaccatcttgtgttgaacaaaagtgattatgtcgctaactgggcaaacttttgggcctttcaagcgcagtcgacagttatcgcccaacatcttcaaggctttttagccgtgagcaagttgaaagatgaattaaaaaaggccaatgactctcttgtttccccgctttttgcccatattgcattggttggagacaacttgaagttaaaggcttgtgtcatcgcccttgagctaaagtcaaaggggttggaaactcgcactatgaatatcaaagactctgcaaagttaagtgcggaggaggtggagaggttgataacttcattggccttagtagagaaggagaaagatgttgaaaagaaagggaaaacccaaattgagcaaaaagcctatgatgacgtgtatgaggcgcatgtatatatttttcatcatttcttccgccaagtcctttttcattatgaggtacttgatgagtaa

SEQ ID NO: 113607 - DNA, 1341 bp, Glycine max
  Peptide Sequence Number=SeqID_230385
atgctatggcatcaccttcctgctatttcaaacacatctgctgtacgtgagcggaagtccaaaggctacttgttaattgcaactagtggaggactgaaccaacaaagaaatgggataacagatgcagttgttgttgcaagaattcttaatgctacactagttgtacctgagttggatcatcaatctttttggaaagatgacagtgactttgccaatatttttgatatgaattggttcattacttatctcgcaaaagacattactattgttaaaagagttcctgataaggtcatgcggtccatggagaaacccccttatacaatgcgtgtaccaaggaaatcagaacctgaatattatcttgatcaagttttgccgatactctcaagaagacgggttctgcaattgacaaaatttgactatagacttgcgaataatcttgatgatgagctgcaaaaattacgttgccgtgttaattatcatgctttgagatttactaaacctatacgagaacttggtcaaagacttgtaatgagaatgcgaaagatggcaagtcgttatatagcagtccatttgaggtttgagtcagatatgctggcattttcaggttgttattttggtggtggtgaaaaagaaagacgcgagcttggtgaaatcaggaaaaggtggacaacgttgcctgatttgagccatgatggagagcggaagcgtgggaaatgtcctcttactcctcatgaagtgggtttgatgttgcgagcacttggttttacaaacgacacatatctctatgtcgcatcaggagaaatatatggtggggatgagaccatgcagcctctcagagatgttttccccaacatttatacaaaggagatgcttgctcaaaaagaagagctgaaaccttttcttccattctcttcccgccttgctgctattgactacatcgtttgtgatgaaagtaatgtatttgtcactaacaacaatggtaacatggccaaaatccttgctggtcgtaggaggtatatgggtcacaaaagaaccatcagaccaaatgcaaagaagcttagtgcgctgttcatgtcaaggcatgagatggactgggatacatttgcaagtaaggttaaagcatgtcaaagaggattcatgggagagccagatgagatgagacctggacgaggagagtttcatgaatatccaagtacatgtgtgtgtgagaaaccattcatggatgatcttagccaagacggattccggccccctaaactcgcagccaacaacgtgacagtgaatggaggaggaaatgaagaaagtgtacgaaagcgaagtgggagaatggccagcacgtga

SEQ ID NO: 113608 - DNA, 222 bp, Glycine max
  Peptide Sequence Number=SeqID_230386
atgaggcagaaatgccagcacttcagaaaatacagctcgctcgttgagcagccagaggatgtgaaggagctaaggtgtgcaggtgtgcttagtaacgaacttggcagtgataaagagatggaaaatttgtttaataagctgaatgtgttgttggtgcctgaaactgctgcttttgctctcatcagagaccagattgaagttcattttaagtccaaacgttga

SEQ ID NO: 113609 - DNA, 330 bp, Glycine max
  Peptide Sequence Number=SeqID_230387
atgctggtggtggatgggtgttcggtgcttcaggcgttggacaaatccctggattcggattatccagagaaagaactcaaacgcagcgctgggcagcagctgcggttgcatcatgatctgttcctcttggtgaaccaaattccttaccaattgctcaagctgttgtgcggagacaaagcgaggctaaatagatccatgcacaattttcttttggtgcatggtatagaccaggcatcgagtggggaagggtcaatagagcaagagcactatataacagttgaagaagatgagcaaggcaaagaggaacctgttcatcttttagggacttag

SEQ ID NO: 113610 - DNA, 864 bp, Glycine max
  Peptide Sequence Number=SeqID_230388
atgacaaatcggaatccaagaggaataacttcttaccgtgaacaggaaagaattagagaaagggtaacattgttccagtctctattccttaaaggaatcaatctaacctcgccagcaatgggaacagccatgccaaaccttgcaccaggtcttatcttcatcatcgcatggatttttcggttggaaaaagtcgacttgagctgcacatatagtagagtgaaaatcattggcacattcctttgtgtcttgggggctctcacaatgagcatactgcaaagcatctctacaacacctattaccgctaaagagggaacaattcaattattatctccaccaaatgtaacgtttgacagacacaagataatcggttgtctctatctcttggtcgcaatcctcatattatcaagcaacattgtcctccaggcctttactctaggagattttcctgcaccgatgtccttgtgtgcaataacttcgtttttcgggacgttcatgactgccgcagttcaattagttgaagatcacgaattcaaaacaggttggccaattgtgggtgttggagacatgattgcctattctcttctggcaggtgcagtgaatggaatatgcttgagcgtcaatggttgggcacttgagaagagagggccagtgttgatctccatgttcagccctattggcacagtctgctctgtcattttctcagttgttactctaggacaaaccattaatattggaagctttgccggtatgttcctcatgttcactgggctctactttgtgctttgggccaaagggaaagaaggctttgcaaaaggaggtggcttagagagtgagtatgatgcagagaagcctctcttaagttaa

SEQ ID NO: 113611 - DNA, 309 bp, Glycine max
  Peptide Sequence Number=SeqID_230389
atgtggtggagcttggaggagagggagatcatttttgagtttggaggaagggaagtcaaggagtgtgaggaggaattttacggtttcgtggatgtctttggaagggagggcccttgtagagttctagggttgggcatcaaccgatgccaacaaaggacaggcgactgctcatgtcggagtcgcaggaagagttctgccggtggtggttgtgaattcttgcttcaagatttcttcaaaatcaagccttgcctcacaatgaaaggtttcaagtcattcaaggcacatgtaatcgattaccaatacatgtaa

SEQ ID NO: 113612 - DNA, 531 bp, Glycine max
  Peptide Sequence Number=SeqID_230390
atgataagtatcactaatctcatccttatgttttctacaggatcattagcttcatatgtgaccggcatatctcgtgctcttcaccacctggtattgccaaagtatgcaactttaaacctagatgaggtgcaagggttgcatcaagttaatgtagaggttacctcgtattttaatggtcaattacacggaaatagaatttggattgggcctggagcctgtcatgacaaagatgtcttcttcgatctcttcacgggagagagcgatccagaatttcctcttctctttcttcacactacacggtgcgcccaagaacccgcgaagccacaacaacttcggtgtggggttgttgttgtcgtcgccgctgccgtcgtggaattctctgttgttggtggcgtggtggtggtttcgagaaggtccggtgccgatctcaagtgggccttggggagaagtgtggacttgcaagggtgcaagttccatggcttctgcacggcattgtcgtgtgcggctttgaaacggtgtcgtagagaatga

SEQ ID NO: 113613 - DNA, 279 bp, Glycine max
  Peptide Sequence Number=SeqID_230391
atggatgctaatagcacccttttttgccttaaacaccttcaaaaacctttgattcaagttaaccactttaattactctcaaatcccatcagagattagtaagctttcacagttaaggcgttactacgttagcacttaccgtctatcagactatcaccacattgttgaaatccaagctaggcatagggaatcacaaaaagtgtccaatagtttgttaggaatagtcatcacagctgacaaaaggacactatccatatcgcacaagcaagggacgttgtag

SEQ ID NO: 113614 - DNA, 297 bp, Glycine max
  Peptide Sequence Number=SeqID_230392
atgagaaatctgaaatttgatattggcaaatgcacaaaacggatctaccgcactcgcaattacaatgccggcgacggtattgagtcaagcctgactgaattcgaggtgaaaagtcaaatgcgaatcggtaaaggatcgagcggttacctgagaaatggagttgttcgtctcaggtttcgtgccgtcgagatcgacggcggcgggaataacggcgtcgaatcggagcgaagggcgataacgatgtttgagagagaaaagccggtagtgtgtatgcgtagaatggagaatgatgagtaa

SEQ ID NO: 113615 - DNA, 858 bp, Glycine max
  Peptide Sequence Number=SeqID_230393
atgtccattcctaagcgtgaggggcatgggttgagatctcaaactacaaatatgaccaaagtagaacttacaaaggtagttttagattcaaacataccaaacaagagcttaaatgaaatcaagagtgtacttgtgtcagctcttgcatcacatgggcaattgtccgaggctcttcttgtatatgaggagatcaagaaagctggacataatttggagccaaaagctgttataactctgattgaggagttcactaaattcaatggggagttggatggattgctgcttctacttgaggaaatgaatgatgtagactattgggttgatggttgcttcaaggttatcatgtactgtatacggaacaagaatttgagttctactattcttttgttcaaacaacttaaggacaagttcaaaaatgatgacctagtaatggaagctctttttgatgcagtattttctctgattgcatcgtctgagtcctctcatttacagattggcctggacttgctttgggcaatcaaggatgagcttggccttatgccttcgcggcagtgtcttgattttcttctaagtgcttgtgcgaatgctggagatttgaacaatgctcgcttgatttggagagagtacgaagttgctggatttccttacaatgtattaagttacttgaggatgtatcaggcacttttggctgcaggagatgatagatctgctcactttatgcttaagaaaattccacaagatgatgccgaggtttgttctgtcatcatagcatgtcaggaaacgtacaatgatcttaattctgtagaagagaagaaaaagcaaggaaaaaggaaaaagaaaaaagaaagaaaagagtaa

SEQ ID NO: 113616 - DNA, 636 bp, Glycine max
  Peptide Sequence Number=SeqID_230394
atggagagagagagtagaaagagaaacagcgggtgggagagagttaggtctagaagagagaagagagagagcgccagagcacgaacgacggagggttccggtctgaccattgaagggagaacaacaggacaagatcatagctacatgcgagcgaattggagagaccatagggacattacctcgttctatttcaccaggttcccagaagacgcaactgcagaagatttatggcatcatttcaagcagacaggagacgtacgagaggtgttcatacctcggaaaagaaacagacagggaaggagatatgggttcgtgaggtttaaaggggtgcgagacatacagcagattcaaaagaaactggacagcatgatttttggaggaatgaagatgtatgttaatgtacctaaatatgggagagcaaagaaagaagagccacaaacagaagaagggggaagaacagaagctagacaacagcaacaggggaaaaaagacatgtacctgagcaggaatgcagaaacgaaggtgggagtccaaagagggtcgtatgcagacatggttactcgaaataaccaaagagcagaacagaggagagtaccagtcaaagtcagcgataatagtcacaattcgacatccgaa

SEQ ID NO: 113617 - DNA, 228 bp, Glycine max
  Peptide Sequence Number=SeqID_230395
atggcagttgccagccttcatattgaaaaggttgtcaagctagaaatgaaatgcatggttcccttgggaggatcaccaagtccaagctttcttagatgcagttcaaactgcacgagaagaaagaaagtttgggtggctgttatcaatgcaatttggtatcactgtaataacgtggtctttagggttggggtagtggatgtggaggagattcaacatatgtcaagttaa

SEQ ID NO: 113618 - DNA, 1185 bp, Glycine max
  Peptide Sequence Number=SeqID_230396
atgggggatgacatggttctattacttggtcttactgacacaaaagcagaacaactgattcaagaagaaatccatgaaacgcctcccctgttctacacgctgcagaaatggaatccgagcctatgtccgggatatgggttgacctgggtccagtgctggggcatcccgcttctagcctgggacacgatgcaaatcaagaagatcgtggtagaggtcgacgatgatgttgatgaacgtcggcgtttggacagagcacgggtgctcattaaaacaccgtggaaacccgcgattcagcatacgttaaatgtctacatagattcagaggtctatgaagtgcgtatattggaggaatgcggatatagcaccgacatctgccattgtagaagaagcagcgttatggtgtcgccagaggagattgactctgacggaagtttcatgggatcaccgattaaggagaggacccatgcgtcagagaaagacgacgccgcgcgggacacggagacaccggcaacgacgagggcccactacggagcaattgcagaaccgatagcggaggtgacgaagaccagtgcacgcaattacctagtggtcaaaacgaaatacaacgaccactgggtaatagtaatctcctgcggacatacgaggtataaggaggggcatgaggtaggagaactcagctggaaggagaaagaggcacgtgaccccatgtggaagaggaaactagttcaaatgagttgggcttttctattcacacccctgttaaagccccaacaccccatggttccagcccacaaactaataacacagctacagctccctcttggcaggtgtattctcaaactaggagcccacaacacagaatcaagattaaacataacaagcacacagcagcaacaaaataaaataagcgcacagcagcaacaagtaacggacagagacaagggaggaaagggctacaaccataatcttgtccacagagaagtattatcagttcaggatgcagtggaggatgcaagcttaggggaaaataacatgcaacatgcaacaaagatatgggaaatagcaaaacatttgggggcaacgggagctgcagatcaggggagaattattgggaaaatcatgacaatggaggaaagagataggaaagaggcaaagagattggggaatagaagtgataacccataa

SEQ ID NO: 113619 - DNA, 495 bp, Glycine max
  Peptide Sequence Number=SeqID_230397
atggcattgggattgggtaacgctgttgctcttcctatctcaaacttgaaaccttctctaaagttatcttcttcttctttcaccaaactcttgttctcttactctcgccccttttcctgcatcaatgtttctcctccaatgccaaaccgcattcccaccttggcagtagttcgagccttttcctcttcctctttcaggtcttgcctcgaagacaccatcaaaaagaccgtagctgagaacccagttgtcatttattccaaaacctggtgtttctattcctctgagatgaaaatcctcttcaaaaaactcggcgtcgaccctcttgtctttgaattagacgaattgggtcctcaagggccacagttgcagaaggttttggaaaggatcacagggcaacacactgtgccaaatgtatttattggtggcaaacgcattggcggctgtacagatacactgaagctgtaccggaaaggagaactagaacctttgctatga

SEQ ID NO: 113620 - DNA, 329 bp, Glycine max
  Peptide Sequence Number=SeqID_230398
atgcaaactcgatttatattagttcggccacttcacgtgcctatgtctagtcctcaagcaacccatttgagatttatattggttcgaccacttcatccgcagtcaccggaactcgaagccacgaagcatccaaagcgcatacatctcaaattcctccctccatataatctcctacgttgttttcctcagaagaacaacgtaaagggggtttcgacttcatccgcagtcaccgaaactcgaagccacgaagcatccaaagcgcatacatctcaaattcctccctccatatcatctcctacgttgttttcctcggatgaacaacgtatccg

SEQ ID NO: 113621 - DNA, 1797 bp, Glycine max
  Peptide Sequence Number=SeqID_230399
atgaagatgtttgttaatcgacccaagttcgaaaggcgtaaggcagtaagactgaacataaaggatgactgccaacctgataatggcaagccacaacgtgtgattaattatgaggaacgactgcagcgaacaagcaccactgacggaagactgcggtcttacgctgaggtggtgaagacgtcctcgatgggagatggtgctttgcataatcagggggcagactcctcacaaccctctatggctgaacataggccaccggcggttataaccacaaacatggagcagaacaaatggatacagcaggcatgggttggccgtttgaaaaataggggaatgttcgaaaggctagaggacgagctgaagtgggtcttagaccctgaagttactccctgttactggggtgatgactggatcatcctccacaacatggaagatactaaggccacaaggcttgtgaaagaagagaagacatatgggtcgacacccatcctggaccttcagaaatggtcccaggatatccgtccatctcataggctggcgtggatactcctctggggtttgccgccgtcagcgtgggactcggaatgcatgggaaaggtggtagagggggtcggcgagatggtggaagtggatgattacgtggaacggagacgacggcttgacgtggcacgaatcctaatccggacggcgatgaaaccagggattcgaactgagttgcaggcggtcatcgacggcactgaaatcgccctccacgtgatagaagacatgagctgtttgggtacgacgagggaccagcagaggatgggttcttggctgcctccgtccccgctctcgaccgagccaaacagccccgtctctgacggaacggacatcttcgggattgattccatcctcgaattccctgaagatgggccagaagacgacggcgttggtgtctccaccgctgagaggagggttcgcgatacgcagacatgttgtgaccaatggacccagaccactgggagatgcggcttggaccggtccttcaccgccaatgatgacgtggatgcctcacatgacgacaacgcggttttaaaaaattacccaaccgttgaaggccttgctaggtcccacgaaaccggcgttggtcaaaatggattgcagcagggaacattaaatgcttctgggaataggagagagaagttccccttacgtgcaccgctaaggcaccttgaacaacatgcgggtcaacagaggaatccaaatgaggaaacctctgcagacattgaccattactcagaaaagaagcaggagcagaagcataggaatgtagcttgtccaccgacaccacctgcaatgaccgacaacagggataatatatccccacaccagcatgagacaaatatggccaaaggagatatgggcctcagacccccaggcccaattcctggttctgctgagactaaattctatgttagaagaagaaaaataatcaaggggcttagagaaacggcccatattaaccaggtactgcccgaggaacatctaacacctcttacaatggtgcctactaccaaaggaacctcgcaaacaggccacatcactacagcatctcttctggaattaaatagcacaaaacaggacttgtgctttggggaaccaaatccctatattctggaaagtcagtgtgccttaatagaagaaatgggtttgacccatggggacaatagtaggaagcttcgtgagatgatgtcagacatggaaaaaagggattctaatttggcagttgagatgggaattaaacaggcccaaccatga

SEQ ID NO: 113622 - DNA, 3999 bp, Glycine max
  Peptide Sequence Number=SeqID_230400
atggctgacagttcctcagccaccagcgatgatcaaaataaggagaaggagattgtcgcccccaaagacttgcaaggaaaactcagatacctcaatggtgagcgacccaagccagatactgctgatccacagtatgctgtttgggatgctgaaaactccatggtcatgacttggctggtaaactccatggaggaggacattagcagcaattacatgtgctattccacagccaaagagctatgggatagtgttacagaaatgtattctgaccttgggaataaatctcagatttatgaactcaccttgcaagccagagaaattcggcaaggaggtaataacgtgacaaaatacttccactctttgaagcgggtttggcaggaccttgatctcttcaacacttacaagtggaactcagcagaggatgccaaaaaccatcaacagacagtggaagaagaaactactgcccttaagagttcaactaaccaaaagaatttttcaaacctctggtgtgaccactgcaacaaaccacgtcatacccgaaaaacttgctggaaaattaatgggagaccagctcatctaaagagcaacaaatcaggtcctaaagttcacagacccttccctacagctcatgaggcagaaaagacttctttgagaaaggaacaagttgaggaactcataaggttgttaaattctaaatttttatctggtacccctagtggttctgtggcacaaacagggaaaagggatattaccttatctaaaaacattgacttaaaaaatgttttacatgaccggacttcggggaagatgattggcagtgctaagatgatggatggactttactactttgagaatactttcaaaaataaagaagctcggggtctaagtggtatgagttccgtacctagtggttctgtggcacaaacaggaaaaagggatattaccttatctaaaaacattgacttaaaaaatgttttacatgtacctaaacttacctataaccttctctctgttagcaaaatctgcactgattcccattgcagtgtgaaattttttgacactcattgtgtttttcaggaccgaacttcgaggaagatgattggcagtgctaagatgatggatggactttactactttgagaatactttcgaaaataaagaagctcggggtctaagtggtatgagttccgtacctgttagggaccaaataatgctctggcataagcgactagggcacccaagttttcaatatcttaggcatttgtttccaaacttattcaaaaatgttgattgttcttctcttgaatgtgaaagttgtgttcttgctaaaaatcaaagagctccttattactctcaaccttatcatgcatctagacctttctatttaatccatagtgatgtttggggtccttcaaaaattacaactcaatttgaaaaaaggtggtttgtaacattcattgatgatcacacccgattatgttgggtctaccttatgcatgaaaaatctgaagttcctaatatatttaaacttttctcacaaatgatagaaactcaatttgacacaaaaatctccattttgaggagtgacaatggaactgaatattttaataaaaatctcaatgagtttctaaaaaataaaggcattcagcatcaatcgacatgtctaaatactcgtcaacaaaatggcactgctgagagaaaaaataaacatctccttgaagtagcccgtgccatcatgtttgagagtaatgttccaaaatatttgtggggggatgctgtcctaacagcaacctatcttataaatagaatgcccactcgtgtgttaaattaccgcacacctttggacactttcaaaacaatttttccagcatgtcgattacatactgaaatgcctttaaaagtgtttggttgtactgtttttatgcatacaccctccatatctcggtctaaactggacccaagggcagaaaagtacatctttgttggatattctccaaaccacaagggatacagagtatttaatcctattacaaaaaagctttgtgttagcatggatgttacctttctagaacatcaacctttttttcaaaaaaattcccttcagggggagaatgataatgtgagtgaagacaattttttacatttgcatgaaccattgcctatccctgttgtgcatactgaaaatacagattttattgatcaaacaaatgaaaacaagttacacaacaaggaagaccatgtggaaacaagtcctgaattttccaaaggaaatcctatgccagacttaggtggagcccaagcagggaaagaaataccacagtcaaataaagagtgtcatgtttatactcggaaatatcctaaaaggatcaaagagcagcccatcatctcagcaccaaaccaagcagaacatccggaggaaggccaaggagaaataccaagagaaagtcgaggtaacactgaaattcccgcttctactattgaactgcccatagctattaagaaaggaaccagatcctgcactcaaaactcaaaaaaggctaccacaaaccatcccatttcccaatatgtttcttataaaaatctttcccagaatcacagagcctttacctctaaaataacaaatctgtttgtgcctagaaacattgaggaagcactagatgatcccaattggaatttagcagtcttagaagagttgaatgcattaaaaaagactgggacttgggaacttgttgacctaccacgtgacaaaaaacaggtgggctgtaagtgggtctttaccattaagtgcaaggctgatgggagtgtagaaaggtacaaggcgagattagtagcaaagggattcacccaaacttacggagtagactatcaggagacttttgctccagtcgctaaacttaactctgttcgaattcttctatcccttgctgcaaattgcaactggcctttacatcaattggatgtaaagaatgctttcttgaatggagaactagaggaagaagtgtttatgagccttcccctgggatttgaagaacttggaagaaataaggtgtgtagactaaagaagtcattatatgggctgaaacaatctccaagagcatggtttgaaaggtttggaacagtggtaaaagggcttggatatatccaaagccaagctgatcacacattgttctataaacattcaacaaataataagattgctatcttgattgtttatgttgatgatattattctgacaggtgatgatagtttggaactcaaaaatttgagggagaaacttgctaaagcttttgatatcaaggaacttggcccattgaaatacttccttggaattgaatttgcaagatcaaaggaaggattacttggatgcaaggctgcagaaacacccatggagcccaacttaaaactacaatcagctgaaacagaaaatatggtggacaaaggaagataccagcgactagtggggaggctaatatatctatctcacacgcgtccagacatagcctttgctgtaagcatggtaagtcagtttatgcatgcaccaggacatgaacacttggaggcagctttcagaatcctaagatatttgaagggatcacctggaaggggactttataaaaaccatggacatcttcagagtgttgtagcaaggagtagtgcagaagctgaatttagagcacttgctcatggaatttgtgaaacattatgggtgaaaaaacttctacaagaattaaaggttcatagttctcctccaataaaactatattgtgataacaagtcagcaatatctattgcacataacccagtcctacatgataggaccaagcatatcgaagttgataaacacttcatcaaagagaagatagaaagggggcagatctgtattacatatattcccactacagaacaatcagcagacatcttaaccaaaggattacccaaaaaatcatttgacaacatcactagcaagctgtctatggaggatatctttaagccagcttga

SEQ ID NO: 113623 - DNA, 294 bp, Glycine max
  Peptide Sequence Number=SeqID_230401
atgattccctctttcactcctggtctcaaattggaaaaggaagggaattgtaggatacctatgcatcactgtaccttacctggccaacagtgttggcctgataagaaaaattatagagaagtggaggaaacctcccatcttggtagccaaaagaattttgaggagtttcctgttgcaacctaccttcaatctaataacggtaagatgcattcagcattcatttttagagatccgattctcgtcgttgaagtcgagttggatgctagtacaaaggatctttcatggcctctctaa

SEQ ID NO: 113624 - DNA, 384 bp, Glycine max
  Peptide Sequence Number=SeqID_230402
atggagataaagagttggtggagcgcgcgggtgcaacttcgtcaagtgagatctgagatcaagagtttcttagcaacacagaacagagcagaagaagcaacacagagccctctctctctttctctctctctctccctctctctctctctctctatctgggaagaacaaagcagaagaagcaacacagaacagaaccaccaaacccactcaaaaccacccatgcttcgaagtagtggcgcaaaaaaccgctccgcaacccgctccgccacgatagcggccgctccagccgcgacccgaaaccgccccgctacacacgtgtacgtcgcggatgggtgccgctccgctctgccccgccactatagcggccgctacggccgctattga

SEQ ID NO: 113625 - DNA, 222 bp, Glycine max
  Peptide Sequence Number=SeqID_230403
atgccgatgcggagggagaacaccaccctcaaaatgcctgggctactcaacaccaacgaccaccacgatcgcaaaacacaatctcccgacgcggaggaagaagacgacgctcacgacgggaacgcgacgcagaggaccgaggttaagcacaactctatcctcccattggcggcactcaagcatatttccatgttttggaccacaggaaaaaggcattcttga

SEQ ID NO: 113626 - DNA, 825 bp, Glycine max
  Peptide Sequence Number=SeqID_230404
atggtaacaactacaataggtggtgtctccaaatcagagtcatctttcgtttcaacaatgtcacaaaaattgtgtaagacggtgttcaagaacgggatgcagataacatgggacattcttgataagtcctatatgggtgcttacaaattaaagaagatgttgacccttacaaatcaaatgaagacttgtggtgagaagttggaagatttgacgatcattgacgagattttgagaatcttattaagtccaaggtttgatcacatagtgggaaagaaattgccaagaaaggaagatgaagctcaatcagcacatgatgagggttctgattccaataatgtaatgctaatgacgactactaatttagaaggcgataattctaatctttggtacttggacacgtgttattccaatctcaagactggccaaagaaagtggtttgtgaatcttgatgaaaagcaaaggaaaactgctcctttatcaaagaatagaaccttcgagatttggattcaaattatggagcatcagtgcttagccactgcaataagtgatgagagttgggcgcggcatcacaggattgtggctatgaaccttgaaaatgatcaagataaagaaagttcagtatcaactagaaaccatcctagaaagtctcaaatggagaggcatatgccacaaatgttgaatgacaattttgaaatttttcctgatgcaacaattactgtagaaggagacttagtaaaatttgctttgttctctgagacagagcttgtgagttttgagcaagctctacaagtctccaattgggtggctacaatggaagaagaatag

SEQ ID NO: 113627 - DNA, 552 bp, Glycine max
  Peptide Sequence Number=SeqID_230405
atggattatataactatagggggtggtggtgacaacaacaatggtggagaggatggtggtggtagttgtgttgatgacaatagtggtggtggttgcactagcaatgataatggtgacgacaatggtggtgatggtggtggttgtggtgacgacaatgatagtggtggtaatggtggttgtagcagcaacaatggtgatccgctactggtggtgatagcaatggtaatgatggtggttgcagtagtgacaatggtgacaataatggcaatggtggttacgatgacaataatgacggtgagtgatggcaacaaagctggtggtggttgttatgacggtaatggtgatgaaggtggtggtggttgttatggcagtgatggtggttatggtgacaatggtagagtggtggtggtaatagtgatgacaagggcaatggtagcggtagttgctgcagcggaaattacggtgagtggtggcaacgacgacgatggtggtggtggttgtgatagttacatggaagtgtttctaacacttgtagaggaaaaaaaaatatga

SEQ ID NO: 113628 - DNA, 396 bp, Glycine max
  Peptide Sequence Number=SeqID_230406
atgatgggtgtcttctctggatttcctcttcttttccttcttcctttttgctttgcttccttagcttttggagccactttgccagaagacgaagtgcaagctctgagagacatagcacacacaattgggaagaaaaattggaactacagcgtagatccatgtactggaaagagtaattggaattcttccgaaaaaaatgttgtcacatgcaattgttcatttgttaatcacacttgccatgttgtaagcatcattttaaaagaacaaaatctttcgggtattatctcagcggatctggtcagattaccctatctccaacaaattgacttcactcggaactaccttaatggtacaattcctaagcaattgggaaccttaaatctcgtcaacatgtaa

SEQ ID NO: 113629 - DNA, 585 bp, Glycine max
  Peptide Sequence Number=SeqID_230407
atgtggaggatgagtgtttcaacaaattggtgtgtagagctttgttcgtttcctggaaccagaagtttcttcccaaagatgatttctcacaatgaaaatttccctgcttctttatccatcctcaatgatggtgttcaagaacggggtagaaacccattgatgggcaaagggaaacttatcatgattcaaacaagaaatatgatgcagataacatgggacattcttgataagtccaatatgggtgcttacaaattaaagaagggaaagaaattgccaagaaaggaagatgaagctcaatcagcacatgatgagggttctgattccgataatgtaatgctaatgacaactactaatttagaaggcgataattctaatctttggtacttggacacgtgttattccaatcacaagactggccaaagaaagtggtttgtgaatcttgatgaaaagaaggtattgacaaggtggtggttcaaagaagagatggacaatgatccttcatcaataatgtgctctatgttcccaacacgaagaacaatctgcttagtcttgggaagctatatatttgagaaaggctatatgtga

SEQ ID NO: 113630 - DNA, 384 bp, Glycine max
  Peptide Sequence Number=SeqID_230408
atggccaaaagcatgatgaaaagaaaggaaatgtctcattatttttggggtgaggcagtatctattgcttcctatatcttgaaaagaagtccaataaggaggcaaaaggaaaccccacctgaagaagcttggactgtggctatgaaccttgaagatgatcaagatagagaaagttcagtatcaactagaaaccatcctggaaagtctcaaatggaaaggcatatgccacaaatgttgaatgacgattttgaaatgtttcctcatgcaacaattactgtagaaggagacttagtaaaagttgctttgttctctgagacagagcttgtgagttttgagcaagctctacaagtctccaattgggtggctacaatggaagaagagtag

SEQ ID NO: 113631 - DNA, 315 bp, Glycine max
  Peptide Sequence Number=SeqID_230409
atgcccaaatctgcttcaccctctctcagtaaggccgaagttgttgtcattgccaaggcaaaacaacgctctcttgctaatgctaagagaagagcaagaatagagaaggccatgaaaataaaggcagaagtagaagtagcaaagaaggttgttattcttgaaggacatgcttcagaagagattcctaaagaagttataatagaatctctaaagaccatgataggagaagaggagctcaaaaaggcaactgctagtgatcaggtgctagaggaagtggtgcttgatgctatcattgttgtgtttgaagacgaatag

SEQ ID NO: 113632 - DNA, 258 bp, Glycine max
  Peptide Sequence Number=SeqID_230410
atgaataatgacacatacctcgaagtggctgcaatggcttccttgacaatacatgttacatgttttggaactgatgcagataaagccactaataggccattaacacaggcatataggagaaggaaaaaaggaaaggggcagttaaatcaggctaagaggggcatggaacagagtctggtagaggagagagaggggaaaataacagaaaggacaggtggcatgagaggagtgaagaaaggggattctgctactgattaa

SEQ ID NO: 113633 - DNA, 396 bp, Glycine max
  Peptide Sequence Number=SeqID_230411
atgatgggtgtcttctctggatttcctcttcttttccttcttcctttttgctttgcttccttagcttttggagccactttgccagaagacgaagtgcaagctctgagagacatagcacacacaattgggaagaaaaattggaactacagcgtagatccatgtactggaaagagtaattggaattcttccgaaaagaatgtcgtcacatgcaattgttcatttgttaatcacacttgccatgttgtaagcatcatcttaaaagaacaaaatctttcgggtattatctcaacggatctggtcagattatcctatctccaacaaattgacttcactcggaactaccttaatggtacaattcctaggcaattgggaaccttaaatctcgtcaacatgtaa

SEQ ID NO: 113634 - DNA, 481 bp, Glycine max
  Peptide Sequence Number=SeqID_230412
ggttcttaaaaaggtgacggacaaactggtgagcttccagagaaggttcctatggggtggagattatgagcaaaagaaaatagcctggatcaaatgggagacgatatgccttccaaaagaagatggaggtttgggaatcaaagatatcaactcttccaatctatcactgctggttagtggtttaacatccgcaacatggggctataatgaagaacacaacattatggaagagaatcaggatggagctttcgaggagctatggaaactccaggttccaactaaaattgttgcatttgcatggaggctactcaaagataggctaccaaccaggctaaacctgcgaaggcgacaaatagagcaagataattcaggtatggtggaaatcgttgtcatggatgaatatggtgggtgttttcccacatcacccaaggcaacattttctccaacacattcatggagtgacagagggaatgagggctaa

SEQ ID NO: 113635 - DNA, 156 bp, Glycine max
  Peptide Sequence Number=SeqID_230413
atgaatagaaaattggagttcaatcagttatctggaagtcttcctctagagcttgggaatcttgcccagattgaaaaactgcatctaacctccaacaatttcactggagagttacctgcaacattggctaggctcacaacattgaaggaactgtaa

SEQ ID NO: 113636 - DNA, 144 bp, Glycine max
  Peptide Sequence Number=SeqID_230414
atgtggatgatacacttttttgaggccactttgaacaatgtcttggttatcaaaagcatgatgagatgctttgagttgatgtttgacctaaaggaatccctattgatgctaaccctaggagagaggaaacatggaagcccataa

SEQ ID NO: 113637 - DNA, 132 bp, Glycine max
  Peptide Sequence Number=SeqID_230415
atgacgggtacaaaggtgttgtatttaggacaacaaggaattcgaagtgagggtcagcctaaggaactccccaaatggttaggatggggtctatatggaccacttatatggtgtcgaaattccatggagtaa

SEQ ID NO: 113638 - DNA, 2145 bp, Glycine max
  Peptide Sequence Number=SeqID_230416
atgggtttttttggcacagaagcagtacaggaagtgagggaccatcaccaggaaacagctctcattgaggaacagattgcaaatgaatcctctgccaagcaagtagtaggtgaaactagtgtccaaattaactgttctgatggagatggattaactgaacttgagaagctattaaagcagaagactttcaccagatcagagatagagcatttgacagaacttatgcgttcaagaactgtgggttcatctgttgtggaagaagggacgagcacagaagtggttccatcagatccaattttgcctcgtgaacaaaaggaagaatatcccaaaactccagatccagaaaatgcgattgaaaaccagcttgtttcaaccccatacgttactaaggctatctccactgtttctgttgacgatgttgcttcccctgcggagcttgccaaggcttacatgggtagcaggccttcaaagttgtccccttcaatgttaggattgcgaagttctcccagggaggatccatttctactaaaaaatcagcatgttgctcagaaatcccctgttaagtcaattgtgccgaaggctactaaccttgctagggttcatgaaaatggttttgtgaccccaagatctcatggaagatcagccatatatagtatggctcgaacgccatatgcaagagtttatccaggctctatgtccaagggtgctggggttgctgttgaaggtgatccgtcatcttcagctcagcatgtgattgatcatgatatgctttctggatctaaacacggggtattaaaacgtagaagttctgtattagataatgatataggatcctttggtcctatacgccgaatccgtcacaagtctaatcttctatctactaaaagcttgaccttaccttattcgggaaatgctctagctatagataggagtggagttggcattgatgctgctcagcaaccttcatcttccatgcagaagcctaatctgttgggtgaagctaagcataggcatacaaaattgtctgcagaaaatgtagatgacatcatgcctcgtaccagtattcctcctttaccctcaaaatctagtgagatggcctcaaaaatactgatgcagcttgataagttggtttctcctaaagaaaaatctccaacaaagttgtcctcatccatgttacgaggacaggctcttcgaagtatggagacagtagattcatcaaaattccttgataatgtatgggataatggattggatggcacacatggaaatttgtctgctggtgctcaaaagttaaaatcaaagatagatgaaactgagagtggtcaatcgaaacttgttgctcctactgatgtattagttcctgttgatgcatatgctacagcccctaagaagcaagatatatctattttaaaatctggagattcctctggaacaaaatccaattctcatcctccacaaaagaagagggcattccatatgagtgcacctgagctgacagagctggattatttggagctggatgatgatgcccttcctaatggagctgtgtctcctttctctacttcggggaaagaaacaacagtctccactgctgtggctgataaaactatctctgctgttgaaacagctgtactggaaaagcccccaggttcatctgtgctaatgccatccaaaagttttacaatagatggtaaacctcaagttaggacagctgattggtccaaagttgaaaagaaggttgatgtaccaacctctataacttcatccgtctctgatcctatttttaagccaattacggcagcttctaacacaagtttaggctttaaccaatctactacaccaaatggatcagttgctaatcctcccctatttaactttgggaataaagttgttccatcgatggagctgacggctgctgatgctccaccacaggactctaccaagtcaggttcactatttggtttggagaaggttccattgtcaaaagagccagggactgatgctccttttgttaattctgggttcaacaaaaatgttggcaatgtttcacaagtaccagttactttctcttcatctgttggtgaatctgctgtgtttaaatttggctcttcttctgactcaaagccgataagctcaatcagataa

SEQ ID NO: 113639 - DNA, 180 bp, Glycine max
  Peptide Sequence Number=SeqID_230417
atggaagtcaagagcatgacacatctcgtaaagcctttttcagaacaggtagctgagggaccagtgaaacctgtagatatgttggatcctgacatcgatatgcggtacctaatgacattgatcattccgaagcttttcctgaagtcgttgcaagtgtcgcgggatgctagcgtgtttggg

SEQ ID NO: 113640 - DNA, 478 bp, Glycine max
  Peptide Sequence Number=SeqID_230418
ttgggcaagggttgctgatttggtattggaaattaaaagggaactgttggattttatgtcgtttggagtgggaagcatggatgaccattggattgttcaatgtccgctgaacaataagagtgagagaagtgcttgtgttatacgcttttggattttagatggtttcgctgcagaaggatttgtttctactggtaaccatggccaaaggggcgttagtaaaagcgacgagtctagtgggaatgtcacagtgtcatttttcaaatcgatgggggagaagagtgatagggaggatgattccgacaaggagcagataagtaagggtggggatgttagggatatgaggaaagttggttgggtctccttaactagtcgtcgtgggaagggattattgcaaccttttcatgggagttttaagggctataaggataagctttttatagtgaaggatggaaaagggttgtcctcttttgtttactga

SEQ ID NO: 113641 - DNA, 467 bp, Glycine max
  Peptide Sequence Number=SeqID_230419
gtgttgttgcttcggtgatcaacgatgcaaggttaagaaaactgagtagaagaaaggagaaggtcactacctttaatgcaggtgctactgtgaaacaacattcaataattgatttttccctttcgcgtgttgtggaggaaaggaataagaggaggaaacataacgactctattgatcgtgaggtgaattcaaggtctaagctacatcttttgcaaactcaattttctttccctattatagatggtgatgtaagttggcatgaggcttttgcttttgaggaatttgaaggtgaggagggtgtgcgctctatatggagtaagactttccctattcgtgagatcttagaccaaaattttgtgggggttagtgatttggctaaactagataaggttggatttagtgatacctataaagccttgcaacatattggtgttggcgtgggggttatgtcttgtttgatggagtag

SEQ ID NO: 113642 - DNA, 894 bp, Glycine max
  Peptide Sequence Number=SeqID_230420
atggctgctctcacttctctctctttctcagcagtgactcattgctcagaaagaaaagtaaccctttcctccactcgttttctcgcttcctcttcagaactctttgggttccgaaccgatttctcgtaccactatgttggtgttcgagcttccaattctgcgtctaaaatggttgttcaatgcatgtcttctgccacagatgttcctcccactgtttctgagacaaagttaaatttcctcaaggcatataagcgaccaatccctagtatctacaatactgtgctgcaggagctaatagtgcagcaacatttaatgaaatacaagagatcataccgctatgaccctgtgtttgctcttggttttgtcactatatatgataaacttatggaagggtatcctagtgatgaagaccgagatgccatcttccaggcctacattaaggcattgaaggaagatccagaacaatacagaattgatgcacgaaagttggaagagtgggctcgagttcaaagtccaacttctcttgttgagttttcatccaaagaaggagaagctgagaggattttaaaggacattgcagaaagggctggggggaaaggggaattcagttatagtcgtttctttgcagttggactctttcgtctagttgagttggcaaatgccacggaaccaacaattttggacaagctttgtgcggctttgaacatcaacaaaagaagtgtcgatcgggacttggatgtgtatcgtatcctgctttcaaagttggttcaagcaaaagagctgctgaaggagtatattgacagggagaagaagaaaagggatgaaagggttgaaccacaaaaggctaatgaggccatcacaacatgtttgggacaacaattgcatggtctgtag

SEQ ID NO: 113643 - DNA, 183 bp, Glycine max
  Peptide Sequence Number=SeqID_230421
atggatgctcaagtctcatatgcatttcattctgaacgtaaaatgaatcctgaaaaattcaaaaatcagttggtcaatctgagtacttatgctaagcttggatgcacacaaggatggttttttgctcctctgttccttcctccttccagtaaatttgcaaaaccatctaatataggaggatga

SEQ ID NO: 113644 - DNA, 372 bp, Glycine max
  Peptide Sequence Number=SeqID_230422
atgcctgacatggccttgttttgcttgctccaaatggaaatggaactcgccttgctcagaatccgctttgagtttcacaaaggtgcagcagagtatacgttcatgaggattgatggggaaccttggaaccaacccctcccagttgacaatgatacagttttggtggaaatttctctccatggccaggttaacatgctcgccactcatgattccaagtccaaaagtgtgaatgatccatcatcaccacaccataatgatgttgaggaagatgatagtgatgacgaagaagctaaagcagatgaattccggaagtttggcacggcagatacatttaaaatcccagacgaggtggaccatgctcatcttagttag

SEQ ID NO: 113645 - DNA, 267 bp, Glycine max
  Peptide Sequence Number=SeqID_230423
atggtcaaaggatggaaaaagaagaaggttaaagcaactggtgtctcgctaagcgaggcatatgcgcttagtgaggatcatccgctaagcgaggcacttagctcgcttagcgagttgagaggatctggaagagaatctgccattcatgcacgtgcccagtgtgccatcagctcgcttagcgagtcatttgtctcttctggcacccagcgcacccagctcgctaagccaaaagtcactaacttgcgcttaacgagaaaatggcgctaa

SEQ ID NO: 113646 - DNA, 279 bp, Glycine max
  Peptide Sequence Number=SeqID_230424
atgggccttcttgatcacccattgaccccatccagggtgtggggctggcatgggaagattaattcaaactaccgctacctatgggtgctcacctatgaagcacaaggacacctggtagttgccctccccccatctctagtactgcacgaggacggggacgacccagggacggcgataatttcttgggaatggttggcccaagacgggggatggcgatgggtatatagcgagggacgtatttgggggacgatggtgggccaacatgcacatttcccatag

SEQ ID NO: 113647 - DNA, 198 bp, Glycine max
  Peptide Sequence Number=SeqID_230425
atgggtctcgatctcttgaatgtgccagctacgatgattctgaggcaagaaagcaaagtcaaaaattgtgttgcacaagacagtgatgacgatgaactgtgctacttggtgtttctagcagattgtcgtgatagtactcctgaactttcatttccttcaaggtactttgggaattgtggaaatgatcaagaggagtga

SEQ ID NO: 113648 - DNA, 195 bp, Glycine max
  Peptide Sequence Number=SeqID_230426
atgtttaaccaaactttgacaccaacaaagacatcaaggttagaggaactggagatgactctgaagaggataccaaaattgtcacatctaaccctgatgggaggtccaggcccgtgcagtagtgcaatgcaagggcaacacgtgagagccccagtagcaagctactataatggaccctccccctcaaaaaattaa

SEQ ID NO: 113649 - DNA, 1410 bp, Glycine max
  Peptide Sequence Number=SeqID_230427
atggctcaagtgaagatcttagagcaaagtgaagttggtccaccaccatgctcacttccctcaaccacccttcccctcactttcttcgatattccatggttctactgccaccccatccaacgcatcttcttctatgactttccccaccccacacaccactttctccaaacagcacttcccattctcaaacactctctttccctaaccctccaacacttcttccccttctcctccaatctcatcgttcctccacagcaaccccatctctctcacatacgctaccttgatggagactctctctccttcaccgttgcagagtccaccgcagacttcaccctcctcacatcagattcaccacaagacgttccaaattggcaccctcttgttcccgcgtttcctaccccacgtgttgaccaagatggcgcacgtgtgttccctcttatggccattcaggttacaattttcccaaagtctggcttcaccatatgtctcaccttcaaccaccttgccagcgacggcaagtcacttcaccatttcatcaagttctgggcctctctttgcaaagcaaaaggaaacatggcttcccttcaaacctctttgtctcttccttctcatgagagggacaaagttaaagatccaaaggggcttaagctcatttactttcaagaacttgaacatcctgagtccagaaacatggagtttgcggggctcgtgagagaagtctcctctaacaaggttcgcttcacagttgcattgagtcgtgaacaagttgagaaatttaagaaatgggtctctcttaaatgcgccagctacacttctgatgagacattgcacatatcaacctttgtggtgacatgctccttaatttgggtttgcatgattaggttagaggagagcaaaggcaattatgttgcacaagattatgctgaattctgccacttggtgtttcttgcagattgtcgtggtcgtcctgagttttcattaccttcaacgtactttgggaattgtctaaccacttgttttgtggctatgaagaggagtgagatagtgggagaaaatgggatcattggggtggcaaaggctattgaaaggcaaattagagatttgaagagtgatgctttgagaaatgctgaaaggttgatgtcatattatagagagttagggaaaccaggaaaatctgtgttggtagttgcggggtcaccaaaattgggtgtgtatcatactgattttggatggggtaagcctaagaaatctgaagcagcgcatattgaatcgtcaggatcaatttctctttctgattgtagagatgaaaacggaggaattgaggttggattggcacttgaaaggattcagacgaataattttttcaacatcttagaagagcaactcaataatattaataaattctaa

SEQ ID NO: 113650 - DNA, 975 bp, Glycine max
  Peptide Sequence Number=SeqID_230428
atgggaagagcaccttgttgtgacaagaatggcctcaaaaaaggtccatggacttccgaggaggatctcttgctcaccaactacattcaaactcatggacctggaaattggagaaccatccccaagaatgccggtctacaaagatgtggcaagagttgtcgccttagatggactaattaccttagacccgatatcaagagaggaaggttctcatttgaagaagaggaggccatcattcagcttcacagtgtcttgggaaacaagtggtcggctatagcagctaggttgccggggagaaccgacaacgaaataaagaactattggaacacgcacgttaggaagaggttgcttcgaacgggaatagacccagttacacacgctccacgcctcgatcttcttgacatctcctcgattctaaggtcagcaattggcaacgttaatccatcgattctgaatctgcaaggcctattgggtgcccaagcgttgatgaacccagagtttttgaagctcgctgccactgccacacttttatctctaaagaataatgagaacccatcaaacttagtttcacaagtacaacaacaattcaatagtgctgggaattgtctagtacaaaaccaagttgctgctccaaatgatccgtttcagacaccaactcacgtgaacaatggcttatcatcaagttcccccgagaattcaattctttcccatcttggggagaataataattaccagctgaatgctcaacaaattaaccaagttgatttgcttctggaccatgaattggaacattacttaaactgtgtaaaccaaaacattggctatgaatcagttacacctttgtcgaccccaaccccattgaattcatcatccacgtatgtgaatagcagcacggaggaagagagggacacctattgcagcgatatattcaagttagaaattccagagagtcttgacattagtgatttcttgtaa

SEQ ID NO: 113651 - DNA, 186 bp, Glycine max
  Peptide Sequence Number=SeqID_230429
atggctcatggatatcatcgttttggacacggagcctactatggtcatggaaagttcaagcatgggaaatatggcaagcgttggaagcatggcaggacaacttctaagtctattgaagcatacgctccggatgtgggactaaagtttgtgtttttatttgccatttaccttgtccttcttgtgtga

SEQ ID NO: 113652 - DNA, 1425 bp, Glycine max
  Peptide Sequence Number=SeqID_230430
atggtggttcttaaacaacacaagcttgttgaaaattttcaggttgttccagcagtgagaacaacaacctctcttcccctcacattccttgatttgcctttagcaggtcctatttatgtgagacgccaattcttctatcacttccccaattccacactccatttctgtgaaaccatacttccttgtctcaaaacctctctctctcaaacccttcaacacttcttccctctcgctggaaatctcatctgtccaccaacaccccacaaacccttcattcgctccaccgatgatgactctgtcaccttaaccatcatcgagtctgaagcagatttcaaccatctctcttccaaccaccccaaaagcatcaaagacttggatcacttggttccaaagttaacatgcacaaacacacatgatggcacgtttgtttttcccttggtggcattgcaagccacggttttccccaaccatggcctttgcatcgcgatcacgtattgccacgtgatggatgatagttgttgcagccatttcatgaagtcttggtcctccatttgtcgaagtggtggagttgactttactcttgtggagaagtcaccaccgtgctttgatagggaagtattgaaggaccccaaaggactcgaagccatcttcttgagatattatttagaaaataggtcaacttggaaggacaaactcattggtaaaacttctgagattgctggtggaaatgaagattatttcaaagcaacgattgtttttggaagagatgacatcgaggggctgagaatatgggtgctgaatcagtggaagaacagtgacgaattcatcacgccacaatatctatcaaaattcgtggtgacatgtgcttttgtgtgggtttgtatggttaaaacaagatgcagaaatgatgctgaagatgatgtccaagaggattacttttttttcggtgcaaattgcagagatcgccttgagcatcctgtgccaaaaacttactttggaaactgcttaaccctatgttcagcaatgctcaagagaaaggacctcaagggagaagggggttttcttaatgcggtcaagctcattgaaaaggaagtaactgatttaaaaagtgatctctttaaagatgcagaaaattggagggaatcttttacgaagatgtttgtgttggaaactatcttgatggttacagggtcacccaagttcggtgtttatgagactgattttggatttggaaggcctaccaaagtggaaatggtacattccttcaagggtatgtctctagctgaaagtggagatgaagaaggaggacttgaggacaatgcaatcttggttcaagatcagagtccctcttataccacaaagtctgttgtgagttgtgactggttaaagattggtgatggtgagacaacgttcttccatgtataa

SEQ ID NO: 113653 - DNA, 630 bp, Glycine max
  Peptide Sequence Number=SeqID_230431
atgagcaacagaaaagacaagaatgatgatgagtctagtgagagaggtatattttcacatctaggatatccaagtgcaccacccccctaccctcctccacatggatacccaccatcaggctatccacctccaggagggtatcccccaacagcctatccgccgctgggaggatatccacattccggttactatccttcagaatatccaccagcatatccgcctccgggagggtatccacccactgcttatcctcattcaggatatcatccaccagcttatcctgccccacatggctatccacctgctgcacctccatatcctggagaccttagtacagcacccctcctaagtgcaatggaggtcactattctaggccataggccttcatggttacccattgaccccatccaggtaaggcgtggggctggcatgggaggattgttggcagggggtgttgctgctgctgccgctgcctatggtgctcaccatatggctcatggatatcatcgttttggacacggagcctactatggtcatggaaagttcaagcatgggaaatatggcaagcgttggaagcatggcaggtttggatttggcaagcataagcatggttggaaaaggtggaagtga

SEQ ID NO: 113654 - DNA, 777 bp, Glycine max
  Peptide Sequence Number=SeqID_230432
atgttacgattctcaccttttctcgctactccccctactccttcttccctctctttctcctccaactgccacgtgtcctcttccgctcaagcaacactacaacaacaacatgaacaacagccccttccgcaaagctcacagctggtggcattggaatatgctgacctcaacctctcttacaacttggatctgggtcacgtcaggataaggcagcatgttaatcccctaagctcttctttctcggttcctgcacaagtaccagactggaaccatgcctttgcagacccaacattgccgctcatggtggacattggatgtggtaacctgaatctcaatgataatttatttgatgcatttagtgtgtctgttaaggactggcacagatcatgcagtggcaggtttctaatgtggctggctaaaagaactcctaaagagagaaactttttgggattggaaatacgggaaaggatagtcaagcgtgctgagtcatgggcaaaggatctggctcttgataacatgtactatcctaaaactacatatatagatggtggaacttttcttgtttgcaaacgcgacaatttctttcaagcagttggtagaatcatatcccgggcccttggtcttagtttcagtattggatgtcatctacatttttatagtactaagctggtaggccccattgagcaacctaaggctgttcaacaggagggggagtgctttctggggcaattgagacccctatggagcattgcaaggcaagaagggcttgttgactaa

SEQ ID NO: 113655 - DNA, 411 bp, Glycine max
  Peptide Sequence Number=SeqID_230433
atggcggttaggcaaagagccgtgtctgcacttccaactcttctacgcactctccgcaaagaacctttgaagcctcgcaaccacgcacacgtcaatgccttgccctctcttcgacgcgctttctctttgtacgatcagatcaacctcatcgatcaagtccccgaagaccagctccgatttcaagggtataatgatacggggtttactgtaaatggggttgaatacgaaggaagcttgctttgtgttggaaatttgctcatgtcttggaaacctaagaagttttcagagatcactgccgatagtgtttgtcctgaaactgattctttatatctaaagttgaaggagtgcagtggtaactgtgctgccttagtaatccaagttcaaagtttcgaatttacttttgaagcttga

SEQ ID NO: 113656 - DNA, 429 bp, Glycine max
  Peptide Sequence Number=SeqID_230434
atgtcagttgattcaaagaggaacatttcaggttcttcagctggcggtactgttgccaaggatgccgttggaaatgatgtaattgccgagaattggctcaaggcacatggacctggtgaccgaacccttacacaaggattgaagggagatcctacctatcttgttgtggagaaagacagaacccttgcaacatttgcaattaatgccgtgtgcactcatcttggatgtgtcgtgccatggaatcaagcggagaacaagttcatctgcccttgccatggatctcagtacaatgaccaaggaagagttgtgagaggacctgctccattgtctctggcattagcacattgtgatatagatgatgggaaggtcgtgtttgttccttgggttgaaacagatttcagaacaggtgatgctccatggtgggcttag

SEQ ID NO: 113657 - DNA, 258 bp, Glycine max
  Peptide Sequence Number=SeqID_230435
atgacatgctctcccatgttttggcatgtgaacaccttgtcaatcttccaaatagttcgccctattccagagattttgattattggctgtggaaagaacattcaacatgtagatcctgaacttagacggtttattcggtctactggcattaagctagaagctgttgattcgagaaacgcagcatcaacttacaacatactgaatgaagaaggtcgaattgtggctgctgcacttcttccacacggagtttcttcatga

SEQ ID NO: 113658 - DNA, 4503 bp, Glycine max
  Peptide Sequence Number=SeqID_230436
atgtatctttatgacattgacatcgatgattgtttgactttgacagagctcaaaagtccgttttggacttcatggcagcccttcgaatcaccatgcttgttggagcatgtaactttaccagtggaactggggttctttgtgatcttgttagtccaactcctaagaaaatacataaaccttatcagcaagcaaaacaaggtcactgatagtgccaaagagattgtgcatccaactgcaatcaaatttggttttgcttacaaactcagctttgtttgcaccacgttgttgttggttgttcattcatcactgctatcactgattctcaatcatgagactcaatgcacctcgaaacttcaggccttcacatcagagatagttcaagtgctatcatgggcaattactcttgtagcaatatggaagacatcaaaatcaaacacctatttcccttgggttctgagggcttggtggctttgcaatttcattttgtgtatcataagcacagcccttcaagtccacttcagtgtcaccaacaatggtcaaattggccttagagaatgtgcagatttccttggttttcttgcttcaacatgccttttggttatttccacaagagggaagacaggcacagtgttgcttgccacaaatggtgcagcatctgaaccacttctaggagagaaagctgagaaagaaaaacattcagagtgtcaaaaggaatctccatatggaaaagccactcttctccaactcataaacttctcatggctcaaccctttgtttgcagtagggtataagaaaccccttgagcagattgacattcctgatgttgacatcaatgactctgctgagtttctaacatgctcctttgatgagagccttaggcaagtcaaggagaaagatgccactgctaatccatctatctacaaggcaatctacttgtttgcaaggaagaaagcagcaatcaatgcattgtttgcagtggtaaatgcttcagcttcatatgtcggtccatacctgataactgactttgtggatttccttggagaaaagggatcacacggcttgaagagtggataccttctgtcactggcttttctgtgtgccaaaatggttgagaccatagctcagaggcagtggatttttggtgcaaggcaattaggccttcgcctcagagcagcgttgatatcgcatatatatcagaagggcctgcatctttcaagtagatcgcgccaaagccacaccggcggtgagataatgaactacatgagtgtggatgtgcagagaatcacagattttgtttggtatgtgaatgtgatatggatgctgcctattcaaatttctttagcagtgttcattttgcatacaaatctaggactaggttcattggctgcactagctgctacattggcagtgatgactttgaacattcctctaacaaagatacagaaaagataccaagccaagatcatggacgccaaggacaacagaatgaaggccacttcagaaatcctcagaaacatgaggactttgaaacttcaagcatgggacagacaattttctcaaaggatagaaggacttaggcaaatagagtacaattggttaacgaagtcactgaggcaagcagcatttactgccttcatcttttggggatcacctacattcatttctgtgataactttttgggcatgcatgttcatggggattgagctgacagcaggaagggtcctgtcggcatttgccacgttccgaatgttgcaggatcctatatttagcctgcctgatttgctcaatgtcattgctcaaggaaaagtttccgtcgataggatcgcttcattcctccgcgaggaagaaatccagcatgatgtcattgagaatgttgcaaaggacaaaacagaatttgacatagttattcagaaagggagattcagctgggatcccgagtcaaaaactccaaccattgatgaaatagagttgaatgttaagaggggaatgaaggtggcagtttgtggatctgtaggttctggaaagtctagtttgctatcaggaattttgggagaaatatataaacaatctgggacagtgaagatcagtggaacaaaggcttatgtgccacaatcagcatggatactgactggaaacataagggacaacattacctttggaaaagagtacaacggtgataagtatgagaagactattgaggcttgtgcattgaaaaaggactttgagctattctcatgtggtgacatgacagagattggagagagagggattaacatgagtgggggacagaagcaaaggattcagattgctagagcagtttaccaggatgctgacatatacctttttgatgaccctttcagtgctgttgatgctcacactggcactcacctctttaaggagtgccttatggggattctcaaagagaaaactataatttttgttacacaccaagttgagtttcttccagcagcagacctcattctggtgatgcaaaatggaaggatagcacaagctggaaaatttaaagatcttctaaagcaaaatataggatttgaagttttagttggtgctcacagcaaagctctagagtcaattattgtggctgaaaattcaagtagaacaaatttaaactcaatagctgaagaaggggaatctaacttcagctccaagtcaagtcatcaacatgaccacacacaacatgacacagtgcaagacaatcctccagagggcaaaggaaatgatggaaagttggtgcaagaagaggaaagagaaacaggaagcatagcaaaagaagtttactgggaatatttgaccactgtcaaaggggggattttggttcctctcattctcttggcacagtcttcattccaaatacttcagattgctagtaactattggatggcttgggtttgtcccacaagtagtgatgctaagcctatatttgacatgaatttcatactacttatttatatggccctctcagttgctggttcattttgtgttttgctccgagccatgatggtgttaaatgccggactttggacagcacaaacatttttcacaaagatgttgcatagcgtgctccgcgcccccatggcattttttgattctacaccaactggaagaatcttgaacagggcctccacagatcaaagtgtgctagacttggagatggcaaacaaaataggatggtgtgctttctcaataatacagattctaggaactattgcagtgatgtgtcaggtggcatggcaagtatttgtcatcttcattccagtaactggagtctgcatatggtatcaaagatattatacgccaacagcaagagaactggctcgccttgcacagatacaaattactccaattctccaccatttttcagaatctctagcaggagcagcatcaatacgagctttcgatcaagagggccgtttcatatacacaaatcttctccttgttgatggcttctcaaggccatggtttcataatgtgtctgcaatggaatggctttctttcaggttgaatttactttcaaattttgtttttgccttctcactggtcatgctagtgagcctccctgaaggaataatcaatccaagtattgccgggttggcagtaacatatgggatcaatctgaatgtgttgcaagcttcagttatatggaacatatgcaatgcagaaaacaagatgatatcagttgaaaggatccttcaatatacaaatataacaagtgaagcacctcttgtgattgaagacagcaggccgccaagcaactggccagatactggaacaatatgtttcaaaaatttgcagatacgttatgccgaacatctaccatctgtattgaaaaacatcacttgcacatttcctggaaggaagaaagttggtgttgtaggacgtaccggtagtggaaaatcaacactcatacaagccattttcaggattgttgaaccaagagaaggaagcattataattgacaatgtggacatatgcaagattggtctccatgacttaaggtcaaggcttagcattatcccacaagaccctgccttgtttgaaggcactgttagaggaaacctggatccactacagaaatactctgacattgaagtgtgggaggctctagataaatgtcagctaggtcacctagtaagggccaaggaagagaagctggattccccggtggttgaaaatggtgataactggagtgtgggccaaaggcaattattttgccttggaagagccttgctgaagagaagcagcatattagtactagatgaagcaacagcctcagtggattctgcaactgatggggtgatacagaacatcataagccaagagttcaaagataggactgttgtcacaatagctcatagaatccacacagttattgatagcgatttggttttggttctcagtgatggactgccaagagagtgcctaatgcaatcttatattacaggaagagttgctgagtatgatgaaccatcaaaagttacttga

SEQ ID NO: 113659 - DNA, 672 bp, Glycine max
  Peptide Sequence Number=SeqID_230437
atggcttccacggttgttgcggccgccgtgaggagtgacgtgccgcctcggcagccggtggatccttcggcgtcgtcctcccccgacgtcgctgatcggagcgattccttcaattcctctcccaaccacttctccgacactgaaattcagttacaaactccagacgtattgaagagtgaagagtatcgccaattgttccgtcttccactggaggaagtcctcattgaagattttaattgtgccctccaggaaaacctacttattcagggtcatatgtacctctttgtcaacttcatttgtttctactcaaacatatttggatatgagacaaagaaaataatcccattccctgaagtcacaagtgtaaggagggcaaagacggctgggctctttcccaatgccattgagattctagccggaaacaagaagtacttctttgcatccttcctatcccgtgatgaagctttcaggattattaatgagggatggtcgcgacatggcaatggagccatagcaattatggaacagaagtaccagaagtactacaaggaaacaaaggagataatatctcctaaaacacaagaacataaccagcaaataacaaaccaacaaagaacaacaatgcccaaccctacagatcacacactaggtaaaagacaaagacatagctga

SEQ ID NO: 113660 - DNA, 471 bp, Glycine max
  Peptide Sequence Number=SeqID_230438
atggctcttggaattggcgccaactcccaagatttgcaggaagagattatcagactgctcgaaaagctgggtaacaaatggtctgtgattgccactcatttaccgggaagaacagacaatgaaataaagaaccactggcacacccctctcagaaagcgttttggaaataacgcagttcactccaataaaaaagtgaaagccacaaaatcaaatagttctgagtccaagcaagataaggactcaattgagaacggtggtttctttcacagtagttctacaacaacttctaaagcctctgactctgtccctttgtccccacaattatcctcaagcgaattctcgtccacaacctcggattatacttacgccacagctgccactaaagaaaacttgttactcggattttctagatgcatgcttagagtcagaggacgtgaacgagaatatttggacagagtcatatgtagctaa

SEQ ID NO: 113661 - DNA, 315 bp, Glycine max
  Peptide Sequence Number=SeqID_230439
atgcaatgtgagaatcttgcaggaagagatttggtaccagtttcttggtcgaactgtctttggagggctacatgcaggtggtgcagagcaattaaattcgtggaaccccccagccctgcccaaagtcacatgaattccgagacagaagaaagagagttggcactagtcatagttatcgttaaagtggtcacacaaactaacaatgataagcctccaaactccataatacgaggtggtcttcatccttgtcttatttgctgcggtgagcttagtaaaaaacaaatgtccatgagatttatttacggctacagctag

SEQ ID NO: 113662 - DNA, 195 bp, Glycine max
  Peptide Sequence Number=SeqID_230440
atgcatggctctaaactcgtgggtggaggacgcatgaacgaaaacgcaattcatgggtctccgaaacagggtagagaatggagaattgcactaagcaatcactgcgcatggctccaaacttgtgggtggaggatgcatgaacgaaaatgcaattcatggggctccgaaaaaaggggtagagaatggagaattgca

SEQ ID NO: 113663 - DNA, 186 bp, Glycine max
  Peptide Sequence Number=SeqID_230441
atggcattaggggtcatggcagctcgcccaagggagctgttgcttcaacctgaagtaaccttgctcgcccatgaagtaaagataaggacactaattttgttcgagctatcttgctatttgaccgggcaactagcgaaaaccaaggaagtgaaaccgagaaaacatgaggacattgaagttctgtag

SEQ ID NO: 113664 - DNA, 234 bp, Glycine max
  Peptide Sequence Number=SeqID_230442
atgggactggcgggtttgctgctggtgactggactcgccactgctagtggcgataagcacatgcaaagggagcaaatcgccagtgagactcgcgatataggtgcaaggtgggaacctttcccaccaaccaaaaggcaagttgcaactgccattgacgagttaaggggcaactgtcattggcgatttagggccaagaaaatagccacgggaaatggcgattcaatgcctttataa

SEQ ID NO: 113665 - DNA, 276 bp, Glycine max
  Peptide Sequence Number=SeqID_230443
atggagagagtggtgttagagaactgcagtgagtacgctgtgataacaacagatgctgctgcagccatcacaaaccatgaaaattcggttctagaaggtgatgattatggcctttcctttttggacacatacacggagcctgatgtgtgtgcaaatttctggacagagccttatttaattgacaattcctatgtccctcctgagggtgatgtagtagaactttggagccacaatgatttgtacatgcacgaatattgcgagggtttcttctgctga

SEQ ID NO: 113666 - DNA, 219 bp, Glycine max
  Peptide Sequence Number=SeqID_230444
atggatattgatgccataaaaaaagaaaagggagcgatggatattgacgccatcagagtaatgaagaaatcgaaagatggcgaggcgaaacgtaaaaatgcgtcttctcatgaagaaaacgtgtggagtcgccaccaacgtttattcgaggaaaatgttagaaaaaccaaaatgatgaagggtgttgcgcttgctcctacgtatcctcaggtgcaatga

SEQ ID NO: 113667 - DNA, 270 bp, Glycine max
  Peptide Sequence Number=SeqID_230445
atggaggaagtatatgagtcttgggtagcccaattcacgtttcttctcccgtgcacatcttcttccttccaccattgtcgctcgttggtgaagctttttggtgcatttgttgcgtctggtcgagaaagcatgggagagacagaggtaggagacgaagaggttattcgcatacggaagaacgcaatccttcgtacggaagatcattcttccttatgttcgtatggaagaaggttgttccgtaagaacatatggaaatgttcttccgtatga

SEQ ID NO: 113668 - DNA, 669 bp, Glycine max
  Peptide Sequence Number=SeqID_230446
atggtccaaaaggctattgatgaaggaagactgaagttcgaggaaaaactaatgaaagtggacactgactcattttacattcaagctaactatgtagaacccatgcaaatcatgatgattggagcctcgatggggacatcaaaagtgagcttccctctgtctaaagaagaggttaaccaagccctagaggagtttgaaaaagaggaagagtcagtttgtctacttgcaggagaatcattggttggttttctattgaaaaaacaaaaagatgggaaagaggcctcacagtgtgtcttagaggaagtcctatgttcctcaagaaaatgttccaacaaaaagtggtttcgaccaaggaatgaaggatctagttcacgttttaaagagttcgaagagagtagtttggcacttcgaagggcgaaaccattgaagaggatgaggagagatgcgatattagcaatgcaacataaaaatgctacaagattgtcaatctttgatagaatcagtgaaggtccacctcttaggtttgagaactcattggaagcaatatgtggagttatttcgatcttaccaacaaaatatgcaaaagattatcagaacatgaatatcttgagtgattatgctagagaggattacttcaatgatccttctttaaagcccaaggctatttga

SEQ ID NO: 113669 - DNA, 273 bp, Glycine max
  Peptide Sequence Number=SeqID_230447
atggtgagaaccccttgttgcgacaaaaatggactgaagaaaggcccgtggacaccagaggaagataggaagttgatcgattatgtcactaagtatggacactggaattggcgcttactccccaagtttgcaggtcttgcaagatgtgggaagagttgcaggctgagatggctgaactatctaaggccagatgttaaaagagggaactttagtcatgaagaagaagaaaccattgtcagacttcacgaaaagttgggtaataggtatgtgtag

SEQ ID NO: 113670 - DNA, 701 bp, Glycine max
  Peptide Sequence Number=SeqID_230448
atgccctcagccagttcctgggccacccactaatcttggaggaggaccagcggtgcaaattctaccagaggagggaccaggcctccggctttgacgaggaggccatcgcccagctgttgtgcataccggggcaagactttgcccagaccgctgcggggaggcgggagtggattatgtgcaccagtatgactactctgactcagatatggatgacgctgctactcagcaacatcctgctcagcgaccataattttgacctccctctgcctaagtgtcagatggtgtacaccatcctgacatggatgactgttcacgtggaccagataattgctgacgccatttatttgtttgcaggggcggcgcccactaggcaccctttggacccgaagaggtccaacagggccctgggatttttggccttgatcatgggcctctgccagttctacggggtacttgtcatccccagcaaggtaatccggccgccgatcactcaagctttcatcgagaaatattgcacccctaggcaagcgaagggtgacgcacagcaggctgcggatgcaccaccacctcagcagcccgatccagttataccactgagtgtggagcagtatctacggcatatggttcgccagcagatggccaaccaccgcgggcaggtgcaattgcatgagtgcttctaccattttagcctcagccagtag

SEQ ID NO: 113671 - DNA, 192 bp, Glycine max
  Peptide Sequence Number=SeqID_230449
atgggtgccaagtaccttgaagcggtcaagcaaaggatgcatgccatcaacaatggtccctggacgaaattaggcaaagatccacaaaggatgtaccctccattgttctctttgaacctagtggatgtaccctccactagaactgatccacaagagatgtaccctctcttgttcttagtcaaacccaagtag

SEQ ID NO: 113672 - DNA, 212 bp, Glycine max
  Peptide Sequence Number=SeqID_230450
caaggagcagaatcgtctcaggccacgaccagaagtcaagacaagtcaatggcagaaatcgaccaaggtacatagggacggatgcaagtggggctagggtcacgaccgaccaatcgttgcctcttcccggcgctaaacaagcagagaatgtcgctgcagggcagcccagtatcctttgtgttcgcagtttcttttactattgtttgttttaa

SEQ ID NO: 113673 - DNA, 393 bp, Glycine max
  misc_feature (54)..(54): n is a, c, g, or t
  Peptide Sequence Number=SeqID_230451
ggtccagcggctggaagagcaccgcacgtcgcgtggtgtccggtgcgcccccgncggcccttgaaaatccggaggaccgagtgcctcccacgcccggtcgtactcataaccgcatcaggtctccaaggtgaacagcctctggtcgatggaacaattcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactgtgctctgaatgtcaaagtgaagaaattcaaccaagcgcgggtaaacggcgggagtaactatgactctcttaaggtagccaaatgcctcgtcatctaa

SEQ ID NO: 113674 - DNA, 267 bp, Glycine max
  Peptide Sequence Number=SeqID_230452
atggcccttttcaggtcttggaaaggatcaacaacaattcttataggctcgacctcacagaggagtgtagctgattcagatgatgaggggtctacagatttgaggacaaatcatcttcaagagagaggggatgatgcaatcctcccaaggaggggacccatcactagagctatggctagaagactccaagaatattggggtagagatgcaagagaagaccctagggttctcatgcgtcttagggtagattttgggctcataggctaa

SEQ ID NO: 113675 - DNA, 162 bp, Glycine max
  Peptide Sequence Number=SeqID_230453
atgaatggccttcgtaaattttcagagaggggacgtttatttgccaagaaagatgtggcattgattgagttaggtcctggtggcctcttcttcactggagatgagagtggtttgctgatggtatggaaatggttggaggtacccaaggtggcatcctcttga

SEQ ID NO: 113676 - DNA, 315 bp, Glycine max
  Peptide Sequence Number=SeqID_230454
atgtcttttccggttttttcgatgttttcctcaaataaatgttggtggcgactccgcgcgtattcctttcttggaagaagcatcccacgagtcacgcgtcgccctcccgccgaagggcagattcctctaccttttctttctagatccatgcctacaaagaaagtggagcttgattctaatcttcttgacactttcatgatggtggaagtcaacattcccctcttggatgtcatcaaagagattccaaaatatgcaaagttcttgaaggatttgtacactcataagaggaagctgaagggaaatgaggatgagtag

SEQ ID NO: 113677 - DNA, 266 bp, Glycine max
  Peptide Sequence Number=SeqID_230455
agattcaaaggactaaccgcttgagaattctttgtcccaacacattggagggtacatcctttgtggtacaagtagaggagagggtacatctcttgtcgatcaaagtggaaggtccatccacttgggttttcaaagagaacaagggtggggacatcccttttggatctttggcttgtaaaggatttttcaaggttgaaagaaatctcaagaaccgcaagttgcttggggactggatgcaggcacgggctgttgtggaaccagtataa

SEQ ID NO: 113678 - DNA, 681 bp, Glycine max
  Peptide Sequence Number=SeqID_230456
atgaccacggcgccccgtgcgcccggcctcctcgtcctcgcgacaaacacaaaccccggcgcttcgtgcgccaaggaactcaaatctgttaagtgcgactcccgggggcccggagacggtaatcccgtgaaccatcgagtctttgaacgcaagttgcgcccgaagccattaggccgaggggcacgcctgcctgggtgtcacacatcgtttccccaacgcaaacatgtaacaatgttgctgcgcggggtgtatgctgacctcccgcgagcacccgcctcgtggttggttgaaatctgggttcatggccgacttcgccgtgataaaatggtggatgagccacgctcgagaccaatcacgtgcgagccggtcagttctggacccatcgacgaccctttgcgtgcacgcacgctcccaacgagacctcagtctggagaagcgtcctcagtggcggaccgggcccaagtcccctggaagggggcgccagagagggtgagagccccgtcgtgcccggaccctgtcgcaccacgaggcgctgtcggcgagtcgggttgtttgggaatgcagccccaatcgggcggtaaattccgtccaaggctaaatactggcgagagaccgatagcgaacaagtaccgcgagggaaagatgaaaaggactttgaaaagagagtcaaagagtgcttga

SEQ ID NO: 113679 - DNA, 375 bp, Glycine max
  Peptide Sequence Number=SeqID_230457
atgcagagactaacgttgtcatttgcacctttgtcatccatagacggcgggtccgatgacatgcgggggcggaaatacccaagtggttatccgtataaacattcttttgctatctctaagactcagcgcatgataacatggtcaaacgagcccgttgacgcacagagactaacattgtctcctacaccttttgtcgttgtaacccgcgaagtcagggtttttgctctcgttgtccggaaacattcaagcccaacgacacacgagattcttctctactgggcagagacgatcgggtgcaatggcgaagggaagtgttgtggttccgctggctgggatattgatcggccgaatgatgttccgctcgaacgaaattag

SEQ ID NO: 113680 - DNA, 1141 bp, Glycine max
  Peptide Sequence Number=SeqID_230458
gcgtgcgccaggtgcagcgcggcatcggccaggtcgatccgctgcaggtgctggccgatggcctgggctacgagtaccgcttcatcgccgccggcagtgacgatggccagatccagcgcggccaggccgtgctgacccggctgccgatcgccgctgaatccggcccggaccagccgggcctgagctacctgcgcctggacgatggccgccacacggtggcggtctataccgatgccggtgcaggtgccgcgcagctgccagcgctggtcacccgttcgcggctgggtgcaccggcggtgctgctcggtgcggtggccggtgaatcggccaaggccgcaggcttcgatccggcgcgtgtcgccctggaagccgatgccagctatttcagcgatggtttccaggccgccagcagtgcgccgttcaagctggaaggcaacaccctgcgcgccaccctgctgaccctggcctatgccgccgacaaacatggcgacaggccgtggatggacaccaccctcaacgccgatgcgcgcgctgcgctgctgctgaaggcgatgaccgaggacgagaagttccagatgctgcacagttacttcgggctgggcaaggacggtggcccgctgccggaaggcgcggtcggttcggccggcttcgtgccggcagtgccgcgcctgggcattccgtcgcagcagtcggccgatgccggcgtcggcgtgaccaatccgggcggcatccgccccggtgatttcgccacggcgatgccatcgggcccatccaccgcatcgagctggaaccggcaggtcgccttcgcgggtggcgcgaccatgggccgcgaggcatggcagcagcgcttcaacatcctgctgtcgggcagcgtcaacctgcagcgtgatccgcgcaatggccgcaacttcgaatatgccggtgaagatccgctgctggccggttcgatggtcggcgcgctgatccagggcgtgcagagccagcacgtgatctcctcgatgaagcacttcgcgctgaacgacatggagacccgccgcaacttccacgacgtgcgcattggcgaacaggccatgcacgagtcggacctcctggccttcgagatcgcgctggaagccggccgcccgggcgtggcgatgtgctc

SEQ ID NO: 113681 - DNA, 618 bp, Glycine max
  Peptide Sequence Number=SeqID_230459
atgggtaatcaactacttgagcaactattggagcaacctgctaatgaattgagatggcaacagaaaagacttgagaatgagcttgagttggccaaggtaaccttaaaagaaaaggagatggaagttcttgctgcacaaagggctctaacaataaaagacgaggagctgaagatgactcttgcaagattggactcaaaagaggaagagttgaaaaaagtaagggaagaggtgacagaagactctaatgatcttaaaaggctgtatgctttggcacaggagagaattggtgagaaaagcttaggtgatttggcaattgagaagcttcagcttgaggcagctcagcttgaagttgaagctgccactaatgcactacaaaaacttgccgaaatgagtcgacaacttctgaataaggctatcctgagtgttgaagctgataactacatcagtgtcatgcaaaataatgctaataaaaccccagattcaatcacagataccaataaccctgaatgtttcgaagaggtaaaagcaagagttgctcgcctctcagctttgtctgagcagcttgtgatggaggcaggcttgcatttgcaaacatctggcactgctgtccgagtttaa

SEQ ID NO: 113682 - DNA, 1629 bp, Glycine max
  Peptide Sequence Number=SeqID_230460
atggctttctccgctttacttcgcccttcctcttctccttctcactctcagttgttttgctctgttaggttcaataggaggcatcgtagtagtagccgggtaggtttcgcgtcgaacggcagaagaagagttcgtcgtttacggaacaacaatgatgtgaccgttagcgttaggtcggtgttgaacgacaacaggcctagcgctagcgtgaacgacgattacggggcggcggagtctgctagggttttgttcgagaggctgttcacgcagaaccggatgaccggagatgaaccggatcttcggattcttgaatcggatctcaaggcggcactggcggcattgaagatgaaggaggatcacttgatggaagcggagaggatggtgttgttggagaatagtaagttgaagctcacgaaggaggagctggagcggcaagagagtgaaattgaggctgctagggttaggtatgagaagctcgaggaggagatgaaggagaccacggttaaattggtttctcaggcgggacagattgaggagctgaagcttagggttagggatcgcgatagcgagatcaatgcagtgaagtatgcgctggggttgaaggagggtgaagtggagaaaatgagggttgaattggaggaaaggagtcgtgaggctgtggattttgataatgagcttagagagaaggggaggattttagatgaggcaaatgaggttatgaagaaacaggaggctgagcttgaggagctgaagagggcggttcgagagaaagagaaggagattgaggttttgttggtcgagagggaggttgagagggagaagctgagggttgctgaggcaaatttggagaagcaggcaatggattggatgctggcgcaggaggagcttaagaggctgggagaggacgctactaggcatgctgaggagagtagtgagacactggaagatttcaggagggtgaagaagcttctcaatgatgtgaggtctgaattggtttcgtctcaacaggcgttggcgtcttccagaagtaaaatggaggagcaggagcggttgttggaacagcagctgagtgagcttggggagcagagggtaagtgtgatgtcatacatggaaaatttgaaggatgcacagatagaagtggagagtgagagaaagaaactcagggttgcagagtctcgtaacagagagcttgaacgggatctgaagatggaaaaggagcttattagtgagttggaggaggagctgaagaaagagaggacttctttggagcaggcagtcaaagaagtggcttttcttcaagaggaattggagaaaaaaaatgctgagtttagagaaacaagtgctgttcttcaggtcagagagtcagagcttgttgatgctaagctagaaatccagcgtttgaaatctgaaaaggcttctcttcagggtatattggaggagaaagacttggagctttccaatgctaagaagatgctgggggaaattaaccaggaaatctctgatcttaagatgcttatgaacagtaaagaaacacagttcattgaagcaactaatatgctaagggagaaagatgagcaattgaagatgatccagaacaagttgaataatacaaaccagaaaggcttttga

SEQ ID NO: 113683 - DNA, 204 bp, Glycine max
  Peptide Sequence Number=SeqID_230461
atggctgctatctacacccctttctctatgtgggattgctatcagaataatctaagagactttttgaatgttgctggacctatgggtgtcacacatttcttcatattgtcgaaaaccactactcacatgatgcaactgaagcattgcagcatcttaaaccttagacaaattaaatggaattgcacaactgataacttttcatga

SEQ ID NO: 113684 - DNA, 153 bp, Glycine max
  Peptide Sequence Number=SeqID_230462
atggcgactgtggtgccaacctccgaagaagacgctgcactctccgtcgttcgattcgcctctgaacttgcctgggccgatgccggtcccgaggttactttcttcctctttcttctctctaacccttttctggcctttttcttggctctaact

SEQ ID NO: 113685 - DNA, 2778 bp, Glycine max
  Peptide Sequence Number=SeqID_230463
atgttggttttgcagtcactggatcaaaatgctagaaatgagctcacaccattaaagttgagggcaaaggctgctaaatttgccaaagaaactgttaaaaagcagatgtcatcttttaagcgctatggagtatgggcagactggaatgatccttatcttactctaaacccagaatatgaagcagcccagattgaagtatttggccagatggccttgaaaggctacatctacagaggcagaaaacctgttcactggagtccttcatcacggacagcacttgctgaggctgagttggagtatcctgaaaagcatgtttcaagaagcatatatgccatttttagagttgtgagtgctcctttaacaccaagttccctattacaagaatttccaaatttgtatttggctgtatggactacgactccctggactattcctgccaatgcagctgttgcggtgaatcctaagcttgaatatgctgttgttgaaataaagtcattaccagagcctgacccttcatctggtggaaataaaaagaaagggcttggacttgttttgaaggatgagaagttgccgtttctcattgttgcttcagagcttgtgccaagtttagaggcaaaatggggtgtgaagcttgttgtcaagacaagacaattgggttcagagttggaaaactacaggtatatccatccagtagatgatagggaatgtcctgttgtaattggtggagattatattaccacagagacaggaactggactggtccatacagctcctggacatggtcaggaggactatgtgactggtcagaagtatgggctacccatactttctccagtagatgatgatggaagattcactgaagaagctgggcagtttagtgggcttgatgttcttggtgaaggtaacactgctgttgtaaaatatttggatgaacatctctcactcatcatggaagaatcatatgaacacaagtatccatatgattggcgaacaaaaaaaccaacaatatttagagcaacagagcaatggtttgcttctgtggagggatttcgtcacactgctatggatgctattggccatgtaaaatgggttccacctcaggcagcaaacagaatctcatcaatgacttctattcgctccgattggtgcatatcacgacaaaggacatggggtgttcccattccagtattttatcatcttcagtctagagaacctcttatgaatgaagagactattgatcatatcaaatctatcatagcccaaaagggtagtgatgcatggtggtacatgacagtagaggatcttctcccaactaaatatcgtgataaggcagcagaatatgaaaagggaactgacactatggatgtatggtttgattcagaccttagtaacattaacctgggtccttactcccttactcccgaccctcagctacctgagataatgctgatgatttgttttggctgtttacttctaacttcaggttcctcctgggctgcagtcttgggaaaaagagattcccttagttatcctgcagacttgtatctcgaaggaacagatcaacatcgagggtggtttcagagttcattgttaacaagtgtagctacaaaagggaaggctccatatttgagtgttttaacacatggatttgtattggatgagaaaggcttaaaaatgagcaagtctttgggtaatgttgtggatccacgtttagtgattgaaggaagtaaaaatcaaagggaatcacctgcatatggagctgatgtcctccgactctgggtttctagtgtagattatacaagtgatgtgatgattggcccacagattcttcggcaaatgtctgaggtttacagaaagttgcgaggaactttgagatacctcttggcaaatcttcatgattggaaaacagaatacactgttccataccatgaacttccgaggatcgatcaacatgcactttttcagcttgaaaatgttgtaaaagccattcaaggaaattatgaaaattaccagttttttaaaatatttcagattttgcagaggtttgttattgttgacctgtcaaatttctattttgatgttgccaaggatcgactttatgttggtggatcaacaagttatacgaggaaaagttgccaaacagttcttgcagctcatctcctttccattgtgagaataatagcaccaatattgccccatttagctgaggatgtgtggcagaatcttccttttcagtatataactcaagatggttctattgctgaatatgtatttgaatctagatggcccatctcgaatgaaagaaggcttgccctccctgttgaagaaattaatttctgggagaatattcttgagctgagaacagaagtaaatagagtcttggaagttgctcgaacaggcaaactaattggggccagtttagatgcaagggttcatatctatacatctgatgcccgcctggcatcccaattatgtgaactaagtgcagccaaaaatgatgctgatacattgcggcgtctactcataacatctcaggctgagattcttccctcattggacgacgaacaaattgtaaatataccatatagtggtgaatgcctaattcaagggaagaacaaaatctggattggcatatctcgtgctgtgggttccaagtgtgaaagatgctggaattattcagagcaggttggttcatttttggaccaccctaccctctgcagccgctgccacgatgttgttgctgttcagatgccccctcaagtagcagcagtcagttaa

SEQ ID NO: 113686 - DNA, 2610 bp, Glycine max
  Peptide Sequence Number=SeqID_230464
atggaggaacctcagttccgcgaacatcccaaagccaaaatcgccaccattccgccgtcgcagcactccgacggcgccgccgccgaattgcgcggtgccgattgcaacctggcttccctctgcgagcatgtccaaatcgaaggcttcaattcgggttccttctctgatatcgtcgtcaatgccatgggttccacttatcacctccaccgtcttatcctctctcgcagttcgtatttcaggaacatgcttcatgggccttggaaagaagccggtgctcctgttgtggctcttcatgttgatgataagaatgttaatgatgaggcaattgcaatggctttggcatatctatacggacaccaccctaagcttaatgataataatgcttttcgtgttcttgctgctgcttcctttcttgaccttcaggatttatgtggaatttgtacggatttcattatatctgagctgtggacttcaaacttcttggcttatcaggtgtttgcggagaaccaagactatggcatgcatggggagcgtgttagaactgcttgctggggctacctctgtcaaagtggtggcatggaattgaaagaggtgcttcctaaactttcatctcaaacattacatgcattactgacttctaatgatctgtggatactcaatgaagagaaacggttcgaattggctttgtacacattcctggcaaaaagtgctcattgcaaggttgaacatcctgcgcatggaatttctggcactgagtctgcaaccggtatccacactgattctggtagctccaagggaaaaattgtaactgatagctgtactagtaacaggttggaaactgacatggggaaaattggtcttaaaactgatctaaaggaccctagcactcctagtcttctagttgaggttgcagatccagtggcagacttcaaagatgggggggtttctgtttccaatgaacaggttccacaagcttcatatgtcagttcaccaaacctgaatccaagatattcttgtgacatggaagggccgtcattgggtaattcattgcctgatacagatgaggtgagaacatcgtgttatgttgagacacctcttggtgctggagctactagtatgggagccactggagtgggtattgaagggacatctgaagaaggacctttctaccatttagacaacaatagttggttagttagagatcaatcaagatattgcttttcatcgaattcttgtaatgagctgacatccaatgattggggaagatatggaactcctttattttcatggaatggccaggttgttggcagaagacagcttaaatctcaccccagaggaaacttcagaggtcatggagatgaatatgacgcatttttcaatatatttgaaggggggtcccttttatattgcaatatgtcttttgatgcacttctaaatgtcagaaagcaacttgaagaattaggtttcccttgcaaagctgtaaatgacggtctttggctgcagatgcttcttagtcagagggtacaagaaattgctgctgatacatgcaaagtttgctccctcatgaacatggcctgcacttgtcagaagcaatttgcattttcacatggagcttctacctccggatcttacgtgcaagaacacaatcagaacattatgcctggcaatgtgggaaatatatatgttgctgaatcttctgcaggcgaaagaaatggcctttttagacctgtacgagtacatgttagaggtgctattgatgggcttgcaggtattggccgtggaactacatttgttccagcatctgcttcacctcctacacgttttgtcttttctcgtgtaccatttggagttggcaacagaaactatcctcagtctgcggccaatgatgattcagaggcacgtgctgacccaaatggagacctggctggagatgggttgacagctttagttgggctaagcctgggagggagtaatggaactaatgtacatacagagctaacacaaagggggtatgaaatgggcttgcaaagcagcatgtctggaactaccgctggaggtgcaagtactggtggcattcccatgcagatgttagagacaccggaacataccattggtatagaatgggataatgtcaacagtacttccatatcattggatttgaaagcacctttaagccattttcccccttttcgctttggtgtacgtttcgaggatgtgcataggcttggtgagggccaggttaagcattccccagaagttttctatgctggttctttgtggaaggtcagtgtacaagcttttaatgatgaagacccccaagggcggcgaacccttgggttgtttcttcaccgtcggaaggcagagataactgatatacatagaaaggtgcatatgtatgttgactcgcgtgaaaaggtgactgcacgctaccagttgactgttccatcgaagagggaaatgacggtgtttggaagctttaaacaaacaggcactcttctacctaaagctcctaagggatggggatggcgaactgctctgctatttgatgagcttgctgatcttctccaaaacggtgccctaagggtcattgctgtagtgcagcttgtttaa

SEQ ID NO: 113687 - DNA, 2271 bp, Glycine max
  Peptide Sequence Number=SeqID_230465
atggcttcttcagactcgaagagcttcttcttcatgtctgcacctcctcaaatccgagctcctcttactctcgaagctgatgattccgacctcgatgttgcaagtaatgatactctttctcaatctgaagaagaagagttttttcaagatgatgagtgtgtgcagctatctcccatgcatgctgcacctttgcgggttactccttttgcccatttgtctacctttaatgatgaagtggacgaagacgaagacgaagacgaagacgaagacgacgacaatgaagaagaagaaggagaagaggaaggtgcgcccagaattaagatgctggactcagaagaagaaaatcacgaggcgtcgacttttacgaacttgttacctgttagtcaatcactgcttgcaaatgatttcgcatttttcagtggcagtgacgaggaattggatgtggatgagcatgttctggacccggttcttggaattagggttgcttatcatgaatactctagtgcaaaagattctgatgttacgtcggagcattcacaggacaatttcaacaacgaagagggatttggcgtgccaagagtggtactcaatgaactggagagtgttgagctggttgagactgataccacaatgcaagggaagttggatggaggagcttcaattgttgttggtgacaccggcttattgaagtccagtcttgaggattgcagcaacagcatattacaggaacatcatatgagtgttcatgacctaccagaacacaactcccaagtacattgcatcacatgtgaacctgaatctgctgaaaatgttcagtatagtgcagcgactcaaaccactgaagctaatggaagtggaggtgttgccgatgatcaagtaaagggatgtgagaatctggtaagtataactagatctgtagtagactcaaatgctgaattgtgtgattcttctgctggttttgaatccaatcatgatgcttatgaaagtaacataattcatagtgttgagtcttgtgaagttcttgaccccacgcatcttcaagaatgttatttggaaaaggatttgtctgaaacgagtctaggtgttagtctagaagatgaattgttttctgattaccattcagcggaacatgtggaagcacttaaagtgggattcgctgcaaaagaagagactactgttgagttaaacacggctagccaagaatcagacagagaaggttctgcttcagatggggatgtggaagggttgacaacagttgcccttgagcagttcagggaacaaatttcagctttctctattcttctgggttcaaaaggttctggaaaggactctcaagaaaaacagaccatcaggatttcacatggatcaatgaacttaccaactagggatgatgcaaaaggccaattcatttatgctgatagtgatgatgaatcagatggcagctcaggtacagtcacctctgctgatgaatccagtgttatctgtcttgaagatccagctactttcagttccttacagttaccatattacgatgctcgagctggtttccagcacaacataactgagaaggaaaaggggaaaatacagaatatacaggccataagtgtgaaattcttgaggcttgtcctgcgaataagcttatctcttgaagattccttggtttcaaaagttttatacaggttggtcgcagatattgaaaggcgcttgaatcaggaatttatcattaaatcagcaaaaacatcagcaaagaagcttgaagaaaattgtcaagatgatttggacttttctttgaacattctgcttcttgggagaagtggggtgggaaagagtgcaaccataaattctatttttggtgatatgaaggtcgtgacaaatgcatttgaacctgccactacttctgtaaaagaggtttctggaactattgatggaatcaagatcagaatccttgacacacctggtctcaagtcctgtataaaggagcaagcttacaacagaaagatattgtcatctgtaaagaggtatatgaaaaagtttccaccagatgtcattctctatgttgatcgagtagatgcccaaaccagagatctaaatgatttaccaatattaaggtcaatcacaagttctctcggtccctcaatatggcaacatgcaattcttactctgacacatgctgcttctgttcctttcgatggaccatcaggatcccctttgagctatgaagtatttgttgctcaaaaatcctatcttgttcaacaatcaattactcaagca

SEQ ID NO: 113688 - DNA, 1335 bp, Glycine max
  Peptide Sequence Number=SeqID_230466
atgtcccaaaaccacgcgcaatccttgttatcctcgactagtatcatttcaagaatctctaagtaccccgaaaccaagccaccactgcatagggaggttcacgccccgtgtagaccacgtaagtttgattctcctgccttcaatagaagttttcattatcctcgcaaagaagagattagttacgacaagggcaacgtgctcagtaaaaactaccaaagggcgaaaaattctgcgttggctagcattaggtttggggaaaagggcaaggaggtgatagaagtggatgctgatagttccaagggtatggtgtcggaggattcgagtgtggaagaagatggacgagagcacaagtggcaagaaggtggtgatttggttgtgactgaggtgaaggatttggatgctaataaggatatgcatggtgtccctcagcagcagtcaacttcttccgttgtttctgagttgactaacggtgatctgaatgtggttaatgctgagaagatgttggacactctttctttgactcctgagcatgatctttcctccgttcaagcctacaagaagttgctcgatgctcttggccaacgaaatgatacgcttgagaggctgaaggctgaaattcaagttaacgagaagcgtatgtccacatttgaattgttgcgcccaaagaaggaactagttgaggaagttccattggaaccttttattcctcttactaaagaggaagaagttgaggttgcacatgccttttctgccgacaggaaaaagatcttggtttcccatgagaaatctggcattgagatctctggagaaaagtttcaatgccttagaccgggtgcatggttaaacgatgaggtaataaatatgtaccttgaattgctgaaagagagggagagaagagaaccactgaagtttctgaactgtcattttttcaatacctttttctacaaaaagttaataagtggcaagaatgggtatgatttcaaatctgtgaggagatggaccagccaaaagaaattgggatatggcctacatgaatgtgataaaatatttgtacctattcataaagagattcattggtgcttggctgttatcaataagaaagataagaaatttcagtatctggactcactgagaggaacagatgcccgagtgatgaaaattctggctagctatattgtagatgaagtaaaggacaagactggaaaagatattgatgtaagttcttggaaaaaagaatttgttgaagaccttcctgagcagcagaatgggtttgttttcttctcctattcacttaatgaaccatcattagcaggtggtggagctaggatgttttag

SEQ ID NO: 113689 - DNA, 1659 bp, Glycine max
  Peptide Sequence Number=SeqID_230467
atggcgagtgcgcattacactctttcctctgttctcgcgcctcaagctaccggacgaaccactcttcgtattccaatttcttcaaaacgccacaggaaaaaccatttgcgacccaaaattctgaaaatccttactaaaccttacccactcacccttcctcttctaccatcaccaccgccgccgccacaccctatcgtcttgcctcaagaaaacaacaacctctgtgtcgagcttcccgccgaagagacgctcgccggagaaccagataaattggaagagttacaagtctcggagggcaccacgaaggacaatggtgttttccagaacgtttctgccgtggatatattgaaatacggcggtatgtattttcttgggttttttgtgttgcagacgatttacaccgtttggattgtggggattttcaaattcaaccagaaggatagggatttggagatagatagggatgagaaaactgtgtcatggcctgttcatggtgctagcaatgtttttctttctgaggaacaagttttaatggataagaaaatcgaggaaattaagttaatggccagagaagcgcggcgaattgaatcggagaagaaaggtaaagaggatgaggatgaggattttgaagtggatgatgatgatgacgacgaaggtgctgtttctagtaatagacttggtattgagaaagagattggtgagcgattgttaaaggtgcagaataggattaatggtagtgctaaggatatttcagcagcgttacagattaattctcgtgggaattctgcagctggagtggataggggtgtcaataagaatgtgaagaataagggaaatgaggcattggtgttcaagaagaagtttaaattcaaaagcccttctactaaggatacaaagactcccaagggctttccagggaaccgagattggaaagaatctaaggcaacgaagaggggttcagaaagtaagaaagcagctcaagatcatggaagtgatgatgtttctgatcatgcacaaatgttacatgaagataaacgagccaatcagccggagcttgtgacgcagaagagtgtttctagtgttccttcggaagaaggaggaaaagttgttgatgacaagtccaaggtgatgcaagacagtataaacggcaattcaaggcatgaattggctaaaaaaaattcacaagctaacagagtcaaagttaagcaagcgaatactaaaactgatgtgtggtggctgaacctccattatgtttttccaatgtcctgcattgtaggacacaaatacactggtacgtctgttgtcattctcatgcaaagagattccgaggaaggattagaaggtctatattatggcctaaagttcacctctaaggaacaggaacaaagtgatgatgattcctatacagttgcttttgaggatcatgctgatgccaacaacttctgttttctattaaaatccttttttgaagatttggggtcttttagtgcttatgcagttccaatgccaatacaagaactgaatgaagaaataatatcacgtgccaagaaagtggtagttgtgaaaaagaggcagcttcaactctatgctgggcaaccacttgctgatgttgaaatgcacttgcgctctataatagagcaagatcaaattgcaccataa

SEQ ID NO: 113690 - DNA, 564 bp, Glycine max
  Peptide Sequence Number=SeqID_230468
atggagagtggtctgggcattgatgccatcgggcgcaaggcacgatggcacgagacgaccaccaggccaacggcgatgcgacgcggagccacgacactggaggctagaggtcacggcagtggtacgagggagactcaccgccacggcggggtcacgggaaaggcaacgcatatgcctttggacggaggtggagggtttgatcgtggtgatttcattggtgaaggcgaaggtgcaggcataggatttttagtggttgcaagtaaaggaatagtagttggaggaggcataatagctcttaaaggcgctcttcaaacacaccaattagagaaactgtggtcaagggggaataggttgggaagtgacttcagggatgggatgtgtgaccttataggaagtttactggaaaacatggctacctacagagggggttatgatcggtggaagtttctgacaacaaggatgttgagtgaagcattatcatgtgaagatgaactaggcggaagttggtgggcttgtaacaccctaatcaaatcacacccaaataagagggatccaagcctatga

SEQ ID NO: 113691 - DNA, 267 bp, Glycine max
  Peptide Sequence Number=SeqID_230469
atggtggatagcaatatgactgctatgctaacattatacatatgtgctctatggggtttcccttttgcagctaatccaataccaacactcactgagtttgttactcagttggtgatccttgaattgttagacaatgctattttgcacatgcactctgcggttgaggaatgtgagattgttgaacttttacagcaaattgatacaaagacacataagcctttgaaaaagaaagttctctttgtgaagactggagctgctgtattgtag

SEQ ID NO: 113692 - DNA, 240 bp, Glycine max
  Peptide Sequence Number=SeqID_230470
atggcttccatcattgtgtccatttgctctttcatggcctccatgtgggccttcatctgctcttgcacctcctctatttcgctcatttctctagctctagcacgcgttcgaggaaaatggactattagcaacaatgcatcaccaaaagaggaaaactctatatcaggcttcgctattatcaagcgagtcggagacctagcatggccacagatcgacctccactccttatggctcatatag

SEQ ID NO: 113693 - DNA, 225 bp, Glycine max
  Peptide Sequence Number=SeqID_230471
atgggggtgcaaatagcaaccaggcccacttggaccttccagaaaattcctccaaaaggcagttgcttctggaggaagcaacctagctcgcctggaaaatccaagccgaggcacttccgtaacgtttccatgggtgatttcgcgaagattttcaatcgttcttcgacgttcttcgttcgttcttcgtcgttcttcggtcttcaaccgataagttcccgaaattga

SEQ ID NO: 113694 - DNA, 2592 bp, Glycine max
  Peptide Sequence Number=SeqID_230472
atgagtgctcaggatttctctccaactacgaataatatgggtgctactagcttgcgaaagaaaccatcagacgacagcaatgacgatgactcttcatcaacaacaaggacttccttcagggatagagttatgggaggcaacccgatgaagtacatggtacacattgaccactctattctggaagagttatgtgcaccatgggaggatgcgttgttctcggctggttacgacctcatggacataagcaatgggttctacatggcgaagtttgatatagagccggatagggctcatgttatggaagatggtccttggatgcttttcaaccattatctcacagttctacgtcggtccccagagtttgcttcccctactgcgaagattgatcgcacactttcagagtggatgcaaacacgagagatgtctgacaaggccgagtgtaagaagcaagtgccaactaccccggtgacagtgagcccaacaccggaaactcaggtcattcctattgtggctgtagacaaacacatgacgatgcaaccattccctaacaacgagaatgatactcaacctaaccctaatgcaggtatgaatcagggtacaatggcaagagatcagggtgttaatgacgacgaccccactcataaggaatggatgattgtgaagggcccaccaacagctagtgggttgaggaagtctataagtggtttcaatgcccctaaaaagtcagacatgggtcccaccggcttgatgattgtgcttgtccccaccgaacctttcccacatgcacatcctcctcgtgctgaaatccgagaactaggggatggtgccaaaatagctctcgacattgagcttcttcaacatggtagatacgcaatgcaaatggatgatggacactcgggacttatgtcagacatggaaatttcccagcccatagatatctctatcctatcatggaatatcaggggtgctacaatgacaggcaaatggtgccatattaaggatattgttaggaaactatcctctcctatcatcatgttgtatgaaactcataacttgttctccaacagcaagattgttgggatcaagtggccaatcgtgccttgttccttcaagaagcagctgggaattctgggggtatttgggtgcttatctggcttgttgacattacttttcagttgttggactcctctccacaagctattaccttctcccttcagcgaagacaccttttctggtattgcattgttgtctatgcctcccccaaccccatggggtatctttacgtggaggaagaacatccaaaatggacaacgcatttggaagaaacttgattattgtctatcgaatgctacatggctcgctcatttgggttaccaggatatagttgctttggcatggaagaagcccaacatgaatgtcgtaaactgtctttcaaatgtcaaagaggattctctagttttcaatagagagacttttaggaatatcttcaggaagaagcgccaacttgaagccagaatcaaagcaaaactagtcaccattgaggaagttaagggcaccctcttttctatggactcgtacaaggctcctggcccagatggttttcaaccaatcttcttcagcaattttgggacttggtgggtggaccaacctaagtgccttaaggaattcaggcctattagtttatgcaatgtgttgtccaaaaccattttgaaggtccttgtccacaaagttagacctttgttggatgagctgattagcccccttcaaagtgtcttcatctctggccaaggcacgagtaacaatgcactaattaccaaggaaatagtccaccacattagcttcatccttggacaaggcacgagtaacaatacactaattacccaagaaatagtccaccacatgcgtaagaagacgagtagagaaggatatcttatgtttaaaataaactttgaaaaggcttatgataaggttgatggggatttcttggagcttaccctcactgagtttggcttccttgctttgatcattcatctcattatgaataacacgagggccacgtctttatccttgaagtgggataacgaagtctcatatcctttcttccccactcgcagcctcagaaaagggaaaggcctaaagtttcccatcttttctttgcaaatgacaatctattatgaagacgaagacatcttaggtttagctggttttgaaagatctggcggattttgccaaggcctcaagaaggtgaagaaggtggactttgggttcattcttgatcggatgacctcgaaactaactgattggaaggctaacctactaggaagagcacgcagagtgcacaagcactgggccaattggaaaacgatgaccaagtcgaagaaggaaaggagtttggggattcgttcctctagagaggtcaatatcgccatgctaggaaagcatacatgggatctcatttttgagacaccgaaactatggacccggattctaaaaaagaaatacctcaagagagactttatcttgcatatcaaggagtataagggcaattcttacacttggaaatatattaggaaagccattgagtctcttgag

SEQ ID NO: 113695 - DNA, 906 bp, Glycine max
  Peptide Sequence Number=SeqID_230473
atggcttcagattccaaaaaggatttccctgctgatgacaaagctggaacagcagagaataaagcatccaaagatgaaacgtcatctaaagattctccagcagcacaaagagctactacagctacttctggacctgcaactggttttccaggcaacccttttgatttctctgcaatgtctggcctgctcaatgatccaagtatcaaggaattggctgaacagatagcaaaagatccatcattcaaccagatggctgagcagcttcagaaaacttttcaaggagctccacaggatgctatgcctagctttgataatcaacaatatttttcaaccatgcaacaggttatgcagaatcctaattttatgaccatggctgagcgcctgggtaatgcattgatgcaggatccatctatgtctgccatgcttgaaagtttttctaatccatcaaataaagaccagcttgaagaaagaatgacacgcatcaaggaggatccatctctgaaacatattttggaggagatagagactggtggtcctgctgctatgatgaggtactggaatgatgaggaggttttgcggaagttgggacaagccatgggtcttgcaaattctggagatgtaggtgcctctgctgaaaattctggggcagatgagacagaagatttgggaaatgaagatgaatcaattgttcatcatactgctagtgttggtgatgtggagggcttgaaaaatgcactagccgctggtgctgacaaggatgaagaagattcagagggaagaactgctttgcattttgcctgtggatatggtgagaatgtctgcttatgttgttgggtggtggtgttgactttagaaccatggtgcgaagtaaatgaaggatatattgaggctcagggtattatttag

SEQ ID NO: 113696 - DNA, 438 bp, Glycine max
  Peptide Sequence Number=SeqID_230474
atgctcaaagataatactattgggattgggagcaacaatctatcgaggagaaagtgtttgaaggactggttcgtctgcaccatagaaatcaaaagcatgatgctcctcttcaggatcaaggacctgagtcccaatatctaccttgtttctctagactttgttgtaggaatggctcataagcacgtctcacagacttgtcgcccccttcaccttttgagcttacccccacaatcagaacaactttgccacaatcatgacttcaacatcgtcgccatcgacgttgatgtggacctccataaccttgatctattcttaggcctcatatgcgtcaactttattccattgatcctcatcgacatcaagtgttggtgcatcaatgccaactttatcatctctatcaagttagttattattcccactgttgagagtgattgttag

SEQ ID NO: 113697 - DNA, 177 bp, Glycine max
  Peptide Sequence Number=SeqID_230475
atggcagagatctgggacccgatcaagaaatggcaaaagacaagtgacaccacagtgacgatagtgagtgctgctaggatgaggcatcattggctggccctttctttggtgatgggtgtgtatatgtgcaagttaagggaggccgattatgaaagaagtggggatgagatgtgctag

SEQ ID NO: 113698 - DNA, 699 bp, Glycine max
  Peptide Sequence Number=SeqID_230476
atgactcaacactcgccaaccctttatgttgggaacccagttctcgtgcttgcttgtccagggagtttgtttaaacatgagtttgaggtgctcaaacacaagtttgggctcacgtctctagatggccatgtcatacaaaggttttacagattgcaagaatattcctctggcttagaacctgaagagaagccacttgttgatgcttatcatcatgaagttggacaatgttatcagactctgaatcactcctgcttcactcaagaaactcctttcaacatgatctgctcatggcaaatggacttttatgcaacatctgatcgcacattctcttttctggtgatattgctcttctctcgcttcttctttattcatcatgtagacctcaaaattaaagaagttgacttagatattgatgttgcatctggctccatggttgttcaagtgtatgaccctccaccttctcactcctatgcacttgctcaagccttgaaggattgtgcccttactaagaagaagcctcgtaaatggtctttaattggagacttcttttacaagaaagcatctggatggaagcctcctcactctcctacacctcttggtagcccccttaccatctcctctgattttgaggactttggtgataagttcctaaggaagcttaatgaagaagttgccaaacaaagagggagaaaaatgtaa

SEQ ID NO: 113699 - DNA, 831 bp, Glycine max
  Peptide Sequence Number=SeqID_230477
atgggtggccagatgcagcagagcaatgcctccgccactgctctgtatgaccacgccggccccggatccctgcacaatgcggcaggaccggccaccgatgccggcgacgccgtcatggcgcgatggttacaatccgccggcttgcagcacctggcctctccattggcttccactgccatcgatcaacgcctccttcccaaccttcttatgcagggttatggagcacagtctgcagaggaaaagcagaggctttctaagttaatgagaaacctcaattttaatggggaatctggttctgagccatatacgcccacttcccaaaatttaggtgttgtatcagatgggttttattctccagacttcaggggagattttggggctgggcttttggatcttcatgccatggatgatacagagcttttgtctgagcatgttatttcagaaccatttgaaccatcaccctttatgcctggaggcactagaggttttgtagatgacttcaattcaattagcagaaagcaggagagaggagaagcagattctgatgcatcacttttcttacctacaaatgaaaaagagaataatacaagagaaaataatgttgctaagattaaagttgtggtacgcaaaagaccattaaataagaaggaacttgctaagaaggaggatgatattgtaactgtatatgacaatgcatatttgacagtccatgaacccaaactaaaggttgatttgacagcttatgtggagaagcatgagttttgttttgatgctgttcttgacgagaatgttaccaatgatgaagtaaggctgctccttatgaaagattga

SEQ ID NO: 113700 - DNA, 345 bp, Glycine max
  Peptide Sequence Number=SeqID_230478
atggtcggagcccttaacatgtcccttctattgggcatcagcaccgtgggctcctctgtgtacatccacgttcatggcggctccgactgccagaagggtgctctacgtataccgttggtgacgttcatggtgattgtggggctggtgttcttcaccatgttcgcgctctttgtcaccaacagtaaagtgggccagcaagtttttgctagggctacgacgagtacagggtcgttgacttctctcacagcatttgctaagcacaacactcctaggctaagcgcgaggaagactctggaagaagatgagttgtacaggttcgctaagcgcaccgcttcatctcactaa

SEQ ID NO: 113701 - DNA, 1017 bp, Glycine max
  Peptide Sequence Number=SeqID_230479
atggaaagtccattcaaggactacattaattctctctttgaaagcagatccaatgctaaaaagaagggaaataacgccctatcttttgtatataaattactaatgaactcgttatatggtagatttggcatcaatcctcaaagcacaaaaaccgagatgtgcaataaatctaaacgtgaccgtatatttagacgccctgagtttatagacgatgtctttattagagaggatctatacatggtatcttatctaaccaatccgggtaaggggccttcttattgggaccccccgaagaactccgcggtacaactagccgcagcgatcactgccggctcaaggatctatatgtacaagtatatttcaagagaagactgcttatatacagacaccgactctattgtccttggtaaatttaaattagaagataagatcttggagggattctttttagcacctaaatgctatagctataccacagaagagtcagatggcaataagaaggtctataagtacaagggaccgggtagaaatgttataactccagaatggtataaagaacagtacgccgacccttcccaaagtctgataaagaaggtaacttatcaatttcgacccgattggaaagaactctcggttaaaaagaaagagagtacaaccactcttagaactctcagtaactccaagagaatacctttctttaatgaaaaaggtaaatatgtaagtacagatccacttgatatcaatgacttgtcatctctaaattacattggaacaaaactattagaaagttttaaaaggaaaacagctattttagaaaaagagaattcggctctttctcagaaattacagaagctggaacaggaaagaggtataatagcccagcggagagtagaagaaggaaataataccgaagataataatacattagagcaaaataatgctaaaagggctgaagataatatcaatggagatctattggatccagatacgatgccgcgggataaaaagcccccctga

SEQ ID NO: 113702 - DNA, 1593 bp, Glycine max
  Peptide Sequence Number=SeqID_230480
gtatatcgagttaccgtagaaccaattattcccacaatttttgagaaaaccaaagctacttgttttgcttatggtcagacaggaagtggcaaaacatacacaatgcaaccgttgccgctcagagctgcagaagaccttgttagacaattgcatcgaccaattgctgagtggctgtgtttgtacactgtgaataggaaactctgcatgagagaagatggacggcagcaagtgtgtattgtaggactgcaagaatttgaagtttctgatgtacaaattgtcaaagaattcattgaaaaggggaatgcagcaagaagtacagggtcaaccggtgcaaatgaggagtcctccagatcacatgctatcttacaactggttgtaaagaggcacaatgaggtaaaagagagcaggcggaacaataatgatgtaaatgaggcaaaaagtgggaaggttgtggggaagatttcttttattgatcttgctggaagtgaaagaggtgctgatactactgacaatgatcgtcagacaaggattgaaggtgctgaaatcaacaagagccttttggctttgaaggagtgcattcgtgctttggacaatgaccagatccatattccttttcgtggaagcaagcttacagaagtgctccgggactcctttgttggaaattcaaaaactgttatgatctcttgtatatccccaaatgctgggtcatgtgaacacacacttaataccttgagatatgcagaccgagttaaaagtctatccaagagtggaaatcctagaaaggaccaggccccaaatcctataccaccaccagcaattaaagaggtttcatccacatcttcacttccaggtagtgttggtgcagaggattttaataatggtcaacgtcaagaggtaaaaacaatggacatgagcaggaaagttgtcgaaaaggaaagttctttgtacagctccgctgctgatgttgacaaacaatcaagtttttcttctagttgtcaattcaatgggcgagaggaaaaaagctcagcttctgccccaatggacagggaaaagtttgaagtaaagaattcttacggtggtgattctaccagtcagaagatgaactcttattccctaaatgttacagatgagaaagtgcaaagggtgtctcctccacgcagaaaagggactaaggaggagaaatctgaaagatctgtaaattgggtaaaacgggatgtcgatggttatgatcattccaccacaagctccaaacagcagagcacaggaaattataacattaccactggatcggggcagtctgaaacagaatcctcttctaatgtgaatatcagcgcaatacttgaggaggaagaagcactaattgctgctcataggaaggaaattgaagacacaatggagattgttcgtgaagaaatgaaactactggcagaagtggaccagccgggaagtcttattgacaactacgtgacccagttgagtttcgtgctttctcgcaaagcagctagtctcgtcagtctccaagcacgccttgcaagattccaacatcgactaaaagaacaagagatactaagtagaaaaagagtgccccgttaa

SEQ ID NO: 113703 - DNA, 506 bp, Glycine max
  Peptide Sequence Number=SeqID_230481
atggctctatatgaattagcagtttttgatccctctgaccctgttcttgacccaatgtggagacagggtatgttcgttatacctttcatgactcgtttaggaataaccaattcgtggggcggttggaatatcacaggagggactataacgaatccgggtatttggagttacgaaggggtggcttgttttggttttggcgcatttcatgtaacaggattgtatggtcctggaatatgggtgtccgatccttatggactaactggaaggatacaatccgtaaatcccgcgtggggcgtggaaggttttgatccttttgttccggggggggtagcttctcatcatattgcagcaggaacgttgggcatattagcaggtcttttccatcttagtgtgcgtccaccccaacgtctatataaaggattacggatgggaaatattgaaactgtcctttccagcagtattgctgctgtcttttttgcagcttttgtcgttgctggaactatgtg

SEQ ID NO: 113704 - DNA, 240 bp, Glycine max
  Peptide Sequence Number=SeqID_230482
atgggaggtgatagagacggaaacccaaatgtgacagcaaaggctaggataaaagaggtgggtaattttgggcagttgatagccaatgtcacaaaagatgtttcacttctgtcaagatggatggcgattgacctctacattcgggaagtggatggcctaagatttgagctatccatgaaccagtgcggtgataagttgtcagaactggcacatgaaattctaaaaggtttgtctgtttag

SEQ ID NO: 113705 - DNA, 572 bp, Glycine max
  Peptide Sequence Number=SeqID_230483
gtcttggcaagccgttggttgaaattttgccccccggtcaacttcgtggtttttgcccgttgttggcttggctagggtcggcggtgctgggttatggccccgtgctaagtttcggattggttggccccctcctcccccccgtgatcagttttgttgccaggattttgccaactttggcttgcgccccgttggctaagtctggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggtagcttcgcgccactggcttttcaaccaagcgcgatgaccaattgtgcgaatcaacggttcctctcgtactag

SEQ ID NO: 113706 - DNA, 162 bp, Glycine max
  Peptide Sequence Number=SeqID_230484
atgcggaaattgattaaggaaaggatggaaaataaggtggttaatttcgtgggtcttaataaggtggttcttggcataaaatggatgaatgggatgggtgaagatgaaaggaaggaaaaactcactgacatatatcatgaccacccgttctacaagccttga

SEQ ID NO: 113707 - DNA, 228 bp, Glycine max
  Peptide Sequence Number=SeqID_230485
atggcacgagaatgcttcccaaatgaatatatgatgtggaattgcccctcaagagaaatggccccgaggaagcttgcctcaaagagatctaggaaggataaagcggctgaaggaaccagttccgctcccgagtatgacagtcaccattttaggagcgctgaacaccagcagcgcttcgaggccatcatagggatggtcatttctccgagagcgacgcgtccagcttag

SEQ ID NO: 113708 - DNA, 276 bp, Glycine max
  Peptide Sequence Number=SeqID_230486
atgggtaagggttggggtcctggcactgctggtgcagtgtatactggtagaagctgtcgctcaactgcacctagcccctatgcttggccgcctactgataagccaaatgcagcatgtacgcgcgcatctggagctccatcctctgcatgtgagccgagatggattctagggacgatggatgatgtggaggcagtggtggtgcatctgttgccggctgctgctgctggtcctaccccgactattgtgcctgccttgggatacaatacttctcaatga

SEQ ID NO: 113709 - DNA, 276 bp, Glycine max
  Peptide Sequence Number=SeqID_230487
atgcccgggataaaagacagcgttgtcgattctctggatatcacccttgtcgccttgttccagaaacaaacacagtatccttttggtatttcgctaacccctcagtgcaactcattacatgaaccgactagatgcagatttgctaaggtgcaatttgatgaaatagggttccgaaatcaaggagtttcattccttgcacacacacttgaattggatcaaaggtttcacgggaagacgagacaagatttccttgatgatttcgttacagaggagtga

SEQ ID NO: 113710 - DNA, 675 bp, Glycine max
  Peptide Sequence Number=SeqID_230488
atggacattgcccccagtgtcacagttcatgaaccttcgttagaaaggacagcaaattcagaagcagtaaaagaagtaacgtgcgagattttagatctggtggttgagggattaggggtcccagacaagttcgcactaagcaggctcattagagatgtgaatagtgattcagttctgaggatcaatcactaccctccattgaaccagaaggtgaagggcaacaagaatagcattggttttggggcgcattctgaccctcagatcttgaccatcatgcggtccaatgacgtgggtgggcttcaaatttacacccgtgatgggttgtggattcctgtccctcctgaccccaatcaattctttgtcatggtgggtgatgtcttccaggttttgacaaatggaaagttcatgagtgtgaggcacagggcattaaccaacacattgaaggcaaggatgtcaatgatgtactttgcagcaccaccacttgattggtggatcactccgctacccaagatggtgtcaccaccacaaaatccaagtctatataagcccttcacatgggcccagtacaagaaagcaacatattccttacgcctcggagattctcgacttgatctcttcaaggcccagctagatacccatcatgtatctgcctctccatcacaaattcaatgttag

SEQ ID NO: 113711 - DNA, 186 bp, Glycine max
  Peptide Sequence Number=SeqID_230489
atggaagagatcactcagttcagcggggtaatcgacacgcatggcaatctccacaaagagagaaagctctgcattccgttgaacaaaagaaaaacgacaccagaaattacaaaggaactatcattcccaccaccaactcttgctattggcactaccccgtgggtagtttcttttttatttccataa

SEQ ID NO: 113712 - DNA, 1404 bp, Glycine max
  Peptide Sequence Number=SeqID_230490
atggacgcgaaggatatcctgggattgcccaaaaactcattcccaactctcgagaagaagtctcgtcctcccaaagagtctcaaagaaaaccagatggcatttcacgcgaggtgtatgcgcttacgggtggattggcccctctcatgcctgcaactgaagcctctcagttgaagaaaaagcctcctcctctggaaaagatcacttggcagtggcttcctttcaccagttctgctcgtaaagataatcttcatctttaccattgggtacgagtcgttaatggtgttcctcccacaggggactattcttttgccaagtataacaagtccgttgatgttatcaaatacacagatgaggagtatgacaagtatttgacagatcctccttataggggaggagtgatcttcatgtattcaggattccttttggcttctagctttggcagggatagttttctctgtggagcacttgctttgttgggggagatgtggaccaaagaggagacggatcaactatttgacttatgtgagagatttgatctccgatttattgtaatagctgataggtttccatcctctcggactgtagaggaattaaaggatagatattatagtgtttcccgggctatattgattgctagggctccatcttctggggatgtcgcagcacatcctattgttaaggaaacatataattttgcacaagaaatggaacgaaaacgagcactgtccatggtcctctctcaaacaaggcaacaagaacgaagagatgaagaggttcttgttgaagcaaaaaaaatagcggaaaaacgcctacctcccaaggttgctgaacagtctcagttggttgcttctaatgctggtgcagaagctacagagagggctgtccctggtgaaaccatatctccatcaaatgtgcaaattccaatggctgttccagataatgcatctactctagcttctcttcgtatgcttcgtgtatatttgagaacatatgcacttgagcaaatggtgcaagctgcgaacgcatctgctggacttcggactatcaaacgggttgaacaaactttgcaagatcttggggtcaatttgaagccaagggttccaacgaaagctgtttgtgcagagcatcttgaattaagaaaagaaatactaacttggcttaatctccagaagcaggtgcaatataaagaggctgaaggttcctcttttcgtgatgggtcatatggtgaaacacctggaacaccaaagcatttacatcgtgttggggatcaggaccgaacatttgttccagattcaacgaatttcggagtggaaagggttggcaaaaaggaccaaaagcgcaaggcacctggagctccatcagctcataaaagacctagaaaactaaaggcctcagatctttag

SEQ ID NO: 113713 - DNA, 395 bp, Glycine max
  Peptide Sequence Number=SeqID_230491
atggttgtgccttctccttctccaacttctatcaagacaagttacaagaaaaagaagacgataataaaaattccaacgatagacctatccatggaaaggacagagttgtcggaaacagtggtgaaagcctgcgaggaatacggcttcttcaaggttgttaaccacaatgttccgaaggaggttattgcaagaatggaagaagagggtgcagagttttttggcaaagccacctacgagaagcgtggagctggcccagcaagtcctttcggttatggcttcagcaatatcgggcccaacggagatatgggtgacctagagtatcttctgcttcatgctaaccctctttccgtctctgagagatccaaaaccatcgctaatgactccaccaagttcag

SEQ ID NO: 113714 - DNA, 410 bp, Glycine max
  Peptide Sequence Number=SeqID_230492
atggcctctgtgcatagtgcaggtttccatgttctgaagctgtgtaactcgagtttggcctctggtaatcgattaccaatgttgtgtaatcgattaccagaggagaaaacccttgagatcgcgatggcagcgcaattaatccatgaccgagtggagatggagtgcctagagggagtttgggagaccctcgaaggcaatgtgaggtgccgattctggggcacgattcggttcacggctacttcattggtacgtccagaggaacccgcacgcatgcttcagcgcactgtggagtggatattacctacacctactccatatcgactagtggagcccgtccaagtgatagaggtgtcgtcatctgaagaagaccctgaggaggacccagaggagttacctcctgagcctgttgt

SEQ ID NO: 113715 - DNA, 531 bp, Glycine max
  Peptide Sequence Number=SeqID_230493
atggcctctggtaatcgattaccaagggtgtgtaatcgattaccaagggtgtgtaatcgattacaaggcttaaaaaatgaagacaggaagttgagatggcctctggtttccatgttcagaagctgtgtaactcgagtttgggcactgatcacgatggcagcacaattaatccatgatcgcgtggagatggagtgcctagagggagtttgggagaccctcgaaggcaatgagagaggacccgcacgcacgcttcagcaaactgtggagtggatactacctacacctactccatatcgactagtggagccagtccaagtgatagaggtgtcgtcctctgaagaagaccctgaggaggaccgagaggagttacctcctgagcctgctgtggatgctcttgactttccagcgggtgatgaggacccactccctgacgtggattctctagaggatgtcatgtcagcatctatggcagactctacggaggagagcggccctggagggacagcgactagtggagactcttcatcatag

SEQ ID NO: 113716 - DNA, 1603 bp, Glycine max
  Peptide Sequence Number=SeqID_230494
agtatactagcaatgaatttgatgaattctgtgaactggaaggtattgtgcatgatgtgacacctccctacactccccaacataacggtgcagcagaaagaagaaatcgaacagtgatgaatatggtcagatgcatgcttaatggaaagaagctaccaaaatttctttgggcagaggctatctccactgcagtgtatgtgctaaatcgaagcccaacaaaaaggctcaataaaatcacacctgaagaagcatggtctggacacaaaccagtggttagtcattttaaaaattttggctctatttgttataaacatgtgcctgatcagttgagaaagaagttagatagcaaaagtgagataatgatactgctgggttatcatgccactggtggttacaaattgtttaatccagtaaccaaagaagtgctcgtgagtagagatgtggtagttgatgaatccaaggactggaattgggataaagagatggtagaggagcccacaaaagttgtgattgaagcttctattgatgagccaagtgattcttctgctgcagtaattgatgacagtgaccaaggaggagattatgaattgatacatgattcagcaataagggaggaaggtgagctagtacacttagctctatttgctgaatctgaatcagtgagcttggaggaagcaatgaatgacacaaagtggactgatgctatgaaagaagagctgaaagctattgaaaagaataatacatggaaacttgtgcctctgcctgctaagaaaaaacctattgcagtaaagtgggtttataaggtaaaaaagaatccgaaagaagagatttccaagtataaggccaggctattggcaaagggattcttgcaaaaggctggcattgagtttaaggaggtgtttgcacctattgcaagaatggagacagtgagaattattactactataacaagtcaaaaagggtggcatatgcaccatatggatgtgaaatcaaccttcttgaatggtcctctagaggaggaggtttatgtgagtcaaccacctgggtttgaaataaaaggaagtgaagagaaggtgtacagattgaacaaggctttgtatgacttaaagcaggcgcctagagcctggaacaggcgcattgatggctttctaatgaagcttggattcctcaaatgtacaactgagcatggtgtttatataaagggcagcgatactactaacttgattgtagtgtgcctgtatgtagatgacttgcttgtgacaggaaataatgagactgaaattgccaactttaaaggagaaatgatgagagaattcgaaatgactgatttggaccttatttcttattttcttggaattgaattcaagagaactgatgagggagtgatcatgcatcaagggaggtatgcaagagatgtactgaagaagttcagaatggttgactgcaattctgcagacacgcccactgccactggtgtgaacttggtgaaagatcctaatgaagaagaagtagatgtaactttgtatagacaaatggtgggctcactgagatatatggagaatcctaaactttctcacttccgtgctgccaaaagaataatgag

SEQ ID NO: 113717 - DNA, 826 bp, Glycine max
  Peptide Sequence Number=SeqID_230495
gcaacacatggaactattccttttgagacttggcttaaggaggaggaaagaacaagtattgctaagttcgttagtggacttaatatggaagtgagggacaagcaacaacttaaaaggaagcctacttcaaaatcttatggctctcactcttatccaaagaaagaacaaggtaaaggcatcttaggggctgcaccttctaagcccaaagatgataaggggaagacaattgaaatggaatcccctaaggctagtatgcaagtgaagactagctctataaagttttttaaatgtcttggaagaggacacattgcttttcaatgccccaccaagaaaaccatgattatgaggggccaagacatttatagtagccaagatgaggttactacttcaccttcctctattgaaagtgaagaagcaaaaggggaagaatctagtgaagaaatctacccccaagaagaaggggaccttttaatggttaaaaggcttctaggaggccaatcttgcaagacaccttctcttagttatgccaaagatcaactaactatgaaagataaaagggatgaggaagaaaaactagaaaaacaaaagaaaaagaaggatagtaaggccttgtcttcaaaggctaaggggaaggaaaaagaggtaaaggattcctccaagaagattgttaagaagaaaaatcattttgcaacaaaaggtgatatcaaaagagcactccttcttaaacaatcattctatcttctcctatcaagcgaaacatccccttgcactgccatacctcttgagcttgaggttattcctcaagtaaaggggttattggatgagg

SEQ ID NO: 113718 - DNA, 264 bp, Glycine max
  Peptide Sequence Number=SeqID_230496
atgttggtgcgcatgatccacactcgtctctttgcagcggcacgggtgaaatcttgccccggtatgcatagtagctgcgtgatagcctccctttctcgttgtgctcgcatagttggtgtcgcaacatgcccttttgcgggcgagcgaggcgaggctcacgggtgcgctttccaaaggaggaaagatgcgcggagtcgccaccaatgtttatttgtggaaaacgtcggaaaaaccaaaggaaaccggtcaaaacaaaaattctaa

SEQ ID NO: 113719 - DNA, 334 bp, Glycine max
  Peptide Sequence Number=SeqID_230497
ggttgagtttgcgcattggcccttaaagaggctactgcagaatagccttgaagacctatgtagtgtttggaaagtcatgaacaacatgattactctgcaacacactgaaattgaggcatcttttgggacaagcacacatgtggtcgaacatatttttaaagtcaccttatacaagagactaattggcatgcttgatgtatgtggaaaagtgactttaaagagtaaacttcgagaaattgtctaccctaatctaaattctatgtgtgctcctcctaaaaaggtaaccatggatgaatattaccaatatgggttatgtgattgcatcaagatttga

SEQ ID NO: 113720 - DNA, 888 bp, Glycine max
  Peptide Sequence Number=SeqID_230498
atggtgagggaagttgagaagaaaaattggcaaaacctagcaagagacaaatacccgaagccactaatattccacgatggaagattggcactgaaacccacagcactaacgactctagccatgttaatgtggcttccttgtggcttcattattgcgttgattagggccacgtcagcactctcgcttccatacaacatctcaacgcccatattgacattcacggggcatcatctcacaacttcaaggcccaaaactacagagaaagaagagaaattactaaaaaagggacatatttatgcatgcaaccacagaacattgctagaccctctcgctttatcgttcatgttgaatagagacctagtggccgtcacatatagtttgagcagaatgtccgagatacttgcaccaatcaaaacggtgcgtttaaccaggaaccgagacgaggatgctaagaccatgaaaaggttgttgaaacaaggtgacctagttgtgtgcccggaagggaccacgtgtagagagccatatttactaaggttcagccctttgttttcggaagtgtgcgatgaaatggtcccagtggcaattgattgtcacgtgacaatgttccacgggacaaccgcagggggtcttaagtgcttggatccacttttcttcttgatgaatccaacaccccattactctgttcagttgctagagaaagtgtcaccttcaattaccactagtaatgttatcaatgaggattttgcgagatttgaagtggctaatcgcgtgcaaacgcagattgggaaggccttgggatttgaatgcactcaacttaatagaaaggacaagtacttgattttggccggtaatgaaggtatagtttccaccacaaaggctggtaattaa

SEQ ID NO: 113721 - DNA, 390 bp, Glycine max
  Peptide Sequence Number=SeqID_230499
atggggttgaagattatggttatggtatgcttctttgggattaaagcagagaggtttagagtgggaaggaccgttttgccgaagtatttgttggaggatgttgggttagaaatgtatgaggtggtgaaaagaggtggcaaaaaagtggggttgagcaagttgccaagagtgatggtggaaagcttcttgaaggagtatttggagattgattttgttgtggggagggagctgaaagtgttcaatggcttctacgtggggttgatggaggagaccaaaaccatgcatgctaatttggagctgctggttcgtgaagggaaaggaaactgttcccatatgattggaatttcaggatttcataatcttgaccattccttcttctctatatgcaag

SEQ ID NO: 113722 - DNA, 468 bp, Glycine max
  Peptide Sequence Number=SeqID_230500
atggctcttaagagccctcctgcttcaaacgcaacgagcatgaagtatgggaacactgaagaagatttcaacaatgcaccttctacatcaaagaggagagcgtggtcattgaggtttttgagtggcctgaagaaaaaacggtaccaaaagatgaaaatagatttgaagaaaaacgtactcatcatcaccattttggccatatctctcaacgattacatgaacgcggcccagaattattcaacatttgatcaacgtaccaacaaagagagatgtaaaagtagacagaaatgtatgaacgagattgatcaccatgcatcttattatagcaccataggtttttcattcttgcaattgatattgtggcctgtgacttgcgacctatacggtattacagacagtcagtacataaagggtcttcctaggaaagcgcgattaataatgcgtgtaggcttgcaagcaagtcgatga

SEQ ID NO: 113723 - DNA, 336 bp, Glycine max
  Peptide Sequence Number=SeqID_230501
atgaaggcagtggctggattacctcagcctaacaatgcaaagcctattgctgattccagtttttccaaggctaaaccagaagattctttgaacccacaattcaaaccgccagaagcttcacaactactttgtcacagcttagagggcaatgctagtgcactcacaaattttgaggtccttgatttcttacgagctaaaagagcttcaaaggatccaacaaaagttattgccaaagtagcgcagtctgaatacaaggttcatgattatttggttgacactgctgcctctgttcaaacaagagagagcatcaatgagttcttgacaagtgttaaatag

SEQ ID NO: 113724 - DNA, 306 bp, Glycine max
  Peptide Sequence Number=SeqID_230502
atggataaccacttgggtatctccgcatgtcatcggactcgtcgtctctggatgacaaaaggtgcagaagacgatgttagtctctgcgtgtcagcaggctcgcttgcccctggttggcaaaaggtgcagaagacgacattagtctctgcgcgtcaacgggctcgtttgcccctggttgacgaaagggcgtctctgcgtgccgacggactcataggtcacgatagcgaaaggtggggcggtcaacaaaagcgaggcttttgctcctatatatcctcaatgtgtgatgaggaactccgacctacgtag

SEQ ID NO: 113725 - DNA, 402 bp, Glycine max
  Peptide Sequence Number=SeqID_230503
atggaagcggtactcccatttgaggtagatgtcccttcccagaagatactagcggaatcgggcctacaagaatcaaagtgggctcaaacacgttatgaccaactcaaccttattgaaggtaagcatttgacggccatgagccatgggtgcctgtatcaacaaaggataaagaacgcattcaacaagaaggtgcgcccccgcaagttcaacgagggggaccttgtgctgaaaaagatatcccacgctgttaaagatagtcgaaggaaatgggccccgaactacgaagggcctttcgttgtgaaaagggctttttttggaggggctctggtgctcaccaacatggatggcgaggagctaccctcacccgtgaactccgatgttgtcaagcgatactacgcttag

SEQ ID NO: 113726 - DNA, 1122 bp, Glycine max
  Peptide Sequence Number=SeqID_230504
tgcttcagaggactacatgtcctcgccttcagagggctacatgccctcgccttcagaggactacatgtcctcgccttcagagggctacacgcccacgccatcagaacattacacatcctcacctttagagggctacacgccctcgctttcagaggactacaagtcctcgccttcagaagactacacgtcctcgccttcaaagggcttcacgccctctactttagaggaccacactccctccccttcagagggctacgcaccttcacctttagaggactacacgtcctcgccctcagagggctgcacgccatcaccttacgaggactgcatgtcctccccttcagaggactacacatcttcgccttcagagggctgcacgtcgtcaccttcagaggactacacgtcgtcgcctttagagggctgcacgccctcacattcagaggactacacgtcctcactttcagaggactccacgtcctcgccctaagaaggctacacgtcctcgccttccgaggactacatatcctcgccttcagagggctacacaccctcgccttcagaagactacacattctcgcctttagaacgctacacgccctcgctttcagaggactacacgtcctcgccttcagaggactacacgtcctcgccttcaaagggcttcacgccctctactttagaggaccacactccctccccttcagagggctacgcaccttcaccttcagaggactacatgtcctcgccttcagagggctacacgcccacgccatcagaacactacacatcctcacctttagagggctacacgccctcgctttcagaggactacaagtcctcgccttcagaagactacacgtcctcgccttcaaagggcttcacgccctctactttagaggaccacactccctccccttcagagggctacgcaccttcaccttcagaggactacacgtcctcgccctcagagggctgcacgccatcaccttacgaggactgcatgtcctccccttcagaggactacacgtcttcgccttcagagggctgcacgtcgtcaccttcagaggactacacgtcgtcgcgtttagagggctgcacgccctcacattcagaggactacac

SEQ ID NO: 113727 - DNA, 430 bp, Glycine max
  Peptide Sequence Number=SeqID_230505
cgctgttcatgtgtcctccaccttcgagtttggagctatgtttcatgattgcctaagtgcggaccctcaaggcaatcctccattctccccctttttcggagccccaggaatgtcattgtctagcgctgttcatgtgtcctccattatcaagcgcggagcctctggtgactgggaaatatgttcttctgttgttttccggatcggttccttcgccaaacatgtgcatataagaaaaaaagaaggagtagagacgagagtcgtcatcatggaaagggcaggacggacgaaatcagtgtcctatctttgctttcctcttatctccgatgagagatacttggcgccctttgttgcacaatatgtgaagtcccgagacgtgccgaaaatcaaaatgaagcaggcttacgcgattcgtgaaaattccgtaatgtga

SEQ ID NO: 113728 - DNA, 342 bp, Glycine max
  Peptide Sequence Number=SeqID_230506
atggtttctcattttattgcatttggagctttgaccattagcagtggaacttatttccaaggctggataggttatgttgcgccagcagaacttgaagggcttctggtttctcgctctgaaatacttgatgctgttgtcattccatatcctgatgctgaagttggcgaggttccagttgcctatgtctttcgttcacccaatagttcactaacagaggaaggcgatcaaaaatttgctaagcaggtagcgcctttcaaaagattactaagagtgacattcatcaatgctgttcctaagacagcatcgggaaaattcttcaaagggagcttattgagaaagtaa

SEQ ID NO: 113729 - DNA, 854 bp, Glycine max
  Peptide Sequence Number=SeqID_230507
ttttgggacgcatatcaacacactaggtggcgtcatcaatggcatttccagcaatccgtcttccacggcacaagtcgagctggacggtaaggtcgatgattatggtgcggcgcgtatccgcggttcactgcagccatttaaaaccaccgaatttacggatatcaagctggcatttaccaacctggaaatgaaccgtttaacgccttactctggcaaatttgccggaaggaaaattgagtcaggcaaactgtcagtcgatctggaatacaaaataaaacagcgaaaactggcgggtgaaaataaattcgtgattaacaaactgacgcttggggaacgtgtcgacagcaaggatgcccccaatttgccactggatctggcgattgccatcctcgaagacagcaatggtgtgattgacctggacttgcctgtcagcggcagcctggacgatccaaaattcagtcttggtggcattatctggaaagcctttaccaatgtattgactaaaatcgtcaccgcgccatttagtgcgctgggcaaactgtttggtggcggggagaaactggaagcgatcgtatttgatcccggcaatgcaacccttttgccacccgagatggaaaaactaaagtctgtcgctacagcgctggggaaacgacagcagctaaaactggggattgtgcctgggtatgctgtcgtagcagacacacgcgccatccaggaagcaacgctgcgccagcaagtggctgaagaaatgggcgtgcgcctcaaaactggtgaagcgccagggccgattgacctgaataatcccaaattgcaatcggcaatacaggccctgcatgaccgtttaaccaacaaag

SEQ ID NO: 113730 - DNA, 318 bp, Glycine max
  Peptide Sequence Number=SeqID_230508
atggttgtcaatagtaatgtgctaaaattttatcatgaaaaccatagcatggttaccattggtcagtaccgattaccagaggccagagctggaacaccaatgtactttgatttctctagccagatacaaactcgcagaatttgcttcaaactagttggagatgttgcagcttttacggatgacccatcagaacaagatgattctggcactagaatttctccactggcagtagggctatctttgtctaatagaattaaggtgtattactatgctgatccatatgaccttgggaaatgggctagcctgggggcagtttaa

SEQ ID NO: 113731 - DNA, 180 bp, Glycine max
  Peptide Sequence Number=SeqID_230509
atggtgagaagtatggactataagtttcacgatctcactttaagatcctttttcgaaacgggaaatgcgagatttcttgagaaagttgagtttgggaaagaagagaacataaggaatgttgtctttgaggaagaacctgttgttgacaatgctcaagtcctcatacctattaatgtttaa

SEQ ID NO: 113732 - DNA, 324 bp, Glycine max
  Peptide Sequence Number=SeqID_230510
atggtgtttgatggatatggagtgagtaaggatatgatatttatctctgctaaccaagttgtgacatctttaaaagaatattgtcgcaacatgcccttttgcgagcgagcgaggcgaggctcacggatgcgctttccaaagaaggaaagatgcgcagagtcgccaccaacgtttatttgtggaaaacgtcggaaaaaccgaaggaaaccggtcaaaatgaaaattctaagttcgggagttgtatttacgtttgaggaaggtcgacaaaagcggggcttttgctcctacgtaccctccatcgaagaggaaatcagacctacgtag

SEQ ID NO: 113733 - DNA, 587 bp, Glycine max
  Peptide Sequence Number=SeqID_230511
gatcagctatcccaagttggttgaattacagtagaaggggcccatccctgcgtttctggtttcgtaacaagttcccagcaattactctatgtgttgttggagtttttggtagtctgcttaagtgtaagatggaccctatcttaactgccatgatacaggccccagtgattaccgtatttgctgctacaaaatattcaattcagacaaatcatacaattctgtctgatctgttgattgaatttggcagtaataaatttgaaagattccttattgagaataaatggtacagtgcagagatttcatttgaggatatttatggaataacagacattgaatggatgggagtacatgtccaggaacataaaacaaacatggcagatattcaatttacagagcccaagcttacaatggtagacagtaaattctggattcactttattactgatgtcggaaaacaattgaaatgtggtgatgcctattactgttatctcccaccattgagaccaaatgaaggaggcgaagactatgactggcttcaagtgtacattctgattctctctgtgggactctattgtctccttctctga

SEQ ID NO: 113734 - DNA, 228 bp, Glycine max
  Peptide Sequence Number=SeqID_230512
atggagctcaggataagatttgagggaggaggatacacgaacagtgctagactcgatggtggacgatgcatgaatgaccatccattcttggggctcccggtaagatttgagggtggaggaaacacaaacattgctaggccatcaatttgtggaactccaaatgcattggagccagatgaatcaaggaaagtcggttcttggggctccatgaatcactttaagaagtag

SEQ ID NO: 113735 - DNA, 330 bp, Glycine max
  Peptide Sequence Number=SeqID_230513
atggtggtcacagctcgaccagagagggtggtacaacagtttggttacattcagagcatccctccgccgtctgttagtgctcgattgtcacatgatgatatatatgacaggtggatgcattttgcggagcacgtactacctgtgggtgagctttgtctagtgcatgggcatgatgattacgacggatatgaggcaattgcacagaggttggagcgtgtgctcaaccttaggatggtcactgcaggcacaaagttatatgagattatgcaggattgcctgacgatcgccagagggggagccagtgctgatggaagtgttagggctcgttag

SEQ ID NO: 113736 - DNA, 219 bp, Glycine max
  Peptide Sequence Number=SeqID_230514
atggcgactttgctctgtaaatcccacgtggcctgcaaaccgccattggtattggcaattcagggtagcggtgcagctacggtggtgctgcagggtggtgcaggaagcgcagaaggccaaatcgcaacaatgcaggagcaggtgcttccatccttcgtttttcttcactgcactgcattgcttcttgcttgtgttgccattgttctttgcttccagtga

SEQ ID NO: 113737 - DNA, 114 bp, Glycine max
  Peptide Sequence Number=SeqID_230515
atggggcaaaagtgctctactgtgattggtggtattggaccgttagcaattgcggtttacaaaatcatggatgcagtgcttcaccatgttttttttaagggattgcgtttgtag

SEQ ID NO: 113738 - DNA, 225 bp, Glycine max
  Peptide Sequence Number=SeqID_230516
atgaggaaagagtggaaattacttgtagtgttggagaagacggcgagtcgaagagcccaaatgtcgaagaaaccgaaccacacggaggccaatcgaagcgtgcctaccgctatcagccaccatcccaatgccttcatttttccaccactgttctacggtttcctctatcacttcactcccttccctgaaacgatgtcgtttcaagtaactccaacttcgggataa

SEQ ID NO: 113739 - DNA, 1095 bp, Glycine max
  Peptide Sequence Number=SeqID_230517
atgaggttgagggaggacttgccgtgtaaaaacgatgacgtttgtgagaaagaggaagtgatgatagagaatgatgtaaccgtggcccaaaatcattggtgtcccgtcgtgaatgcgggcttttcttcgcccaagagagtcgttgtggttggttacgctcttaccactaaaaagattaagagctttttgcagcctaagcttgaaggtttagctaggaacaagggaatactattcgtggctgttgaccacaataggcctctttcagatcaaggtccttttgatattgtcttgcataagttatcagggaaagagtggcgccaggttcttgagttgaggtcgaggcctcaaggttcctgcaagggaggatgttactactttcatggccttctagctgattttgtcaggctgtcacatccggaagttactgttctggatcctccagatgccatacaacatttacgcaaccggcagtatatgcttcaggctgttgcggatatgaacctttctgattcctatggcactgttggtgttcctcggcaattagttatcaagagagacgcattagccatcccagagttggtcaacaaagctggcttgactttaccccttgttgcaaagccactagttgccgatggaagtgcaaagtcccatgaattatcccttgcttatgagcatttttcccttcaaaatcttgaacctcctcttgtgctccaggagtttgtcaaccatggaggtgttctcttcaaggtttatatagttggtgatgctataaaggttgtaaggcggttttcgttacctgatgttagcaactgggaactctccaaagatgctgcttctgcggatgatgcagatctggatcctactgttgccgagcttcctccaagacctttactagagaaactggctaaggagcttcgatggcgattgggtcttcgcctattcaacctggatattatccgtgagtatggaacaagagatcacttttacgtcattgacataaactacttccctgggtatggcaaaatgccagaatatgaacacatatttacagacttcctgttgagcctggggcaggggaattacaagaaaaaatag

SEQ ID NO: 113740 - DNA, 699 bp, Glycine max
  Peptide Sequence Number=SeqID_230518
atggaactgagcggaagagcctttggcgtcttttcctatcctaatccatccattgtggaacactgtggttttggctaccgttccggtgagatccaagggaacggaaactctgccgaggagtctcccggagctgacgccgcaggtggagccgcgacggccggtgtagatagagattttgaggcagagcttggcggagaagatggatttgccggcgagcttgtcgagatcggacttgctgaggtggaaagtagcagcgataggatggaccagggagtcagggaagagggaatccggaggaatgaagggaacgacggcggattgaagaggaaaattcttgagctggattttgcagaaacagggagaagaagaaggatgaacaacggagcgcgcgggtttggaagcgacgggaattttgagggcgaggttgcgaacggtgagtctggagaaagggcaaggatccatggcgggagggaaagaagggtgggatacagctgggtacagttggctctcttcttcgctgggctccactcatacaataccttctcttaccggcagttcctgaaggttatggagagggatgagagagcagagaaggaagatgtggtgggtttcaagcatgttgatggcgccaatgggaattggattgaggatagtgtgttcgtcgacggcgcatcacatgaagacgcaggcatgggatag

SEQ ID NO: 113741 - DNA, 984 bp, Glycine max
  Peptide Sequence Number=SeqID_230519
atggcttcttcttcttcttcttcctcctctcttcctaatcttcatccatcacatcgtgctgaagtacgcatcgtgacgaaggcgtctgaactccccgctgcatttcttgcaccctccccgtcgtcgaagctggtgatcggtttcgacaacgagggcgtgaaactgggccgcgatggcactctctgcgtgatgcagctggcgttcgacgacgccatatacatcgtggacaccatcgaaggcgaagagaatctcgtaatgaaagcttgcaaggcggcgctggagtccgaacacgtgacaaaggtgatccacgactgcaaacgcgacagcgaggccttgtacttccagttcggcatcaggctaaacaacgtggtggacacgcagatcgcgtactcgctcatagagtcgcaagagcaaggaaagaaggtaaacgactacatctccttcgtcgaccttctcgcagatccgcgttactgcggcgtagcgtatccggagaaggaagaggttcgcttaatcctgaaaaggaacaccgagttttggagagagagaccgttgaccgagtataagttgaatgctgctgctgctgatgttcgttatcttatacacatttaccacaagatgatggagaagctgagtgagaaatctttatggtatcttgcggttcgtggtggattgtattgccggtgtttctgcgggaacgctgagaattggccacctctggctccggaagcgctgaaagatgagaacggaaagggaccggaggaagaaaggatttgggtgttggatattccggcgggagggtgggcgagagaagttattggggacggagggataacaattaggaatcttaggaaggccagcgatgcagaaatccacattgttgaaaggccaccggatgacaaggccttcatcatcggaacagagaaggaggccaagaaagccatggctatggtacgtggtgtctgggaacattccgaaatcagttag

SEQ ID NO: 113742 - DNA, 1952 bp, Glycine max
  Peptide Sequence Number=SeqID_230520
ctgtgcctcagcattgttgtgggttccgatcagcctcattctgacagttgagggacaacaggagctcgactggcgactcgcagctggctacgagcgcgccgaacttggtgttgtttatccgattgcccgggggagcggaccggttctgacgatactgtttgcaacccttctgatgggggaacggctttcagcaagcgctttactcggcgcgcttctcgttatcgctggtattttcgttgtcaccggcaatccattcaggagcggaagccggccacttaaaggaatgatatggggggcagcgacaggcaccgccatcgctggctataccctctgggatggttattcggtaatctctctgcacctggatccagttagttactacgccagcacactcctgctacagagtcttattctgacccctggtgcgatgcgacgacggtatcgaatcccaacggctgtacgtgtagatagagttccgatccttatcatcgctgtatgttctccacttgcctacatccttgtgctgacagccatgcagagcatgccactggcactcgtcgctcctctcagggaaacatctattattgtcggctctcttctctcgtactggttgtttcgtgaaaatcatctggcacgccggattgccggtgcagtggtggtatcaagtccgcttcctctgtctgtggctgttagcgccattgagataagactgtatataccgccatcagtcctacgagagttcgtgatgctcaaaacagaagatctcaacactatgatatcaattgatgagattcactttgctgactggcaaatctggccacagctaaggattctgttacatcggggtaagccagtaagaatttctgccagagcttttgatgttctagttgctctggcacaaatttcagctatacgccgcatactgggacatgaccgccatctactggttactgaatttggttgtgcgtcgattctggggcgtgataaagctgtgcaggaattatgcgccttattggatcaataccgtctggtgacgattacaggctcagggggcgtgggtaagactcgtctggcatgggaagtcgtcagtcttacacacacgcattttcctgatggaatatgtgtggctgaactggctcatatcaccgaagcatccagcttgctatccgttatttcacaagcgctccatcttccattagctgccattcataatgatgccgatttacggcaacagcttgcacggcgtcgatgtttactgctgattgataactgtgaacatgtagcgttgcaggttgccggcgagcaacattatctactaccaccattacaagttcctgagagcgaagaggctgatacccacgagttactgactttttccagtgtccgcctctttatcgaacgcgggcaggccaatcgacatgattaccatccatcagccagcgaactgtctttgattggcgagttatgccgtcatcttgacggtctgccgttggcgattgaacttgcggcctcccgtctgccagtcatgagtgtcaaagagatctatagccgactggaagaccgtttccagctattgagcaatacgcacagatctctggagcccagacatcagaaaatactgaccgcgctggagtggacttatcagttgctcaacacacgtgaacaacgattattttgctctctggggatctataccgatatgttcagtgtgaaatcagtaagcgaccttctgctgattaaagacaagcatcgctggcaggttgttgacgatctgcaaagattgctgtctttatccctgattcaggtcagtactcaggtaccagagacccgtttccgcctgctggaaaccatgcgccagttcgcatgcgataaactcaggcaacagggtgaatatactgttcttgaggcccgttttgccggttattataaagttctggtagaagaggcccaag

SEQ ID NO: 113743 - DNA, 501 bp, Glycine max
  Peptide Sequence Number=SeqID_230521
atgtcccttaccgacgcgaagattcgcactctcaaagccaccgataaaccctataaagtctccgattcccacggtctgtatctgctggtcaaacctagcggttcccgtcactggtatctcaagtaccgtattaacggtaaagaatcccgcattgcactgggtgcctatcctgccgtctcactgtctgatgcccgccagcagcgcgaaggtatccgtaagatgctggcgctgaacatcaacccggtaatgcagcgggccgcagaacgcggtgcctgcccaactgagaaggtgtttaaaaccgtggcgctggcctggcataaaagcaataaaaaatggtcgcagaataccgctgaccgcctgctcgcaagcctgaacaatcatgtctttccggttatcggatatctgtcagttaccgaacttaaaccccggcatttcattaatttgctgaaaggaattgaagaaaaaggcctgctggaagtcgcgtcccgcacgcggcagcac

SEQ ID NO: 113744 - DNA, 207 bp, Glycine max
  Peptide Sequence Number=SeqID_230522
atgggttttaggatgtggcttgtgaaacagacggtagagaagcttataatgatattttacatcatgaagctagcaaagggaggcaaacgatgtggcaaacacacttgcgggatggggttcctctatacccccaacgattcaatcatggcttatccacccactgggattttagcttctctagcttttgactcttataccctagtatga

SEQ ID NO: 113745 - DNA, 201 bp, Glycine max
  Peptide Sequence Number=SeqID_230523
atgaagaacacctccaacccccatgcagctattgtagaagcttccatcaaggttgattttcacttacgactccctgggatatttctagtaaaactcgtttctagtagcaagagatccaattgtaaatctggtgcaatcagctacataagacctaatcatactacatatatgccagtgttaggactcaaaaatgaaatttga

SEQ ID NO: 113746 - DNA, 546 bp, Glycine max
  Peptide Sequence Number=SeqID_230524
atgcttcaaaataaacttgacgaatttggaatcatactgaggaataaagcaagattggttgcaaaaagttacaaccaagaagaaagaattgactatgatgaaacctacgctccagttgcaagactttttcatatggatgtgaagagtgccttcctcaatggtctcattgaagaagtgtatgtagatcaaccactaggatttgtggactacgaacatcccaaccatgtctacagactgaaaagggctctgtatggtttgaaacaagcaccaaggtcatggtatgatagattgagtagctttctaattgagcaatctttcactagaggccaagttgagaaaacattgtttattaagaaaaaagaatttgagatgtatatgatggaagaactaaacttctttcttggactccagattaagcagatgaaacatggaatcttccttagtcaaaccaaatactgtatagaacaaattaagaaattcggtatggaaaaatgcaaagaagtatctactccaatggaaacttcaagaaagagtcaagatatatag

SEQ ID NO: 113747 - DNA, 288 bp, Glycine max
  Peptide Sequence Number=SeqID_230525
atgcaagtgggatcagcaactttcattatcagagtaatcaagcacagcggaattggtaatggcgacagcaaaattctgcaagttgcaagtcgtttccaggatgtcaagacatctcacgtgacatcagctttctgctccccctgtctccatgctcttactgctgtgaagcagcatcttctatcagctactagtcttttccaggatgtcaagacatctcacgtgacatcagctttctgctccccctgtctccatgctctagctgcagcatcttctatcagctactcgtag

SEQ ID NO: 113748 - DNA, 252 bp, Glycine max
  Peptide Sequence Number=SeqID_230526
atggtcagatggagaacatacagcttcaaggtagatggagaacaaagagagcaagaaagcttagatggagaagaagacagagagaaggagaatacagcgctaaggagacgaaacatacctaggtatggtggcgaaggagaagaagcagagacttgtgacgatgctcgagtgcgacaaacacgatgctcaaatgtagacagggaccttgaaggtagacggagattagaagaagaagagagtgcgaaagcttag

SEQ ID NO: 113749 - DNA, 111 bp, Glycine max
  Peptide Sequence Number=SeqID_230527
atgtcagttgagactgcattaggtacaaagggaaaatgtgaggtaatcttagagcttaagaagttagagttgaatgtccattatgtaactaggattgccagttgcaactaa

SEQ ID NO: 113750 - DNA, 360 bp, Glycine max
  Peptide Sequence Number=SeqID_230528
atgaaccacttcttccggaaagttcccggaagaggttttccggaagtcttccggaagaagtgttcttccggaagacgtttggttacttccggaagaacacttcttccggaaactttccggaaaaggttccattgctatgctaacaatgttgcatattacaagcaaagggtagggagggagactaacctgttcgcggagaagaagaaaaccttgccttgggcgcgccttgcggagaagaaggaagttcacgaagaagataagaagaaccaggttcacggaagaggaagagaagacgaagctgttcgaacaaacagtgtcttccgggagctgacccaatctggtttctcgtccctaacttaa

SEQ ID NO: 113751 - DNA, 2385 bp, Glycine max
  Peptide Sequence Number=SeqID_230529
atggttcaaagaaaggtgcctagcaagcttggcatcgaagctgaacatgttaaatcagaaaagaggttggcaaactcgaagctatcttcatctcagcaccaagatggaaaaactagaggggctgatatgaagaagaaaatgaaaaaatcaaggtcaataaagctttctgatcttgaggctcttcaatcatcatcaccttcaaggagaagattgtcacaaccaggaaaaccactccctcttcatactccaacaactacagcatcaccacagaagcagcaacctttgttcagaacaacacatggttcacctaattacatgaagccaacaagcagttcacatgcaaaaaaggagcttttcccggtaagccacaggaacactcaacctggttctgattttaggagtcttcctagacaattttccagtgattccaaagcttcctgtgctaagaagcctgcaaaagttttgacaagaacatccagtttgagtttggtgagaacattgaccaaaaccactagtttcaaggcttctagagcttgttctagaaaatccaccagggctgttatgtgtgcagatatgggtgcaccacagagagccacttgttcttcaactttgaaggactcaaagttccctgcatacctcatgcttagccctgggggaactgagtcagagggaacttcagccatgaaggtttgcccttacacatattgttctcttaatggtcatcatcatgctgatttgccaccgttgaagagcttcgtgtctgcgaggaggttgcttttgaagatgcagaagcgtgcaaagcttgaagctctcagccctcggagactgaaggttccccttgagacacagaaggaggactctgatgctgagcagaatgtctttgatgcaaaaccttcttgtgatgaaattggcattgatatcttcattgaaatctatgccaatgaaaaggatgcaaaaccaacagcagcagaagaaatggggagaatagattttctcaaagagattgaggatcatgaagataacaagtcaacacttgaggataatggcatagaagccagtgagggtgtcatgcaaatcactacttcaagaagtattggtaattgtattccttctccctctatatctgagattgatcttgaagaggatttgaaaaaatccttagataatgttgcaattgaagtagataccaaaggaagctctctcctagaacaaaatgaaggaggtgcagatgaagattaccaatctattgtctggtctcatgaagaaatgagcatgggaagttactgcagtgatggggaacaagacatgggggatgttgacatggatgactcggattccaaaacctttgacatggagtgggaggaggagcggttgcacagattcgatcacgaagaggatgctgattcttctgtgtactcagaggaggacaatgactcaaaagttgagtcctcatcagagagttctcatgatgtatcagtgacatggttagatgatattcttggtggctattatgagcactttctggttgatgaaacacacaaagaagccaattcagaagaaagcacctactttgaagaacaacctagtggcatcaattctgtccttgaagacacaaatggaagcactgaaacacaagaaattggttacgaccaaccttcttttacggaggaaatatttgagtacctgacaaatgcacaaaataatggtgaaggagatgaaaagcataaggatgatgatgcggccagttgcaacacaaaggcacgtgatgaagagacaattgacaacactcaatgtcagaagatgagtgaaacttccaaaattgaagagacaaatgaagatggatactcaagtagcctagagaacaatgatgagagcaacaaaggggagagacaaattgagttggtggatgtgtctaaagaaagtaacatagcttctgaagatcaagatttgttggaaaaagaccaaggcaaagctatagggttgcaacaaagcacaagttgcataagtgctgaagaggaaagcacgagcaagaattggaaagatggcattagaagaaagaagggtgttgaagatgatgatgatgaaatgagaaagttcaacccaaaagagccaaattttctgccattggttcctgagccaggacaagagaaggttgacctgaggcatcaaatgatggatgagagaaagaactcagaggattggatgcttgattgtgctctaagacaagttgtgacacagcttgccccagctaggaagaaaaaggtggcactgctagttgaagcctttgaaacggtattgccagcagcagcacccaaatgtgaaacccgtgtgagaaacaattctccagcatttggtcattcaggaataattcaagcttgtagctga

SEQ ID NO: 113752 - DNA, 441 bp, Glycine max
  Peptide Sequence Number=SeqID_230530
atggaactacccactcagcgatcttccagccatcacgccactgttgaagctgatattaagactacattgacaactcccacatttatagttgttaatacctctatgtttggtacagtgcaaatggctaaacgttcacccaatgtctcaagtgcaagaactggcgtcgcctatgaagcacggacatttcagtcccttatcgtgtttggtgtccgatacgtgtccgtgtccgtgttcgacactgacacaacatccgtactacgttctatatttttggatattacaggtattcacgtgtccatgtccgtgtcgtgtccggtattcgtgtcggtgcttcatagggcgtcactaaccttaacggctcccataatcagacatagggggatcaaaaccaccaatatatgggatatcaccttccattccatacgctaccccaaaacgtga

SEQ ID NO: 113753 - DNA, 309 bp, Glycine max
  Peptide Sequence Number=SeqID_230531
atgggaggagtggttacagcagtgtttgcatctgcatttggaccatttttccaccttgggcagacacaacaaatcattcaacggttgtttccatttggcagggggctttgccatgcatactgggccccaaatttttgggtattctatatcatgtcagacaaagggcttgctttcatattcagaaaacttgggtttaatgtccagacaccaacaggttcattcaccgctggtctagtaggggattcctcaccattttctgtactacctcaggctagctatttcaacttccaacgtgctactgttcaatag

SEQ ID NO: 113754 - DNA, 429 bp, Glycine max
  Peptide Sequence Number=SeqID_230532
atgaagagagtcattgcctcttcacatttgcggtttgctttatcattctctggaaggtgctacggttgggggcaaaggcttcagagtgcgtgtggtgacgacgaaacgatgttgtgctcacctgatctagttgttccgacaccacaattctcctactctaccttcctattgtcgatctggttgttttgcaaaagtcaaaccctcaggcaaaaatccattttcagaaaactccaatgtctagaaaaaccttacgggatgtggcacctgaccatgaacgatgccgatgtcaccgacaacaaagaagatgaagagaagaggacaacgggagaaagtaaaaaaaaaataaaaaatggagggacaaagaaccagtcgagaaagggggaagaggtggggatggaggaggagaggacaatcccaatgaagtcgtga

SEQ ID NO: 113755 - DNA, 360 bp, Glycine max
  Peptide Sequence Number=SeqID_230533
atgctggaaagaggggagtgtacgttgcaatttgttaagagcatctttagcaaaaattactgcttaaaaataagtaactggtgtatacgactcaaacagtgtaaagagagtgacaagctagaaagttgtgccttggtgacttgttggtcatgggttcgaatccggaaacagcctctttgcatatgcaagggtaaggctgcgtacaacatccctcccccataccttcgcataacaaagagcctctgggcaatgggatacgaagttttttattacagctcggcagatagcagtcaaagcgatgtccaggcacttgaagtctttcttgcacacaagtctataattaagtgcttaacacattaa

SEQ ID NO: 113756 - DNA, 234 bp, Glycine max
  Peptide Sequence Number=SeqID_230534
atggaaggaggaggagtagaagttgatgcctctgctttcagagaatgcttgtctctgtcatggaaaaatccttacgttcttcgccttgctttttctgctggaattggtggccttctctttggctatgacactggagtcatatctggggctattttatatatcagagatgatttcaaagcagtggataggaagacttggcttcaggtactgttcatctccaaagctgtgtcttag

SEQ ID NO: 113757 - DNA, 420 bp, Glycine max
  Peptide Sequence Number=SeqID_230535
atggaaacacaaacaggagagattcagagcacaagttcattgggaattcctagaatctcttcagttgctagagactcagatctcattgaaaatctacaatacacgagcctgaaggacattatatgtaacacaccagcaaggtattatttaaccttgtatgagggaaatgaatttgactcaaccattgctatcagaaacgagttggtgaagcgtgcagcttcggtttacctacaatctgcggcgttgttggtgaccagaaaccaaaactgctttgtgtctttctgggaaaggctaaagaacagggctgcttcctattcaagatggagggttttagatcatgcaaacccattcagggcttgtcttgacccaatttaccagtttttgaatcacatgtttgggagtattcgttcattgccatga

SEQ ID NO: 113758 - DNA, 294 bp, Glycine max
  Peptide Sequence Number=SeqID_230536
atggccacagatccgacgtctccctcgcagtccgatggtcaatcagaggcgacttccaagaggagtagaacaacgacacggttgagaacattgacattaagaaccgtggatcagcccagaccggcagtttatgtggatctcgctaccgggagagcatcgggaccgatgcgtgaaaagttccatagctacctaggcgtagtggcgcgagaaaaggttcccattatccacaataattggaaagacgtacctgaaacgctaaaggacatagtgtggaatgacattctattgatttga

SEQ ID NO: 113759 - DNA, 636 bp, Glycine max
  Peptide Sequence Number=SeqID_230537
atggcatccctggtacaaggagttctactgaagcttctccaaagtatgaactctaatgtgaaagttcatggggaatatcgctcagtccttttgcaagtgatcagcatcgtgctcgcattatctggatttgaattatggcctaaccaaggtttcttcataaaagtctctgactcttctcattcaacctatgtctcactctccaaggaagacaacgagttcatcttgaataataagctgcagcttgggcaattcttttatgtggatagaatcgagtctggtacacttgttccaattctggttggagttagaccagtccccggacggcacccttttgaaggcaatcctaaggatctaatgcagatgctagagcaatcagataatgttggagttaatggttcaaagtccatggatttaacagaagccaaagagaatccaagttcaaggcagaagatcgttattaaagaggaaaaagttggtgttgcgtccaggacacaatcaagtttaatgctgagaagcagttctaacacggatagtgaagggctggtggagactgttgacaggttgaagcaaaaagtttattcttgtctgcttgtacatattgattccgctacattagctttggagaaccgagcttga

SEQ ID NO: 113760 - DNA, 180 bp, Glycine max
  Peptide Sequence Number=SeqID_230538
atgaaggttgaagagtttcaacgatatcacacaagccaagcaagcgattccgagtactcgcaagatcaatcccaagggattgagctaggtgctcataagaaaaagttgtacatatcccacaactacgacccatcattggctagctaccattacacgactaacaaacttacactgaaatga

SEQ ID NO: 113761 - DNA, 417 bp, Glycine max
  Peptide Sequence Number=SeqID_230539
atgttgttgcttcccttatctctaacagaactggtgatcgacgctgatgtatggatggaagtagctggactggacatgggtggaatccgtaaattcgaagaaactattgatggtgaggaatttgaggaagcgcctaggtgtaggtggtctgacatcagaagacaaaatgctcatgtacctcattacttacattctcactccaagaggtcaagtaatcacgctcagatagtggattttaccaaagcatctagtgagatcaccgaaaggcatctcaagaatcttgggatgaggcttgttgaacatgagtggattatggttggagagccaccatcagcaagaaacatggatcagatggatgaagaagctaaagctgaagctccgcaagagcttgcacatcaatggagtccttttaagtaa

SEQ ID NO: 113762 - DNA, 399 bp, Glycine max
  Peptide Sequence Number=SeqID_230540
atggggtcctatggtggtcacagctcgaccggagagggtggtacgacagtttggttatattcagagcatccctccgccgcctgtatctgcggattacatggagtggtttttccggatatctcacccattcatgatatcgacccagcagaccctgaggagttcatacagccgcccagcccccaggttccagtggcatttgacccccctccacatgcagtggatgattacgacggctatgaggcgattgcacagaggttggagcgtgtgctcaaccttaggatggtcactacaggcacagagttatatgatattatgcaggattgcctaacgatcgccaaagggggagccagtgctgatggaagtgtcagggttcgacagagacggcgcacagagcattga

SEQ ID NO: 113763 - DNA, 240 bp, Glycine max
  Peptide Sequence Number=SeqID_230541
atgattatgaggggccaagacatttatattagccaagataaggctacaacttcacattcctctagtgaaagtgaagaagcaaaaggggaagaatctagtgaagaaatctacccccaagaagaaggacaaccaaagctagtgtttggagcatttgggcgctatgggatttgccaacaacgccaattgaaagggaaatctctaagattgtacttgaaaaagaggatggaactcataaactaa

SEQ ID NO: 113764 - DNA, 606 bp, Glycine max
  Peptide Sequence Number=SeqID_230542
ggaaaggaggaggaagcaaaagcaatattgaggaaaatttatccacccaatgatgttgaagaagaaatccaagctttgcatgattcagttgctacggaactggagcaggcaggatcctcagaaaaaatcagcataatcaaactgttgaaaaccaaggcagtgaggagaggtttggtggcaggaatgggccttcaaatcttccagcaattcacgggcatcaacactgtcatgtactacagtcccacaattgttcagttagctggtgttgcatccaaccagacggcaatgctcctctccctgatcacttctgggcttaacgcgttcggttcgatcttgagcatatacttcattgacaagactgggagaaagaaacttgctttgcttagtttgtgtggctgtgttgtagccttggcccttttaacattcactttccgccaaaccgaaactcattctccaatgattagtgcggttgagaccgctcatttcaacaacacctgccctggtttcagccaagctgtgaatgctaatgaatgggattgcatgaagtgtctaaaggcagaatgtggcttttgtgcatccgacgtctctagcaacataaaaaaatga

SEQ ID NO: 113765 - DNA, 381 bp, Glycine max
  Peptide Sequence Number=SeqID_230543
atgaccatatttgtctctgcgtgtcaacgggctcgcttgcctctggttgacaggtggcggatgaccataatgtgtctccgcgtgtcatcggactcgcttgtctctggatggaaaaggtgtgcagatgaccataatttgtctccacgtaccattggacttgattgtctctggataagcataggtgcacagatgaccataatttctctccgtgtgccatcagaattggttgtctctagatgggagacttcaatagtctcggttaagcataaatggcagaggactttgagccctatgaaggcgaggactttgagtcctctgaaggcgaggactttgagtccaatgaaagataaaggtgaggactttgagtcctatgaaagataa

SEQ ID NO: 113766 - DNA, 382 bp, Glycine max
  Peptide Sequence Number=SeqID_230544
atggttgccttcgttaggcagtatcagtacaattctgatatggctccagatagaacgcaactacagaacatgtgtaaaaaagagcatgagtcgttcaaggaatatgcccagaggtggagggacttggcagctcaagtggcacctccaatgacgaagaaagagatgatcacaatgatagtaaacacgttactggtgttctactatgataaaatggtgggttacacaccctcaagctttgttgatttagttttcgctgagaacttctggtgtgaagatcctgagggacaacagagattgaagaggaagttatcatcgagagtattggatgagagtttgagtgattgtgaggtttctagaggtgaaggagacatcctcaccactt

SEQ ID NO: 113767 - DNA, 519 bp, Glycine max
  Peptide Sequence Number=SeqID_230545
atggctctgtgcattgaagcagtaacaactataaacgaccccgctttgatcaagtgtgatatctggggcacatttgtatatcagagaagatttcaaagatgtggacagatagacttggcctcagtaaaaaacctttacattctaagagagacgtttggagaggctccaagacttgaggatgtgctgaaatttgttcaaatacatagcttgattgtgactaaacagaaagccatagtgagtagggcacttgttggtgtcatcataggagcttctgttggtggatggatgaatgaccgttttggaagaaaaataacaatcctttatgcagatgcactcttctttgctggttctgtcatcatgtctgtagctcctaactcggccgttctcgtctttggtcgagttttcttaggccttggtgttggaatggcatcaatgacatcccccctttacatttcagaggcttctctaactagagttcgaggagcccctgggaaaggaacatggaggtggatattatga

SEQ ID NO: 113768 - DNA, 1173 bp, Glycine max
  Peptide Sequence Number=SeqID_230546
gcgccgggtacatggaggtggatgcttggagtggctgctgcacctgctataatacaagtggtgttaatgttcacgctcccagaatcaccacgttggctgttccgacggggaaaggaggaggaagcaaaagcaatattaaggaaaatttatcaagccaatgaagttgaggaagaaatccaagctttgcatgattcagttgctatggaactgaagcaagcagaatcctcagataacatgaacataatcaaactgtttaaaacgaaggctgtgaggagaggtttggtggcaggaatggggcttcaaatcttccagcaattcacgggcatcaacactgtcatgtactacagtcccacaattgttcagttagctggttatgcatccaaccagacggcattgctcctctccctcatcacttctgggcttaacgctttcggttcggtcgttagcatctacttcattgacaagactgggagaaagaaacttgctttgcttagtttgtgtggctgtgttgtagccttgacccttttaactttcactttccgccacaccgcaactcattctccaatgattagtgcgcttgagaccgttcatttcaacaacacctgccccggtttcggccacgctgtcaatgctaatcaatgggattgcatgatgtgtctcaaggcagaatgtggctattgtgcatccggtgtctctagcaagagcttaccaggggcatgtttgatttctaatgatgcaacaaagggtatgtgtcaaaaagaacatagagcatggtacacacagggatgtcctagcaaaattgggtggcttgcaatagtgggacttgcactgtacatcatattcttctcaccagggatgggaactgttccatgggttgtcaattctgaaatctatcctctgaggtaccgtggggtatgtggaggaattgcttctacaacttgttgggtttcaaacctcattgtttcccagtccttcttgactttgaccgtggctattgggacagcatggacattcatgttgtttggatttgttgctctcattggcatcttcttcgttctcattttcgtgccagaaaccaagggagttccaatggaagaagttgagcaaatgctggaggaaagagctgtgcacttgaagttttgggagaaggcgagtcctccccagaagggttga

SEQ ID NO: 113769 - DNA, 401 bp, Glycine max
  Peptide Sequence Number=SeqID_230547
tcgatccaacggttaacgaattggatcgaagaaattgttactgtggtctttacgtgagaaaagctgtgattttggttgatgtgttgagcagagttttctgcctttgctctgttttgcttggctgtgatagcttgtgctgtttgaatgttgttttgcttggatgttgtggaagcttgagaggattgatggggacccggggatggtgggtttatgcgcgcattgtggatgaggaaagcttgttgtgcaccatcgcccgaccgccacctagtaccacatgtgatggagtggtacctggagatatgtcgcgggggtcagagaccttggggacgtcaggtggggtgctattgcccaaaaccaagcttgaccaatcccgacccaacccgggcatagtcggtcagtga

SEQ ID NO: 113770 - DNA, 699 bp, Glycine max
  Peptide Sequence Number=SeqID_230548
ggggatcccaccaatcagcttccgtgcgccttacgggttaactcgcccgttgactcgcacacaggtcagactccttggtccgtgtttcaagacgggccgaatggggagcccacaggccgacgccaggagcgcgcaggtgccgaggcacgccaagggcgcgcgctgccatccacaatcgcgatgatgacgtctccacgagcatatcaacagcccgggcttgggccaccatcgcaatccgcgtcggtcaatgtcccgagtcgatcggcggaccggctctcaccgttccacatccgaccgggacacatcgccggcccccatccgcttccctcccgacaatttcaagcactctttgactctcttttcaaagtccttttcatctttccctcgcggtacttgttcgctatcggtctctcgccagtatttagccttggacggaatttaccgcccgattggggctgcattcccaaacaacccgactcgccgacagcgcctcgtggtgcgacagggtccgggcacgacggggctctcaccctctctggcgcccccttccaggggacttgggcccggtccgccactgaggacgcttctccagactacaattcggacgccgagggcgaccgattttcatggtgggcttttcccggttcgctcgccgttactaagggaatccttgttagtttcttttcctccgcttattga

SEQ ID NO: 113771 - DNA, 354 bp, Glycine max
  Peptide Sequence Number=SeqID_230549
atggggatcgcgcccgcaagacacccagtggacccagagacgtccaacagggccctggggtttccagctttggttacaggcctctacaaatcctacagggcgcccgtccccccatcaagtttatgccatcgtgacctagggatcgtgcccgcaaaacactctgtggacccggagaagtccaacagggtcttggggttgccagctctgattacgggtctctgtcgattctacggggtgcctgtcgcccccagcaaggtcatcaggccccctattaaccaggctttcatcaagaagtactgcgcccccaggcaggcgcagggcgaaacaccacagcagcattgggatggccggtag

SEQ ID NO: 113772 - DNA, 414 bp, Glycine max
  Peptide Sequence Number=SeqID_230550
atggcttgtttgcttgagggttgtaaccttcatggttgcatcaaacaagctctgaatatcattggcaaagatttctcgggctttattcctaaaggaacaacatggttccagaaaaagagaaagcagggccagcagaagccatttcagatcaatgataaagaccctaacggaaaaaaaggtagaggaaagcacgagttggcacacggacttgccgaaatcaagaaacaacacttggaacgtactcaggggaggacgatgaagctgccaggacaaatcgggcaagcttccggtgaagagcgacttgcaggggtggatcgcgcttttcacggcgatcctaaccctggtctcgccagagagaatggcggctggcgacggcggcgacagcggatggaacccgctttgatgccaagttga

SEQ ID NO: 113773 - DNA, 237 bp, Glycine max
  Peptide Sequence Number=SeqID_230551
atgggaagcccaagtgcaggcgatgtacttggacaattgattggggcaagagatgaatctaaaggattggatgaaggaggagacacgggtttgggtcaagcttgttgctgtgcgaacaacgaattaatgattgaagctggtgcaacaaagggaatagaggaaacaatccgggatgggagttctgtgggcagagtagcattgttctcagctgaaggagaaggggctggtttcgaatga

SEQ ID NO: 113774 - DNA, 1479 bp, Glycine max
  Peptide Sequence Number=SeqID_230552
gatattgctcgtttccggcctgatctcaagctgctgatatcaagtgctacacttgatgcagagaaattcagtgattacttcgattctgcgccaatattcagaattccagggagacgatatcctgttgaaataagctataccaaagctccagaagctgactacttagatgcagctattgtcacatcacttcaaatccatgtcactcaacctcctggagatatattggtattccttactggtcaagaagaaattgaaacggcagaagaaatcttgaagcatcgaactagaggcttggggactaaaatttctgagttaataatatgccctatatatgccaaccttccaactgaactacaagctaaaatatttgaacccactcccgaaggggcacgaaaggttgtccttgctactaatattgcagaaacgtcattgacaattgatgggatcaagtatgttattgatccaggattctgtaagatgaaaagttataatccaagaacaggaatggagtctttgctagtaactcccatctcaaaagcttcagcaaatcaaagagctggtcgttctggaagaacgggtcctggaaagtgcttccgactgtatactgcatacaattatcacaatgatttggatgataacactgtaccagaaatacagcggactaaccttgcaaatgtagttttgactttaaaaagtcttggtattcatgacttattgaactttgattttatggatcctccacctgctgaggccttattgaaagctttggagcttctatttgcattaagtgcgttaaataagcttggtgaattaactaaggtgggtagacggatggcagagttcccacttgatccaatgttgtcaaaaatgatagtggcttcagaaaattacaagtgttcagatgatatcatttctattgctgctatgctttcggttggaaactcaatattttaccgtccaaaagataaacaagtacatgcagacaatgcaaggctgaattttcacactggaaatgtgggagaccatatggcgctgctaaaggtctacaattcatggaaggagaccaattattcaacgcaatggtgttatgagaattatatacaggtaaggagtatgaaacgggctagggatattcgtgatcaactggcaggtcttttagagagggttgagattgaactaacttcaaatgctaatgatttagatgccatcaagaaatccattacatctgggtttttcccacactctgcacggcttcaaaagaatggatcatatcgaactgttaaacattcacagactgttcacatacatcctagttcggggctggctcaggtgatgcctactaggagtcgataccttctcaggtctttcaatggctccttgacctggaagaaggtgctggatgccaacctcatcatcgctagtgatgacaatattgtcaacataggcaacaaatgtaatggccttcaggagaatgaatga

SEQ ID NO: 113775 - DNA, 225 bp, Glycine max
  Peptide Sequence Number=SeqID_230553
atggttttcctgccagtttcaagtaaaaagataaagaagaagaaggttgcagcagctggtgtctcgctaagcgaggcatatgcgcttagcgaacaacatccgctaagcgaggcactcagctcgcttagtgagctagaagaatctggaagagaatctaccaagcatgcacgcgccatcagctcgtccagtgagtcatttgtctcttctgacgctaagcgcgcctag

SEQ ID NO: 113776 - DNA, 396 bp, Glycine max
  Peptide Sequence Number=SeqID_230554
atgaaaacaaaggtacttgtaattgttggagaaactggttccggaaagacaacacagatcccccaatatcttcatgaagctggctacacaaagcgtggaatgattgcatgtactcagccacgacgtgttgcggctatgagtgttgctgctcgagtttctcaagaaatgggtgttaaattaggacatgaggttggttactccatccgttttgaagattgtacatcagagaagactattctgaaatacatgactgatggaatgttactgagggaatttcttggtgagccggatttggcaagttatagtgttgtgatggtggatgaggctcatgaaagaacactctcaactgatattctgtttggattagtgaaggtggacagaaaattcttgtcatga

SEQ ID NO: 113777 - DNA, 4416 bp, Glycine max
  Peptide Sequence Number=SeqID_230555
atgggagagcggattgaagctttggagacacaaatgggtaacgtaacaacgacgttgcatgacctcgctctgcagatgcagcaacatgctcaacagatgcagcaacagagtgtaattcttactgagctcagcaaacagatcagtcagaagggagtgtcgccagagggcgaaacttctgttggtgactcaactcagaacgagtctcgcctcgtcgaaaagaaggtcaaacttccggtgtttgaaggggaagatcctgtagcgtggattacgcgcgcagagatctatttcgacgtgcagaatactcctgatgaaatgcgggtgaagctgtctcgtctgagtatggagggctcaacaatccattggtttaacttgttacgggaaacagaggatgatctttcgtgggaaattctgaagagagctttgattgcgaggtatggtggtagaagattggaaaatccgtttgaggagttgtctaccctccgtcagacgggaacggtagaagagtttgtcgaagcatttgagctgctttcttctcaggtgggtcgtttaccggaggagcagtacttgggttatttcatgagtggcttgaaacaaccgattcggtggcgggtgcgaacgttgaatccgcagaatcgtatgcaagtgatgaggatggccaaagatgttgaagaggaactgaaggaagaagacgatgaaggagatcgttactatgggaagaatcgtatgggccgtagtgagcccaataggctgctgtctaaatctcgaaatgggtctaacccgatccacaaagattttacccgctctaattcgggtgggtacgctccaagtcagaaaacgggttctaccgggtcaaatacaaatcccacgtcctcaatgaattcaacaggacgaaaaggggaaaatgaccgtcgtacgctgtcgtcggaacggtggaagggagttcgcggcgttcagagtgatgaaatagctgaacgaagagccaaggggttgtgttttaagtgtggagggaagtaccatcccacgctccacaagtgtcctgaacgagcaatgcgtgttctgattttaggagaaggggaagagctgaacgaggaaggggaaattgtttctcttgaagccactgaaacggagggagagggagaggagacagaggcggaatgcaatctgattggagtgatgggtagcatgggggagtataatacgatgaagatttgtggaaaaattgctagtattgatgtgatggttttaattgacagtggagctagccataatttcatctccccagaaatcactacagcattagggttatctgtgacccctatggcagctaagaacatcaagctaggtgatggtcataaggttctttcaaagggaatatgtgaaggagttcaaattgatttggggccccaagtttttcatgtggatgcgttggtgttagagctgggaggtttagacgtggtgctgggagtgtcttggttgagcactttggggaaagtggtgatggattggaaggatctatcaatgcagtttatgcacgagggaagaatggtaaacttacaagctcagggccgtatacaggaaaagcagagctgcttacactcttttttagaggataagcatagaaggggaggtgaaggttggtggtggactcaacaggaagagagggatattgctcaagcagctggacagatggaattgaccaaattactaagtcaattttctgaagtatttcaggaaaaaattactctacccccagaaagaagtcaggtgcatcagattaagttaattcctgagcatggaccggtcaatgtaaggccctacagatatcctcatcaccagaaaaaagaaattgaaaagcaggtgacggagttgctagctgcaggagttattaggaccagcatgagcgcgttttcgagcccggttatcttagtcaaaaagaaggatgggtcctggaggatgtgtgtggactatagagccttaaacaaagccactgttccagataagtatcctattccaattgtggacgagttattggatgaattgtatggagcaactattttttctaaaatagatttaaaggctggatatcatcagattcgtgttcataaggatgatattcataaaactgcttttaggactcataatggacactatgagtacattgtaatgccttttgggttgatgaacgcaccagcaacatttcaggctacaatgaatgacattttcagaccctatcttagaaattttgtactggtgttttttgatgacatcctggtggactaccttggccatgtcatttctggagatggggtagcagtagacccagacaaaattaaatgtgtattagaatggcctgagcctaaaaatgtgaaaggagtgcgtggttttttagggctcactgggtattacagaaaattcattaaggattatggcaaaattgccaaacctttaactgaattaactaagaagaacaattttgtgtggggaaaagaagctttagttgctttcaagttacttaaacagattatgactacacctccagtgctgggattgccagatttttctgtgccgttcgaagtggagtgtgatgctgcaggaaggggcattggtgcagttctgatgcaaaagagacaaccaatagctttcttcagcaaagctttatctgatgggaatttgacaaagtctgtgtatgaaaaggagcttatggccttggtgcttgcaatccaacattggaggcactatcttttgggcaaaccttttgtggctgctgatgctttgtcaagatgccatggtgatatggagctggctgtgatgttatcatatcccacatggttggatggagagcaattgctgcaagaggttaggcaggaccctgtattgaagaaaacagtggaagaactcaaaaggaatcctggagctaagacaggattcactgtgcggcaggatgtcttattttatcagggtcgtctggtgttatcctctgactctccttcaattcccgtgttgctaaaggaatttcatgaaacgcctatggggggacattcagggttcctaagaacttatagaagattggcagctaatctgtattggacaggtatgcaaaagagagttagagattttgtgagggcatgtgatacttgccagagacaaaaatatgcagcaacagcacctggaggcttgcttcaacctttgcctattcctaatgccatttgggaggatctttctttggattttatcactggcttacccaaatctaaggggtttgaggctgtgctagtagtagtggacagactttccaaatatagccattttctgctgttgaaacatccttatactgccaagtctgtagcagaattgtttgttagggagattgtcaggcttcatggtgttcctctatctatcattagtgatagagaccccctctttatgagtcatttctggttggagcttttcagactgcagggcactaaactgaagatgagttcggcctaccaccctgagacagatggccagactgaagttactaacagatgcttggaaagttatttgcgttgttttgcttttgaacaaccaaagacatggtcacactggattccatgggctgagttctggtataattccacctttcatgtatctattggtaagactccttttgaggtagtctatgggaggcagccaccaaacatcatccgtttcttgagtaatgagaccaaagttgctgctgtagctatggagctgtgtgaaagagacgaggctttgaatcagttgaaggctcatttgctgagagcacaacaacaaatgaaaaaatatgcagataagaagagaagggaagttcagtttgcagtaggggaatgggtttttcttaagttaaggcctcataggcagcaatctgtagcaaagagaatcaatcctaaactggctgcaaggttttatgggccgtttcagatcattgagaggttgggtgaggttgcttacaagcttcaattacctccacagtctaggatacatccagtttttcatgtctccttgttgaaaaaggctattggtgattattctgtgcaaggggatctacccacagagctagaggttactgatatggatgaattttatcctgagaaggtcattggttcacgcactatcactcaaggaggagtatctgtgcctcaaagtcttgttcagtggaagcacaagtccagtgatgatgtgacttgggaagatgatgcgttcattagaggacagtttccagattttaaccttgaggacaaggttgttgctaaggaggatggaattgatagaaaccttagtaaggaagtgggccttgatgagaatgttaataggcccaaggtttggagagtgtatacgaggaagaatggaaaagggaaaaagaatgatgaggtggcagaggatacatcaaaatag

SEQ ID NO: 113778 - DNA, 969 bp, Glycine max
  Peptide Sequence Number=SeqID_230556
atgaagcacaaggtggggttagtcatggacaagatagcagaggatgagcagcgacagggcaaaaaggaaacagaacacacgttcaggaacaaaggactactgaaacaacacccacaacgaatgcaaccaccagtctcgtatgcgacagtggtggcgaaaggaaacaacaacacgaagaagagatggtttccaaggcacgcgattctaacgagatcaatctctcatttgacactgcagctgaatatacccatagaggaaactaaatggtacagtaatgcatgggttggaagattaaggaacctggtgctattcgataaaatggaagatgaaatcatgtgggttggaggagaagacatcatgccaaaatacctaggtgatgatatggtattactgacgggactcactgatacaagagctgaagaaatgtgcaaggagggagcttgttggggaatcccattacacgcatgggacaaggagaacatcaagaagattgtgtgggtggtaggggaaggagtggaggtggatgacgaggagtatacggttcatatggcagaggagacatgccacagtccagacaccaataaatggcgtatgaggagcatgatggggtcatcagaggaaattagctctgatgagagcgaaacggggctgccattatcggcaacctatgagtcatcggaaagcaagtttccgatgaatatcaacaatgaaaatggaggaaaactgggaggagctgctcgtgataagcaattgtccgacggacaatgccccacgcttggatccaagggtaataccctatgggtgctgacacaacgaccacaacaacccaggcatagggacgaaagctgtggacagagcgagacagcagggaacgctgatagtggtataagcaaacctatccaacaactacagtctggaggcaaggatacgaaacagacagcaaccagaggtcacaaggaagagacatga

SEQ ID NO: 113779 - DNA, 432 bp, Glycine max
  Peptide Sequence Number=SeqID_230557
atgtcattgcagaaaggtttcaaggcaagaatacttgaagaaaagggaggaaaagaaattagaagaactgagcatggtcactgcagagatgatatagaagatgagcaatatctatttgaaggtgtgaagctttcagaagcagaatatcgcgaactgaggtacaagaaagagatatatgaacttgtgaaaaagcggtcagaggaggctgacaatgcgaatgagtatagaatgccagaagcttatgatcaggaaggtggtgttaatcaggagaagagattttctgtggctatgcagcgttacagggatctaaatgctgaggataagatgaatccatttgctgaacaagaggcttgggaagaacaccaaattggaaaggcaacactgaagtttggttcaaaaaataaaaaacaagtctctgatgattatcagtga

SEQ ID NO: 113780 - DNA, 372 bp, Glycine max
  Peptide Sequence Number=SeqID_230558
atgtcgaaggaaagagaatcgtggatggggtcaaagaaaggggaagtcataacaaggctactgttttctgtgcctgcgtcatcttccccatctttacttgactatttattcgcctcatactcgggcatagattattattcaagcgttcatttagatgtatttggattagacatggcaatgaggcgggacgagtacgggtattgtcttcctaatttcttaccccgacttttcaacacatccccgtatccgtactcgatacccgacaggtttaagtttattgtctcatccctgtattcgtcgggtatccgtcgggtatcgggtatccccgaccccgttccatacacgattcaaattagaaaaatatttttttaa

SEQ ID NO: 113781 - DNA, 519 bp, Glycine max
  Peptide Sequence Number=SeqID_230559
atggcaccaacagaaggaaaccatggcaaggcaaagcaattggtggtgaaatctgaagcgcagaataataaggaaaggtcttacattggtgtgaggaaaaggccttgggggaaattcgcagcagagatcagagatacaacgaggaacggcgcaagggtttggcttggaacctttgacagtattgaggctgctgcattagcttatgatcaagctgcatttaccatgagaggtgatcatgctgtgctcaattttccggtgaagacggtgaaaaagtctttgcaagagattcaatatagctgctgcaatggttcttctcctgcacttgcactcaaggagaggcactgcatccaaagaaagttgtcatcaaaagctaaaatgtgtagagggaaagagacatcatcatcagaggattcaacacaaagtgtggtggtgtttgaggacttgggagttgactatcttgagcatcttcttagcgtatcagatcaaagtgaaagtacaagccctagctacttcaactaa

SEQ ID NO: 113782 - DNA, 630 bp, Glycine max
  Peptide Sequence Number=SeqID_230560
atggaaattacggaagtagaagctggtgaaggttgggtgagccttggaaaaatgcttaaaatcacatgtgaggagaggtttatatgctgggatgggcatagtcttttcccaacagtttgtgggtatcaacacagtcatgtactacagccccacactatagttcagttagctggttttgcctctaatcagaccaagatttcctccccattgattgacccaactgaaacaactcccttcaatggcacttgctctggttacactgcagctaccaaccgtgatcaatgggattgcaagacttgccttaaaggttctaaaaaatgtggcttctgtgctgcctcagataagctaaaacctggtgcatgttgggactatgacaacaactcggagaatcattgtacttcacaacacagggattggtactccaaaggatgtcctagcaaaactggatttgttgcaataataggcctagcactctacatcatgttcttctcacctggaataggaactgtttcatatgttatcaactatgagatataccctttgaggtttagaggagtatgtggaggaatggcatccacagcagtttgggtgtctaaccttatattgtttgccagtccttcttatccgtaa

SEQ ID NO: 113783 - DNA, 615 bp, Glycine max
  Peptide Sequence Number=SeqID_230561
atggccaacgacacccagctgatggtggacgtcatcagcacgtcattgccgctggttcgcgagaacaagatcaaggccctggccgtgaccggcgcccagcggctgccggtgctgcctgacgtgcccaccgtggccgagagcgggttcgccggctttcgcgccgcgacctggttcggcgtggccgtgccgcgcggcacgccgccggccgaggcggacaggctgcgcgaggccgtggccgcggtgatgcgccaggcggatttccgcgaccgcttccaggcgcaaggcctggtgatccaggcgccgcgcggccaggccgaggtcgacgcctatctggccgaggatcgcgagcgctggaatggggaagcgccgcaaggccaagggcgcgccgcggcgggcgggcatgacggcgtagatgcgtgccggcgcggcgcgccaggcgggcagcaattgcgccaggtcgcctttggccagggagccggcgcacagcgccgccaggttgctgctgaggcagcgggggcggaattcgatcgattcggcctcgcccgccgggccgacgaagtgccagctctgcgggctgtcctgggtcgcatgggccagcagcggcagcgcgttcag

SEQ ID NO: 113784 - DNA, 522 bp, Glycine max
  misc_feature (25)..(25): n is a, c, g, or t
  Peptide Sequence Number=SeqID_230562
atgggaagagggcctcctgttgtanttgagaaggtgaaatttgatcatatagaggagaggttgagagtcattgaaggaggtggaaattatggctttgctaacatgtcagaattgtgtttggtacccaacgtggttattccttcaaagttcgaggtgccaaattttgataaatacaaggggaccacttgcctgaggaaccacttgaagatgtattgtaggaagatggaggcatatgcaaaagatgaaaagttgctgatgcatttcttccaagaaagcttggtcaaggatctaatggatgccttcattatgcaatatcaatacaactctgacatggctctagataaaatgcaactacaaaatatgtgcaagagagatgagaatgaatcattcaaagaatgcgctaaaaggtggagagacctgactgctcaagttgctagtttgtttgctcatgtgacctacgctccagagttgatctctaagtctgcccaatcagaaattgcatgtttggtggggctgctgtaa

SEQ ID NO: 113785 - DNA, 324 bp, Glycine max
  Peptide Sequence Number=SeqID_230563
atggaggatgaatcatctgaggccaccattctagagccattggttctaggggaggaggaaggtgagacacaggtgagacaggtagttgctgtcactcccgagagatctcttgaggccacttcagagcctcctgcaccattagtggacctaccctcacctcagcgtacaacaaacccctccactcctattctagagatgccagaggaccaaaccacactagtcctgactatggacacttctcctccagctactccagtacttcatctgacaaatgaggaggatgttcagacacaagatactcaagaccagtcacaggaattctaa

SEQ ID NO: 113786 - DNA, 237 bp, Glycine max
  Peptide Sequence Number=SeqID_230564
atgcatatcgaggcaagatttcgcccagaccgccatagggagatgagtgcggatcatgcgcaccaccacaactctgatctcccctttccaaagtgccagttggatcacgcccacaagacacccagtagacccggaaaagtccaacaaggccctggggtttctagctctggttacgggcctctgtcagtcctagagggtgcccgtcccccccagcaaggtcatgtcatcgtgacataa

SEQ ID NO: 113787 - DNA, 444 bp, Glycine max
  Peptide Sequence Number=SeqID_230565
atgaatcttgatcgactccaccaaattgacatgcgagacaatcattacattgacgggatggaataccatgcggagtggattaatatctggaaaaacaaacgcaatgatgttttagttgggcaatgggttgaaggaatagtgacacatacaccagcgtacatggaatggtataggaaaaacattgaccacaacaacatatccaacatctccactttcggtgccccatatttgagtaggacaatgttctatttatttgtcataatccatcacaataataacccaccaaccaaccaacatggctcaacctccaatcttgaggatttatcagatgaatacaagacttgtttggtcaaaaactatgatagtgatactgactcctcttccaggcccgaaggaagtaacatgtctccatcccacgaaacaatattcaaacgggattggtaa

SEQ ID NO: 113788 - DNA, 210 bp, Glycine max
  Peptide Sequence Number=SeqID_230566
atgggttgtttcgccagcaaaaacgctgacaccaaggccagtagggccgcgcgctggcgatccacgggcatcgttgctttgcgcgattccaaattaaaggcaattgacattcctgtggaaattagcaagttaattaatgtacagcgcctggtaaggaccaactattactctgcctttgggactgtatcttctattgagcatttactgtaa

SEQ ID NO: 113789 - DNA, 612 bp, Glycine max
  Peptide Sequence Number=SeqID_230567
atgtggtggaaatgggttgatgttgattataaaagcttaagatatttgtccaacgatcaagacgctatggatttggcaaggggtgaacttactgggggtgaggagttgttcaatgaccaacaaattgtagagtttgaccatagtgtagatgatttgtttgattgggacaatgctatggcatttgatgacaacaatgagtcatccaggaagcaaaatgagcctacagtgaaaagcaaagtgagcaataaaggaaaatataatgcttctaaatacgaagatccttctattgaaaatcctggtcggtgtgatgaagacctagacgggattgacgatgacaatatgcctaaccaccccatgaggaaccttatacaaattttaaggagatgcacaatttggaggctagctatgaaactgatgagttgtacaatgatgttgaaagtagcaagaaacattgttgtagctgttggaactgagacacaagttgctgaatatgaaattccaacagcaggaaacaatgttgcaaatgctagatctgcagtaggaggactaggatctacaattccaataggaaacaatgttgcaatgcctactgaatctgatattccaacgtag

SEQ ID NO: 113790 - DNA, 438 bp, Glycine max
  Peptide Sequence Number=SeqID_230568
atggaggggtttcaagagtttgaagcaaggaggaaaaagaagtttgacaaacaaattgattcaaatgtgatgatcggttccaaaggtcttgatgagggtggtcttaggcttgttgatggggttctttcagttgtacatttggatgagcttctggatgtagcgtggaatactgggagcaccaacaaactcggaagacatttttggagatgttggaattgggtgggtcctatcaatgttagaggatcaaatgtcgatgaaaggcaaacagttattgttgatccaagccaaggcatatttcataggatagaacaacaattggagcaacaattagaggaggctcaaatgaagattattaaattgcagaagatagttgttggtgaaagaatgaatgtgtatttgttgatgggtctttcagtgatgtgtttgtccatgttatga

SEQ ID NO: 113791 - DNA, 213 bp, Glycine max
  Peptide Sequence Number=SeqID_230569
atggttatcagttgggctaagcgcatacccacagctaagcgtagctttagcgcgcttagcgcaaaggagaatctagaagagcatcaacatcaaggtcgtgcgctaagcgcgagatcaggtagacaatgcccagggcacagcagccacagagcctattttaggaaaagagccctggaagcagcaaagaggagcaacttatgcattgaaacctag

SEQ ID NO: 113792 - DNA, 438 bp, Glycine max
  Peptide Sequence Number=SeqID_230570
atggaagcctcaaaaagggaggaggaagagaatctgcttagaatgaagaagctaaaggctgctaaagctcagaacattatgggttttcaacctgtacaagatgatctcaatgtggagatcattactgatgtgttagcaaagctgaggactgttgaatccatcttagagaaggaagaagacaaattagaagagccttttgagatggaagaaaaggttgaagttgctgcagaaactgctcaaaatgtaccagaagttgcagttggtgagagaacccctattgtgtttatgaaggattacttgttcaacattgagaatgtgcaaaatcttttcaacactcccatctttcacacttatgttaaaattgtttgtcgccttggtcccttacatggtgaaccctcaaacttttctattcctttccctcaattcccttatgattaa

SEQ ID NO: 113793 - DNA, 240 bp, Glycine max
  Peptide Sequence Number=SeqID_230571
atgcctaagactaatgaagtcattgagggaactagaccccagagagataggcacgtgctaatcaaatttgatcagtttgaaatgtttccagataatgttgtgacagatgatggtgatctaattcacttggctttacttgctgatattgaacctgtagactttaaggaagctgctaaagaacaaacttggaaacaagctatgattgaagagttgcaatcaatagagaagaatcacacatag

SEQ ID NO: 113794 - DNA, 540 bp, Glycine max
  Peptide Sequence Number=SeqID_230572
atggtggatattcctactaacaatctgttagatgctaataacttggacactcactctcattctgacattgcctccccaactgtcccaattcctcttgataacttaggtaaatcaaccattatatcccaaccttttggcggacttcctttcggaattggtgttattctttctcatgcatcagactctttgtcagatacaatttctcccatagtaggccacgttgatgattgtgccttaacgtctcaacatgaaggtgtttccaaagacttgcgtacaatgtccaagttttgggcatatatgttgtacagtcccatacctacagaatctctgaatccttcttattttggtgtgattcgattagggtgttacaaaaatactatgcaaaaagaccctgattttgaagttgtgttgtccaagtctcaaaagaaaaagattaaaaagaaagcaagagatgatgattctgccataacccaccacactggctccaaggggtctctttcagcccgtgatcaatgtaaatcctctattggaatgctagag

SEQ ID NO: 113795 - DNA, 567 bp, Glycine max
  Peptide Sequence Number=SeqID_230573
atgattttaggggttggacctgaatcaggagggagaggccctgacggactcttcggaggtgataccatctcggtcactattcctgaagaggagtatctttctgggctagagagctgcaagaaccatctccatggccgttttcttttgcccaaaggatcaaagaaaggtcctttttgtcgactcttgggaaatttcactgggcttattgcgagtgttctcatggagtactggaggcctaacatccttttctccatacctaggggtgttggcacccctctactgctggatgatgccattatcaagcgaacttttggccatcatgctcatgttttagtggatctcgatttatccggagagctgagagaccaagtccttatggaaagatctgggtatgctttctttgtcactattacttatgagcgacttccacatttctattttaattgtaaaaacattgggcacatagttgctaactataaatcctctattcaacatgctaaggaacccctgggacattggcaaggagctttgaagaataattcaaagaagctgttggtagtttattag

SEQ ID NO: 113796 - DNA, 588 bp, Glycine max
  Peptide Sequence Number=SeqID_230574
atggtttgtgctaaaaatgctgttttgactggccgtttgcttgctggttcttttacctttgagtgtcgcatcatgcattatattttatgtcgagtcttgcttcctcattccacaaatcttgctcaagcctttgaggaagatttaattctgttatgggccctgcaaactagtcgtcaaattgactgggctcatcttgttcgctaccatatgcataaggcattacaggaaaatgcacctctcccttatccctaccttgttactctaattctgcagcacttcaacattccgttggttaatgaaccttttgtcattgttaaacgttccttttccattggagttgctgcagttgcatcctttggggataggaaggatctggatggtcaatggatttgtaagcaagacctccctcctaatgatcccgatgaatgcactccttctccaccaccaagggatccctcctcttcattgatgtgtgatgtccttactgagctttgggatcttcgggcctttgtcagagaccggtatttaaaatatctaggcaaaaagaaagaaaatcacgcaagagaaatactgtgtaacaacaagtaa

SEQ ID NO: 113797 - DNA, 692 bp, Glycine max
  Peptide Sequence Number=SeqID_230575
atatcaagaatattgtcgttgaggtgtggaagcaacctcaagtgggttgccctatgtacatcttgaagctgaagatcaagtcttcgaaaactgctatcaaatcttggaatgttcatgtttttagtaatgtccataacaaggcgaagagtgctttggagatggttgacaatgttcaacaacatattaatcttaaagggaaaaatctagggttgattggttcagccttggggatagaaatattgccttttttcacaagatcacctgaattagaaggcattattcccaacctagtctctaatgaagataaagccatgttgtctaatttgccttcgcttgaagaagttagaaatgttgtcttctcaagaagtagtacgagtgctacggggccagatgggtttggagcagttaatatgctcaactgtaaggtgtatggggggaacttgggcattaaatttgatgttaaaaaagcttttgataccttggagtggaaatttctgcttaatgttcttaaaagttttggtttttgttctactttctgtggttggataaaaaggattattgaatcggcaagattatctcttgctgtcaatgaagaagtgttgagtagaggaatttcttctctggtggcttccaatagcttgcttcccatggctagccctaagcagtttgctactccaatgcatatcttatag

SEQ ID NO: 113798 - DNA, 273 bp, Glycine max
  Peptide Sequence Number=SeqID_230576
atgaagaagataatatggcaaaaacttaaggaaggagatatacaccataatatcaatgacgatgaacctcaagtcggtgaatccaacatcggaggtagtactagcgatggacctcatgttgtgattaaacaaaaaaacgacgatctcggactcgttcaccgttggatcgtcgtgaaatttgagcaccatgttcggaacccaatttctagccttctcaccgttgagaatttcaatatcatgtttgagctgagagaaatacttttcgcatcgtag

SEQ ID NO: 113799 - DNA, 343 bp, Glycine max
  Peptide Sequence Number=SeqID_230577
tgtgagagctatgagagtgcttattgaatattcatactcaactttcaagaattctcaacctgaaaaatctaatggatcaaatcaacttagtgctatggcagatcttcaggtgttgatgaaaggtctagatcctccaccaggatcacctattttgtcgtcgtttctgtcaacaaaaaacttccaatcaaaaggagaagaaggagaaggggaggcggaggccaaggttagtgctaagggcagagtcaacgacgcggttggccatggtggcattgggttggatgacggtggtggcgtggggtttttttctgttggagaagggaaagaaggagaattgaatttttaa

SEQ ID NO: 113800 - DNA, 360 bp, Glycine max
  Peptide Sequence Number=SeqID_230578
atggcggacacctactccgcccccaaggagatccacggacttctcagctatttgcgaatcaagtcactccctcatttgatctctagcatgcattgcatgttggtctcgtcctttgtcacgggaagccggaagaattgccattccttggattatagggttgaaccaagctcatgcttttacaaaaaggttcatcaagtcaagttgaaatatggaagtaaccgtcttgcaaaattggggcaaaagatgaatcgagtcacatcactgcttcgtctactgccaaacatatttaggattgttgatgtccttgttacttccagtttcaccttgacaaagatgtcatggatcatgttgaaaatctaa

SEQ ID NO: 113801 - DNA, 234 bp, Glycine max
  Peptide Sequence Number=SeqID_230579
atggatccaatcccacacttagcgtattgcatccagaatggcgatgctgaagatggtaagtcaaagaagcctcaatatgaaggtcctgatccagaattggctgcaatgcttgaaagggacgtgttagaaacctctcctggagttagatgggatgatgttgcagggcttactgaagcaaaaaggcttctagaagaagctgtcgttcttcctttgtggatgcctgaatatttccag

SEQ ID NO: 113802 - DNA, 246 bp, Glycine max
  Peptide Sequence Number=SeqID_230580
atggaagatgctgactttggcggtgagggcagaggcacaggtagaggattttcagtgagtgcaggtgcaggagtagtagttggaggtggcagaggtggttggacgaatggaggcaacctttgttgcattaacaagttcatgttgaagagcactgagtcattgaaaaggggatggctccaaagttggcttgttgaaggcataacaactcttgaaggtgctcctcaaacacacctgttggaacaatga

SEQ ID NO: 113803 - DNA, 450 bp, Glycine max
  Peptide Sequence Number=SeqID_230581
atgatccaatgcggtctaactaaccagtggccaagctatccccttggaattcacatccaaccaaccacaaccattaagttcatgccagatagaattgcttcgaggttgcctcattggtccttaagaaaaagaaagggaaggtacttcaccaaggatgcaactaagaagatggtcactccgaagccagacactgagttcgatcaaaatgatgtcatgcttttttacttcaaagacatgtatgaaaactcaagtcctgcatccacatcacaacaagaaggagataacgagttctaccagcacctcattcatggcatccatcctcttcgctctcggttcatctttaacttgcatgagtaccccgaagttgcaatgcgaagggaaattgttgttgcttgggcaaggcatcttgtactcaaagagcgttcattctcccctaatcagaacccttga

SEQ ID NO: 113804 - DNA, 252 bp, Glycine max
  Peptide Sequence Number=SeqID_230582
atgaggctaaatcttgaagtgctaaaagtggtagttgcgctcagctcaccatttaggcttagcgtgcatccatcgttaagcacagcttcagtgcgcttagcacgacagaagaatctggcagagcatcaatatcaaggtcgcgctaagcgcgagatcagtgtgctaagcacagcgttattctctactcttaatctcatttgtgttagggtttttctctatgactggctaagcactcttgttgggaatttctaa

SEQ ID NO: 113805 - DNA, 171 bp, Glycine max
  Peptide Sequence Number=SeqID_230583
atgaggctactactgtgcagagagagtggggaccacaaatactttttgcagcatgtcttcagagaatacttgaggattgagtatgttccattgcttttgtactgtgagccaagtgctaaagcacttgacttcataggactggtcactagagctgtatcatccaatgactaa

SEQ ID NO: 113806 - DNA, 1881 bp, Glycine max
  Peptide Sequence Number=SeqID_230584
atggaagaagatcatcaagaagtgaaacacgtgtgcaagttctgctgcaagagcttcccttgtggaagatccttgggtggccacatgaggtcacatgtcaccaccaatgtttcaaccgaggcagataagctttcatcattcaacaacaatggaggaggagattctgaaggaggaactaacaatggaggaggagggtatggtctgagggagaatccaaagaagacttggcggttcaatgattcgagtgaggacaacaacaacaacaacacaactttgttggtgttggacaagttgtgcaaagagtgtggcaaagggtttcaatcttggaaagctctgtttggtcacatgaagtgccactctgagaaagtgtaccaaaacaacaacagcagcagcagcttgttattggaggatcaagattcgtggaatggtaataacaccaccaatgctagccagagccagaagatgatggtgtcgatggatgatagccactctgagaatgaggccacggctccgaatcgaaggagaagatccaagaggagaaggacaaggtacatggccccttcaacttcttctgtgtcccttgtttctgaggctcatcatgagcaggtgcagcaggaagaggttgcaatgagtttgctgatgcttagtagggatgtgagtccttggtgtggtctcaattctgttaattcaatgcagtttgaatctccttctttggttcctacctatttggattctaaggttgagggaaaaagggttgttatctccaatggttatgagaaaaaggttaccaaaccaagggatatgatgaagggggagtttggaaatttggattgttcaaatctcaactcaaaaggaaaaacgagttcagagcttttgggtactactcagagtcctggaagtggatttggggtcagcaagaccatggtttctaattctgcatttgaggacaatggaacagataataatcataatagtaacaataagtacacttcaatcaaggcaaagtttatggactctgagttgaagtcaagtcctttgaagagttgggtgaacaacaacaagaactcagaaggtgaattcagcaaaagctccaataagagaggaaagtttgagtgcactacttgtaagaaaatcttccactcatatcaagcacttggaggccacagggctagtcacaagaggatcaagggttgctttgcttcaagaaatgagagcagtgagaacagcactgagttggaggcagaactctccccagaccctacaacagaaagtaagctcctgaagaatgagtatgtggaagaacatgaaatggttactaatgttactactgctactactactactcaatttgacaatgaggttgaaacagtgagagattccaagaaggggaaagggcacgagtgtccaatttgccacaaggtttttccatctggccaagccttgggtggccacaagagatctcatcacttggctggtgggtctgagagtgcaagaaattttcaaagtcaaacaattgtacttgaggaagcagcaccagaaattagggacttttttgaccttaaccttcctgcttctacagaggaagaaggtactagccatggccatgctgagcattacagaccttggtgggtagtaggaggaaatcacaagcaggaagcactgggccaactacatggtgcagcttacaaaacggcacttgttggcagagctagagggtttgataactggcacagtatgggagaggctttgatttacttagctgtagtagctggcaatgttgcattgctttgtcaactagcacaaggtcattgcataaaggctagaaagagatggttcgtctgcttgttcaacaccatctttttctatatgaccttgcactga

SEQ ID NO: 113807 - DNA, 312 bp, Glycine max
  Peptide Sequence Number=SeqID_230585
atggagcccatcttgtctatgtcgaccctgatgtcaatcagctctagatttcaggttagcacacagtctagcctcagacccgagacacccccagagaactccaatcctctcctaacatctatgccaagcaacgacactttccaacaactccaagcccgtattgtgaagatggagcaacaccatgagaaggaactcataaagatgaaggctggccacgatgagttgaaggctagtgtgagacggccccaggaggacgagcacttcgcccacacgattcatgatcatactcagggggaatcacacccccgataa

SEQ ID NO: 113808 - DNA, 684 bp, Glycine max
  Peptide Sequence Number=SeqID_230586
atggtcatctctgttgtcatcgcccatttcatggtgtccaaggtccttattgaccaaggcagttccatggatatactttattggaatacattccagaggctcaaagtctcacctgatacaattcaaccatactatggaccacttctcgattttacgagaaaaatagtagaaatcagaggttacatagacctaataaccaactttggtcaaggcaagctctcatggagattcattgtcgggtacttaattgttgaagatgcgtcttatttcgctttgattggcaggataacattaaatgagcttggagctatcgtgtctactccacaccttaagatgaaggtcccaatatttactggtgaaatcgtaactatcaaggtggaccagaagcaaacccgacagtgctatgtcgaaagccttaagcctcatcccacatctggtggtagcaatcaagtcatgagcgtggacgaagaatctccaaaaaagaccctggtcatctacaaagcaactacaagagaccaagatgacatattcgatgtagatccgcacaacgacactattgaaaaaggctcaaaaccaatcaaagaacttgtcaagttacaacttggacccgaacctgggcaatacactcaactcagtagggacctcaccagccacaagaacaaacacataactgaagtcctatga

SEQ ID NO: 113809 - DNA, 228 bp, Glycine max
  Peptide Sequence Number=SeqID_230587
atgccgatgtctattgttgcttcagagtctgcttttagcactagaggtagaatgcttagttgttacaggagttctcttaccccaaaaattgttgaagctttagtttgtacacaaaattggtgtcaatcttccccattgacaatggaggatgaatttaataatcttaaacaagaaatggaaccaatccaacaattgaccgaagataattcagatgttgaatctgattag

SEQ ID NO: 113810 - DNA, 513 bp, Glycine max
  Peptide Sequence Number=SeqID_230588
atggaagccatgatgagtatgagaaaaatgatggaggtcaacacggctacagtcgttgccgcaagtactaccactgaggtggacccgactcacccatctggcattaatcaagcaagtcatccagtcccggatatggtaggtcagggaggtggagcattgggaagtacaagcggcccccattttgtgcaggtccctcaacccatgggggagacatatgaagcaccccgagaccacactctagccgactctgagcctcacctcggatatgccactgaggggcaggcttttggtggcatacccctgccaaacactttgggggggccctcggtatctgccacaaccacaacccttacattttgtggtggaaagactacttcctaccatggaggcagaaattatgcctttgctgacatggtagagttgtgcctagtgcccgacgtggtcattcctctgaagttcaaggtgccggatttcgataagtacacgggactacttgccccaagaatcacctga

SEQ ID NO: 113811 - DNA, 252 bp, Glycine max
  Peptide Sequence Number=SeqID_230589
atgcttcgacgaacacaaggttcaagatcatcacaggatccaaacacaaacatcacacagggatgcaggatccttgagtggattcttgcactcaagatccatttttgtcaagatccagtagtagagaaagagttaggatctccatggtggaacaatgggtcttgcacaagaatcctcaagatctcagaagatgtgacttgcttaacggatttgggagggaaacaacaagaaaaagatgcaaaggaagaataa

SEQ ID NO: 113812 - DNA, 1815 bp, Glycine max
  Peptide Sequence Number=SeqID_230590
cttgagaaagagcatggtcttcatgttgatcatgatcaatattcagagttggctgcagaagccaaagaagtgaaagggaaaccagacgcatatagccttgtttcatgtgctgcatttgctatcatgtctttggctttaacaagattgagtcattttggttttgaggttgatctcttacactttttcagtggagtcctaacaatacaactcatgaaaataaagttatggttagtcattgttggagggagtttcagttattccctcatcattcttcgttcctctttggttgctccaagaagtgggtatcatggactccaagaccgagatcacgatcatgtagtcattgaatttggttcacattcacaatcgcaaagaaacagaaccagtcctagtgttactcaagtggattcgccccaggctattgtatctgtggcacaagaggctgattcccctccagaaaatgaggatcaaggattgttagtcactcaatcacaaggcaacagtgacagtgaagataatagtaatatagtggcgcagttcatgagttgtataggcacgcttaagaaggagaatcagaaccttatcctcacgatattcaagcatgtagatgaataccttaaagctgattatgtcattaaggaccataatattcaattgctcaagttgcataaggacgacaacttggtggcggattccttgccatctgaaattattaaggaccttcgtgaaagcacaaggctgatggtgacaacagggttaaaggaggaatgtttacatgtgtacagtacatgccggagggagtttctgagtgagattctatccgcattggaagagctcaacatgaaggacattgacgaggtggcgaagatgcggcatgccataaaagttatgtgtgtagctaataggattgtactacccaatgaaaggagactctgtgaaaaggtctttgaagggttcattcactgtgaggatttgtaccctgcattacgaagaatagatgtgtttcagttctggaagaaccctgtattacccgtaatagatgcagtcaggttgtgggagagtataggcattcagcctccaatatacagaataaatgagtccaggtttgacgacttgttatatcttacttatagtgttaaggagcaggccagtgttcccagcggcaggaattatcggattagcattgatgtgttggactacattgagattttatatcagaattggagaggtttattcaaaaccatgcttgataaagagggaaagttactgtatggacacatagccatgattacagacctattagacagcagtttggaagccatctccaaaaattacaatgaccctagtttgggttaccttttcatcatcaacaataggaggttcatagagataagtgcaaaacggcgaggattgagtcctatttttggcgatgattggcttcgaaaaaacacagcaaaattccaacaaaaccttgaactctatcaaagaagctcgtggagtaagattctgaacattttgaaactggacatcaatgagtcagagcctaatgttgcagctaagttaatgaaaaacaagctttgttccttcaatgaacacctggatgatatatgcaacactcaggctacctggtctgttttaaatgaggagttaagggaacaaataataaaatccatagaaaacatcttgttgcctgcatatggaaacttcattgcgagattgcaggattttcttggtaatcatgcttttgagtacattgagtatggaatgtttgacattcaagatcgactcaataatttgtttcttgtaagaatgtag

SEQ ID NO: 113813 - DNA, 282 bp, Glycine max
  Peptide Sequence Number=SeqID_230591
atgagggaaagaaatattctcactgctagactagcagtcttaagggagaaagaattggaaaatgagcactacgatattctaatgaagggcacatctacaatgtccgaaagtcaactccaagaccatcaagccttttgtaaaataattaggtgtaaactagtgaaaaatctcgtcgagcgcccaggagtacatgacaaaacataccacacactggtaattcaagtcactctcactaggattaaaggagcacttgaaccgggtgtatttatccccaaggtgtag

SEQ ID NO: 113814 - DNA, 447 bp, Glycine max
  Peptide Sequence Number=SeqID_230592
atgactcaattgagacagcttagcagaggggaatatttgtcaaatctcacgtatccactatgggtaacaaaaagagtctggacatcatggtcagggcccaatgttgcggctgagttaatgaaagacaagctccattccttcaatgaacactttgatgaaatatgcagcattcaggctatgtggtttgcatatgaggagttaagggaacaaataataaaatccatagaaaacatgttgttgccagcatatggaaacttcattgcaagattgcaggattttcttggtaatcatgcttatgagtacattgagtatggaatatttgacattcaagatcaactcaataatctgtttcttatggggtactcctcgaaatcagtatcaattacctacatgactgtaattttgcgcaaagggttaccaaaaggtttctctccaagaaaagggtag

SEQ ID NO: 113815 - DNA, 159 bp, Glycine max
  Peptide Sequence Number=SeqID_230593
atgaaaattgggatgttcaatgcttcaacatcctatcatagaggaggtatgacaaatgcagtagggaatgtttacgcaggaggtatgatgaatgcgaatttcaaagaaaaaggtgagctggagctcgcccaggcgagccgttgcttcaacctgaagtaa

SEQ ID NO: 113816 - DNA, 111 bp, Glycine max
  Peptide Sequence Number=SeqID_230594
atggaggatggggtcgtgacggaccaatgttccccccttcccggcgttgggttagcggagaacgtcgctgcaaggcaccccggttcgggtaggcaaaatgctaacccataa

SEQ ID NO: 113817 - DNA, 1329 bp, Glycine max
  Peptide Sequence Number=SeqID_230595
atgtcccaaggagaagcagagcattcaggaaaggtggcttgcactgcaacaaatttcaatggtgatgagcatagttttagttgtgaacagacatgcactgagaaaactaagactgcccctcaaatgaaatttgatgctcaaagtggagagaggaaaattggtgagagaggaaatactaaacaacatctgaatgttgcaataaaccccgaagaaagcagggaccaaatgtcatcaagccaaggtgattacagaaggaacacaatagcagatgaacctgctgcagtgcaagaagtggggaatatccagaaaccttctcaaagggctcatagaaagatgttgagaggatcagaagagaaagagagttggaaaaagatggaagaggagatggagagagaaagggaaagacagaaagacaaaatggctgttgatagtgcaatgctagaggctgagagggaaaaggaaaaagaaaaagataggatggcggttgataaagcaactttggaggctcgtgatagaacatatgttgatgctcgtgagagagcagaaagggctgcatttgagagagaacctacagaagctcgacaaagagcgctggctgaggccagagaaagacttgaaaaggcatgcactaaggccagggacaaaacatatgctgataaggcagctgcagaagccagattgaaagcagagcaaactgctgtagaaagagcaactacagaggctcgagagtgtgcaatggacaaagttaaggttgatagagctgcatttgagtccagagatcgattagtaagatctgtcactgacaaatttagtgtttctttcagatatggtaggagacagggctcttcatcctcaaacgagaaggtgaatcagctcagaggtgtagagctagactggagaggtattgccgaacagctgagcgtgcaaataaatgagattgaccatgagttttttgggaatagattagcagaaaccctggatactgaagtcaggaggtggtcaagtggaaaagaaggaaatttgcgtgcattactttcaaccttgctatatattcttgggcctgatagtggctggcagccaatcccactcacggacgtcattacttctgccgctgtaaagaaaacttacaggaaggccaccctttgtgtccatcctgacaagttgcagcaacgtggagcaagtattcaacacaaatacatatgtgagaaagtctttgatctcctaaagcatatgaaagtatgcaaatactcaaacatgccgataaatgctcatgtgcttggcgaggttggtatctggcaccttttaccaaacctcctaccccaagcttga

SEQ ID NO: 113818 - DNA, 318 bp, Glycine max
  Peptide Sequence Number=SeqID_230596
atgtatccggaagaaattttaggcacagcaggaggaagtttcggaatgagaatgttagtaacttccggaaaaagtgattccggaagtgttttccgaaagcacttcttccggaataggccttggtataatggtataatattaaatgatttaggtgtagtaaatttttggatgtggttatatgataatttgaatgtacttgtgtatgatgcatatgtccttaagatggacgaagatcaatggaggtatgactttgcgatgtcacaagaagttcatatggattatgattatgataatcaagaagaatgtgggggtgaatga

SEQ ID NO: 113819 - DNA, 480 bp, Glycine max
  Peptide Sequence Number=SeqID_230597
atggcggcaaatggaaacaacacctttgtagccaaccagatagtaccaccattggggcaggcagccaactggtttggcatgcccgccataggaacccttgaaaatgagatcccaacaaccatggtgaagatcccgtgtcagatggaaaacctccaaaaggagaatgttgtcctttgggaacaataccagaagctcccgcaggacaacaacatgcatttgatctcggcagttggcacccatcagactcatatgcctgagatcgatgaagccgacaagactattcccgataaccccaaggggagcaacacttcattggtatacctgtctactggaaaaattgatagactccttgtaatgcagattacacgtttcggagcccaagatgcaacaagccacttgtaccacctaactgtagtggctcttgcaaacattcggcaagacgaggaagagtcactatattacttcatggagaaaacttaa

SEQ ID NO: 113820 - DNA, 1737 bp, Glycine max
  Peptide Sequence Number=SeqID_230598
atgcctacgatagatgagctacttgatgagatcggaacaacatcgtgcttctcgaagttggacctccgtcaagggttccatcaaattcatcaaattcgaatgaatgaagaggacattcccaaaactgcgttccgcacccaccatggtcactttgaattcaaggtggtgccatttggtctgacaaatgcaccctcgacatttcaggccaccatgaacgaccttctctggccatttctacaaaagttcattgttgtcttctttgatggcattctcgtctacagcccttcatttcatgcgcaccttcaacacttgcaggccatcttggttacgctctcacagcgctccttctatctccgctgttccaagtgtacttttgccgaacagcaactgaattatctcggccacatagtatcctcgcaaggtgttgctccagaccctgagaagattcacgcaatgaccgcttggcccacacccacaactccttcggacctcaggagctttttgggtctcacggggttttatcgtaagttcattcgcaattacgccaccactgttgccccgttaacagctttactctgtaaagacagcttcatgtggatgcctgaagcttacactgcattccaacatctgaaaactttaatgactcaggcccttattcttgcttcacctgacttcacggtgccattcattttggaaaccgatgcttccggcaccgctatcgggccagtcctgctccataagtcacgacccattgcatttttcagcaaacaactatgcccaaggagaggcttcgacttacctccgatagttgcatgccatcacctctgtggtgcgaaaatggcatcactatctgctagggcacaacttcattatcatgacagaccatcggagcttaaaagagctgatgtcacaggttatcagacccccgaacagcagcgctacttggccaagcttcttgggtatgattataccatacaatacaaacctggcgagacaaatgtggttgtggatgctttatcgagggtccaagcgcaaccctctctaatgcttttatcggcacctcactccatcttcatggaacaactccaacattcatgttcccaagatatgacataccaggagttgcttcttaaggtccaacaaagtcctactgaccaccccggcttcactgttaaacataataggttactgttctggggaaagatatggctccctgctggtcatgatctctccaaggtgctcctcgacgaatatcacaacaccccgttaggcggtcacatgggtgtttcaaaaacgctccatcgtattcaacagcatttctggtggcccaatatgcgccaagatattcgtcaatatatcgttgcatgcattacttgccagcaaatcaagacggagacatgcaaaccagcaggccttttgcaaccattaccacctccttcatcactttggagtgatctatccatggactttatcacgggtctcccggcttcgcaagggtacaccaccatcatggtcgttgtcgaccgatactccaaaggcactcactttggaccattgccaacacactacactgcgcataaggttgctttattgttcatggatattgtctgcaagcaccatggttttccccgtagcatcatttcagacagggatcccatcttcattagtggattttggcgagagcttttttgtatcagtggaaccaagctgcatttcagtacagcgtatcatccgtaa

SEQ ID NO: 113821 - DNA, 1974 bp, Glycine max
  Peptide Sequence Number=SeqID_230599
atggtcttcatgttgatcatgatcaatattcagagttggctgcagaagcgaaaggtatggagatttgtgtgtttcttttcatctgttgttggactgctctgttacgctttcagctcttctttcaataatctatttggaaagtggacatggtggaagatattactttacattggttttagtttcattatctgccttactgtcttgtttgcaaaggtttgggagtgctccacctctcctcgggtggaagctcacatggccttttttattttgatgatcacttctgtgtatgcttttttcttcgataaagaagtgaaagggaaaccagacgcatatagccttgtttcatgtgctgcatttgcaatcatgtctttggctttatcaagattgagtcattttggttttgaggttgatctcttacactttttcagtggagtcctaacaatacaactcatgaaaataaagttatggttagtcattgttggaggaagtttcagttattccctcgtcattcttcgttcctctttggttgctgcgagaagtgggtatcatggactccaagatcaaaatcatcatcatgtagtcattgaatttggttcacattcagaatcacagggaaccagaaccagttctagcactactcaagtagatacgtcccaagctattgttatcatggcacaggaagctatttcctctccagaaattgaggatctaggattccaagtcactgaatcacaacaaagaaataatgatagtgataacaatagtattgtgacacagttcatgggttgcatagaggcgcttaagaaggagaaagagaaagttattttcacaattttcaagcatgctgaggaatacctcaaagctagtcttgtccagactccagtgctgcaattgcattgcgatgacaacttggtggtggattctctgccatcagttattatcaatgaccttcgtgaatgtgtaaggctgatggtgacagcagggttaaaggaggaatgcattgacgtgtacattacttggcggagggagtttctgggtgagatgctatcatggttgataaagctcaaaattgcccggttttatataaaagctttgtgcgtagctgataggatattattacccaatgaaagaagactatgtgaatgcgtctttgaagggtccattccccatgaggataaataccctgcattacccggaatacatatgttcgggtttcggaagaagttggacagttatcctggattgcccgaaacaatacatggacgtaagttcggggaattgttaagtcttacttacggtgttaaggagaaagccattgttcccggcggcagggttcatcagattacccttgatgtgctggactacgctgggattatagatgaacagttaacagacctgttagactgcagtttggaaggaaagtttccactgaataacatagccatgataacaaacctgttagacagcagtttggaagccaactcccaaaattaccatgatcctattttgagttacgttttcatcatcaacaatcgaagctacatacggcgaagggcaatgcggggtggattgagacacattcttggaaatgactggattcgaaaaaacacaactagtatcaaagaaaaccttcaactctatctgagaagctcatggaataagatcttggatattttgaagctggacatcaatgagtcagagcctaatgttgcggcacagttaatgaaaaacaagcttcgttccttcaacgaacacttcgacgatatatgcaacattcagtctacgtggtttgtcttcactaaggagctaaggagaaaaataatacaatccatagaaaagatcttgttgccagaatatggaaacttcattgggaggttgcaggattttattggtaaccaagcttatgagcacattgagtatggaatgtttgacattcaagatagactcaacaatttgtttcttgtaagagagtag

SEQ ID NO: 113822 - DNA, 799 bp, Glycine max
  Peptide Sequence Number=SeqID_230600
tggtagtggcctttcacccttcgagattatgtatggcacagcaccaccagctccacctttctattctgccggaacttcaactgtggaagcagtagacgctatacgcactttcgcgggatgtcattcaccaaaccctcacacgcaagctacaaaaacctcgctccaaccagcctatactaagctctccaaaaggttctatggaccttacaggattcaggcacgggtgggcaatgtcgcatattgcctacagctgccacccacttcgaagatccacccagtctttcatgtctccctcctgaaagcccatcatggtcccattccactggacgtacctactttgccaccatttagcactgctaatcatccaatagtgcgcccactacagctgttggactggaaaatggatgagtccactcagccacccactccacaggtcttggtccaatgggtcgggttagcacctgaagataccacctggaagtattggccacagcttaaagacatttatgaccttgaggacaaggaattgcttggatcttttattacagaacacgaggatctagaattcctagtccctcaatcacaacaaggcaatcgtatcgtggtgcagtttctaggacaagattctgaagagtttgggcaatttgggggtcttgtgtatctatcttatgagaaaatcactgttccttgtggcaggcttcatcagattagccttgatgtgttggattatactgatatgacacttcgggattggaatggtttgtttggcaccatggttgataaagaagaaaagttttaa

SEQ ID NO: 113823 - DNA, 327 bp, Glycine max
  Peptide Sequence Number=SeqID_230601
atgactcctaggtcgacagccacaatcgtggagctggaaggaaaaaccgtcaagctgcagattgttagagtgatccttgaaaatggagagcaacatgatggtgatattttaataagagcagatggaatatggtcagaagtatcggtgttcttgggcttgaaccagtactttgttgcttcagatgttggccatggcaagatgcagtggtatgctttccatggggaacccccttcaagtgaccctttcccaaaaggtaagaagaataggcttttggatctctttggtaattggtgtgatgaagtgattgcactcatatcagaaacatga

SEQ ID NO: 113824 - DNA, 1431 bp, Glycine max
  Peptide Sequence Number=SeqID_230602
atgtttggttcaaagaaaactcctctgagagatgctaaacctagttctagtgttactcaagtggattccccccaggctattgtatctgtggcacaagaggctgattcccctccacaaattgaggatctaggattgttagtcactgaatcacaacaaagaattaatgatagtgataacaatagtattgtgacacagttcatgggttgcatagaggccctaaagaaggagaatgaaaatgttattttaacaattttcaagcatgctgaggaatacctcaaagctagtcttgtccagactccagatctgcaattgcattgcgatgacaacttggtggtggattctctgccatcagttattatcaatgaccttcgtgaatgtgtaaggctgatggtgacagcagggttaagggaggaatgcattgacgtgtacattacttggcggagggagtttctgagtgagatactatcagcgttgatagagctcaaaattggcaacacgattaagaccgagttttttataaaagctttgtgcttagctgataggatactattacccaatgaaagaagactctgtgaatgcgtctttgaagggtccattccccttgaggataagtaccctgcattacccggaatacataggttcgggtttcggaagagtttggccagttaccctgcattgcgggacaagttgttgatggatttgaacatttactcagcattacacggaatacgtaagttcggggaattgttaactcttacttacggtgttaaggagaaagccattgttcccggcggcagggttcatcagattacccttgatgtgttggactacgctgacaaaatagataaggattggcgaggttctttgaaccccatgactgatgaacaaagaaagtttccactgataacagacctgttagacagcagtttggaagccaactcccaaaattaccatgatcctattttgggttacgttttcatcatcaacaatcgaagctacatacaacgaagggcaatgcagcgtggattgagacatattcttggaaatgactggattaaaaaaaacacaactagtatcaaagaaaaccttcaactctatctgagaaacccatggaataagatcttggatattttgaagctggatatcaatgagtcagagcctaatgttgcggcacagttaatgaaaaacaagcttcgttccttcaacggacacttcgacgatatatgcaacattcagtctacgtggtttgtcttcactgaggagctaaggagaaaaataatagaatccatagaaaagatcttgttgccagcatatggaaacttcattgggaggttgcaggattttcttggtaaccaagcttatgagcacattgagtatggaatgtttgacattcaagatcgactcaataatttgtttcttgtaagagagtag

SEQ ID NO: 113825 - DNA, 264 bp, Glycine max
  Peptide Sequence Number=SeqID_230603
atgaattgcgttttcgttcatgtgtcctccaccttcgagtttggagcgatgcgtagtgattgcttagtgcaattctccgttctcaacctttttcggagccccgagaattgcgttttcgttcatttgtcctccacgttcgagtttcgagccatgcgtaatgattgcttagtgcaattctgcattctcaaccctttttcggagccccgtgaattgtgttttcgttcatgtgtcttccaccttcgaatttggagccatgcgcagtga

SEQ ID NO: 113826 - DNA, 402 bp, Glycine max
  Peptide Sequence Number=SeqID_230604
atgcataaaccttatgcatatattattaaggctcaatgggataagcatttaaagctcaaacttcatgcaacaacttattggtttaatcatgcattcaggtacaatgagaagtttaataataagagaagggtcatcgattcagttgttgatttacttgaaaaaagaggtttgtgtgagaacctgactcaagtcattagtgagatggagatgtatcaagatcgacaagaaagttttgatcgaccaagtgctcttcctataagcaacacaatccggcctataattacatttcttgatgatcaatggtggtcattatttggaagtagtgctccaattttgaaaaagttggtggaatcactacaaaaagacatgttatgtcctattgactttgaagcaattgactaa

SEQ ID NO: 113827 - DNA, 576 bp, Glycine max
  Peptide Sequence Number=SeqID_230605
atggcaaagaaacttacgatcctcgtcaccgccgccctcatgggcacgacggctttcgcgccgcttgccatcgctcagggcacgacgcagcccgcgccggcaaatcccagcgcacagactgaaccggcgacgccctcagcgacgcccatggctcctgcagcaccctcggccaacgacagcgcagccacgaccaccggcggagcctatctgacggagcagggcgaaacgcaaatcagcgccaatgactatatcggcaagtctgtctatacagcggccgatgagagcatcggcaatgtgacgaacctcatcatggaacaggacggcggtctggttgcagcggtgatcggtgttggcggcttcctgggtatcggcgccaaggacgtggccgttcccatggacaaggtgacgatgacgcgcaacgcgcaggacggcaccattcgcctgacgacgaccgaaaccgcggaaacgctgaaggcagcgccggaattcaagacgctggagcagaagaccagcgagcagaacgcggcaacccccgcggcacccgacagcaccaccacttcggcgacaaagccgtaa

SEQ ID NO: 113828 - DNA, 141 bp, Glycine max
  Peptide Sequence Number=SeqID_230606
atggcgacttgcaacgtgaaatcgccagccatgtctgcgctttcgtccagagcttgccacttgtcgcacatgcatgaagtcgccagttcaactggcgcttcccatgtaggaaataatatcatcgatcctgtcaaagacaag

SEQ ID NO: 113829 - DNA, 1065 bp, Glycine max
  Peptide Sequence Number=SeqID_230607
atggccgacgtccaaaagtcaacgtccaagcttttactcttgagcctggcccagctcgtgcgctatgacgcccaggattggacggtattcgcctccattgagtacctggcgaaagtcacgcacttgaaccgcaagaccgtcattgaggctctggccaggctacgccagttgggggcaatccaggataccctcatgcgcgccggcgagaatcgcagcagcgttgtctatcgtttgtgcccgaacgccgtcccgcgcatcgacatggccacgtcggcgcatcaggcggactttcaaccccccgttgtgggccgccagccgaggttggaattcgacgcatcctcgccgcattctagccaggcttcgggcaacaatactggcatggctgccaatgctgtccacccagccttgtcaagtgagcctgcaaccgcaccctcggtcgatgtcacagctgaccaggatggtgcgcttggagcgagcgccacggcagcccaacccggcacgacgatgccggttgctgcccctgtcgctcccgaagcacatctgccgccgccagtcgtgcccactatagccgctgcatccctcaccgacccagccttgctcagccccccgaacgctggatccgcaggacctgcaacgtctgcgcaaatgcaacgcgcatgcatgcatagccagcggcgccgatcgtcttcggccatgtacggcggcgcaggcgcctcccgcctgcccgcaggctggagccttccagcgaagtggcggttgtgggcacaacgcgaacgtccgcactggcccgcggagaagatcgatgccatggccaccaccttcagcgcgtatatgcggtcgcggccgggcgaagccggcatgtcggaagactggtttgaatcctggcgcctgtgggtcttccgcgaatgggacaagcagtcttcctcgcgcaaatcatggcagagtagttggacgggcatcgtggccaaggggaaggagctcggactcgagcaagctcccaacgagccgccacccgacttcaaagccagggtatttcgcgctgcgggtctggcgccaccgcattga

SEQ ID NO: 113830 - DNA, 252 bp, Glycine max
  Peptide Sequence Number=SeqID_230608
atggcccttggaaccctttattcaggctccctcatgcctatttacagcaaaaaaggggacttggtggacttgcagctcgcccaggtcgacaaaagcggggcttttgctcctacgtaccctcctttggagaggaaatcagacctacgtagttctttctttatgcgtgaatcaagcgattctttttacttgaaaggtgatcattttaaggcgttggaccttaaaaatgatccattttacttggtaagaaactga

SEQ ID NO: 113831 - DNA, 372 bp, Glycine max
  Peptide Sequence Number=SeqID_230609
atgaggaaacaagaagttattttacatgaaatttggagatggaacattgacatccttggccagagcgggtttgattgggatgacactaagtacatgttcacagttgagaatgaaaatgcttggaatgaatattgcactgtaaatagagccactggtcatggagctgaagctgctatggatgctgatgaagcgatgagtagagagacaaatgaagtggaattcatggggttaggtgctactactactatagacttagaagaaccaagctctaatacaaaagaaaaaagacaaggttcaacttcttctggcacacattcattctcacaagacaaatattggagaaaaagaaggaataacagtttctttggatag

SEQ ID NO: 113832 - DNA, 751 bp, Glycine max
  Peptide Sequence Number=SeqID_230610
atggttgttgggatctcattttcaggggttcctatggcgggcatgccaaacaagttggccgcctgccccagtggtggtagtctctggttggctacagaggttgctcacggtgagggaggggggaatacttacaaagacactctaacactaaagttagaggcacagagggttgatccgaagtcaaaactggtggctatcagattctctgttcctgaatgcaaaccttgcttgcttgagaaagaacatggtactcatggccatcaaatggctgcaaaagctgaacatatcgctgggggtcacacaattcccccgaagtttctcaacaacgaagatgaggtgaaagatttcgtcaatcccgcctatgataatttcgagcagcaggataatcttctcaaatattggcttttggaatcgatggataatcaatttcgtaaacatggatcaatcaacgagtatttggtccaaatcaagaagattgtcaaaacccttggtgcaatcggctctcccttaacagatgaagaacacattgatgcgatctttgatggtcttcttgaggagtacgatgggctcatctcttcgtgtctcacccgatccgaacctttcactgttcctcaaatcaaagcctctctcatgcaccaagaagaaagattggagcatcataaacaaagggacaccacccctattcaagcacacactgtccattgtcaaaatcaatcaagaagagggtttcccaacactccttgtggccgtg

SEQ ID NO: 113833 - DNA, 264 bp, Glycine max
  Peptide Sequence Number=SeqID_230611
atgactactcgagctaaatctggtgtctttaaacccaaagctttactgaaaaagatcactcccagatgtaccaaggatgctatgcaagatcctcaatggttagctgcaatgaaggatgaatacatggctctcatgcaaaataaaacatgggatctcgtccctttgcctcctcataggaaggctattggttctaaatggatatatcggctgaaatacaatgttgatggctctgtagccagacataaagctagactagtggcttag

SEQ ID NO: 113834 - DNA, 1074 bp, Glycine max
  Peptide Sequence Number=SeqID_230612
atgaaaataaagttatggttagtcattgttggagggagtttcagttattccctcgtcattcttcgttcctctttggttgctgcgagaagtgggtatcatggactccaagatcaaaatcatcatcatgtagtcattgaatttggttcacattcagaatcacaaggaactagaaccagttctagcactactcaagtagatacgtcccaagctattgttatcatggcacaggaagctatttcctctccagaaattgaggatctaggattcaaagtcactgaatcacaacaaagaaataatgatagtgataacaatagtattgtgaaacagttcatgggttgcatagaggcgcttaagaaggataatcagaaagttgttttgacaattttcaagcatgatgaggaatacctcaaagctagtcttgtccaaactccagtgctgcaattgcattgctatgacaacttggtggtggattctctaacatcagctattatcaatgaccttcgtgaatatgtaagggtgatggtgatagcagggttaaaggaggaatgcattgacatgtacattacttggcggagggagtttctgtgtgagatactatcatggttgatagagctcaaaattgacaacacccagttttatataaaagctttgtgcgtagctgataggatattttacccaatgaaagaagactctgtgaatgcatctttgaagggtccattccccttgaggataagtaccctgcaataccaggaatacataggtttgggtttcggaatagtttggatagttatcctggattgcccgaaacaatacatggacaaaactacacttgaggttagtcaagaaaatgatgatattggctcgattccctttacatctaatgtcctacataatgatcaaggattgtcttgggataggaatgatttagcccgttccatagttgatggaaaaccagttataccttcagaagttgttgaccgcaaagaagaagaaagtgatgatgaaattattgatttagcaaaagatgaagaaaatgattttattgatgaagctaataatagtgatcattattag

SEQ ID NO: 113835 - DNA, 1974 bp, Glycine max
  Peptide Sequence Number=SeqID_230613
atggtcttcatgttgatcatgatcaatattcagagttggctgcagaagcgaaaggtatggagatttgtgtgtttcttttcatctgttgttggactgctctgttacgctttcagctcttctttcaataatctatttggaaagtggacatggtggaagatattactttacattggttttagtttcattatctgccttactgtcttgtttgcaaaggtttgggagtgctccacctctcctcgggtggaagctcacatggccttttttattttgatgatcacttctgtgtatgcttttttcttcgataaagaagtgaaagggaaaccagacgcatatagccttgtttcatgtgctgcatttgcaatcatgtctttggctttatcaagattgagtcattttggttttgaggttgatctcttacactttttcagtggagtcctaacaatacaactcatgaaaataaagttatggttagtcattgttggaggaagtttcagttattccctcgtcattcttcgttcctctttggttgctgcgagaagtgggtatcatggactccaagatcaaaatcatcatcatgtagtcattgaatttggttcacattcagaatcacagggaaccagaaccagttctagcactactcaagtagatacgtcccaagctattgttatcatggcacaagagactgattcccctccagaaattgaagatctaggattccaagtcactgaatcgcaacaaagaaataatgatagtgataacaatagtattgtgacacagttcatgggttgcatagaggcgcttaagaaggagaaagagaaagttattttcacaattttcaagcatgctgaggaatacctcaaagctagtcttgtccagactccagtgctgcaattgcattgcgatgacaacttggtggtggattctctgccatcagttattatcaatgaccttcgtgaatgtgtaaggctgatggtgacagcagggttaaaggaggaatgcattgacgtgtacattacttggcggagggagtttctgggtgagatgctatcatggttgataaagctcaaaattgcccggttttatataaaagctttgtgcgtagctgataggatattattacccaatgaaagaagactatgtgaatgcgtctttgaggggtccattccctttgaggataagtaccctgcattaccgggaatacataggttcgggtttcggaagagtttggacagttatcctggattgcccgaaacaatacatggacgtaagttcggggaattgttaagtcttacttacggtgttaaggagaaagccattgttcccggcggcagggttcatcagattacccttgatgtgctggactacgctgggattatagatgtgcagttaacagacctgttagacagcagtttggaaggaaagtttccactgaataacatagccatgataacaaacctgttagacagcagtttggaagccaactcccaaaattaccatgatcctattttgggttacgttttcatcatcaacaatcgaagctacatacggcaaagggcaatgcggggtggattgagacatattcttggaaatgactggattcgaaaaaacacaactagtatcaaagaaaaccttcaactctatctgagaagctcatggaataagatcttggatattttgaagctggacatcaatgagtcagagcctaatgttgcggcacagttaatgaaaaacaagcttctttccttcaacgaacacttcgacgatatatgcaacattcagtgtacgtggtttgtcttcactaaggagctaaggagaaaaattatacaatccatagaaaagatcttgttgccagcatatggaaacttcattgggaggttgcaggattttattggtaaccaagcttatgagcacattgagtatggaatgtttgacattcaagatagactcaacaatttatttcttgtaagagagtag

SEQ ID NO: 113836 - DNA, 456 bp, Glycine max
  Peptide Sequence Number=SeqID_230614
atgcggattaggctaattaaggaagagaaatccataactgggagagaaacgcaaggaactggaaccagagaaacgacacgcaaaccgaggcaggattttagcgtttcaaagcccccacactttttcagacagctctctctctccctcacgttgccattttcttctccctcattctccattgaagctccaaacaaagcttcaacctttggccatcatttctgccccaaatcgcgaaaggagggcatttttggagtcgtgaagtgcgtggctacgagtcggacttcgaaatttcagcttgggaggattgatggggacccggtgttgagagaaacgaggatatgggctacgtgggagtacgtgagctcagatggaggtgggcaacaggggatggtgggtttatgcgcgcattgtggatgtggaaaacttgttgtgcaccatcgcccgaccgccacctag

SEQ ID NO: 113837 - DNA, 345 bp, Glycine max
  Peptide Sequence Number=SeqID_230615
atgatagttcatatcattagtgtgaggctcctccttcaagggataagcagcaatcactgcacaacttccctttatgctcacgagcactgggtccttatcaactcaagtaactattttgggttgatcaaagtagaagtatcagatgttgagtacaagtgtgaggcctccttatgtggtggctcgtggtccacaggtgtacccctcgaatctccccaacaattggtatcagagccgatggttcaagttgatgaccggctcagacgagtatgcaagtaccgcaggtggccagaatggctagcggcacagcgtgccccgcaggtgaagcggggtggccagaatggctag

SEQ ID NO: 113838 - DNA, 492 bp, Glycine max
  Peptide Sequence Number=SeqID_230616
atgtcgattgatgatcccttacatgatttggttaaggtttcctttgacctttaccaaaagccttatcaagtggcatgggatgcaactttgtttggggtatacaatgatgattccctcttgtttatagattacaatgatgcacaacaaataatcttaggcaatcaatgtctaagcatcactattttacaattttggagaactcacaaagaaagaagaaagatatacctaggagcttacttgaataacgctttgaaggaattctatggcaagtccctcaagagtaaatctaatgttgattggattgaattaaaaagtcattttcaaatcggaggctttgagtgtgactattatgtaatggattggatgcaaaacatagtcaaggggactttgaagaatcaatgggacatgtggattattaatcaaacaccattgaaaccagagagaatggaaacaatttggacagaatgggcaagatatttttttgaatgttag

SEQ ID NO: 113839 - DNA, 1530 bp, Glycine max
  Peptide Sequence Number=SeqID_230617
gcattctttgaagaactcgctaagcgtgcttaccgcgctaagcgagttcatcctttgaggatgaacactcatcctcttgctgaactacctgtggctaagcgagctaagcgagcttcactcgctaagctctcaacacttagtggaatttttgaagatttgatgccgctaagcgcggcgttcaaggagcttagcgcttatcattgtggcagatgccagctaagcggaccatgtctcgttaagcggccagatcctttcgaaaggaatgtggaactttatctttctgagttcaacaagtttaaagtagaattgaagaggcaaaaccttcacaaacgcctcgccaaccttcaggaagggagcatagatgtggtagtggttaaagaattctatgccaatttctatagtccagcagatcaagctcccaaatgtgctagaataagaggccatttaatcaagatagatgcagacaacttaaatgagttcctccagactccagtgttattaaaggagggggaatctttacccacttattctagattttgcagatcaaggtctgatcctagagagatggaggctagtctgtgcattccgggcaagggctttattctaaacacagagggccaaccatggaaactcctcagaaaagattttaccaccctggctcagacatggagcatcttctcttactcaaacctggctcctacctcccacacttcagatttgaacacagacagagctaggttggtctatggcttaatcacaaggatggacatgaacattggtggttttatctctggacaaatgaccatgatggctcaatctaactcttctcacttaggcttcccagctttaatcacagccttgtgtagatcgaggggagttggatctgatgctcttacctcctacgaaaacctaagaccgatcattgacttagcctatatcataaggaactgttggaatacgaatgaccaaatagttaattttccagaggtaaggaagaccaagctcagagcagctgatgttccctcttcctttgcaccaatagttggcatccctgcatcttctacttcagccccacttccagctttagaactggctcagcaaaggccaattatgagtgtagagcagttcattgagaaggtggcctggcctggagcccgaccttcttttgtgggggataatgaaagttttacagcccaagcacctcaacaccatgagctagagccagaaaatgatcactcatttgaagccatcatccctggagctggtgatttttcaaaaagaagattagagacgagatctagtgaggcagctcatcctggaccaacgccagtattagctgatgaaccatttccaggagtggatccatcttcacctcagcatgcagcagactcttccactcctatcttagagatacctgagggccagaccatagcagtcctggctctggacacttctcctccagctactccagtattgcatctgacagataaggaggatgttcagacacaggatatccaggaccagtcatag

SEQ ID NO: 113840 - DNA, 126 bp, Glycine max
  Peptide Sequence Number=SeqID_230618
atgaaagatactaaggtagtcattggagcatcctcagatttttcccatattaaggaactacggttacaattttctatgggtactacacttataagattctcaatctcgcacttaggtggtaactaa

SEQ ID NO: 113841 - DNA, 508 bp, Glycine max
  Peptide Sequence Number=SeqID_230619
atggagaagatgaatgtgcacgaaacaacaagggggaccgctaaggttgcaactcgcccaggcgagctgaaacttagtgctaaagcaatgagcttgcccagacgagttggtttcttcaccatgaagctatttggtggcccaggcgagctagaggctagccttggtaccaggatgatagctataaatagatcatgttgggattatacactcatgattgcaaatcacaagaacatggttgtcgaagtattggcaatcaaagtttctattcttgcgaacatagggtcgaaccaagcacatgcttttaagaaaaggttttcatcaagtgaaggaaagaacacgcttttattgtgcccttaccgaacccgtgctagagctagagtaatgagtgaaatagaggaggtgcaagagcagatgaaggctgacatggaggccatgaaagagcaaatgaccacaatgatgagtatgagaagcatgatggaggtcaatgcggctacagttgttgctgcaa

SEQ ID NO: 113842 - DNA, 1196 bp, Glycine max
  Peptide Sequence Number=SeqID_230620
atggtcttcatgttgatcatgatcaatattcagagttggctgcagaagtcaaaggtatggagatttgtgtgtttcttttcatctgttgttggactcctctgttacgctttcagctcttctttcaataatctatttggaaagtggacatggtggaagatattactttacattggttttattttcattatctgccttactgtcttgtttgcaaatgtttgggagtgctccacctctcctcgggtggaagctcacatggccttttttattttgatgatcacttctgtgtactcttttttcttcgataaagtagtgaaagggaaaccagacgcatatagccttgcttcatgtgctgcatttgctatcatgtctttggctttatcaagattgagtcattttggttttgaggttgatctcttagtctttttcagtggactcctaatattacaactcatgaaaataaagttatggttagtcattgttggagggagtttcagttattccctcatcattcttcgttcctctttggttgctccaggaagtgggtatcatcatggactccaagaccgagatcatgatcatgtagtcattgactttggttcacatgcacaatcgcaaggaacaagaaccagtcctagtgttactcaagtggattccccccaggctattgcatctgtggcacaagaggctgattcccctcaagaaattgaggatctaggattgttagtcactgaatcacaacaaagaattaatgatagtgataacaatagtattgtgacacagttcatgggttgcatagaggcgcttaagaaggagaatgaaaatgttattttaacaattttcaagcatgctgaggaatacctcaaagctagtcttgtccagactccagatctgcaattgcattgcgatgacaacttggtggtggattctctgccatcagttattatcaatgaccttcgtgaatgtgtaaggctgatggtgacagcagggttaagggaggaatgcattgacgtgtacattacttggcggagggagtttctgagtgagatactatcagggtggatagagctcaaaattggcaacacgattaagaccgagttttttataaaagctttgtgcttagctgataggatactattacccaatgaaagaagactctgtgaatgcgtctttgaagggttcattccccttgaggataa

SEQ ID NO: 113843 - DNA, 567 bp, Glycine max
  Peptide Sequence Number=SeqID_230621
atgaaggtatcggtgttcttgggcttgaaccagtactttgttgcttcagatgttggccatggcaagatgcggtggtatgctttccatggggaacccccttcaagtgaccctttcccaaaaggtgatgcagcacatccaatgcaaccaaatcttggtcaaggagggtgtatggcaatagaggcctctgattttgtgccaaaagttgtggatttagcagccagagaattaatagcaattgcatcaccgggacaaggtttaatctggcttgaccatgccaagacatccacggagtctgcagttgtaatgaatttagagtccagatgtctaggaattcgtcctggagttatggatggggccatcagtatatctgctgttcagaagcacggatctacggaagatttctcaagccttccttacatttgcacattgcttaattgttccttatggacttactatggaatcataaaggctagagagtacctcgtggctactgccgatggctttggcattgtggtggagacaatctatgttattctatttctcatatatgctccaaaagggataagg

SEQ ID NO: 113844 - DNA, 516 bp, Glycine max
  Peptide Sequence Number=SeqID_230622
atgcagcgtgaattgagatatattcttggaaatgactggattgaaaaaaacacaactagtatccaagaaaaccttcaactctatctgagaaactcatggaataagatcttggatattttgaagctggacatcaatgagtcagagcctaatgttgcggcacagttaatgaaaaacaagcttcgttccttcaacggacacttcgatgatatatgcaacgttcagtctacgtggtttgtctcaactgaggggctaaggagaataatgatagaatccatagaaaagatcttgttgccagcatatggaaacttcattgggaggttgcaggattttcttggtaaggaagcttatgagcacattgagtatggattgtttgacgttaaagatagactcaacaatttgtttcttatccagtatagcaattacctatatgactgttatttggtagtaagggttaacataggtgtctttccgagtaaaggtagcacatcaccagttgtaccattaccgttcgagtag

SEQ ID NO: 113845 - DNA, 154 bp, Glycine max
  Peptide Sequence Number=SeqID_230623
agtcatgttcaaacaggaaattatgagtgtggatactatgttatgcaatggatatggtgcatcataagtggtggattgaaggatgactggattcacggtggtggtgacaaggactacaaggaggtacccccacctcctttgtttaaacctgcag

SEQ ID NO: 113846 - DNA, 219 bp, Glycine max
  Peptide Sequence Number=SeqID_230624
atgtcacactctggtccctcgtcatcacgttggactagcctcaatgaggaactagagcagcttcttgcgaatgtgcctaaattaacaattgaagagcatggagaatggagggaaatggcaaacatgatgcagaatgtcgcggctccaccagaggctttttttccagaccgttcacgcctgggaccaggtcatgttcattttgatttaattaacatttaa

SEQ ID NO: 113847 - DNA, 450 bp, Glycine max
  Peptide Sequence Number=SeqID_230625
ggcctgggccagcggccggttcttgaagtcggacagcgacgacaggtcgcggtcgatcaggtccgggttgccgctggccagcacctggaagtcggcgtcatagacgaaggcgtagcggcggtcgtcgagtttcaggcgattgatccaggcgcgcgccatgcccttggccgcgccgggcgtcatgatgccgcgctcggccatgtcggcataggcgttcagggccgcggccaccaccgtgccgctctgcatcaactgccgccggccgctgcgcaccgtggaaatcttgtccgccagcagggcgccccagcgcgcctcggcatcccgcagcaccagttccatcacgttgctgacggcgtggcgctcgctgttgaccaccgtgcgcgtgacattgcgctgggtggtcagcatcacgaatgccgcgaccgccaggagcagcgctacgaccagtag

SEQ ID NO: 113848 - DNA, 1005 bp, Glycine max
  Peptide Sequence Number=SeqID_230626
gcggctgaacggcgcctcgacgccacgcagccggtccacttccagcccatagccgagcacccggttcaggtcgcgctgcaggccctcggccaagaggccgacgttattgcgcgtcacgtcgagccagccgctgcggaaagtggaaatggtgtaggccgcgtacacgccctgtgccagcaccagcgccagcaacggcaccacgaaacgggcccggccgccggcggccagcgaggtcagcggcacaacgtatttgaagaccgccgccaatcccaatccgaccagcaccgtaaccagcaacagcacctgcaggttggcgatgatgagccggcgactggcctcgccgtccttggcggcggacagcaccacggcgcccaccaccttgccgcccgcggcgatcagcggcacggccaccgtcaccccgtcgtcggcaacgccgaccagggcgccggagccacggtgcgccaggcccgccgcgagcgggccgcccgcatccagcgtgcgcgccaaccgcgccgcgccttcgggcagctcgccctgcgtggccagcgcctggccatcggccagcagcaccgcggcgccctgcacgccgcgcgagcccgcggccccatcgcgcaatgtgtcgcgcagaccgaagtactgttcaagcggcttgccaaggcgcaggccgttttcgatattgccggcgacgcggcgcgccaccacctcgacgcggtcggcggtggtatccaccaccagccggttcagcgcggacaggctgagcgcgccgatcaatgcctgcgccagcagcagcacggccagacaggccaacgtcacttcaagcacggggcgacgacgcaacccatcgagcactatttgtattggttcgctacgcatggggccccgccgccgcaaagtatttacacacgggcaccaatggtatttacaattaatgcaaattgcatcttatttcacgccttcacctcatccgccgcctatcgcccccatgtcgttgcgctcgctccgtag

SEQ ID NO: 113849 - DNA, 159 bp, Glycine max
  Peptide Sequence Number=SeqID_230627
atgaagaaggagaaggagacgaaatctagagacccaaggcctagagctcatccccatgtgttcttagaggaagaaattcacaagcttttcgcaaaggttgatttgcaagtcaagcctgacatgaggtttctcatgcctggcatgagacagctagagtag

SEQ ID NO: 113850 - DNA, 636 bp, Glycine max
  Peptide Sequence Number=SeqID_230628
atgggtaaagcatctattgaaaatgtggtggtaatcaaaagcttgttaaggtgttttgaatttgctacgggtttaaaagttaacttttttaagagtaggtgtggtgcaattggggtggatgaaatagatgtaagagctttggcagttaggattgctagtggagtagtgaagaggttagaaagtaacatgagggatttcttgtgggaaaaaaacaagatatggtgggtggagaggcctaggggaagattcattgagtggagggtgatctatttggtggagagagaccttcgaaaggtgtgtggtggtgaggataactataggtggtttgatagtttggtgaggtgtgaggtaggtgagggggataaaataaatttttggaaggatccttggttgagtggtgtgtctttagctacatcacatgttaggctcttcctaaattccaagcaaaaggaggaaagtgtcaataggacggggagatgggaggatgacatgtggatttgggatttttgttggagaaggaggtggtttgtatggaaagtcgatattgtggagaatattaaccatttattagcaaatgtaaaattgctaaaaaaagggagggatgcgtggaggtggaaattgagccaaatggtgtga

SEQ ID NO: 113851 - DNA, 510 bp, Glycine max
  Peptide Sequence Number=SeqID_230629
atgggcccaattttgccagactcgcaaagacccttctttggagagcagaagctcctggctgagaagaccaagaagaagctggaggaagctgcacggtcaggaagcgttgatggcgtgatcgaccctccatcccccatcagacgccacgtgaagtggaagatggcccgcaccaagaaaacaggggagatgacgactgaggtggcaaagaaaatcgctgagaagatcgtaagtcattttcaactaaccattacaattatatttcaatattgtcgcaacatgcccttttgcgggcgtgcgaggcgaggctcacgggtgcgctttccaaaggaggaaagatgcgcggagtcgccaccaacgtttatttgtggaaaacgtcggaaaaaccgaaggaaaccgttcaaaacgaaaattctaagtttgggagttgtatttacgtttgaggaaggtcgacaaaagcggggctcttgctcctacgtaccctccatcgaagaggaaatcagacctacgtag

SEQ ID NO: 113852 - DNA, 249 bp, Glycine max
  Peptide Sequence Number=SeqID_230630
atgtctcttagcaagtcagatggggagtttctcttaagtttcagtcatggttttcaagaaaatgttttagctacaagaaaggtttttagaaatgaatactcctttggtgacatgagttttcgaaggagagttatgatcctaaaagaggagctaagaggtcctcctaaagatgaggatgtaggtaagattaagcaggtggatgtgctcaaggaggagcttggagcatggagtttcttggaggaagtttag

SEQ ID NO: 113853 - DNA, 288 bp, Glycine max
  Peptide Sequence Number=SeqID_230631
atgagatccgcaacaaagtcagtgtctgccccgatgtatccaacatctccagcactagaggaggaagaaggaggctggctagtggtgaccggtggagctactgatggcagcggaactggtgatggagggactggaggtgcatctagagcaactatggctctaacccacctcgatcctaggaaagtaatggaaaggtctactgtattccagcagatcttctggatgtacgccaagttgatcatgggacttaacgacttgaaggtcaaggtgtctaaagtggccccctga

SEQ ID NO: 113854 - DNA, 492 bp, Glycine max
  Peptide Sequence Number=SeqID_230632
atggcctggcacagatatcagaacaacattcacctccgaaagatcctttcagagaggaacgtagagctttcccccaccatgtacgatgaattttacagggagctccaacgtagaaaatggcactgctggctcacacgcctcctagagaagaggatcaacgtcgctctgatcacccagtccagcacctcctggcttggattccctgcattgatcacgacactatgcgatgttcagggggccactttagacaccttgaccttcaagtcgttaagtcccatgatcaacttggcgtacatccagaagatctgctggaatacagtagacctttccattactttcctaggatcgaggtgggttagagccatagttgctctagatgcacctccagtccctccatcaccagttccgctgccatcagtagctccaccggtcaccactagccagcctccttcttcctcctcccagccgaagtcgccagtgcagatgatgtag

SEQ ID NO: 113855 - DNA, 756 bp, Glycine max
  Peptide Sequence Number=SeqID_230633
atgttggaagaattggacaacttttttagcgcacaagatcggctcagtgtgcgtgctcgcttagcgcaaagaaggcccaaagtatattgtggcactgtcacagctcaccttatggaggccattacaacagagataggacaattgctagaatacttcaggatggatttttttggccctccatcttcaaggatgcacatgaccatagaattgaagagaatcctggagaagatcgttgcatcctcaaggaaagattggactgcattcaagactcccgtaggcttttcaccatttcagatggtctgtgggaaggcgtgtcacttaccggtggagctggagcataaggcctactgggccctcaaattcctcaatttcgacggcttactatctagggagaagcaaagattgcagctactggagctggaggaaatgaggctcaatgcctataaatcctccaggcattatacgcagaagatgaagatgtatcatgataagaagctgctaaagaagacctttcagcctggacaacaagtgctactatataattcacgactggggcatttccctggaaagctcaaatctaagtggtccgagccattcatggtcaaacaagtgaagccctcaggagtagtggggctaataaatccagccacatatgatcctgagaagacttggattgccaatggtcataggttgaagatatataatggtggtgatatcgagagactgaacaccgtcatccatctccaggacctatga

SEQ ID NO: 113856 - DNA, 120 bp, Glycine max
  Peptide Sequence Number=SeqID_230634
atggccatagggcttagcgcaggtgtcttgctaagcccaggtgcacatgagtggaagcctatgcaccaacacctcaggaggcataatgtgagatttatgagtggagtgaagtctgtgtag

SEQ ID NO: 113857 - DNA, 225 bp, Glycine max
  Peptide Sequence Number=SeqID_230635
atgttcctcttggtgtgggttcggcgacaagcaacggcggctcatggtgaccaccggtggtcatgggtggtgaagaagaagatatcgcttagccagctcgtctcgctaagcaggagtccacttttcgcacttagtgcgacaattcgcgctgagcacaactcccttgtgctaagcgcgacaattcccactcaatgcaattctttctccgattggaattgcgcttag

SEQ ID NO: 113858 - DNA, 545 bp, Glycine max
  Peptide Sequence Number=SeqID_230636
atggcgtttgaaatcgctccgaatttatccacagctttccccaccccctgggggtcggtaatacagagggtttcgaggggcacggaaccacatgcgtttcacactgcagcgcgaagcctttctcaagccgttggcacaggtcgtcaacgtggtcgaacgccgccagacccttccggttctggccaatttcctggtccaggtgcagaacggccagctgtcgctgaccggccggtcgcaatcgcttcccctggccctctgccgtccaatgacttcccgtcggtggacgaagtggaagccaccgagcgcgtggccatcggcgaagcaaccctgaaggaactgatcgagcgcaccgctttcgcgatggcccagcaggacgtgcgctactacctcaacggtctgctgttcgacctgcgtggcgatgcgctgcgcaccgttgccaccgacggccaccgcctggccctttgcgaaaccgacctggccaagcccagcggttcgaagcgccagatcatcgtgccgcgcaagggcgtgaccgagctgcagcgcct

SEQ ID NO: 113859 - DNA, 153 bp, Glycine max
  Peptide Sequence Number=SeqID_230637
atggccgttttaagttttgctaaaaacaagttcccaaaagttttgtctctctcaaatactgccacaccaagtgctcctgcaaaacacaaagctggaacaatcgctaaacagggaatgcaactgaaatgcaaaacagaacgctacacaaaataa

SEQ ID NO: 113860 - DNA, 1395 bp, Glycine max
  Peptide Sequence Number=SeqID_230638
atgctgcaggcggcgcggctggtccacgtgatgctgcgcgaaatcggtttgcgcagctggctcaagaccagcggcggcaagggcctgcacgtgttggtgccgctgcgccggcagtacgactgggacacggtcaaggtgttttcgcaggccatcgtgcaacacctggcgcgcacgctgccgcaggtgttcgtggccaagagcggtcacgaagaaccgcgtcggcaggatcttcgccgactacctgcgcaacggcttcggcgccacgacggtggcagcctggtcggcgcgcgcgcggccgggcatgggcgtgtcggtgccgctggcctgggacgagctggacgaggtccgggccagcgaccagtggaccatcgccaacatccacacccgcctggatgtgggcgacgcgccctgggacgactacacgccgcaggcgctgggcgcagccatgaaggcgatggacttcaagccggattcgggcggttccgcttcggcccgggcgcgcgtaccgatgccgaacacctgcgcgacgatgcccatggcgacgatgacgccggccaggatcgaggtgtagaccacttcgttgcggtaggtgccttcgatcaccatggtgacgagcgctgcgacaatgcagacgatcaccgcgtacgtcagccacggaaacagccacatcctgaattccagccgcacgccgcgcgcctgcaggcgctggcgcatgcgcagctgcgagaaggcgatggccaggtagacgaacagcgcgatggtgcccgtggcctgcatcaggacgtcatagacgtccatcttcgaggtggccatcatccagaccgcggcgaaggcgaacaggctggagatgagcacgcccacatacggcgtgccggtcttgcgcccggtgatctgcatgacgcgatgggcgtcgccgcgccgggcgagcgaatagagcatgcgcgaggcggtgtacagcgccgaattgaagcagctgcataccgaggtcagcacgatgaagttgacgataagttgcgcgtgcgggatgcccagcgcgtcgagcgcgacgttgtaggtgccctgggtcggctccgtgaggcccggcgcgttgtacggcaccaggcagaccacgatgaagatcgatcccacgtagaacaggcagatgcgccacaccaccgagcgcgtggtcttgatgatctcgcggcccgggtcggccgattcggcggcggccacggtgacgatctcggcgccgatgaaggcgaacatcacgcccagcagggccaccaccacggacttcgggccgttgggcatgaagccctggctggtcaggtggctccatcccttggcgtcgccccacggccacaggtgcgccagcgccaggctgcccatgaccaggaacagcgtgggatcctctag

SEQ ID NO: 113861 - DNA, 406 bp, Glycine max
  Peptide Sequence Number=SeqID_230639
gttgctatccattttcattcttctttttccgcgcaaggatggcgatgttgatttaaatgtctctcctcaagcactagataggctattgggttgtttccttgcattcaaagtgaaggtgcaaccaaggttcaggaattctgttgttcttaaatattcagatgaatcagacttgatcaatgttgtgctggatatgattcccgatagtgagccatgttgcaagatcgagaattcaatacttgagttgaccgatcctacagagcttgaatctcaatctgtgtctgttaccgctgatcatgaccgctcaatgcttgactcaagtgagcctacagagcttgaatctcaatctgtgtttgttaccggagatcatgaccctcttctcaggattccattgacaccaactaagcgc

SEQ ID NO: 113862 - DNA, 288 bp, Glycine max
  Peptide Sequence Number=SeqID_230640
atgaggatccacttcttgaggtggattctcccgaggaagtcatgccggcatctgaggcagactctacggaggatagtggcctgggggagatggcgatcagcggaggctctttatcctagtggacagctttttggattagtgtgggacgccacatcacagggttcgtttgtcccccatggacgtcaagatgtcctggttgttgccattgggcgaccaaaacaccctggccgtgtgcgtgcttctggggccgatgtcaccatcaagcaatacttcagatcggctccatga

SEQ ID NO: 113863 - DNA, 528 bp, Glycine max
  Peptide Sequence Number=SeqID_230641
atggctaagtttgacccagatatagtcttggagttttatgctaatgcttggcccacaaaagagggtgtgcgggacatgcgatcgtgggtgagggtgttagaggaaggccaggagtgcgagtttagtcagaggaggaacagggctgatgggttcgatgaagaggtcattgcccaattattatgcataccgggtcaggatttcgctcggaccgctgcagggaggcgggtgcggatcatgcgcaccagcatgaccaccttgacccagatatggatgacattgctgctcagcaatgtcttgcctagtgatcacaactctgaccttcctctgtcgaagtgtcagctggtgtatgccatcttgacacggatgagcgtccatgtggcatcagttgatgctgacgccatctatttatttgcaggtatgccacccaccaggcatcctctagacccggataagtctaaacaaggccatggggtttccagcattgattacgagcctctgccagtcattcggggttcccgtcacacctag

SEQ ID NO: 113864 - DNA, 333 bp, Glycine max
  Peptide Sequence Number=SeqID_230642
atggaagagagatctttactttcagaaatagcaagagatgtaccctctcttgttctcagtcaaacccaagtagatgtaccctctacttgtaccacaaaggatgtaccctccaatgtgttaagacaaagatctcaagctgtcaaacctttgatactttgtgaatggggatacagaagaattctcaggcgggagaaaggagacacaaaagaattcaggcgggtagtcctttgttcttttggaaaagggagaagagagacacaaaaagaattcaggcggttagtccttggcgaattctttttggcaaaggcagaagggaatgaaaaagatgaataa

SEQ ID NO: 113865 - DNA, 129 bp, Glycine max
  Peptide Sequence Number=SeqID_230643
atggaagcccaagacctaatacaaggcataggaggacccatgacaagagcaagagcgaaaaaggcccaagaagctttggagcatatggtgactattctaagcgttcttcagcttgtgccttcagcctga

SEQ ID NO: 113866 - DNA, 960 bp, Glycine max
  Peptide Sequence Number=SeqID_230644
atgggttctgtcttgatccctactgtaaacaaaccaacggagggtccgtgtcgccttcttaaaaacgtgcgttggggcattttgctacccctagacgtcgtatctaagaaggggacaaattccccggacccccgcattcctagattgcatctgtgtcatatgcattccatcatgcattcatccattccacccatgagatatcggagttttgatttgcaccagcttttatctcactttagttctaccaagtcaaagtcaaaagtcgtcagcaaagagaattttgaagcaccggaagaggacgcagaagtccaagctctcaaaagcgagttaggaaaggcaaaactcgccaaggagaagttcaagttggctgctacacacgttcggaaggagtgtgccgggttacgggaagagaatacaattaccgcaagagcccttgaacaagagaccaagagggctcgcaaggaagagtatggccggaacaaatttcgcgaagctctatggggtagcaatagtgaactcaagttgcgaagggaagaaagggaccagtcgcgagcacatagcatggttctgaaagaggagttgattgcttgttcaaggtccaaaagaagcttgtctcagcgtttatgcgagacagagaccaacatgttagctatcatcgccaagtacgaagaagagttaggtctagccacggcccacgagcatagaatcgcggatgagtacgctcaagtatatgcggaaaaagaggctagagggagggtgatcgactctttacaccaagaggcaaccatgtggatggatcggtttgctcttaccttgaacgggagtcaagaacttccccgattgttagctaaggccaaggcgatggcagacacctactccgcccccgaagagattcatgggcttctcggctattgtcagcatatgatagacttaatggcccacataattagaaatcgttag

SEQ ID NO: 113867 - DNA, 270 bp, Glycine max
  misc_feature (226)..(226): n is a, c, g, or t
  Peptide Sequence Number=SeqID_230645
atgggcttctcttcaaggcaattccatcagcactgggcgtcagtgctgccaaacagtaccatgttaactctcttgcagtacctcgaaaagcaaaagaagctattggtggaattaccagactcactcactctgatgggctggtcagggaggtctatggtgataaatgtggaatacaatcagctagatcctcttcttagagcaagtggataccctgacggcgacgtanattgtgagactggctactccccatttccaggaaatattaaccaa

SEQ ID NO: 113868 - DNA, 147 bp, Glycine max
  Peptide Sequence Number=SeqID_230646
atggatgaaagggaatccttctggcatcagcttcaccacatgcatggagacggaataagattcaactttgtcacggcccaaacccaaaggagtagcagacctaagatatcacaaaggagaccagcttaccttcaggattacaattga

SEQ ID NO: 113869 - DNA, 390 bp, Glycine max
  Peptide Sequence Number=SeqID_230647
atggtgatggcggaggtcggatcagttgttatggacagagggtgggatagtgcctttgttcgaggcaaggctcctcctaagaaatcccacatcggctgcctcaatccttggagtgcggcttatatatctgttgggcaacttcacttaatgccaattgattttaagatgaaatctaacatggtatcagagcaggttctgactttgggacctcgtcttcgcttctgctgcgacgagtacccaccatttgtggttcacgcaccaagcccaataaatactgggcgtgaagggggtgtattgggaaatacccaagtcacgcatcggctgcctcaatccttggagtgcggcttatatatctgttggacaacttcacttaatgccaattggttttaa

SEQ ID NO: 113870 - DNA, 492 bp, Glycine max
  Peptide Sequence Number=SeqID_230648
atggtgagggatggggtgagtccgtgtgccgcgacgtataattgcttcttcaagaagtttagagggaggaaggatggggagagtgcgttgagaatgtttaagaggatgaaggtggatggactgtgcgcgccgagttcgcatacgtatgtcatattgattaggatgtttttgaggtttgagatgatcaaggttgtgaaggagatatgggaggatatgaaggagactggggcggggctggatttggacttgtatacggttttgatacatgggttgtgtgagagacagaaatggagggaggcttgccattattttgttgagatgatagagaatgggtttcttcttctgaaaggtacctttgacaccctttacaggggactgattcaggctgatatgttgagaacttggaggaggttaatgaagatgcttgacgaggaattgatcacgtttggttcagagtttcagaattatcaattgaagccatacaggagataa

SEQ ID NO: 113871 - DNA, 414 bp, Glycine max
  Peptide Sequence Number=SeqID_230649
atggtggaggtctccacggaggccattgcctccctcgcccaatattatgaccagtctttgaggtgcttcacctttggggacttccagttaacacccacgatggaaagaaatttccaaactagtcaaaatctcgacacaggaattggaccgcggaaagcaagtcgaaaatggggtggttggagtaccaaggaaatgtttggaagcaaaggtgagaaccttgacaagtcaagacgaataggccccgttcatggacgtcctggcactcttgatcttcaagcgattaatgcttttctcgccttttacaaccgtaaggaaagcccgattgtcactatcttagctggtctatatgacacattcgaccgaagatgtgagaagaacagtgcaaggatcatttgctgtacaccagccctctac

SEQ ID NO: 113872 - DNA, 306 bp, Glycine max
  Peptide Sequence Number=SeqID_230650
atgcctttatggacacgagagaccgaaaaatcatatcttcttacttgcgcattcgggggcacagtgccccatgtgtgcagtgaagaaggtgatatggacctttcggcttcccgtgacaaaagacgagaccaacataccacgcatacaaaaattctagatgaggattcactgttatcaagcaagtcggagacccagcatgaccacagattcacctccattccttatgttcccatggacccgggtgtagggccccttttcaactcaccatgtgtacaaatagtgctggtgtttgtgtgcatcaaatga

SEQ ID NO: 113873 - DNA, 711 bp, Glycine max
  Peptide Sequence Number=SeqID_230651
cctgcccggtggcgacctgcgcatccagtggccgggcgatggccagccggtggtgacggccggcccgactgcattcgtcttcgaaggggagtggatcgcatgaccgaaaccgtcgacaagctcggggcccatgaagtcgctgcctggttgcggcgccatcccggcttcctcaagcagttcccggacctggccctgaccctggtggtgtcactctatgacggcccgaccgcatcgctggccagctaccagctggaagtgctgcgcgagaagaaccgcgagctggcgcgacggaaggccgatctgggcgccaccgcccaggtcaatgaacggggtggcggtgcgcacgcaccagctgaccctggcgctgatgaagcaggacaacgctgccgataccctgcgtgctatggctgcctcgctgcaggaagatttcgctggcgacctggtgcggctggtggtgcacacgccggtggccgggctggaacaggccgactggctgcagccggaaaagaatgccgtgttgtatggcgtgcgcagcgaggaagtgcagaccaccgcattgctgccgctaccgggcgtgggcctgattgcggtcggaagccacgacccgaaccgcttctatccgggcatgggcacgctgttcctgcgcatgatgggcgatgcgctggtcaccggcctgaagcgcttcccgggctgagcaggacacgacgatga

SEQ ID NO: 113874 - DNA, 309 bp, Glycine max
  Peptide Sequence Number=SeqID_230652
atggaagccgggtcacattttatcgtttggattaagtacctctgtcaaccgttgttgcagcacggagcgcatttcggcatccagcgcacgtcgttcgctgttggcaaggatgaacaaatcctccacccgttcgccaatggtactgatgcgggcgccgtgcagcgaaacaccgaggtcagcaaacacttcgccgacgcgcgccagcaaacctggctggtccagcgccaccagctccagatagctgcggcggtcggtatgggtgggcaaaaagttgacttcggtatcgacgctgaagtgtttcagacgtga

SEQ ID NO: 113875 - DNA, 375 bp, Glycine max
  Peptide Sequence Number=SeqID_230653
atggcgatccgctgccagcggactgccgtccggctccagtacaataaaggtgtccatggccatgccgtcgcggctggtaaagatctgcgcatcgtgcacgctcagattacggcggtcgagctctccggctacggcggcaaacaggtaagggcgatccgggctccagatgaagatctcggtgccgccgcgcgtggcctgcgggcttaccagcaccagcggtttgctgaggtcatgattgatcagatgccgcgcgtgccacgccagctggttgggcgtatggcgcaggaagtagtcggcgcggcagcggctccagatatggtgcaggcgctcttcgttaagattctccatgcgcagcagcgccagcgcctgcagccg

SEQ ID NO: 113876 - DNA, 348 bp, Glycine max
  Peptide Sequence Number=SeqID_230654
agacacgcctttgtaaagtggtggtcacaattcgatacctcaaaggctgctccagaacaagtcaagaactggtttcagagcaaccctgagtttctcagacctgctgatccagagacatctttgtttctgaatcagaagtctcaacttgcagcattcttggcaagctcaaaatctaaagaaagtcttgctcagaatcttaaggaagttctccaactacttcaacaggaagaagaagaagaaccccccaagaaggaagccgaatcatccgaaaataatgatgaccaagaagattacccattctaccagaatgaggatgactgttttggtatatcgttagatgatgattag

SEQ ID NO: 113877 - DNA, 303 bp, Glycine max
  Peptide Sequence Number=SeqID_230655
atgcaatcacaaggactcgcactgcctcctgatcctgaggttggtctttctgatgctcgtgtcaacaaaaaggaaagttgtgtcgatcctttggggcaggacccatacacgagaaactcagagaaatgccagttatatgttgatgagaatcctcctcgcctggttgcccttggaagactttatgaggggtcgacaaccgtccacaacgtccctttgggcaatgatcaagtcaaggtcggtgttgaggaagttcgagatgctgatactgatgcagatgcttgcgttcttgtacccactcaagag

SEQ ID NO: 113878 - DNA, 467 bp, Glycine max
  Peptide Sequence Number=SeqID_230656
cgcgttcatcgtggttgttgaaccataacgatgcagacgctaagcgcgcatgtgcgataagcatcaatgctaagcgccagctcgctgcgcttagcgcttgtgttaatttcataaggcgtgctaagatggcttctaggaaaagaaaggcaccctctacacctacccaagccagattcgatagatccagattcacttcccaagaggcttgggaaagatacaccgacattgtggatgaggagttgactgattttgctgacggcaacatcgatgttgctattgtgaaggaattctttctaaacctctatgaccccaaggacaaatcacctaagcaggtgagggtgagaggtcatcagattaagtttgatgaggatactctcaacacattcttgaagacccttgttgttgtggaagaaggggaaacactttgtgcatattccagatttgcactcttgaggcctgacccttag

SEQ ID NO: 113879 - DNA, 420 bp, Glycine max
  Peptide Sequence Number=SeqID_230657
atgggaagccgaaaggtctggatcactttcttaattgcaagcgttgggcaccatgaattttcattctcgcaaacatggggtcgaactaaagcgccctcctttaaaaagaggttttatcatgtcaaagtcaagaacctagaactagccagcttgcaagagctagggcaacggatggatcaagttcgacgtcaagcctttagtaaggcatataggaaaatatgggatttggccatgatagaagtgtctgttgaagccatcacatccctcgcacaatactatgagcagtcgctcagatgcttcatgtttagggactttcaattggtaccaaccatagaagagttcgaagggatcttgggatgctcgcaggaggaaggaagccatatcttttttctggattctacccttccatggcaaaagtag

SEQ ID NO: 113880 - DNA, 255 bp, Glycine max
  Peptide Sequence Number=SeqID_230658
atggcttatggacatggtctatatttacttcttacagatgcagatgctccaattcctgtacccactgatgaggtttccttagtggggcaggcacttcacaccttccttgcttggccgacacatctggtcaagtctttatcacagcaggtagctgtgtcttcgccaaaaccacctccgaagcccgatccggaggtcaatgatccgctttatctgatgacattgaccatcccagagcttttcttgaggccttatcag

SEQ ID NO: 113881 - DNA, 411 bp, Glycine max
  Peptide Sequence Number=SeqID_230659
atgatcagcgaggtagattctgatgatggtggtcacatcaaccttaccgagtttatcgagttaaaaaccaagctaaggaacatccgtggtcgttatcatctattatataatatcaaaggtaacggttgtaacgaggaagaacgctccactttcccttttcgcgaaaactacaaccttgcataccctagtagaggtgacgatttagcgattgaagcaaagccgtgtcttcgttcagcactatttagtagagcattggcttcgccgtggctttcctcctacgacgtcaaaaacctcgagaaagtttgttcggtgttggttggtgttgcaaatggcaagtgcctcagggttaaggcagctgtgaggagtcatgtaaaatctggtcatcacttccaggaagtccctatttggtga

SEQ ID NO: 113882 - DNA, 168 bp, Glycine max
  Peptide Sequence Number=SeqID_230660
atggacatcgaagaagatgttgatatcccattgatcttgggacgtccgttcatgctgaccgcaagttgtgtggtggatgcaggaagaagaaagttggaaatgggcatcaatgatcaaaagatcagtttcgatctatttcatgaagaaaaacaacttttggaccaaaat

SEQ ID NO: 113883 - DNA, 162 bp, Glycine max
  Peptide Sequence Number=SeqID_230661
atggccggtttaccagcgaggatccgtctccaacccaccgacgtcaaagccgccgccttgtggggcgtcactgccgtcaccggcgctctctacctcgttcaggatttgtgccctatgccttgtttggctcctcgcattcggcgacgtaacatgctgatctga

SEQ ID NO: 113884 - DNA, 117 bp, Glycine max
  Peptide Sequence Number=SeqID_230662
atgtgcaatagagcaacaacatcaaaaggagtgccaccaaggaatggcgaataccaccatagggtgatggtctatatgtcctctaatgtagattttcaagcttctaaaggttattaa

SEQ ID NO: 113885 - DNA, 827 bp, Glycine max
  Peptide Sequence Number=SeqID_230663
atggttcctaaatcgagtctcacactgtgtttactgcttcaaaaggggatcaaccgccgcccaaggaaagtggcccgacgaattctccacaaaccaactcgcatttacaacaccagggccaatcggaagaggatggatatagttgaacaagaaaatcagagtctcagggaggaggttgccactctacgagagggaatggataggttgacgaccatgatgagtgcactcctgtcagcccagaactctcaagctgccgccgctactgtagagcagcctttggtgagcacaaccccactatctacggtgacttctccacccctctttttgcctccaggttgtacatggggaatgccacctccagtctgtggaggcccccagcccgctgtatctgaagttccacctccttttgctcagcagtcagcaccagttccgcaacccagtacctctttccctcaagctgcaatgacttattcagctccactgattcacactattcaacaagaggttgaaccaattttccaagctgaaaatgttgtagccttcgaaaagatggaagaactccaagaaagatttgatggtatgcaaagggaagtcgaagccctccgaggaagagatctgttcgggaaggacgcctgtgaattatgcttggtcccaaatgttactatccctcacaagttcaaggtgccagacttcgagaagtataaaggaaactcttgtccccgcagtcacttggtgatgtacgcgcggaaaatgtccatgtatactgacaatcataagctgcttattcatttctttcaggacagcctgactggggccgctctgaagtg

SEQ ID NO: 113886 - DNA, 2071 bp, Glycine max
  Peptide Sequence Number=SeqID_230664
atggaagctgtagaggcaaaatcttcatctgggtatggaaagccgccatgggtatttagaggcaggcaagttgcctggtatcaactcgatcttgtgaaggcagagaaagctcgagcttacattccaaaagaattcaaattggttgaagcttttggagcgagcgactcgcgaaaagaagatcctgctcctgatctagttcgcaaaatcgtagaatcattcgaatttgcgattcagatctccattttttactaccttgcttctcaggaaggatgttcggttcaaacctcatcgtcgagccctttcggctctcaatcggtttttggacagaccaattcgagtagcaatccttttgctcctaagccgtttggtagtacagctccatttggttcgcaaaccggtggttccatatttggaggtacgtccactggggtgtttggaacagctcaaccggcttctccgttcggtgcttcatcttcaccggctttcggtagttcacaacccgcttttgggtcatcttcaactcctgcttttggtagttcatcgtcatcgtttggtggatcgtcggtttttggtcagaagcctgcctttggaggctttggatctactcctactcaaacaagtccatttggtgccgctcagccatcacaaccagcttttggaagcagcatatttggttcctcaacgccttttggtgcatcatctcagccagcatttggtgcgacgagcactccggcatttggtgctacgagcacccctgcatttggtgcaacgagcacccctgcatttggtgcaacaagcacccctgcatttggtgcaactagcacccctgcttttggtgctacaagcagtcctgcattcggtgcaactagcacccctgcatttggttcaacctcaagtccaacttttggtagcacagggagtgcatttggggtgtcaagtactcctgtatttggtagtgggggggcatttggggcttcaagtaaccctatgtttggttcatcaagtacatctgcgtttggcacttcaagcagtccatttggggcctctagtactcctgcttttggggcctctagtaccccagcatttagttttggatccactcctcaagcttttggtcaatcgtcttctgcatttggtaacagcagcccatttgggagtacagcctcaccctttggaggtcaaagttcagcgtttggatcccaaactccgacatcaacttttggaaatactggtgggcagtcaggttttggaggtcaacaacggggtggaagtagagtagctagttacacagcaacaactgaagcagatagtggtacctctggacagactgcaaaattggagtccatatctgccatgcctatttacaaagacaaaagtcacgaggaactaagatgggaggactatcaattgggagataaaggtggaccacttccctctgcgctgtcaaccggattgacaggctttggttcgtctacgacaccgacaaatgccttttctccttcaccagtgtttggtcaatcatcagccaatcctttctctagcacaacacctaattctaacccttttgcgccaaagagttcacctttttcttctggatttggaacttcggctactcctgcattcagttcatcagcttttggttcttcaacatcagcagcagcaccttctctttttggctcaaccccatctccatttggagccaactcttcttcaacacccagctttgggcaatctccgtccctgtttaatactgctcctgctcaggctacatcttcaccatttggcaacacacagtcatcctcattatttagttctgcagcccctaaaatcgaacagactggttctgcttttggacagtttacttcccattttgggcagactacacctttaagtcaatcaagcttgttcagttcaccttcctggcttgttgcaagtattttgtcatcaattgcagcttcggtggcactccaggcatatttggtcagaataattttggactcacgaaatatctctagtgaggcatgtgtagcacctcctgatagaaccagttcaaaggataaagataaagaga

SEQ ID NO: 113887 - DNA, 207 bp, Glycine max
  Peptide Sequence Number=SeqID_230665
atgccaacgtcatcacgtcggctcggcggctcctcatcagaatcttactccttgcaccctgccaatgtcattctgctcccaagaacaatgttcacgatcatcacaggaaatagcctaagcgtgtccacacgatactctcacttagggaaccatgcagagttcgtcgagaccacccgggttgtgcatgtaactgcccccctcccatag

SEQ ID NO: 113888 - DNA, 264 bp, Glycine max
  Peptide Sequence Number=SeqID_230666
atggaggaccaaccatcatcatcatcatcatcaaagaatgatgctttggatccacccctttcattcaattggccatttaaggtgcttcatggaggggtatcagcattgatagcagagtctttggaaagcatgggagcacatatggcttctcgttataaaagaatggctggaattcaactaagcatcaaccatttgaaaagagcaaagattggtgacttggtccacgcaaaagctacacctttaaatgttggcaaaaccatttag

SEQ ID NO: 113889 - DNA, 117 bp, Glycine max
  Peptide Sequence Number=SeqID_230667
atgacgagtctttgcaaatctagaagaaagagattccttaccatgcaaaccataagcccaaatgagaagtttgcttttcatggggaatggagtgaaagctccagtggaaacagttga

SEQ ID NO: 113890 - DNA, 249 bp, Glycine max
  Peptide Sequence Number=SeqID_230668
atgtcctgcccagtgatcataactccgaccttcctctgccgaagtgtcagttggtgtatgccacccacctggcaccctctagacccggataagtctaacagggccctggggtttccagcattgatcacgggcctctgccaggcattcggggttcctgtcacacctagtaaggtgatccggctgccgatcacctgggccttcgttgagaagtattgcacgcctaggcaggcgcatggtgatgcaccatag

SEQ ID NO: 113891 - DNA, 215 bp, Glycine max
  Peptide Sequence Number=SeqID_230669
atgcagtgttcgtcgagaccacctggttgtgcacgtaactgcccccctcccataggtgatcagcctgggagcccaaaggagttccctgccagctatgaacatggccaaaagcaagttccaaagaccatggaccaattaaagcgcctaagcatcccctcagaaatccttagattctttaaccacgctaatcacccacgtctgggccatccgacaag

SEQ ID NO: 113892 - DNA, 384 bp, Glycine max
  Peptide Sequence Number=SeqID_230670
atgtgtcctccacccacgagtttggagcaatgcgtagtgattgctcagtgcaattccccattctcaatcttttttcggagccccatgatttacgttttcgttcatgtgtcctccacctttgagtttggagccatgcgtagtgatggcttagtgcaattctcaattctcaatctttttgggtgccccatgaattgtgttttcgttcatgtgtcctccacccacgagtttgcagccatgcgtagtgattgcttagtgcagttctccattctcaatctttttcggagccccatgaattgcgttttcgttcatgtgtcctccaccttcgagtttaaaaccatgcgtagtgattgcttagtgcaattctccattctcaatcttttttag

SEQ ID NO: 113893 - DNA, 219 bp, Glycine max
  Peptide Sequence Number=SeqID_230671
atgactacaggtgatccaccccaacaaaagacaagtcaaggaaatgagaaaaagaatgaagatgagaatattactcaagctgaattctatgcattcaagcgatatttctctcttttagaggaagaactcaagaatattacaaaaggtgatccacctcaatgggagagaagtcgaaaaatcagcataaagaaaaaattcaagaatatagcacaaggttag

SEQ ID NO: 113894 - DNA, 297 bp, Glycine max
  Peptide Sequence Number=SeqID_230672
atgataaaagcctcgagggtccgtcccatccctgaaaatgctatgaggtgttgggaaatggttgaagttggtccggtctattactcttcccttgcgcctatttcgccttggggggttgggttcacaggtacgacctttgtaacttcatggtatactcatggattggcaagttcttatttggaaggctgcaacttcttaaccgctgcagtctccactcctgctaatagtttagcacactctttgttgttactgtggggtcctgaagcacagggagatttacccgttggtgtcaattag

SEQ ID NO: 113895 - DNA, 528 bp, Glycine max
  Peptide Sequence Number=SeqID_230673
atgaggagggttgaagaggaaaaacagcgcactatggacacatttaaaggacaaatacaagaagctatcaagttggagttgtcacaaattgcatcacaacattcagccccacttcagccaaatgatatacaagtattagcagcaagggtaagcacgaagggaagttgtgcagcagtagagacaaatgcattagctaaaaaaccctctaagttgaatggtgacaatgtcggcctgcatgtaaccgttgagaactccaacaaattagtggcagtgggcaaacggtgcgacagttttggcaccatccacaacgtgccctatgctgatgatgttgttcgcgtgagtgtggtggaagttattttcggtgatgcggaggttccaatccttacatcagaaataaagtttgtcaaagaagctttaggtagttttgttccatggccaacacatttggtcaaacccatcttgcctgaggaagcagagaaggatgtgagctcaccattgaagactgttgaggaggaaaaggcagatgag

SEQ ID NO: 113896 - DNA, 160 bp, Glycine max
  Peptide Sequence Number=SeqID_230674
tcctaaagttgatacccttgtatctccttctgctggcaactttgttgttgcagaaaatgccaatggttcagagaaaatccaagatgaagtgggagtggaagagagcactgacccttcatttgacgatagtgttcaccatgctttacttgttggggactag

SEQ ID NO: 113897 - DNA, 186 bp, Glycine max
  Peptide Sequence Number=SeqID_230675
atgaattttgaaggctcagaccataataagctttcggaaaggcattactataaagaggatgcgggttattacttgccatccacttcgggggatgcttggaaccaaaacgagaatgaagatattgatcatgctatttcgttgtctctggtggaagagtcagaaagcaaacaacaatgtaaatggtga

SEQ ID NO: 113898 - DNA, 600 bp, Glycine max
  Peptide Sequence Number=SeqID_230676
atgaccagaactgctctgttgattgccctgggcgctgccccattactggccgaggccgcaccggccgatccgaaacaggcctacatcgattccacgttcaccgcgatggataccaacaaggatggacgcgtcgacaagtccgagtacgcagattttcagcagggccgtttcaacaagcaggccgattcaatcaacgccgcatttaccgcgatggacaagaacaaagatggaaggatcagcaaggaggaagccgtcgtggtgccggagatcgcgaagtactttacgggcctggacaccgatggtgatggctatctgtcactgaaggaaatgcaacaagccatggtggccgctcagactgcagacgcgccaacaaagtgcccatggagggctatcaacggagtgaagcatgaagattggattcaagctgtctgttgctattgcggctgctgcactgaccctgggaatcggcagtgcctccgcgcagtcccgctgtaccccgtgctacaccgcctacgaggcttgtctggcggcgggcaatggcgagaacgtctgctacccggcgtttgcccgttgcctgcggaacagcggctgcaccatccc

SEQ ID NO: 113899 - DNA, 288 bp, Glycine max
  Peptide Sequence Number=SeqID_230677
atgaagaagatcctaggcctacaagctccaatggagcttacaccacttcttgacctagcaagaaacttgaggaatcacttaggagttggtggaattactgtagtgaacagaatgctagtttacctcatcacctacattttcacttctaggtcaagtaatcacgctcagattaagggttttactaaagcatctggtgagattatcaaaagacatctcaagaagattggaataaggtttgttgatcatgaatggacaatggttggagagccagcagttggaaatttgtaa

SEQ ID NO: 113900 - DNA, 228 bp, Glycine max
  Peptide Sequence Number=SeqID_230678
atgaaaggaacattttattcggagctagtcaaggttttctacacttgtgcatgtgttgaccttaaaggtaacctcttcactactgttaatggagtagaaattttcaatgacactgttacctataggggaatgcttcttgatgcaatcctacccccccaagggcattggatagaagactccaagaagattgtgccaaagatgcaagagaaggccctagggttctcatga

SEQ ID NO: 113901 - DNA, 211 bp, Glycine max
  Peptide Sequence Number=SeqID_230679
cttggtccagaaaatcaagctccttgttgtttcaaggtctttggtgaagtttttcatgtgttccgagaggctaatcgtcctgcagatgaactagctaagcgtggtgaaggtgaaggttctggtgttgagcgttgcggtggtcggtggcgacaaacgaggtacacagaaggtggtggatctatcgaggatgtacggatgacttacggatcaa

SEQ ID NO: 113902 - DNA, 126 bp, Glycine max
  Peptide Sequence Number=SeqID_230680
atggatgagattaggaatgcagcagtggtgcacttcaacggcaacatgaaaccatggcttgacattgcaatgactcaattcaagccacttcggtcaaagttccactgcagtttatttgatgtttag

SEQ ID NO: 113903 - DNA, 468 bp, Glycine max
  Peptide Sequence Number=SeqID_230681
atggctgcgcagcgtcatctggaccagcgcactggtctttggctgcctggccctgctgtggctggtgcgccatccgctgataggcccggcacagctcaagcccgagcgcctgcgccgcaagccctaccagcatctgccccagctggaccggctgctgcagctcaccggccgccgttccgccgtcctgcgcgctgcaggcatacgcccgccggactggcagcgggccctgcgccttgccggcgcaagcccaggcgcccgcgtgcgggccctggccgaacgcctgtccgccgtctgcaaaacggcgcaaggcgagtggcctgtgcccggcgacatgttcgagtggacgctgccacccgagctgcccatcgccctgggccgctgcctggtctatgcgcccccggcggacgctggaagagggcgaactcgtgcgccagctgcgcctgctgcaaaccgagtgggatcctctag

SEQ ID NO: 113904 - DNA, 189 bp, Glycine max
  Peptide Sequence Number=SeqID_230682
atggacaaattgcttttcttaggaacacatattcgttaccacaaaaaggataatgatatcccttcaacacccataggtcatcgaaaggatctcgaagacccccaacgcacgaaagcccgggatctttcagaaaatggattcctattcgaacctggtggcggtatggataagctcacactaacccgttaa

SEQ ID NO: 113905 - DNA, 603 bp, Glycine max
  Peptide Sequence Number=SeqID_230683
atggatgaaatcaaacaataccatggatgcaactatatatcaccatttgaagcatgctggagaatattttcttttccaatacttggtaggaagccagttgtggagagattgttctttcatcttcctggagaacaagctgtgtatttcaaggatgatgattgcatagatgatgtcatttcaaaaccaaggctttgtgatgaagatattaaaaatttgacattggagattgaaaaaatattggagaaaagcaaaaagagtctaaaggattacccaatgatgccatatcccaaaggttatgttagaagtatgtgtggaaatagattaatcatgagtgaacttgattatgatgtgaatctactaaaagctgaatatcaaagacatttgaactcacttacagtggtaccggtaaaactttcatgtggaagacagcggtacctgtcataccctaatttcgtccgggaactatcatttgttgatcttttgacccatgctaatcgacttacggtgttgaacgccaattacagtgcaaaagagatgatcattcaatgttttgatcaagaatgcgaaagatacctaaaaaggagggcaaaagggtcattttaa

SEQ ID NO: 113906 - DNA, 468 bp, Glycine max
  Peptide Sequence Number=SeqID_230684
ctgcacgtcctcgccttcagagggctacacgccctggccttaagaaaactgcacgtccttgctttcagagggctacacgccttcgcgtttagaggacagcacgtcctcgctttcagagggctatacattatttcctttagaggactgcacgtcgtccccttcataggattgcacgtcctcgagtttagagggctacgcgtcctcgccttaagagggttaggacagcacgtcctcgctttcagaggactggaattcctcgccttcagagggcttcacgtcctcgccttcagaggactgcatgtccttgccttcagaggactgcacgtcctcgccttcagaggactgcacgtcctcggcattggaggactacaccttcacgactttagagagctgcacgtcctttcctttatcgggctgtacctccttttcttcagagggctacacgtcctccccttcaaaggactatag

SEQ ID NO: 113907 - DNA, 546 bp, Glycine max
  Peptide Sequence Number=SeqID_230685
ggtatgacatctagtgacggtgtagcatttgaaggtgcactagatgatgattggaaatttgatttttctgtgcataatgcccgcctgttggtttgcactaaccaagcgggtatcaccagaaggctgcttgccggtttattggctattgaaagccacatccttcattatctaattgtccgtatcttactccctagatctttaaaccttgcacaggcattgcgattaaatgctcctttgccctatcctcacgtagttaccttgttccttcaacattttaacatccctcttgattcagaaccttatgttccaatcaagagatctttcttgatcggtgctgttgtagttgcctcctttgtttaccacaaagagcgtgatggttcttgggtaaaaaaggatgctcaaccaaatgatgatgaaggatacttaccggttgaagaggactcttctctccttctgagttttttggacaggattgcaaaggttgaagaagatgtcaccttcattcgcgactgctttgatttacctccaccaccaccatcagtttag

SEQ ID NO: 113908 - DNA, 252 bp, Glycine max
  Peptide Sequence Number=SeqID_230686
atggaggaaaaggtggattttgatgaggatacatctcatgattcaataaagaagcgtgccacaaacaatctacaaccaggagtcgtgctaatgctagctaaggacagtgccataatagatgggccaaagcgtttgtctccaggggagaaaacgagcggagtcgctaccaacgtttatttgagggaaacgttagaaaaccaaaagaggtctgcgaattttgaaaatgagggttcgggagttgtttacacatga

SEQ ID NO: 113909 - DNA, 219 bp, Glycine max
  Peptide Sequence Number=SeqID_230687
atgggtatcctcaaacgggattttattcaacatcaaaagggtttgttgaaagggttaaagaatcagggaaggtcactgcgggttgaactcggtgctagaatcgctaagtcagggggtgtcgattctgggctggccaacatgataactattgtgcatattgaaaaatcagatcttgagttgaaaatcattgctcaagatcttaggttaaaaatgctctaa

SEQ ID NO: 113910 - DNA, 117 bp, Glycine max
  Peptide Sequence Number=SeqID_230688
atgaagctttgcttctacacacgcaagttcaacgaaggggatcttgtcttaaagaagttggggcagctagaggagtcaatacatgtttgtgctcctaagactcatcaggatccctga

SEQ ID NO: 113911 - DNA, 288 bp, Glycine max
  Peptide Sequence Number=SeqID_230689
atgtgcatcttgtcatcctgcgagttggaggacaaatcaagattcgttttgagtgatggtcggtaccacaacaaaatcaagacgaagaacgttaaaagtgtgagtatagccaggggaggagtcaagcctcaggcttcgatgaggaggctatcacccagttgccatgtgatgcaatcctaccccgcaagggcattggatagaagactccaagaagattgggccagagatgcaagagaaggccctagggttctcatgagccttagggaattaatgaaacattgggcttaa

SEQ ID NO: 113912 - DNA, 942 bp, Glycine max
  Peptide Sequence Number=SeqID_230690
atgggaagatctccatgttgtgatgaaattggtttgaagaaaggcccttggacacctgaagaagatcaaaagcttattgatcacattcagaaacatggtcatgcaagctggagagctcttccaaaactagcaggactcaacaggtgtggcaaaagttgtaggttaaggtggacgaactacttgaggcccgacattaaaagagggaagttttcccaagaagaagaacaaacaattctagatctccatgctatcctaggaaacaaatggtccgcaatagcaagtcacctaccgggtcggacagataatgaaatcaagaatttttggaacacccatctcaagaagaagcttattcaaatgggttatgatccaatgacacaccagcctcggattgatgatatcttcacaggcttgtctcatctcatagcactggctaacctcaaagaactcttggaccaaccattggaacaaaaccttgcaaggcttcaagaattggccaagctccaatgcttacagcaacacctcttgcagccacaagcttcattaaatattgatgcagatcctaattacacaattaatagcacaataaacagcaccttcatgatgaacaaaggcaccatcaatgtttcaaatgatcaatttgagaacattattatgtcatctaattgtaccatgcctttctctgacatgcctgaattgaaaacaccaccttcttgttcatatgaagcaccattaagtaataaggacatgattcaattgtctcaaggagaaatttatcccgattctccatggcttctttcatgttcaagcaccactccttcttctccttcttcccttgtggctccacctgtgacggaggtttcgttgagtactaatgtggaagataattgcactatttggcctgagctcctattagaggaccctttgttcaaaatgatttcctag

SEQ ID NO: 113913 - DNA, 529 bp, Glycine max
  Peptide Sequence Number=SeqID_230691
gtattgggatactcggcagtcaaatccagtgcatactcaacaacttcctgatcgttgttatgcaataacagtgaaacatcctctgatggtagtgggaactgctgatagaaatctgattgtcttcaacctgcaaaatcctcagactgaatacaagagaatcgtatctcccctgaaatatcagaccagatctgttgctgcttttccagatcaacaaggttttttggtacatcacacttttgcaactgctggatctgatggtgcttttaatttctgggataaggacagtaaacagagactcaaggctatgcaaaggtgtagtcagcccataccttgcagtacatttaataatgatggctccatatttgcttatgcggtttgttatgattggagcaaaggtgcagaaaatcacaatccagctacagcaaagaactacatatatttgcacttaccacaggagtctgaggttaaaggcaagccacgagctggagcaacagattttgaaactggaatcaaaagatcggtcatttaa

SEQ ID NO: 113914 - DNA, 690 bp, Glycine max
  Peptide Sequence Number=SeqID_230692
gtgagtcgattattggatttgattgttcacagtctgtacagccacaaggaagttttccttcgtgaacttgtcagcaatgctagtgatgctttggacaagttgagattcttaagtgtgactgagccttctttgctcggagatgctggtgatctagagatacgtatcaagtctgatccagacaatggaactattactataacagatactggtattggaatgactaaagaagagctcattgattgtcttggaaccattgctcagagtggtacctcaaaatttttgaaggcacttaaggaaaacaaggatctaggagcagataatggtctgattggtcaatttggtgttggattctactcggcttttcttgttgctgagagggttgttgtttctacaaagagcccaagatcagataagcaatatgtgtgggaagcagaagctgacagtagctcttatgtgataaaagaagaaactgatcctgaaaaggttctgcgtcgtggtacacagattacactctatttaagagaggatgacaagtatgaattctcagagccaagcaggattcagggtttggtgaagaattactcacagtttgtttccttccccatctacacatggcaagaaaagtcaagaactgtggagatatcaagattttgggcgttgatttatagcaatggtgatggtgatgaataa

SEQ ID NO: 113915 - DNA, 310 bp, Glycine max
  Peptide Sequence Number=SeqID_230693
atggggatcgcacccacaagacacccagtggacccggaaaagtccaacagggccctggggtttccagctctggttacgggcctctatcagtcctacagggtgcccgtacccccccggcaaggtcacgtcatcatagggatcgcgactgcaagacacctagtggacccgaagaagtccaacagagtcttggaattgtcaagctctaattacggcaagggcatcaggccccctactaatcgagctttcatcaagaagtactgcgccccagacaggcgcaaggcgaaacaccacagcagcattgggatggccg

SEQ ID NO: 113916 - DNA, 897 bp, Glycine max
  Peptide Sequence Number=SeqID_230694
tttccacgttacctgagctttgtgaagggtgtggttgattcagatgaccttcctctcaatgtttctcgggagatccttcaagaaagcagaattgtaaggataatgagaaagagacttgtcaggaaggcatttgatatgattcaagaccttgctgaaagtgaaaataaagaggactacaaaaaattctgggagaactttggtaggttcataaaattaggttgcattgaagacactggaaatcataagcgcattacaccattattgaggttttacacttccaaaagtgaggaggaacttaaaagcctagatgattatgttgaaaacatgggagaaaaccaaaaggctatcttttacctagcaactgacagcttgaagagtgcaaagactgctccatttttggagaaattggttcaaaaagatattgaggttctttatttggttgaacctattgatgaggttgccattcagaacctacagacctacaaagaaaagaaatttgttgatatcagcaaggaggatttggaattaggtgatgaggatgaggtcaaagagagggaaaacaagcaagaatacaacctactctgtgattggataaaacaacaacttggtgacaaggtggccaaagttcaaatctcaaatcgcttgagttcatctccttgtgtgcttgtatcagggaagtttggttggtctgcaaacatggagagactaatgaaggcacaagcccttggggacactgcaagtttggagtttatgagggggaggagaatattggagattaatgcagatcacccaattatcaaagacttaagttttgcacacaaaatgttcactttcagcatagacaatgccatggtggggaagggtgttttaactgtaaaaattgagaaccacatttga

SEQ ID NO: 113917 - DNA, 1179 bp, Glycine max
  Peptide Sequence Number=SeqID_230695
atggcttctttttcagtggaagaattcataggaaatggaattttgaaggaactgctccaaaagttgttggaagaagggtgggatgatgtaccaaccctgaagattatgagttcagaggacatggatttactacagatgacacaagagcaaaaggatgcacttggaatcagatcatacctgcatgatcgtggactaatgcaatatgcagataagatggaagattgtgggaaagctctgtcagagcttatcaatttaagcaccacagatctttctacgcaattcgaaatgaagagaggccacattgcgcgctttattaacagaacaacaagcgatgattctgtcaaattacgtgcactcgctgctcgaagaagaagcagcacgatgcatagagatgatagcattcccaagagtgttggatccaatagctctaatagcttgacaagatcacacataagaagcaatgcagcttctgatgcacttgaacaatcaatggctgatatgaagattaaagaaggatatgtctttaaggggattgttgctgctgaaccagctgagcctagagcatgtggctgtgtgaatccaccacctcctatcagtgaccaagttgctccttatggtactgttgaaaatatttcagttcagaaacttactcctgagtacaagattggcatggaaccgttggtgaaaaccaaggctcctccactgaaggtttcagaactgtggcgagataaaccagctgttttcctgtgtctcagaagaccaggagctgaggcacaccagctctattccagaaaagccatatttgatgcacttggggttcaactttttgcagttcttcatgagcaaatagactcagaggtaaaagatttctggcctcgatactggggcggtgtcgtgcttcttgatcgaggtagggacttcttcaaagctcttggagggggaaaactgctcaaggagaagttcctatcaggatttttgctgaatcctcgatcactttccaactacaagcgtgcaaaagccatgcatattgactacaatttcaaaggagaaggtgaaatcaaaggtggactcttcataatagggatgggaaagagtggcatagcttaccagttcatagagaggaactttggtgattgggcacctatagctgaagtcattgagatctgtactcaaatgcag

SEQ ID NO: 113918 - DNA, 1110 bp, Glycine max
  Peptide Sequence Number=SeqID_230696
atggcctcaaaaactatatgcactaccattcaggtgactctcatagtagcttttctaacaacccaggttgttttctctgatgacactgtgccaattcctgctcacaaggcacaattgggcacatggtttagtactaatgtagggcctttagatcaaagaaaaagcactatggaccctgcattggtggcagctgaagaaggtgctaaggttgtgaaggtaatgcaagatggaagtggggaattcaagaccatcactgatgccattaacagcatacctagtgggaacactaaacgtgtaattgtgtacattggagctggaaattataatgagaaaataaaaattgagaagacaaagcctttcatcaccttgtatggcgtaccagagaaaatgccaaacttgacattcgggggaactgcactaaaatatggcactgttgatagtgctacattgattgttgaatcagattactttgtggcagctaacatcataatctcgaactctgcaccaagacctgatggaaaaatacaaggaggtcaagcagtggcattgcgaatttctggtgacaaagcagcattttataattgcaagttctttggattccaggacacaatttgcgatgataggaatagacattttttcaaagactgcttaattcaaggcaccatggattatatttttggaagtgggaagtcactatatctgagtactgaactaagaacgcttggcgacactgggattactgttatagtggcgcaagcaagaaaaagtcctacagaggacaatgcctactcatttgtacattgtgacgttactggaactgggaatggcactttcttgggcagagcatggatgcctcatcctagagtggtctttgcatacagcaccatgagtgccgttgtgaaaaaagaagggtggagtaacaacaatcatcctgaacatgacaaaaatgttcgttttggagagtatcagaatacgggacctggtgcagaccccaaaggacgtgctgctataactacgcaactaaatgaaatgcaggtcaaaccttacataacacttgggatgattgaaggctccaaatggctacttcctcctccaactcccaaagtctaa

SEQ ID NO: 113919 - DNA, 150 bp, Glycine max
  Peptide Sequence Number=SeqID_230697
atgactatgaccggtatagggaaggaagcatgtacatggcctgttggccactggccgttgccagaagcaataattagaggtgtaggaagttttagcccaagtgtagaatttgttgttaacttactgtttgtctcttatacagagtattaa

SEQ ID NO: 113920 - DNA, 1077 bp, Glycine max
  Peptide Sequence Number=SeqID_230698
atggacccggaaatagtaaagaagctaggaagctctcttctggtgccttctgtgcaggaattagcaaagcaaggcatcaccaaagtcccagaacgatatgttcgacccaatgaagacccatgtgttgaatatgacacaacatcgttgccacaagtcccagttatcgacctgagcaagttgttgtctgaagatgatgctgctgaactagagaagctggatcatgcgtgcaaagaatggggtttctttcagttgatcaatcacggagttaatccttgtttggtggaatatatgaagaaaaatgtgcaagagctcttcaatcttccacatgaagagaagaagttattgtggcagaaaccaggagaaatggagggatttggtcaaatgtttgttgtatcagaggaacacaaattagaatgggcagatttattctacatttccactcttccatcatacgcaagacacccccacttgtttcctaatattccccgacaattcagggataatctagagaaatattctttagaattgaaaaaactttgcatcctaatctttgaatttatgacaaaagctcttaagatccaacccaacgaattgctagatttttttgaagagggagggcaagcaatgaggatgaattattaccctccatgtccccaaccagaacaagtcattggacttaatcctcattctgatgctggtgcccttacaatccttctccaagtcaatgaaatggatggccttcaaataagaaaagatggaatgtggattcctatcaaacccctctctaatgcttttgtcatcaatgttggagacatgctggagataatgaccaatggtatttaccggagcattgaacataaagctacagttaactcagagaaggaaaggatttccgttgctacatttcatagtccaagattgaccgcagttataggtccagcacaaagcctcatcactcctgaaagacctgcaactttcaatagcattagtgtagaagatttcttcaaagggtacttttcacgcgagctgcaagggaagtcatacattgatgtcatgagaatccaaaatgggttatag

SEQ ID NO: 113921 - DNA, 1023 bp, Glycine max
  Peptide Sequence Number=SeqID_230699
atggatccccaaatagccaataagcttggaacctctctactactggtgccttctgttcatgagctagccaagcaacccatgaccatagttccagaacgatacattcatccaaaccaagaccctccttctgttgagtttgctacttcacaccaagttccagttatcgatcttaataaattgttgtctgaagatgaaaatgagttagagaagtttgaccttgcatgcaaagagtggggcttctttcagctgataaatcatggaatcaacccttcaacactggaaaaagtgaagataagtgttgaagagttcttcagtcttccaatgaaagagaagaaaaagttttggcaaaatcaaggagatttggaaggatatggtcagaattttgttgtatctgaagaacaaaagcttgaatgggcagatctattttatattttcactcttccatcagaggctgtagagagctattctttggagctggaaaagctttgcatgacaatcatcaaacttatggcaaaaacacttaagatcaaacctaacgaattgttagagttgtttgaagatgtaagtcaggctatgaggatgaattgctatcctccttgtccccaaccagaacatgtcattggccttaatcctcattctgatgctggtgctcttaccatcctactacaagtcaatgacacagaaggtcttgaaattaggaaagatggaatgtgggttcccattaaacccttttctaatgcttttgtcatcaacattggagatatcttggagatattgactaatggcatttaccgaagcatagaacatagagcaacgatcaactcggagaagcagaggatttccattgccacatttcatgggcctcaaatgaacaaaattataggtccaacaccaagtcttgttactcctgacagacctgcattgttcaaaaggattggcgtggcagattactacaaaggatacttctcacgtgagctaaatgggaaatcatatcttgatgttgttaggatccaaaatgcatag

SEQ ID NO: 113922 - DNA, 165 bp, Glycine max
  Peptide Sequence Number=SeqID_230700
ctttccgccattactataagcgaaacatcacgtggtagggacagcatggcatttcgccagtgggattggcaaaacaggcatggcatttcgccattggggttggcgaaacaagcacccatcacgtcatggcagcagtgggtttcgccggtggtattagcgaaatag

SEQ ID NO: 113923 - DNA, 168 bp, Glycine max
  Peptide Sequence Number=SeqID_230701
ttacactcacatttgttggaaactgctgaactgcctgcatcttctctctcgcactcattttactgcattttcgccttcttttgcatcaaagcatcaacgatacaagaaaacgcgatgaactcgctaagcgagcatgttgcgctaagcaagttcatcgatattcattga

SEQ ID NO: 113924 - DNA, 655 bp, Glycine max
  Peptide Sequence Number=SeqID_230702
gactacaagtcctcgccttcagagggctacatgtcctcacattcagaggactacacgtcctcaacttcagagggctacacatcctcaccttcagaggactacacgtcctccccatcagagggttacacgccttcgccttcagagaactacacgtcctcctctccagagggttacacgtcctccccttcagaggactacactcctttgcctttagagggatacacgttatcgcctttggaggactacacatcctcaccttcagaggactacatgtcctcgcctttggaggactacacgtccttgccttcataggactacacgtccttgccttcagagggttgcacaccctcgccatgagaggactacacaacctcgccttcagagggttacacgccctcacctgcagaggactgcaagtcctcgccttcaaagggctacatgtcctcacattcagaggtctacaagtcctcccctttagagggctacacatccccatcatcagaggagtacacgtcctccccatcagagggatacacgccctcaccttcagaggactacacgtccttctcttcagagggctacatgccctcccctccagaggactagcgtcctcaccctcagagggctacacactctcaccttcagagggctacac

SEQ ID NO: 113925 - DNA, 234 bp, Glycine max
  Peptide Sequence Number=SeqID_230703
atgcctagggcacaaaaatccacagcataccacagtgcctatttcgagaaaagagctctggaggcagcaagaggagtagcttttgcagagatacctagggcatcatcatcaaggtcgcgtgctaagcgcgagatcagtgcgctaagcgcgagggtgctaagctcaaatccacttactcgcgctaagcacgagggtggcgctaagtacaacgtcgcgaattcaaagcctatttaa

SEQ ID NO: 113926 - DNA, 240 bp, Glycine max
  Peptide Sequence Number=SeqID_230704
atggttaaagctgtctctagaataagtccattggatttaatgatgaactatgtgcaatttcagcgcgtatccactgctaagcgcagcttcaatgcgcttaccgtgatagaagaatctgttaaggcatcatcatcaaggtcgcgcactaagcgtgagatcagtgcactaagcgcaatatttgtcttcagccaggctcaacgcacgactggcactaagctcaaatccacttactcacgctaa

SEQ ID NO: 113927 - DNA, 276 bp, Glycine max
  Peptide Sequence Number=SeqID_230705
atgtggaaagagttgccggcttcgctgggcaaactacttgaggcccgatataaagagagggagattctcattcgaagaagaagaagccatcattcagttacacagtgttttgggaaaaagtggtctacaattgctgctaacttgccaggaagaacagataatgagatcaagaattattggaacactcacatcaagaaaaagctattgaagatggggattgatcctatgactcacacacatctttatgcaatttaccaccccaatgttagaaaataa

SEQ ID NO: 113928 - DNA, 306 bp, Glycine max
  Peptide Sequence Number=SeqID_230706
atgtcattgccaggcgctgttcatgcatcctccacctacgagtctggagccccgcaaagttattgcgtagcgctgttcgccaattctccattatccactttttttcggagccccatgaatgtcattgcctggcgctgttcatgcatcctccaccttcgagcctggagccccgccaagttattgcgtagcgctgttctccaattctccattctccactttttttcggagccccatgaatgtcattgcctggcgctgttcatgcatcctccaccttcgagcctggagccctgcgaagttattgcgtag

SEQ ID NO: 113929 - DNA, 370 bp, Glycine max
  Peptide Sequence Number=SeqID_230707
aatagtggggtgagtgttgaggctgattttgaacacttttgtagagcatcaaataacaacctgattcgagtctcaatgccttactttggattcattgaagaaatttgggagcttgaccttaataaggtgggttacaaggacaaacctttcattatggtagaacaagacaggcaggtgttttacgtccaagaaccgtgtgattcaagattgttagtggttctacgacaaagaccaattggtatcaatgaccacaatgattattcaacacttgacatttgtgagacacctacttttttcacaaaaatgccttctataattgaagaaaatgaggtggatgacatatgtgcaaatcacaatgatcatgatgaag

SEQ ID NO: 113930 - DNA, 292 bp, Glycine max
  Peptide Sequence Number=SeqID_230708
cctcagatcgcatcggtagcaggatcaacaaggagagttttggcggtggagctcggtgtcaattggatcgtaggtgttggccacacgactcccataagtttgctcaaacatcattgttgtgggacacttgctgctgcccgtaatggtaatgatgatgatggcagaaacaatgttgatgatagttgtggtgatgacagtagtgataacaataacagtggtggtaatggtggtgattatgatggcagcaataacgatgacgatggtgacaataacaacgacaatggtgatgacg

SEQ ID NO: 113931 - DNA, 1368 bp, Glycine max
  Peptide Sequence Number=SeqID_230709
gtcgattacgctgggaaatcgactgcggcaacggcacatggaagggaagctgtgttgaagattctgcgcggactgggctggaccctggcaggcctgctggtgctggccatcgtggtgtggtgcgcctcgcgcatgtggccggtacccgaatcgcggctgcaggcgcagcaacgactggaagcacgcctgccggcgaccgggcacaacggttatgccttgttgtggacgctgccattcgacgacctggatgcccagcagcgcgagcaggcgctggccgaggatgtacggcgctgggaggccgacccacacggtggaggcggcggccggacacacctggtggccaaccatgccgagctgcactcgcggcccggtgccagttgcgggccggccgccagcggctgtctcgtccaggtccgcgcggacccgcaacgcttcgtggaggcccacgccggccaccagcagttgcatgcgcggctggatcagctggccgaagcggactacttcatgtcgccgttcccgccgaagggcgagggcattctggtcccgttgccggcctatggcgtggtgatggacgccaccagcgcacgcgcgctggcgtacgtgcagggcgatatcgacggtgctctgcgaggtgcttgccgtggcctgcagctgggccggcggctggtgcccggcagcagttatctggtcgagagcatcatcggtgccagcctggtgcaggccaatgcccagttgctggccgacatgctggttgaactgcctgccgaccatccgttgccaagggaatgcgaacaggcgctgcagccgctgcgggccgaagagcaaagcctgtgccgggcaatgcagggcgagtacgcgatgagccgggcggcgatcgagtcttcggcccaggaatttggcggcgtcctggtactggatcggagcagcaccctggcccgcgcggccggcaatctcggctgggcctgtggcgcggcagccacagcggcgctggaagtggatcgcccgttgccagtgccggcgccaccgcagcatgacttcggttgcctgtcgaacgtcatgggctgcgtgctgaccgatatcgccgcgccgatctatcctgcctattcgtcacggccacaggatgctgcggcgatggtgcggctgctgggggcgcagcgttggctgcggcagcagacggatgatccggtgcacgccctgcagcggctgccggcgcagttccgctcgccggtgcggtcgccgcagctgtccgccgatggccaccatctgcaggtgccgcgtcgttcgccgccgcgtggcaacgctgagagcccgtggttgtccgtaccgttggtggccggcgccggcgcaaccgccgctgcccgcgactga

SEQ ID NO: 113932 - DNA, 819 bp, Glycine max
  Peptide Sequence Number=SeqID_230710
atgaacgcgctaagcgcgttcatccctactgatgaatcactaagcctgacctgtcaggctaagcgccactttgcttctctattaccggagaggaatgtggtagtttattacactgagttcgacaagttcaaggaggaactcgagagaagacactgggatgagaagttgactgattttgccgatggctgtatagacattgctattgtgaaggaattttacatgaacctctatgaccccaaggataaatcaccgaagcaggtgagggtgagaggtcatctagtgaaatttgataaggatactttgaacacattcttgaagacccctgtagttctggaagagggggaaaatttgtgtacttattccatgtttgcactcctgagacctaatcctcaggagttggctgctaagctctgtatcccagggagaggattcaagctaaatgctgatgggcagtctttgaagatactgaggaagaacatgaccactttagctcggacatggagcgttctttccttttctaacctgattcctacctcccacacatctgatgtcaccttggacagagccaagttgatttatggcatcattatgaagatggatatgaatgcggggtacctcatctcccaccagatctctctgattgcacaacatgatacatccagacttggattccctgccttgatcatagttctatgcaaggccataagagtccaatcagattctagatccctagagaacttcagccaggagcccaaccttctccttctggagggggtggggcctccgcagcccaggaacctgagccagagcagccaatag

SEQ ID NO: 113933 - DNA, 715 bp, Glycine max
  Peptide Sequence Number=SeqID_230711
caaaataggggagaaggttgccgcccagctcgcccaggcgagcaaggttgcttcctccagaagcaacaaccttctggaggaatcttctggagggcccaagtgggcttggttgctatttacacctccatctttcgaagaagttacggaaacttacggattgcgcaaaaacacctcttttcgacttccgccacattacggaatttcacggatcgcgcaagcctgcttcctttcgatttctgagacgtctcgggacttcatttattgcatgtcatcaaataataatccccggacgaaattaggcgtactcatcaatggcagtaagcaattcagttcttcatgtaagtacatatttttaacatgggaccctatacattggtgtgatctacaatgcaaagcagaggcgatattttcagagcacgaatggaatgaagttgagattttatctgaattgaaaccaacccacatgtttggcagggagattgtaaactggaccctatttggtgtctacgaggaaggaaataataaggaggatattgaattcaagaatcccatgtcaatttttctattccacaatagagaacctttttcttccttacctagttgtttgtactattatgttagctattggaggaatgatagtgaaggtctccatgacactctgatcgaggccgtacccgaatcaaataaacatgaaaatgcagtaactaggaagtga

SEQ ID NO: 113934 - DNA, 222 bp, Glycine max
  Peptide Sequence Number=SeqID_230712
atgagtctcagcctgcagagtcagggctttactcctttcccgtgccctaccccagaccagtttagggcagaggtcgcgtggcctggggattggcctgaggcccaggcagcagaggtaccagcaggggtgccagcagaggctcccgatgaggcggatgaggcccgcgaggacgaagagatgacagatttacttgatttcttaggaggcagcggaaccgcgtga

SEQ ID NO: 113935 - DNA, 198 bp, Glycine max
  Peptide Sequence Number=SeqID_230713
atggaagataatgagttagggaaaggtaaggttctcaaagagggccctaaaccttttagggtactcaatttttggtttcaagttaaaagcttccatgaagttgtgaaggaagtttggaaggaccttatggtgcaaggttggggtgccttcgtcttgaaagagaagcttaaaggtgttaaggttgctttgaagaagtga

SEQ ID NO: 113936 - DNA, 213 bp, Glycine max
  Peptide Sequence Number=SeqID_230714
gatgatgtggcgtgggagcgtgagaaaaaggtgatcagcgccgaagagcgggtgaaaaccgggcaaaacgcgcgtcgccggcttacgtgcgatgctggagaacgcgaagaaggggtaatggtttcgtcacagccgcaagcctggcctctggcgaaatctgttgcgcgcgccgcagaggcaaagcgcccggcaaagcaaacttcactcgcgtaa

SEQ ID NO: 113937 - DNA, 1485 bp, Glycine max
  Peptide Sequence Number=SeqID_230715
atgctaagcgcatcgtcactttatgctgcgattgatttaggttctaacagctttcatatgttggtggtgcgcgaagtgtccggcagtattcagaccgtcgcgcgaattaaacgcaaggtgcgtctggcggcaggtcttgatgcggccaaccatctctcggctgaggcgatgcagcgcggctggcagtgcctgcgtctgttctccgaacagttgcaggacattcccccggaacaaatccgcgtggtggcaaccgccacgctgcgcattgccagcaacgcgcaggattttctgactcaggcggaacagattctcggctgcgcggtgaacgtcatcagcggcgaggaagaagcgcgcctgatctatcagggtgttgcgcacaccaccggcggctctgaccagcggctggtggtcgatatcggcggcggcagcaccgagctggtgaccggcgaaggtgcgcacgccactacgctgtttagcctgtcaatgggctgtgtgacctggctggagcgcttcttcagcgatcgtcatctcgccaaagagaactttgcccaggccgaacaggccgcacgtgaaatgatccgtccgattgcgccggcactgcgagagaaaggctggcagatttgcgtgggcgcgtccggcaccgtccaggcgctgcaggagatcatggtggcgcagggcatggatgagcgcatcaccctgagcaaactgcagcagctcaagcagcgtgccattcagtgcggcaagctggaggagctggagattgaagggctgacgctggagcgtgcgctggtgttccccagcggcctgtcgattctgatcgccattttccacgagctgagcattgagagcatgacgctggccggcggcgcactgcgcgaagggctggtgtacggcatgctgcatctgccgattgaccgcgatattcgcagccgcacgctgcagaacgttcagcgtcgtttcgccattgatgttgagcaggccggccgcgtgcgccagctggcagagagctttttccgtcaggtgagcagcagctggaagctggatcagcgatgtcgcgatttactcctcagcgcctgttcaatccacgaaattggcctgagcgtcgatttccgccaggcaccgcagcacgccgcgtatctgattcgccatctcgatcttcctggtttcacccccgcacagaaaaaaatgctggcctgcctgctgcagaaccagagcggcagcattgatctggcgctgctgacgcagcaaaacgccgtgccgccgcgcatggcagagcggctgagccgtctgctgcggctggcaattatcttctccagccggcggcgcgacgacacgctgccggcggtgcgtctgcaggcggatgatgatgcgctgcatctgacgctgccggcaggctggctggctgcgcatccgctgcgcgccgagctgctggagcaggagagccattaccagtcgtatgtgcactggctgctgacgatttcctga

SEQ ID NO: 113938 - DNA, 156 bp, Glycine max
  Peptide Sequence Number=SeqID_230716
atgcaacagggacaggcagatatcctcatagctaggttccctgaccctaactatggtgttaaacggtttttcaaaggaagcataagacatgcaacggcggttccaaagtcagaaaagatgcaaagacaagatgaaactaacaagaaacaagcatag

SEQ ID NO: 113939 - DNA, 416 bp, Glycine max
  Peptide Sequence Number=SeqID_230717
atggatttccttacatcggtagtggacgacttgcttctattctcaatattctttgatgtcaaatgctcctcctacttctcaaagcgcatcaatgcgcttagcgtgatgctcatgctgaacgcgcttagcgtgatgctcatgctgaacatgcttagcgtgatgctcatgctgaacgcgcttagcgcgatgctcgcactagtccaactggattgcaagtatgcggttgagcgatacatgaagatcttaatagggtattcaaagaatctacaccgtcttaaagcatctattgttgaaaggtacattgtagaagaagctattgagttttgttcaaagtacattgaaaaggcaaaacctgttgggcttcccgagtcttggcatgacgaaagagttggagtaagggttcaagaggactacat

SEQ ID NO: 113940 - DNA, 375 bp, Glycine max
  Peptide Sequence Number=SeqID_230718
atggagacgttcctcctcctacgtgctatggtagttaaaaaattgggagatcttaatgatccaatcgataatgttgatgttgttgaagtagggaacctcaagcttcatgtgagagcgataactcttagatggagaggattttgggatagttttcatgtcggagttatgatggaaaggttccatggttttcaaacgattaaggacatcattgagtttggaatggagggagctctggttattggtcagagcccatccggtaagacggttaatggttctcttgggcttgggtgtaaaggttgtctttgggtcaggaatactatcaggtggggaaaccaaaaagctcatgtttggaggttggcaattgggaaagattaa

SEQ ID NO: 113941 - DNA, 744 bp, Glycine max
  Peptide Sequence Number=SeqID_230719
atggtggtgatgggaatggaaatcttcataaagaagggtgtacttaccaaaatccagaactggcatcgtgtcgtactggtagtggcggtgaagatgttagggcgtatcctcgagtgtgatgtagccatagcactaggtcgccatggtaagggacaacgttttgaaatacaagtcctctctcacctcgattgcgagtgtgactactcttcaacgccagcgtcgagtaatccgcccttctattttaagtataggtatttgtttgaggtcttgggtcttactctccccttgatcgccttccaatgtactctacttgagtacttgaatatggcttcttctcagctgcaccaaacaattgggcaatggttcaagttctttgacgaggatttgttgacacttgtggagagggttgacaaggctattttggatgggattccaccatcatttattgctgctgctactattggagaagagggtcaacctattggtgaggttggccttattgctattgttgccaaggtcaccctcagtgctccttcctccgttttggcaaagatgaaacgggatgatggtgttgggtcgtctggtcgtaagaaggaaacggctcctatgagtcctcatgccttaagtgtgctaactactttggctggttctattttggcgtcgtcgtccaccgttgttgcacctttgttgactatcagtgtggcaaccactagtgctcttacagtgttgcctccttcctcttaa

SEQ ID NO: 113942 - DNA, 147 bp, Glycine max
  Peptide Sequence Number=SeqID_230720
atggctcgcatgaaaaaatctggtcaaatgatgtctaaggcagcaaatgaaactacaaataggattaattccctggaagagcaagcctcacagctaagctttgtcgcccatggacgtcaagatttactgactactgccattgggtga

SEQ ID NO: 113943 - DNA, 237 bp, Glycine max
  Peptide Sequence Number=SeqID_230721
atgtatatggggatcgtcgctcgagacaaggtggacattacatttgttaattggaaagaagttcttgccactcagaaggatttgatttgggagaacattcaggctgaatttgatattctagaagggtatgacaaaaggacaaagaagaatatccttaagacagatgttcaaaaaaaggcacaagccctaaagaaacaaaacattgcccctcacatgttgtctcgtcgggggttatga

SEQ ID NO: 113944 - DNA, 264 bp, Glycine max
  Peptide Sequence Number=SeqID_230722
atggaaaaggcattggttctattcaaaccatcgctgcttagtaaaaccgccgcaagtggctcactgattgcggtggttcaagtagagctagtggcggttttaaaaatatgtggtaacttacttaattgtggtagcggcaagggttattcaaaggtgaacaacttggccccttttgctggcgagccaatgtcaatcagcattctccttgccttcgtttcattacctttgtgttgggatagggttgtcaccatttttttcatttag

SEQ ID NO: 113945 - DNA, 216 bp, Glycine max
  Peptide Sequence Number=SeqID_230723
ctcaaacatgatatcaaaattcccaacagtgagaatgctcggaaatgggttgcgaacatggtgctcaaatttaacaacgatctaacgctaaatgagtccgagatcatcatttttctgagacaggtttggtggactgcggggagacgaaagaattttgagaggaaaatgggaaaaaacgaaaatgagggaaagaagaggtatcatcattctaactga

SEQ ID NO: 113946 - DNA, 270 bp, Glycine max
  Peptide Sequence Number=SeqID_230724
atggaaggaatcatagatttaagaatttcattgagcctacatggaaatgaaggtgatacaaggaggatgatgtgcacaaaagcattgaaacaagaagttggagaacttaacacatttttagcatccaaggtgattttggaggctacccaagaagaaagtgaggtcaagggctttatgaatatgattcatagacaaaagaatttgaagtacaaattagaaatgggagttttgcttgcacaggctggtgtcccaatgtattttgatctttaa

SEQ ID NO: 113947 - DNA, 177 bp, Glycine max
  Peptide Sequence Number=SeqID_230725
atgtgggtgcaagccattggtcagtttgctcaagcgacctgtgctcttgagtttggacttccaagaccattcaatcagagattactcatcttgcacgttggtggggagagaagtgagttatcaagaataggatgttggacaaatggcctcagttaccttaagaaaaaggagggttga

SEQ ID NO: 113948 - DNA, 237 bp, Glycine max
  Peptide Sequence Number=SeqID_230726
atggttggagcattctcgcaaaacatcgtgaccctgactggtctccctatgatcttacttagtgaaagtgacctgacaaacccattgtgtggtgtgtcttgttatgtactcctaagcgccgcagtagttagaaatgtgataactcactcccgatggctaggtgaagtgcttaaaggaaccttgtgcggaaggacgttgggacacaatgctttgataggatgtgacagtgggacataa

SEQ ID NO: 113949 - DNA, 261 bp, Glycine max
  Peptide Sequence Number=SeqID_230727
atggttagtgacctcgcagtcttgctcccaagcctaacacaactcgtagtcttgcactcggcgcagcagccaatactcaagcttgctcatccttggcctgagtggttccaactcatgaagtgcttgctcgacaagggatacttctgtcgtgaagagggaaaaatgttatgcaatgctggtatgggcatgaaggatttcaacgtcattagaaccaagtttggcagtgcttcagaactctgtcagactgtgatattcaattga

SEQ ID NO: 113950 - DNA, 216 bp, Glycine max
  Peptide Sequence Number=SeqID_230728
atggaatatgatactgcttcgacaaagatgccacctgcaaaggcggaaagtgtttatggaagcaatattttccaagtttattttgatgatgtcaaagactcaagtcaagaatcaaaagtcaaacaagtttcaagaatcacagagttgttcaatcaaagcaagtttcaagaatcaaagagtcattcaatcaaagcaagtttcaagagtcaagattaa

SEQ ID NO: 113951 - DNA, 432 bp, Glycine max
  Peptide Sequence Number=SeqID_230729
atggaagatgatgaagtgaaattggctaggctaaaaaataacttaatagtagaatttgagatcaaggacttgggatccttgaggtacattcttggaatggagaagtatattctagacctcttggaagaaactagaatgagcggttgtagaccagcagatacccccatcgatcccaatgggaaactgtgggaaaaaggaagtgttcttgttgatattggaagataccaaaggtatttaaagagcaatcctggaaaaggtatgttttttaagaaaaatagtgacttggagaagaacaaaaaacagggtgttgttgccaaaagcagtgcggaagctaattttagagcaatggcccaagggatttgtgaaggattgtggatttatagagtcttagaagaactcgagatggcaatagaactcccattgaagttgtaa

SEQ ID NO: 113952 - DNA, 108 bp, Glycine max
  Peptide Sequence Number=SeqID_230730
atggattattgttgtatgaggttcatgttgcctgaagacctggggaatgtgaatcccggacatgaatttatatgtatgggttgtggtgaccatgttggatatccctag

SEQ ID NO: 113953 - DNA, 240 bp, Glycine max
  Peptide Sequence Number=SeqID_230731
atggtgatgagattgggtggtgacggtgcggtctggggagaagtgaatgatgcgacacgatctaggacgagaaggacttgtggggcgggggaaactgtccctatccttgtcgtgcctgtggggaaatatttattcccattcccatcctctcggggaaatattccccgtctgtggggccccgagcaggacagtcccttcggggatccctgtttatggtacaaattgatacctctattgtag

SEQ ID NO: 113954 - DNA, 270 bp, Glycine max
  Peptide Sequence Number=SeqID_230732
atgttcgatactcggttcttaccgttttatactacttgtgcgatccggtgcacttgccgaaagcctaacaagtttttggcgtcgttgctggggaacttctttttatatgggaaatctcccacaggcaatttagttcctctggacttagaaattgaagctacattgcgaaggaacagggctgagaggagaaggaaacttctgcaagacataacagttgcatccattcttgaggaggagacttatttctctgacttattatcacctgattga

SEQ ID NO: 113955 - DNA, 279 bp, Glycine max
  Peptide Sequence Number=SeqID_230733
atgccatctctaactccacacctccccatgatcgctgacctccattggcatctcgcctacattgtcctcctgatcaaccaccaaataaaaatgacatgggaagagagccttcagataggactctccaaactaatagtccttctagaaggagatgttctatccatcaccaattcgatggaccaccatactagaaaatcagtcgtcccctccaaattgggtttggcactccctaagccagtccaagtgcccatgcctgcgagcaagcaaaccatgccatag

SEQ ID NO: 113956 - DNA, 297 bp, Glycine max
  Peptide Sequence Number=SeqID_230734
atgtgtgtacggataacccttgggtgtctccgcatgtcacccgattctcacaagtcagggatcaacaaatgttgtctttatacggataatcacttgggtattgatgaggacaagaccaagagcaagggcaaggatccagttgaaggacttggaggacctatgataagggatagagcaaggaaagccaaggaagctcttcaacaagtgttgtccatactatttgaatacaagcccaagtttcaaggagaaaagtccaaggttgtgagttgtatcatggcccaaatggaggagaactaa

SEQ ID NO: 113957 - DNA, 567 bp, Glycine max
  Peptide Sequence Number=SeqID_230735
atgaagaacagaacatcagggtttctgaaggagatcatagcaaatctgagctcaatggccaagtcaaaaaccatggccttgaagtccaaaacaaacgccataagggcacgtttgatcatattctcacttatgaagaacaagaaattcttgatgagttccctctctgagaagttccattctgtgtgggggcaaagttcatctcaacaaaaggaagatcattgcttattggaagatggcagcaatgatcaccaaagcaaggccatagtgttgtacaacagcaatgcacactcctatgaggccctgcctaaccccagtgaaacccaattggtggtggaggaggaacaagaccaagatggatatgatggttactacaattatcattgtgatgatgatgagaagtaccctgatctcacacacaccctttttgagtctgaggatttggatcttggagggtcagtgattgatttgatgaagaattctaaggaggaggcagggaaagagtttaagctggaggatgagattgaccttgctgctgatcttttcatcatgaagtttcgaaggcaaatg

SEQ ID NO: 113958 - DNA, 375 bp, Glycine max
  Peptide Sequence Number=SeqID_230736
atggtggacaacaagtctgctattaatcttgctaaaaatccagtttctcatggtagatcgaagcatatagaaactaagtatcatttcttaagagatcaagtcagtaaagagaagataaagttgcaacattgtggtactgatttgcaagttgctgatatattgactaaacctttgaagattgaaaggttcaagtcattaagagataagatgaatgtagagatgtggaagatccattatgtgcatgtttatagaggggcaaactcatgtccagatgctttaacggacttagcttgtaatttgagtgaggacatagtgatttttgagcattgtctagctgttgtgagcaatatgctcctacctgatgcttcagtttga

SEQ ID NO: 113959 - DNA, 2619 bp, Glycine max
  Peptide Sequence Number=SeqID_230737
atgaaggtgatattcgcatatcaagaagtccaagaagtggttgatgaaggctatcctgcacttgtagaaggtgcaacagaagcacaaagggctgtgcatcgggaaaacaagaagaaagataataaggctttgtttttcattcatcaatgcatagataatgcacactttgagaaaattgctttagcaaagacctcacatgaagcctggaagattcttgagaagtgtaatgagggtgccgatcagttgaagaaagtgcgattacaaactctgagacgccaatatgagctgatgcagatgaacgtgactgaaaaggtagcagagttttttaatcgtgtaatcgccttgacaaattcaatgaaagttgctggtgaaacggttacagatcaaatgattgttgaaaagattcttcgcactctgattcctaagtttgatcatgttgttgtggcgatagaggaatcaaagaatcttgcaactctaaaagtagaagaattgcagggttcattagaagcatataaacagcgtatgctggaaaggcaaagtgacagatctcaggaccaggctcttcaagctcaaacttggaagagaggtggtctttctggaaaaaaaggcaatcgaggcagaggaagatccagagagtatagaagtaatcatggaagttctggaaaacaatctcagaacaatgaggaaaatgatcaatctgaatcttcttcaagaagaggaggatcacaaaattggcaaggaggtaagaagaaagttgatccaagatttcttaggtgctttaattgtaacaagttggggcacttctcaagtgagtgcaaggcacctgctgattcaagaggaaaattcagtaatgaagccaatcttgtgagtgaaaagcttgatcaagacgaagaaccagccactcttatgatgatgacaaaagaaaggagtagcaattcaggaatttggtacattgattcaggatgtaccaatcacatgactggtcacaaagaatggcttgtcaatcttgatcttagcaaaaagagcagagttcgatttgctgatgatagacacattagagcagaaggaattggtgatgtctatgtcaaaaaggaagatgggaaggatgctgtgattacagaggtgctctatgttcctgggttaaagagcaatcttatcagcatgggtcagctgcttgaaaaagggttttcactgtacatgataagtggtcatcttggagtatatgatactcatcaaagaaggattttgaaggttaccctcactagaaacagaacctttcaaatcaaggtgaatgctttagaatcacattgcttatcagctgaagtggacaaggatggctcttggttatggcatctcagatttggtcacctaaacttcaagagtttgagtcttctgaattcaaaaggaatggtgccaggaatgactccaataaagcttccctcaaaggtatgtgaaagttgtttggtaagcaagcaatccagaaactcttttggctcttatactcttgaaagatctactgctgtgttagatgttatatactcagatgtgtgtggtccaattgatactgtctcattgggtggaaacaaatactttgtatccttcattgatgaatttagtagaaaattatgggtgtatttgcttaaggccaagagtgaagttttctctgtgttcaaagtgtttaaatcaatggctgaaaaacaatctggaaaatacatcaaggtgttgagaactgatggaggtggtgagttctgttcacatgaaatggaaaatttttgcacagaaaatggaatattgcatgaaattgtagctccatatacaccacaacacaatgggataactgaaaggaggaataagactatactcaatatggtgagaagcatgttgaaaggcaagaacatgtctcatacattttggggagaagctgttatgacagcagcttatgtactaaatttgtgtcttacaaagaagcttggatccaaagtaccagaagaaatatggactggaaagaagccttctgttaagcattttaaagtttttggctgtttatgccataaacacattcctgatcagaaaagaaagaagctggatgataagatggctgagatagatttagatctagatcagactgcacctgatttagataatggagaagaacttggagaggaactcaatttaccacttgcaccacctgtggaatcaaatgcacctcagaatgaaaggccaaaaagacatgctgaagtgcctgtaagattacatgactatgaattgttccaggattctgaaattgggaatgatggtgagctaatccacatggcattacttgctgatgttagtccagttagttttgatgaagctatagttaataaaacttggaggaaagctatgaaagaggagctggtttccattgagaaaaatgaaacttgggaattggtagagcttccagcaaataaaagacctatttcagtgaagttggtattcaaagtgaaactgaatccaaatgaagaggtttacattacacaacctcctgggtttgagcttaaagggagtgaggacaaggttcttaagctcaagaaagcactttatggtttgaagcaggctcctagagcttggaacaaatga

SEQ ID NO: 113960 - DNA, 195 bp, Glycine max
  Peptide Sequence Number=SeqID_230738
atggtgaaacttggatatttgagattgaccatgattgagaaggtggatacaaagtgtgggaggttgtctatgatggctaacgagaataagcatatagaatggatagatgcaaaaatcttgatgcaatcctcccaaggaggggacccaccaacgccatggctaggagactccaagaagattgggccagagatgtag

SEQ ID NO: 113961 - DNA, 363 bp, Glycine max
  Peptide Sequence Number=SeqID_230739
atggtactacactctaatgcggctgagatgccacaagtaggaggtaaatacctccaaaagtttgagatatgggtcattttcctcacgaagctcaaggtcttccaaggtaatattatcctgtttaagatcaccaatgatttagaggatgccaagaagaaggtgatcattcttactgtggagaacaccaatcttcaacctagaaatagaaaagtacaacaggacttaactacttctaccaaagctctaagtttagaaattgatttgaagttgactaatgagctattgatggtttgccttgagtatgtgattattagacatgacttgattaagaagtatgaagaaaaacgtgaagcattagtttga

SEQ ID NO: 113962 - DNA, 1881 bp, Glycine max
  Peptide Sequence Number=SeqID_230740
atggcatcggagagttcgtttgtgcagcccgctataccgaagtttgacgggcattatgatcattgggcgctactcatggagaatttcttacgttcaaaggagtactggggtctggtagaaaatggaattcctgaattagtggaaggaacacctcttaccgaagtagagaggaagcatattgatgatcagaaattaaaagatttgaaggcaaagaactacctatttcaagcattagatcgttccgtcctggagacaattcttaacaaagatacatcaaagaatatatgggattctttgaaacagaagtaccaaggcacttcacgagtcaagcgtgcacagttgcaagctctaagaaaagagtttgaaattctccacatgaaggagggagaatctgtaaacgattattttgctcggacacttgccatagccaacaagatgaaggctaatggtgaaaacaaaggagatgtggctgtagttgaaaaaattctgagatccatgactcccaagtttgattatgttgtgtgttccattgaggagtctaaggatacagacacattgaccattgatgaattgcaaagtagtcttcttgtccatgaactacgcatgacttctcatgtagaagaagcgcaggccttgcagattgctcatacaggtcaacatgcagaacaggggcgaggtcgtggaggctttggacgaagaggaagaggacgaggccgaggacgtggcagacaggcatttgaaaaatccactgtggagtgctacacttgtcatcaactcggacatttcagctgggaatgtttaaaccaaagaaaggaggccaactatgtagaaaacgatgatgaaatgttattgatggcctgcatagacgtgactaaggcaaatgaagaagttgtgtggtttcttgactctggacgtagcaatcacatgtgcggtaagaaggaatatttctcagatcttgatgaaaattacaaagattcagtcaaattgggcaataattccagtatggctgtaacgggcaaaggtaacgttcggataaacatgaatgacaacacttatactgttactggagttttttttgtgccagatttaaggaataacttactaagtattgggcaattacaagaaaagggacttagtattctgtttcaacatggaaagtgcaaggtgtttcatcctgaaaacggtttaatcatggaaaccagaatctcttccaatcgaatgttcatgctacatgccatatctcaacctaccaaatccacttgctttcacacagttacagaggatatagtgcatctttggcattgcagatatggacatttgagttttcggggtttaaatacgctttaccagcagagcatggtatatggttttccaacaatgaaagcaccaacaaaactgtgccaggactgcttggtagggaagcaatcacgagcttcattcccaaagaagagtacttggagggctacacaggttctacaattaattcatgcagatatttgtggaccaatcacacctatctccaacagcaaaaagaggcatttgctcacctttattgatgatttcagtagaaaaacttggatttatttcttgacagaaaaatcagaagctctttctgtctttaagaaatttaaaattcttgttgagaaagaagctgactcattaatcagaagtttgcgcactgatcgtgggggagagtttacatcacaggatttcaccaatttttgttgtgacaatggtattcgtaggcaactgacagctgcatacacaccacagcagaacggaattgcagaacggaaaaatagaaccatcatgaacatggttcggagcatgctctcagagaagaaaatgcccaaaactttttgggctgaagctgccacctag

SEQ ID NO: 113963 - DNA, 228 bp, Glycine max
  Peptide Sequence Number=SeqID_230741
atggccgcttcgcctgagcccatcaatttcaaggttttgctcaaagttagcagagaagcacttgctggagaccactctcagaacattgaccctaagataaccatggccattgcaagggaggtggcagcagtgactcgccttggcattgaggtgactacaatggattcttttatgttggtgggggtaacatcttccgtggatcctcctgagctggaagtagcggactag

SEQ ID NO: 113964 - DNA, 444 bp, Glycine max
  Peptide Sequence Number=SeqID_230742
atgttcggccttgaaggtaagttagaggaccctgtgagatcagactggcagcttgtatttgttgaccaagggaatgacattcttctccttggtgatggcccgtggccggaatttgtaaatagtgtaggacccaagaaatttaagcactgggataacaactgtgggaagtttgcaaacgtaaaaggatgtcaaggagtgatttccttgaatatggaggatggaacactacatcgtttcaaagctgcttcgacaattttagccacaaggaaaatcaaagtgcaccagagagaagttcctatggagaaaggtacaagtcttcctatggagaaaggtttcaagatcctgttgtttcctatcattgatagtctaggaaaccccttaaagatttacatgtggtatcagagcatgtgttatgaaatttatgattctccaagaatgatttaa

SEQ ID NO: 113965 - DNA, 138 bp, Glycine max
  Peptide Sequence Number=SeqID_230743
atgcaagattcaggaagtctagaagcaaaggaagcgaaagcatatgccttactccgtgctataaaaggggcacaagagttaaacatctcaaagaacaaggatgatagttattccaaactcaatggtgagttttgctaa

SEQ ID NO: 113966 - DNA, 273 bp, Glycine max
  Peptide Sequence Number=SeqID_230744
atggttagtgacctcgcagtcttgctcccaagcctaacacaactcgtagtcttgcactcggcgcagcagccaatactcaagcttgctcatccttggcctgagtggttccaactcatgaagtgcttgctcgacaagggatacttctgtcgtgaagagggaaaaatgttatgcaatgctggtatgggcatgaaggatttcaacgtcattagaaccaagtttggccgtgcttcagaactctgtcagactgtgatattcaattggacaagaacctag

SEQ ID NO: 113967 - DNA, 258 bp, Glycine max
  Peptide Sequence Number=SeqID_230745
atgcagagttggcaacttgcattcaactgggagcaaggattgaacactcaggttcaagatgtacgtgctcgcatcttgacagatatggcttggttgtgtgatgaatggggatgtggacctgatgattgtgcatggataatagtgagagatgatgacacagtgttatgtctgaaactggttacagaaggacgttcgcacttcgcaggcattccaatgtttagaccgtcgagacttgtgaaaagcaaggctgagcagtga

SEQ ID NO: 113968 - DNA, 198 bp, Glycine max
  Peptide Sequence Number=SeqID_230746
atgcaagacttcaatgtcaattgtcaatatcatcaggagagtgtctctgttagtcatcatgttcgtgttggtcatctgtttgctggtcatctacatggtgttggtgttgatcctgatgctgctggtgaggaggtaagaactgaaggacaactgattgaaaaacacacatcttctttgattgacgcagctcctccctaa

SEQ ID NO: 113969 - DNA, 714 bp, Glycine max
  Peptide Sequence Number=SeqID_230747
atgggcgctggtgactactacaaaatactgaaggtgaagcatgatgccacggatgaagagttgaagaaccatgaaaggaaggaagagtttgaggccaagctcaagcagctttctgaggcctatgatgtgctaagtgaccctaacaagcgccagatgtatgacttttacggtgataattatctccttgactctaatacgaaggatgcagtggtggatcaatgcagctttctttgttcccttgaagagctttacaacggttgcaaagagaaagtattaaagtctgttgaagaaattttgaagatagacataaaacctggttgggaaaatggcacaaaaatcacttttcctggaaaaggcaacaaagaacaaggtgctccagctgatctagtttttgtgttgggtgagaggcctcatgctattttcaagagggatagaaatgatcttgtagtgatccagaagatattacttgcagatgctctcacgggaacgagtcttaacttgactacctcggatggaagagatctcacaatccaagtgacagatattgtaaaatcaggctatgagctggtggtcccaaatgaaggcatgcccatctcaaagaaacctggcaagaaagagaatcttagaatcaagtttgatgttatctgtccatcaaggctgaccacacaacagaagtgtgatctaagaaggattcagagtgatgctgattactaa

SEQ ID NO: 113970 - DNA, 1089 bp, Glycine max
  Peptide Sequence Number=SeqID_230748
atggcaagcattgctggtacatgtcctttaggagcattgctcagaaacatctcagaaaacaatgggaagatatctgtcgttcattatgaggggcttagattgcagcagagactacaaatgcattcgccaagtcactacatttcagcttcttcatattggatggattcaccgattggatctgatccacttacatccctattgccacctctcctccctttccttctcccttcaccgttaggccaaccctacgtctccttgccgtctttcacccttgcacttgcagcagctccaagatgcagaacaatcaaggtcatggcttcaccaactgttgcagcaccaaagagagaaaaggatccaaaaaagcgagtagtaataacaggaatgggtcttgtgtctgtctttggtagtgacattgatggcttttacaacaagcttcttgagggagaaagtgggataagcctaatagataggtttgatgcctcaaacttcccggtccgttttggaggtcagatacgtgatttctcttcagaaggctacattgatggcaagaatgaccggcgccttgacgattgctggaggtattgcattgttgcaggcaagagggcccttgatgatgccaaccttggacagcaagtcctggacactatggacaaaacaagaataggagttctggtgggatcaggaatgggaggtataacggctttctctactggtgtggaagctcttgtacagaaggggtataagaaaattactccatttttcattccctactccatcaccaacatgggttctgccttgttggccatagacacaggcctaatgggtcccaattattccatttccactgcttgtgcaacggcgaattactgcttttgttcggctgctaatcacattagaaaaggtgaagcagatatcatggtggttggtggaactgaggctgcaatcatgcctagtggtcttggaggcttcattgcttgcagggctttgtctcacaggaatgaaggccccaagaaggcttcaagaccatgggacaaagatcgtgatggttttgtgatgggtgaaggctctggtgtgctggtagaaccttga

SEQ ID NO: 113971 - DNA, 438 bp, Glycine max
  Peptide Sequence Number=SeqID_230749
atgacgtggatgccgccattgttgccggcgggaaagcttgtaccaccattgacaactgcgggaacaaggatcccgccattggcaactgcggcactcagcctaaaccgccagtaccaacggcgggacaggagagagagaggctgtaccgctaatagcaacggcgggacaggagagagagaggctgtaccgctgttcctcctggcgggacatgccaacgtggcagtcccgccactgcctcctgcggaacaccttgacgggacaagggccagcgttcacatgcatgctgaatcatttttatgcaggctaggcatgctgaatcatttttatgcagtttatgctaggctagggctagttcacatgcacgcacctcttgctttaacactattagattggataggacacgcacctcttgctttaacactattggattggatatag

SEQ ID NO: 113972 - DNA, 390 bp, Glycine max
  Peptide Sequence Number=SeqID_230750
atggacgtggatgccgtcattgttgccggcgggaaagcttgtaccgccattgacaactgcgggaacaaggatcccgccattggcaactgcggcactcagcctaaaccgccagtacgaacggcgggacaggagagagaggctgtaccgctgatagcaacggcgggacaggagagagagaggctgtaccgctgttcctcctggcgggacatgccaacgtggcagtcccgccactgccacctgcggaacaccttgacgtttcaggcttgcagtaatgagaagctaggtaggtgcagcttactgtgcttgcgtgtgctcgtggttgaaatttctttggtgcttgttgctgtgcttccatttgtgcccttactcttattttcacataaattcctg

SEQ ID NO: 113973 - DNA, 396 bp, Glycine max
  Peptide Sequence Number=SeqID_230751
atgaagaagttatcagcatccttggtacaaggagcaagacccaacttgtggcaactttcaaccgcttcaaagatgaaaatggtagttctattagtaagaaactgtatgttggaggaaacatctgatgacttcaataaggctgtcaatgttgcaattcattgcatcaatgatcacaagtactatgaaaaggttcttcgaaatgcaataaaaggggttggaactgatgaggatggactaactcgtgtgtttgtcacaaggattactgagaaggacctgaaggacatcaaagagctatattataagaaaaacagtggtcacctagaggatgcagtggccaaggaaatctcaggttactacaagaagtttctcctcactttgttggggaaagaaggctga

SEQ ID NO: 113974 - DNA, 192 bp, Glycine max
  Peptide Sequence Number=SeqID_230752
atggcaagtccgatgacatccgggggtaccttaagagacggcaagtccgatgacatgcaggggtaccttatggttatccgcaccttttgtcatccagagacggcgagtcggatgacatgcgggggtaccttatggttattcacaccttttgtcaaccagaggcaagcgagcccgttgacatgcagtgactaa

SEQ ID NO: 113975 - DNA, 168 bp, Glycine max
  Peptide Sequence Number=SeqID_230753
atggcattcaaattaaaaagtatctctgtaaggttgtttccctacaaaaatcacacgctaatgccattgaggcatttcaccgaacacttggcgggcgcgcgtttaggcatcaatagcaagagaacggggacaatgtggcatgtcccattgcttcaaaatgcattatag

SEQ ID NO: 113976 - DNA, 141 bp, Glycine max
  Peptide Sequence Number=SeqID_230754
atgacggtaaaaaaaaggctaagtcatgaagtgcaaaaagtgatagttgagcttagctcagtaattgggcaaagcgcgatggagaatctggtagagcatcaacatcaaggccgcacgctaagcatgagactagtgcgctaa

SEQ ID NO: 113977 - DNA, 177 bp, Glycine max
  Peptide Sequence Number=SeqID_230755
gagaagctagcgggaccaagatccttcaaagttaagagattgaaaggcggaacacaaattaacgagcacgcaagctttgttgtttgtgttcgaagccaccgtgagaggttgcacgacgatgttcctaactatttgatggatggtggggttggggttggggttgatggaagaagataa

SEQ ID NO: 113978 - DNA, 339 bp, Glycine max
  Peptide Sequence Number=SeqID_230756
atgtctaccagtttgtgctggggacatcacaaattcgtctgcagaatccttggaagcagcatctttgtacgagcaggcagcaattatttccttgtttattgtgccatgcacaatgtcaacaactttaacataaaagagatgaagaggtgccctcttaggaacaaagaggataggcttacaggcataagtgtccctcacctgagaagtgcttcacaggcaaatgctcttccagtcattggagtcaatcttgtagaaagcataatactcctcctttgtgatctcctaaggctctgtcatccaaatggccttatgcttgttcacgaacgagcattcatgtga

SEQ ID NO: 113979 - DNA, 637 bp, Glycine max
  Peptide Sequence Number=SeqID_230757
atggctggccatatgggtagaggtgtcatagaggagcaggtatggaggaagggaccttggactgctgaagaggacaggttgcttgttgagtatgtcagcggtggtgggagcagcgggtcacagggacaagttcttcacggcgacaacctaaatctcaggctggcaagcaagggcgctggtgctttgttgcgagaatatataaactcaaaaatctacgacgtctcccaaaccctttcaccagagcagctcaccactgtcactcacgattgtcctccttggtcaccaccgtcacttgttctttgcaacattgtcatcaccgtcttccgtcggccaccgtcactcactttggttcttattgttcaccattgtcactcgcacctgtcctccaagtctcccaaaccctttcaccagagtagctcaccactgtcactcacgattgtcctccttggtcaccgccgtcacttggtttggttctcattcgtcaccaccgccactcactttggttctcattgttcaccgacatcactacgtgattgggatagttctttgcaacattgtcatcaccgtcttccgtcggccaccgtcactcactttggttcttattgttcaccattgtcactcgcacctgtcctccaag

SEQ ID NO: 113980 - DNA, 282 bp, Glycine max
  Peptide Sequence Number=SeqID_230758
atgtctaattctttcactgaacaagtgatgattatttgggcagcattgaagcacactaccattttaaactgcgtagtgcaaagagtgcttttcgtacactcgcacgcctaccatctacaacgccacatgcaatctccattggagcttgtaggcctaggatcttcttcatcaatggattcctttgcttcttggaagataaatggcagcggaatggagaaggaagagagagaggagacgccacttcaaggagaagatgagtctagaagaagctcaccaccatag

SEQ ID NO: 113981 - DNA, 354 bp, Glycine max
  Peptide Sequence Number=SeqID_230759
atggaaggacaatcaagagatacaatgaatgaacaacaatgtttggagacaaaattaaccaacatgcttcaaaatgtgaaacctccagaaatgtatggattcgatatgcaatgcatttatagagtaccaccagacattcgtgaaactaatcccaaagcctacacacctcgaattgtttcaattggccattttcacaaagcatgttacgctggaaatgaagacagcatttttgagtcaatggaagagcttaaagtgaactatctcaaggcatttctaaatcgaacccaagtacctgtgggaacctttgttgtcacacttcatgcgttggaagacaaaatccgaagttgttatgca

SEQ ID NO: 113982 - DNA, 186 bp, Glycine max
  Peptide Sequence Number=SeqID_230760
ataacgataggggatggtggcagcgacgatgatgacagtgacagtgatggtggtagttgcagtgatgatcgcaatagcagtgatgatggtagcggcggcaataatggtggtggttgtcgtgacgaaaatgacagtaatgatggttgcgacggtgacaatggcgacgagtggtggcagcgaagatag

SEQ ID NO: 113983 - DNA, 270 bp, Glycine max
  Peptide Sequence Number=SeqID_230761
atgtcacaaaactttatggattacgcaaccatcccgtcttcggcttctggaatgttacggaactttacggattgcgcaataatgtttcctttcgactcccgacatgtcacggaacttcacgtattgcttaacgatgggtgtcaagttcctcaaagcggtcaagtgaaagttacatgtcatcaaacaatggaatttaaaaatcctgtgatctgtcctgggtatcctgtgtctgaacatcctcctcatctgttaagtgaagcacaggggtag

SEQ ID NO: 113984 - DNA, 249 bp, Glycine max
  Peptide Sequence Number=SeqID_230762
atgatggattcaaacgtagaattgttcaatatgtttgtcctaaattggaatttgaaaacttacaaacatagatggcaatatgttgaattttggttcgggatatggatgaaaaatgtaaccaaatgcaaggaaatgaatgaacatgcagtccggtttgggtttaggcttaccttgcttgaggtagttgatgaagcggaagccctgatgaatgacctgtctaatgctgaagtcgataatgatcaggcatag

SEQ ID NO: 113985 - DNA, 390 bp, Glycine max
  Peptide Sequence Number=SeqID_230763
atggaagaacatttttgtgctaatgttctggcaatgggaacatcatgtataaccatatcacatcgtccaacattagttgcattccatgatgtggttttgtctttagatagcgagggaggatggagtgttcatcatagaagggaggacttgtgtactgaattgggtaatgatacaatgaaggctttggagacaaaaagacagagtgatgccaaggcaattcaacaggcatttgatatgaataaaaaggattctgcattctcaaattcaaatatgaagcataatatttcaccatctgttgttccccaacttcatggtaatacaagggcattgctaatgagagtagctgccatgtgcaaagactatgatggtggagcctgctggaaaggctag

SEQ ID NO: 113986 - DNA, 246 bp, Glycine max
  Peptide Sequence Number=SeqID_230764
atgtcgatttcaaagacagtgcagaaccaacgtagaatgttgctaataaccaatgtagaaggcactttctacactagtgatgattctatgcattattgctggtttgcatcattgcttgctattttgtacaaaaagcaaatgaattacttgcttgcttggggttcttgcgttattactgttttgcgttatttcttgcaaacaacaataagattatttgtggatgatcaacaacagagtaaaagttaa

SEQ ID NO: 113987 - DNA, 186 bp, Glycine max
  Peptide Sequence Number=SeqID_230765
atgcaattcaacaaattgttggatcagcaagtgcaattaattcagttacactcaagtgttgttgcatcactacctacgtctaacgggtcacatatcccaacagtgtcatcactacctaactctaataggtcacatatccctgtagttgaagtcttttttctcactggacatttcatgggctcatag

SEQ ID NO: 113988 - DNA, 663 bp, Glycine max
  Peptide Sequence Number=SeqID_230766
atgatccaactttcccattttctgccattgcatgagggttttgacccaccgcggaacgctagaggagtggtcgcgggtgatactgagggtcctccaaagtgttttgcatgggtatatcagcaactgcttgcccttcagtggcatatccgaggcaaggctcgaagtcggctagattgtggttgttggctctcaatgggtataggaatggagttattgacattctcattgggggtgccagatgggggcgttgggttcaccttagcaacagcgccggtagcggcaactgcaactgccttggcttccattatcttcttcatgctcatcatggcctacatcattggggccatttgctctttcaaggcctccgtgtcagccttcatttgctcttgcacctcttctacttcacccataactctagctctagcacgggttcggagaaacgagggaggtggttaccgcctagctcacccaggggagctcagatcgcccaggcgagctgggttgcttccaccagaaggcaccaccttctgttggaacccctggaaggcccaaattgactatccttttgaaagaggtggtaattcatgcaactttatcctatcttttgcaaatctctttgggaactccctcagagtgtatgttctgtttgatttagtcacttga

SEQ ID NO: 113989 - DNA, 252 bp, Glycine max
  Peptide Sequence Number=SeqID_230767
atgtggtcatctgcacccttctcggagatgttagcgtcttccggccgagaccgcgataaagtctcacttctgctgtcatggctcgagggtctgatagcatgcggagacaccttacagttatttgcacctttgtcatccagagacaacaagttcgatgacacgtggagacaacatatgatttacctttgtcatccagagacgttcaggttggatgacgcgcaaggctcttctatgttaaccagagacgattaa

SEQ ID NO: 113990 - DNA, 249 bp, Glycine max
  Peptide Sequence Number=SeqID_230768
atgaccacattggtctctgcgtgtcaatgggctcgcttgcctctggttgacaaaggtgcggataaccatgaggtatctccacatgctatcgggccctcgagtcacggtagtagaattgagactttgtcgcggtctcggccggaagacgctgacatctccgggaatgggcgcagacgaccacataggtctccgcttgtcaatcagacttggggtgtctccgcgtgccaccggactcacaagtcacgatag

SEQ ID NO: 113991 - DNA, 1083 bp, Glycine max
  Peptide Sequence Number=SeqID_230769
atgacccgtacgaaaaaatcaggtcaaataacgtctgaggcaacaaaggaaattacagataggattgcctcacagaaaagctttgtcgcccatggacgtcaagatttattgactgttgccattgggggctcccgcacctctttgtccatggctccagaagacctagagaagttgacacaaaagattagagaccagttaaaggagttaatcacacaaaaaggactcgcactacctattgaggctgaggttggtccttcaactgctcgtgggttgttgatcgtccacaacgttcctttgggaaatgatcaagtgaaggtcggtgttgaggaaattcgagatgttgatgctcgcatttcaatacccactcaagaggataaacacgaagttgagggaccagtgaaacccatagataagccaaatcctgatgtcgatcccctatacctgatgacattgaccacccgcaacttttcctcaaaccgttgtaggtgccgtcacatctcagacctcactcccataggagagaaaaaggaaagaaagcctcaagaggctaacattaacctcccatacttccatgggaaggacaatgtagaagcttacttagattgggaaataaaggtagagcaacaacttaaaaggaagtctacttcaaaatcttatggctctcactcatatccaaagaaagaccaaggtcaaggcatcttaggggcggcaccttctaagcccatagatgataaggggaagacaatagaaaagaaaccccctaaggctatagccaagatgaggctactacttcaccttcctctagtgaaagtgaaaaggcaaaaggggaagaatctagtgaagaaatctacccccatgaaagaaggacaacctttaatagttaaggagactccaagaggattggctagagctgttaaagaaggccctagggttctcatgaacctcaggggggtgtgtgtagctaaggctctagcttctcatctcaaggaggtgagcttagctattagaggggaagcttcccaaggaagcttcttaaggaagtttctcaaggaagcttctcaaggaggtgatcttagttattag

SEQ ID NO: 113992 - DNA, 346 bp, Glycine max
  Peptide Sequence Number=SeqID_230770
atggcgttgaagaaaaagcacaagcaagttatggcatgcctcactttgttaggcaaaatgtctcgtatcgccatggctaacactgaaggcaaatacattttctcaccatcaaaccttggatgtaactggtctcgtatacccatatcagctagtattcaaaccttccattgtcttgctttgaatgttaagaagcatgctgtcgtaacctacccttcggcgggagggcgacgcgagactcacgggtgcgtcttccaagaaaggaaaacacgcggagttgccaccaacgtttattcgaggaaaatgtcggaaaaactgagatgtggtctacgaactttaagtgtgaaag

SEQ ID NO: 113993 - DNA, 302 bp, Glycine max
  Peptide Sequence Number=SeqID_230771
atggggaataggaagctggagctaggttttgaagatcagaaaatcgattttgatttatttgttgaagacaagcctactgtagaatacaatgtttgcttacaggtaatggaaggaggtcaagaggttttgaaaggtttcaatttcttagaaaaaggactgaaaaataacttagaaaactttttttttctgaaaaatagtcctttcgctaagcgcaagcctctcgctaagcgcatctctgttcatgcgctaagccccgagtctcaagcgcttagcacccagcccttgcatctgaggctaatttg

SEQ ID NO: 113994 - DNA, 618 bp, Glycine max
  Peptide Sequence Number=SeqID_230772
atgaccggtgcccgccacggtggccagcagcgtgccttccggctgcatctctacttcgttgtaaccgagcagccacggccagtcgccgggaagatcggccagacagcgcaccggcagcactttctccaccagcgtattgcgatagcgtgcgccgccgttaatcccctgaaaactgtaatagccgcctaccatcatcaatgcgccacccgcggcaacatagtcgtgaatcagcgccaggcgattgggcgtacgccggcttttcagccaggtgtccggatgcagcagcagggtattggcaccgatatcggacagaataatcacgtcccagcgctgcaaatcctccagcgtctgcggaaaatcagtggcggcggcgtgagccggcatatgcgtgacggcataggtgctatcctgcagcgcagcgagaaaatccgccgcaccgctgtgccaggtggcggtagcaaactgatcaaagccttttacgtgcattgcggtactggtccaggattcaccgaccagcaagacgttcttttgcatgccaacttctccgtttatccgccaaacacccgttgcggattagtgatcatgagggtttcgagttgttcgccgctgacgccatga

SEQ ID NO: 113995 - DNA, 622 bp, Glycine max
  Peptide Sequence Number=SeqID_230773
atgccagcgcgatcactgcctctggcgcagcagctgctgagctttaacaccatcaatccaccgggcaatgagctggcctgtgtgcaattcctcgccgcgtggctgcaggagcagggcttcgtggtcaaactgacggcgttcggcgagcagcgcgccaacctgatcgcccgcctgccgggccagatgccgggcaaaccgctggcctttaccggccatctggacaccgtgccgctgggtaatcagccgtggcagtttgatccgtttggtcacgacatcgatggcgaccggctgtacgggcgcggcgccagcgatatgaaagcggcggtagcggcgtttgtgctggcctgcgtgcagcataaagcggcgattgctgccgggcgcggcgtggtactgctgctgaccggcggtgaagagaccggctgccatggtgcgcaggcgctgatcgcggccgggcagttgcctgaaattggcgcgctgatcgtgggcgagccgaccgccaaccagccggtgatcggccacaaaggcgcgctgtggctgcgctgcgaaacgcgtggcaaaaccgcgcacggagccatgccggagctgggtatcaacgccatctacctggcggctgatgcgctgg

SEQ ID NO: 113996 - DNA, 927 bp, Glycine max
  Peptide Sequence Number=SeqID_230774
atgactaacattacgatctatcacaacccggactgcggcacctcgcgcaatacgctggcactgattcgcaacagcggcgtcgagcccaccattgtgctttatctggttacgccgcccacgcgtgaaacgttgcagcaattaatcgatgccatggggattggcctgcgcgcgctggtgcgccaaaacaccgacgcctggcaggcgctggggcccgcacgtgaagcgctgagcgatgagcagctgctggatgtcatgctggcgcagccgattctcatcaaccgcccgattgtggtgacgccattgggaacgcgtctgtgccgtccttctgagcaggtgctggatatcctgcccgatgcgcaacgcggtccgtttactaaagaggatggtgaggtggtgattgatgcgcagggccggcgcgcgatagcgattgcgggcaatcaggttgtagatcagattagtgagcccgtccggcagataacgcagaacgccgcaggcgcgccacggccagggcagcgacagctgtttgccgcgctcgctctggatcgccgcaaagtgataatcgcgcggcaggcggtggcgcagcagaaaaatcacccaggcattacacagcttgcattgtccatcataaaggatgatcggctggccggactcggatacaaaaaaaccggtgaggcgacacgccccaccggttctattatatgtcacttatcagaagctgactttcacgcccgccaccgcgctggtgtcgctgtagctgtggttgcccagctgctgcgccacgccgccccacaggttgacgttcgcattcagccgcgcgtccacgcccagcttcacctcggcggcgttacgcgtgcctgcctgctggatgttgacgccgttcagcgcggtgccgaacgccctgctgttgtgcagccagttggcctcggc

SEQ ID NO: 113997 - DNA, 479 bp, Glycine max
  Peptide Sequence Number=SeqID_230775
atggacctcaagatactcctcgtgaaggtcaaaaccgccatatcaaatagcatcgactcgattccgccgaagctcctgaagaagaaaccttttttcaatgcgaagcagaatgtcggcgttctggcatttgagatcgacggtgtgatgtcgaagctcctccacctctgttactcactctccgacgccaccatcgtgcgcgtccaaaacgacacggtgaacctcaagggtgtgtggaagatcatctccaacgacgagtcattcctccttagactcgattgcaccgagtccctccgagtcgtggccaactcggtgacgcggctcaacacacgctgtgaggaccccgccctgcactccttccactgggccttcctcgagttcgcggactcaggccgcgacctgaaccctctctggcccaatggaaatgtcgagactgcatcatggttttgccggttggtaccgtccgtcgctgccgtcatcgg

SEQ ID NO: 113998 - DNA, 294 bp, Glycine max
  Peptide Sequence Number=SeqID_230776
atgaccatttttgccacaactgtcatgatcgtcaccgcaaccactgcctactaccaccaccaccgtgatcaccacaatgaccaccatcatcgtcacctatatgactttgtcattgccaccgctaccacctacgaaggtcaagttggtgacgactactatggtcatggtggcgattacggtggtggtgttggtggaagtaatggtaactacaaccatgatggtggtgatggaaacaatcatgacagtggtagtgtcatgaaagtgataggtctgagatattttaggatgacataa

SEQ ID NO: 113999 - DNA, 207 bp, Glycine max
  Peptide Sequence Number=SeqID_230777
atgtgcgatttcagttcacaatgggctaagcgcgcatccactgctaagcgcagcttcagcgcacttagcacaacagaagaatctggcagagcatcaatatcaaggtcgcgcgctaagcgcgagatcagtgcactaagcacagcagttgtcttcagacaggctcagcgtatgactggcgctaagctcaaatccacatactcgcactaa

SEQ ID NO: 114000 - DNA, 150 bp, Glycine max
  Peptide Sequence Number=SeqID_230778
atgcaagcacaactacattgggtgaaagttgtggagactttacagtatatggtgtcaccacaaagcagccggaggaaaaacttgagaaatcttagggaactgctagagatgtcgttatcgctgccggaatacacatgtgagcccgcttag

SEQ ID NO: 114001 - DNA, 501 bp, Glycine max
  Peptide Sequence Number=SeqID_230779
atgtcttttgccactctctttggaaaacttcaagaacatgaaatggaacttatgagactccatcaacatgaagagaatgatataaagagaaaaggaataacactcagagcctcatcatcttctattcaagaagaaactgacaaagaggacttgactaaaatagaagaagatgatggtttcagattttttgtgaagaggttcaataaattgctgagaaacaaaagaaataaaaggaaatcaaatatcaatccaaagaagaaagaagaagattcctccttagccccaaaatgctatgaatgcgatcaacctgagcacataagattcgattgtcctgtctttaaaagaagaatgaaaaaatccaacaagaggaatttcaaagaaaagaaagcatacatcacttgggaagataatgacataaattcttcaagtgattcagaaaataaaatcataaatctgggactcatgttgaaagactatgaaagcggagaagggcaaagttga

SEQ ID NO: 114002 - DNA, 661 bp, Glycine max
  Peptide Sequence Number=SeqID_230780
atgaaagacctgtttagtattaaaaacaaagtagcagtcatcacaggggcttcaggtgttttgggaggaagtcttgccaaaagctttatagaggccggcgccaaagttgttgcactggggagaaaccaggaaacactggatgccagggtaaaagaacttacagacctgggaggagatgcattcgctgtggaagccaatgtgatggatattaaaagccttgaagctgccgcagagaaaataaaagaaaaatatggcagcattgatgttctgctcaatatagccggtggaaatatcccgtcagcaaccttatctcccgaacagtcatttttcgatatggatatgaaaggatgggcggaggttactgatcttaatatcaacggaactgtttatccgagctatgttttcggaaaagcaatggctgaacaggggagcggaaacattatcaatatttcttccatggctgcttattcagcgattacaagagtggccggatattctgcagccaaatcagcaattaccaattttacccaatggctggcctctgacctggcattgaaattcggagataagatacgcgttaatgccgtggcaccaggatttttcattggagatcagaaccgtgcaattcttctgaatccggatggaagcttaacggagagaa

SEQ ID NO: 114003 - DNA, 240 bp, Glycine max
  Peptide Sequence Number=SeqID_230781
atgactcctcagccctcatgcatgaagttttttcggagttacgaggcctccacacctattttgttgaatgctttgattccttggatgatcgtatcgatgccattgatgctcgctttgaaggaatggatacccgcatcactcagcttgaggaggatggggagagaaacagggattaggagtggagctaagaaatcaagagatcataaactccaaaacatagggggagtatgggataagtga

SEQ ID NO: 114004 - DNA, 456 bp, Glycine max
  Peptide Sequence Number=SeqID_230782
atggcgtacttggaaccatatcttgaggtagaaagtggtgcaggagtggctggcgatgtggagcatttggagagcgactctgctaatgacgtctccgttgacaagaaccacgactccgagcagcgggttctgtggcatggagcagcggaggtagcggtccaggtcaccggagagaggaggcaaggtgtgcacgacggcggaagaagaaggtcgacaaaaaagcttgaaggtgcgacatcgaggcctaggggagttagtggcagagaagccattggcctccaaatcgagttagtggcatgtgaaggtgcaacatcgaagccattgaccaccattggcatgctgtggagttcgatctctcgaagccaagagacttttggtttttgcctaaaacgagaagtgcaatggacggagcttagaagcaaggacgaaacagtggaatgtaggcccgaaaaataa

SEQ ID NO: 114005 - DNA, 132 bp, Glycine max
  Peptide Sequence Number=SeqID_230783
atggagaatggaaattcaagggaagaaggcaagacagtgagaggcaccaagaatggattgtccaaaactatgataagcactagccaagaatggattgcccaaaaccagatgcagaggcaccaagcccactaa

SEQ ID NO: 114006 - DNA, 540 bp, Glycine max
  misc_feature (247)..(247): n is a, c, g, or t
  Peptide Sequence Number=SeqID_230784
atggctataacagagtttctgttattcatattaacagctactctaggaggaatgtttttatgcggcgctaacgatttaataactatctttgtagctctagaatgtttcagtttatgttcctatctactatctggatataccaagaaagatgtacggtctaatgaggctactacgaaatatttactcatgggtggggcaagctcttctattctggttcatggtttctcttggctatatggttcatccngggggagagatcgagcttcaagaaatagtgaacggtcttatcaatacacaaatgaattgggttcaagctttccccagccccttctcatcaatggactcctgacgtatacgaaggagtgcggttcgttcgataaattcctatctctttatctatttctgagatgtttggatttttcaaaactccatggacatgcagaagagaaatgctattcccactcggaccaagacataactttacttgttcaaataacaattaaggtgaagcagagtcaggaacaacgaatccctttatga

SEQ ID NO: 114007 - DNA, 333 bp, Glycine max
  Peptide Sequence Number=SeqID_230785
atggctcttatcaccagctggtccatcctttgccaagccaaaagcagaaagttttgcattgtaattctgtcatcaccaaaaaggaatgttagaaaagccaatatgactagcctgcaaaataaaccaaggatgtttcacctcttcagcaggacaaatgaaaagaactctatagctagaagatacatttcattgggttttagtggtcagcagatcgaggtaggaggtttgtttgctacgtcatcagtctctttgctggactcggtagatgtaatcttgcagatactgaggtacgacctcatcgagatacgagctgatgaagatatatttcgttga

SEQ ID NO: 114008 - DNA, 351 bp, Glycine max
  Peptide Sequence Number=SeqID_230786
atggcgaaaatgatactgatgcaggcagaccagacagtgaactttaagttgatgatggtgcagccaatggcatgtccatggtggcaaggtgggaaaaatgggatatatttaatttacatcaagatcgctaccacaaccaccaccatctctgccgccaccactactataattgtcgccatgaccatcgttgttgccaccaacttgattgttgtcgccgccactggcagaggcgatagtcatgttggtggtaacgatggtggtcacggaggtgatcatagtagtggtggtagtggtagtggcgatgatgatggtgacaatagtcatgttggtggtggcggtgacgacagttga

SEQ ID NO: 114009 - DNA, 723 bp, Glycine max
  Peptide Sequence Number=SeqID_230787
atgggaaatacattcaaaatatatcttacatctttatgtgcatcgggattcgctgccatttcactttcgtgtagcaatacaaagtttctgaaagaaggacaaatgctatacaccggtggtgaagtaaagattgaaaatgataccatctccaaaaaagagaaaaaagaacttcaggccgctttggaagaaaacctggttcccaaacctaattcaaccattctgggcctacgaccaaggttatatttttataatattgccaaagaacctaaaaaagaaaaaggattcaattactggcttaaatataaggtgggtgagaaacctgtattattaggagacgttgaccgtgaattcaataaagacattattgttaattactccgagaataaaggatattttaatgctaaagccacttatgatacgatttccaagaacaagaaagcaaaagtcatttatacgttaagaccaggagcccaatatctgatcagcaacgtaaaatttcaaaaagattctactctggttaatcgcgaaattcaaaatttaaaagataaaagcttactgaaaaatggaaatccattcgaccttggtgttattaagtcggaacgtgacaggattgataacgggttgaaagaaaaaggattttattattttcatcctgacaatattattgttcaggcagacagtacagtagccaaaaatcataaggttgagcttaatgtaaactaa

SEQ ID NO: 114010 - DNA, 906 bp, Glycine max
  Peptide Sequence Number=SeqID_230788
atggtgctgattcgcgacggcgaccgcgtgcaggcgctgcaggcaaaatgtccgcacgcgggcgcaccgctggagcagggcgcattgtgcggcgacaaactggtgtgtccgtggcataaggcggtgtttgaactgcgcgatggcaaaatgtgcgagccgctggcgctggccaatctcaaacgctatccggtgcgcattgaacaggggcaggtgctgatcaatccgcaggcgatgtcgccggccagcgcgccggtggcccagggtgaagcgccggtgtgcgtgattctcggctctggcgcggcgggcagtgccgcgatctggacgctgcgcgatgaaggctttagcggccggattgtgcgtatcgagcgtgaaagcgacgccccgtacgatcgcaccacgctgagtaaatttgtcccctccggcaagatggccatcgatgaggtacccaggctgctgaaacaggatgtgctgggcccggtggtgtggctgcagggggaggtggtgcagctgaaggcgcaggagcagacgctggtgctgaaagacgggcagcaggtgaagtttgaccagctgctgatcgcgaccggcggcgtgccgcagccgcttgatatcccgggcaaggatctggatggcgtgcacctgctgcgttcactgcgccaggccgacacgctgatttcccgggtggatgaggcgcagcagctggtgattatcggcaacagttttatcggtatggaagtggccggtgcgctgcgaaaccgcgacattgatgtcacggtggtggcgcgtcatccgctgccgtttgccagccagttcggcgaagagattggccgtcatttttatgagctgcaccgcagcaacggcgtgaagtttgtcgagggtgaaccggaagcgctgagcggcgaaggcgca

SEQ ID NO: 114011 - DNA, 105 bp, Glycine max
  Peptide Sequence Number=SeqID_230789
atgaacaaagtgcctaatttgatggacaaggaaacaaattcatttggaactaaccaatcagaattatgtaagaactctggcaaatcttcagttaagttttattaa

SEQ ID NO: 114012 - DNA, 243 bp, Glycine max
  Peptide Sequence Number=SeqID_230790
atggccaccgctgatgccttggaacgagaaaccaagaaggcccaaaaggaagaacacgtgccagcaaaggccatcatcgataagtgcaaagagaagctaaatctagcggcaactcacgagcaaaggctagaggatgagtacgccaggatattcagcagaaagggaagtaagggaaagggtaatttgattcattgcatcaagaggcaacaatgtggacggaccgattgctcttactttgaatag

SEQ ID NO: 114013 - DNA, 456 bp, Glycine max
  Peptide Sequence Number=SeqID_230791
ctagaactacctaggtctgagttccttatcacaaatggaggatatgcaggagcaaaagccccgcttttgtcgaccaccccaccttttgctttcatgacctgtgagtctggtgtcatgcgaagacacccaatggttatctgcccacatattgttgctattcagggaccccaagttcgattgacaagcggagaccaaatgtggtcatcagcaccctttccggagatgtcaacatcttccggtcgagactttttagtctcactgacaacatctgttaatcctgacccacaggtggcaggcgaatatatccaagtgattatccgtacaaagacaacatctgttgatcttgacccatgcgtcatgtggcaagcggatgtaccccaagtgattatccgtacaaagacaacatctgttgatcctgactcatgcgtcaggtggcaagcagatatacccaagtga

SEQ ID NO: 114014 - DNA, 228 bp, Glycine max
  Peptide Sequence Number=SeqID_230792
atggggtggtgcattgaccttgtcggacgtcccttgtgtgggaaactaaagtggttaaagaatctaagcatttctgaggggatgcttaggagctttaattcatccatggtcattgtacatgatgggggtgtgtcacctggtagggaactccttgaggccctagacacgctaagggctattttcttggtattggatacgctatgtactgcattgcatctgagagttgag

SEQ ID NO: 114015 - DNA, 405 bp, Glycine max
  Peptide Sequence Number=SeqID_230793
atggcaaagttgttggctgcaggagaaaagtatggtttgccaagactaatgttgatgtgtgaatcagtactttgtaaagacatatctgtagattctgttgcctatatttttgctcttgctgatcgttatcgtgctacccacttgaagtccatctgtcaaaaattttctgctgaaaactttgatgccatgatgcattctgatggttttgagtatcttaagaaaaattgcccattactgcaatcagaactgctaaagactggagtaggatgttttacctccgcaaccaccgggtacaatgctgcagccagtggcatgtccatggtggcaaggtgggagaaatgggatatgtacgagaacgtgagatacagagaagagagaaaggatatacgggaaccgagaacgtga

SEQ ID NO: 114016 - DNA, 297 bp, Glycine max
  Peptide Sequence Number=SeqID_230794
atggccaaatacaggctaaaggcccaagtggagaaggacgaaggcccaagtagagaaggacaaagcccccgagtggagaaggatgaaggcccaagttccttgttcaacgaatctcaaacttatcaagataatccttgtggcgtctatcctgacttatcttccttcactggaagtggcgtcatccaaaatctccgtagcctgtatcaaacgttccgccccatgaggttcacatcatctggtatcagagcttcggttcttgatataggttctatcctatcctattatttttctttgtaa

SEQ ID NO: 114017 - DNA, 264 bp, Glycine max
  Peptide Sequence Number=SeqID_230795
atgtttggagaaggaaccgatcgggaaaataacaaaaaaccatatttcccagtcaccgaaggctccgcgcttgataacggaggacacatgaacagcgctaggcaatcaattcatggggctccgaataggacggtggaggatacacgaacagcgctagtgctaggcaatcaattcgtggggctccagactcgatggtgtggacgcatgaacagcgctaggcaatcaattcgtggggctccatactcgatggtggaggacgcatga

SEQ ID NO: 114018 - DNA, 762 bp, Glycine max
  Peptide Sequence Number=SeqID_230796
atgttgtttagaatgtcacgctctggacgttggatcgacgtcaaccccgaactggaacacctcctcgcgaatgcgcctaaacctgaagagcaaatggaatggaaggaattggcaagaaagatacaggatactacggctccaccagaggctattttcatgaccgctagcgctagagaccagatttttgaggaagttggtaaaatatatgctatcaagtttaaggacgtgcgaggtagtttatggcatttggttgacagagacgatacttatcataccattgtctacaaccaagatctagatcaaccagacattgtggctgggtggacaacactatgccagttttacccgctaatcgaagatcacctggttttgttacaacattatggtaagagtgtattttttattgaaattttcagggttccttgcttgctgaagtcattccccaagtgtcactctttgtatcatcaagtgccaggtttggtgacgttcaaggtttttcttactaagaagaaaatttcctgcagcagtctggacgttccaagtgcaatgtattattttttgaaagacaaaggctggtataatttgcacttggaaaatatagcagaatgtcggctcgtcttcaatcattataggaagtcactcaagattggagccagatggaaacaattatgcgagaccttgtctttggctgctggcacgaaaatagtcttcgagttcattaatccccgtattaaccgcgttctttattggctctatttatga

SEQ ID NO: 114019 - DNA, 619 bp, Glycine max
  Peptide Sequence Number=SeqID_230797
gcaaccggtacgccgattggcaccgcgctgccgaaaggcacaccaagctggggcatggggtacaaagaggggctggagcagtggtacaaccattcgatgaagatcagtattaccaccacctgccagtcgtaccgcgatatctatctggatctggatccgcactacaccgaccatcgcggtcagccgctgctgcgcatgacctttaactggaaacagaacgagctcaagctgcagcagcacctgaaaggcatcgttggcgacatcgccaaagagctgaatccggacagcatgagcatgagcttcctgccgatgggcgctgattttgacctgaccaaatacgtctctacccacaacgtgggcggcgcggtgatgggtgataacccgaaaacctcagcgctgaacaagtacctgcaaagctgggatgtgcacaacgtatttgtgccgggcggtaacgccttcccgcagaacttccaggcgaacccgaccgacaccatcggcgcgattaccctgatggcggcgcaggctattaaagagcactatttgcagaatcccggcccactggcagcagatgacgcatcactgattaaaaagggcgagtatctggcgcgccttggcgact

SEQ ID NO: 114020 - DNA, 618 bp, Glycine max
  Peptide Sequence Number=SeqID_230798
atgcggaagaaggtttttcctctggatcacatggaagaaacttcttccgcggatacccacggaagaattatcttccaccagacacaaacgaagtgtctttcacgcgcggaagaagcttacggccatgcggaagaagttcgtcttcaacctcacgcaaaaaattcctcacaaatgtcgtctaacctaaggccagcctacgctattcaaagagaaatgagggaccaagtggtgaatgtattcaaggaattacaggagatcctcatcaaattcttaacactgctcattgctctgatttcagtaacaaacactgagtcagggaagcttttgtttacagaacaacacaagctaatgatgtctctgattttaaccattgtcttatacttcttatttgcttccattgggacaatacttcagatatataagggaaacttccttcaacttgtaatttgggtcatgcttattgtgggaggtgttgtttcagttctgtctttgagcttcatttcagccaccgtagcttggatcactttggccatgtgggttggaatattcgcagtggttgcctacgactacggtgttcctcaaaggatcataaattggattaagggtccatcaagctga

SEQ ID NO: 114021 - DNA, 477 bp, Glycine max
  Peptide Sequence Number=SeqID_230799
gctgcattaggtgctcctgaggatggtattatgacaactaaacttcttgaaaggttgtatttggagataaggaacaaggacacaagcagtgcgactcatatgaagtcaccgagctttggtgattcgcatttctctttctccaccgcaacacactcacctttagcattttccgctatggccaaagtattcgtgaagggctctgttcatcaaaatggtgtcgttgtcataaccctcgatcacctcaaagcattttccgctatggccgaagaattcgtgaagggctctgttcatcaaaatggcgtcgctgtcataacccttgatcgccccaaagcattttccattatggccgaagaatttgtggagggctctgttcatcaaaacaatgttgctgtcatgaccctcgatcgccccaaagtcaccgagcgtgctgtgaagacttggcaagctgcattaggtgctcctgaggatggtatatga

SEQ ID NO: 114022 - DNA, 255 bp, Glycine max
  Peptide Sequence Number=SeqID_230800
atgatgatttggaaacaacgtgcaaaattagtcatggctacagctaggtgggtactcaagcatccaatttatggcattgtgatactaaggcttgggatttacacaaaatacaaatctggggatcccacggtcatgtggctccgcatgccaccagactcttgggtcacggtaacaaaaggtggggtggtctacaaaagccagggcttttgctcctacgtatcctcaatttgtgatgaggaactcagacctacgtag

SEQ ID NO: 114023 - DNA, 356 bp, Glycine max
  Peptide Sequence Number=SeqID_230801
ccccttcgagttggccacggggcaacagcctctgacgccccacaccattgcggcaggaggaggcttgcccatcagcctacttttttgccaagacgtggcaggagcgcaacgacctagcccaaacctacttaaactaaaggcttggcccggtctgaaggaagaagaaagtagaccttgtagagaagtggataggagagaccagaccgacccagagaggaacgtgcctagcccacgagggcaccaccagatgttggccaacttgagagcgaggcaagctgggaacgggcagaaactgacgattctaagaccaagtcagagactactggacgtctcgcagagcgactctcaacgaggac

SEQ ID NO: 114024 - DNA, 747 bp, Glycine max
  Peptide Sequence Number=SeqID_230802
atggctccgaagaaactcttcacgaagaggtctagaagagacgccgcagcagaagggtccagtgccgcccccgagtttgatagtcatcgtttccgcagcaccgagcaccagcagcgcttcgaggccatcagaggatggtcgttccacagagagaggcgtgtccagcttagggaggatgagtatacgaactttcagaaggagatagctcacagacgttggacgccactagtgactcccatggccaagtttgaccctgagatagtcctagatttctatgctaatgcttggcccacagaggagggaatgcgacacatgcattcatgggtgaggggaaggccagtagtccgagttcagccagaggaggaacagggccgacgggttcgacgaggaggccattgcccagctgttatgcacactacagggagacgggtgcggatcatgcgcaccagcagtgtcttgcctagcaatcataactccgatctccctctgcctaagtgccagttggtgtatgccatcctgacacggatgagcgtccacgtggcccaggtgattgttgacgccatctatttgtttgcaggtatgccacccaccaggcaccctcgggattacctcattattacccgcacctttcgtcaaccgggggcaaacgagcccgttgacgcgaagcgactgacatcgagtgaggtggcaggcggagataccttatggtcatccgcgcctttcgtcaatcgaggggaacgactttga

SEQ ID NO: 114025 - DNA, 420 bp, Glycine max
  Peptide Sequence Number=SeqID_230803
ggtgtacggaaaaaggcacaggccatccagaagcaaaacattgccccccacgtgttgtctcgtgggggttacgaatatttagaacaaaagctcatgactgagaagacaaagaaaagactagaggaagctgcccagtccgaaagcactgaaggcgtcattgacactccatctcccatcggatgccacatgaagtggaagatggcttgcaccaagaaaattgggcagatgacgtctaaggcaacaaaaaatatagctgagaagattgattctttggaggagcaggcgtcacagggatggttcgtccctcatggatgtcaggatgtcctgactgctgtcattgggcgaccagagcaccctggtcgtgtccgtgctgctagagccggtgtcaccataaagcaatacttcggatcggctccatga

SEQ ID NO: 114026 - DNA, 354 bp, Glycine max
  misc_feature (314)..(314): n is a, c, g, or t
  Peptide Sequence Number=SeqID_230804
atggtgcagcgcctgccgctttccgatacacattttcgtcgtatcagccagctgatctatcagcgtgcgggcatcgtgctggccgaccacaaacgcgagatggtgtacaaccgtctggacccgaacagtgccgagtggcaggcgtttattaacgcactgaccaccaacctgacctcatttttccgtgaggcgcatcacttcccgattctggcagagcatgcgcgcaaacgcagcggcaactacagcgtgtggagcaccgccgcttcaaccggtgaagagccgtactcgattgccatgacgctggcagaaacgcntgggcaccggaccagggaaattttccgtccacgccagtga

SEQ ID NO: 114027 - DNA, 558 bp, Glycine max
  Peptide Sequence Number=SeqID_230805
accaatatcctcgcgctgaacgccgcggtggaagcggcacgcgccggtgagcaggggcgtggttttgccgtggtcgcgggcgaggtgcgcagtctggcccagcgcagcgcgcaggcggcgaaggagatcaaaggcctgattgaagattcggtcagccgcgtcaataccggttcggtgctggtagagagcgcgggcgaaaccatgagcgagatcgtcaacgcggtgacccgcgtgaccgacatcatgggcgaaatcgcctcggcttccgatgagcagagccgcggtatcgaccaggttggcctggcggtgaacgagatggaccgcgttacccagcagaatgccgcgctggtggaagagtccgcgacggcggcggcggcgctggaagatcaggccagccgactgaaacagtcggtggcggtgttcaatattggtaaagaatttgtcgcccaggccgttaacgtaactacagcgccaaaaattgcgcgtccgtctgcaccgcaggcgctggcgccagcggcaggagctcgtggcgctgacgataactgggaaaccttttaa

SEQ ID NO: 114028 - DNA, 207 bp, Glycine max
  Peptide Sequence Number=SeqID_230806
atgacttttaatgcggtgttggacccaaattcagagtctctttggtggagcacactgttacaggaatcagaaattgcacaaactgagcaaagtcgatgtgacagaaaatggttatggcaagcgattggactcgctggttgtggaggtaaacctgcagtgagagtagagagagtgcaagtgaagcagaatagaacaatagatagatga

SEQ ID NO: 114029 - DNA, 177 bp, Glycine max
  Peptide Sequence Number=SeqID_230807
atgcgtgagacaattacaaaattgaatgctaagcttttggaaaagacaaataaggagatgatacttgagtctatcatgtcagctcctagtccattgactaccctagcggatggaactgaccaccatgttgacgatgctcaggttgattgtcctcattacatgtcaaaggatcattga

SEQ ID NO: 114030 - DNA, 213 bp, Glycine max
  Peptide Sequence Number=SeqID_230808
atggcggacacgacggtgggatggcggacaccaatgtcagtttgggtcgaggttttggtgggtggaggcacaaaagatatgaatgagaaggggcacaggttccccattcatccaaacccaaaagagaaaatgggaaggggcacgagaaggtttactagagtggagcatgagagagtgcaaggaagatttgtgagcttccatggaaacatttga

SEQ ID NO: 114031 - DNA, 372 bp, Glycine max
  Peptide Sequence Number=SeqID_230809
atgtggtaccatggtagggcaaaagggtacccttcttctgatttgatagggttggttgtttcaaagaatggggttcattgggagagtggtggaggccctgctaggtcaagttctgatgtggggtttgtgattagctgtggaaatgattggtggggttttgacactggtggcattaggccttctgagatgacttcaacagtggaggtagaggcttacccaactttagatgagttgacctctgaacttagcacactcaatcttgaacgtgttagacaaatcaagagtcgtttggttacactctccggttgtgtgcagaagcttattctcaacgttgatggaactgaaaattccctaaataatgaggaacgatga

SEQ ID NO: 114032 - DNA, 384 bp, Glycine max
  Peptide Sequence Number=SeqID_230810
atggcttctccacctgcctcccctcctcctccttctcctcctcctcctgctccttctgacgcatcggcttcgctaccacctgatgctgagagaccagtggtccatgttgatcctactaccgacaaggctaacgatccccacaggaagaaattaagaacatatttggggattgtggtgcgtgataaggacgacgtcacctatgagaactggaaggaggtccctactgctcaaaaggacctgatttgggaggatattcaggaggaatttgaaatcctagaggcttttgacagtaggacaaaaaggaagttacttcagatcgtgggcaagagatggaggcagtttaaatcagacctcatgaggaaatgggcccttgcagccgattag

SEQ ID NO: 114033 - DNA, 279 bp, Glycine max
  Peptide Sequence Number=SeqID_230811
atgattattgatgcccatgaaggagaagagcattgttgtggcaaaggaacaaatgcgaggagtgtttcttttttgccaagaagccaagagaagataggagattcggctaaagttgtgataaaacaagacatgaagggaggagagcataaatatgggtttaataacaataaacgtgagaaaccagagaaggtaagggtggtggatgatgaaacaggcgacaaacatgagctgtatgaagtcctaaggatgccatctagatgtgtatttttcaagatatag

SEQ ID NO: 114034 - DNA, 300 bp, Glycine max
  Peptide Sequence Number=SeqID_230812
atggtgggaatagatgtgattcgggaaccaaccagccaaggtgagattttgtttagaatttgtaaaacagacggtacagaagaagggcttagattcctcaaaattttgaggccatctacaatggacacaactgggtatcttccaaggttgaatggtttcatgtgtaaagaacactctaaagtgaatctgaactcacagattgatgccacactgggcattgtgagtcacaacgatgactttcaaggcggtgttggacccaaattcagagtctctctggtggagcacgctgttgcagtgtga

SEQ ID NO: 114035 - DNA, 306 bp, Glycine max
  Peptide Sequence Number=SeqID_230813
atgagaaaatttcaatttcttttacccccggtcgataaaaaagcccccattcttcttccctccttcctcgacactgtcatccccaaccgcctcacaagttcacaaggactaaagagttgtgccaccatgtcggacgatgaaagggaggagaaagagttggatctctcttctgccgaagttgtcaccaaatacaaaatttctgttgagattgttaacaaggccttgaagctagttatttcagaatctaaaccaaaggcgaagattgtggatatttgtgagaaaggggattcatacattagagagtaa

SEQ ID NO: 114036 - DNA, 282 bp, Glycine max
  Peptide Sequence Number=SeqID_230814
atgtttaacatcacagagaagaatattgatgtcgccgtcgctaacaataacaccaccaccaccacaaaagtaggttttgaaggagtgaaatggaacaaccataacctagaaaagaagcattccaatttgaatggcgaggagcacatgacaaaacaaatggaggcagaagaagaggaagatcgagaagttgatgaaggcgaaggagaacaagctagatgtcgccaaccttcgagaacccttttcactaatcttagccaggtcgatgctaaattgcttgactaa

SEQ ID NO: 114037 - DNA, 321 bp, Glycine max
  Peptide Sequence Number=SeqID_230815
atgggttacggcaactggttgcacggtgaagcggttgcggcgggcatggtaatggcggcgcgcactgctgagcgtctgggtcagttcagcgctgccgatactgaccgcattattgcgctgctgcagcgtgctggcctgccggttaacggcccggccagcatgacggcagaagcttatctgccgcacatgatgcgcgataaaaaagtgctcggcggcgagctgcgtctggtgctgcctctcgctattggccgctccgaagtgcgtggcggcgtggcgcatgatatggtgctggctgcgattaacgattgcaaagtatcttga

SEQ ID NO: 114038 - DNA, 567 bp, Glycine max
  Peptide Sequence Number=SeqID_230816
atggatgagttcaaaccggaagacgagttaaaacctgacgccagtgaccgccgtcccacgcggcctcgcaaatcgtcttctgcgccgaaagcgaaagtaccggtttcccgtcagcatatgatgatgggcatcggcattctggtgctgctgattctggtgctgggcattggctccgcgctgaccggcccggacgagaaaaaaccggccagcaacagcgccagcaccggtagcgcggcaccggctggcggcggcagtgaaaagaatatcgacctgtcaggttcaaccgccatgagcggccagcagaatgccacgccgtcggctgagggcagtgcgccgcagaataccgctggtaacgccgcacccgccagcagtgacggtcagtcaatctccatgccgtctgtctcctccacgccgactcaggcagcaccggttgacacaccggccaaccagcagcgcgtaacgctgccgggcgatctcaataccgcgctgaataatcagcagggttccgttgatgccgcggcgcagggcgcacagggcaacagttcgctgcctaccgcaccggcaacg

SEQ ID NO: 114039 - DNA, 3612 bp, Glycine max
  Peptide Sequence Number=SeqID_230817
atggtgttcatatttccaacgcttctgtccatgaagctccaaccacttttgctgcttcttgtgatgtacttctgtgcatttgctgcttcttctgagattgcttcagaagcaaatgctttgttgaagtggaaatccagccttgacaaccaaagtcatgcttctctctcttcatggagtggcaacaatccttgcatttggctcggaattgcatgtgatgagttcaattctgtttccaacatcaatcttacatatgttggattaagaggtacgcttcaaagtctcaacttctcattacttccaaacattctcactctaaatatgagtcacaactccttgaatggaactattcctcctcaaattggttccttatccaatctcaacactcttgacttgtccactaataacctctttggtagcattcccaataccattggtaatctctccaaactcttgtttctcaatctttctgacaatgatctctctggtactattccttctgaaatagtacacttggttggtcttcatacattgcgcataggtgataataatttcactggatcccttcctcaagaaataggtagattgatgaatctgagaatacttgatattcctcggtccaatatctcagggactatcccaatctcaatagagaagttatgcaatttgtctcatctagatgtcgaaagcaacgacctttctggcaacattccactgagaatttggcatatgaacctaaagcatttgtcatttgctggtaataacttcaacggttccatccccgaagaaattgtgaatttgaggagcatcgagactctctggctttggaaaagtgggctttctggctccattcccaaagaaatatggatgctgaggaatctaacatggcttgacatgagccaatccagtttcagcgggtctattcctcgtgatattgggaagttaaggaacctaaagattcttcgtatgtcgaaaagtggcttgtctggctacatgcccgaagaaattgggaagttggttaatctccagattctagatctcggatataataatctttctggcttcattcctcctgaaattggttttttgaaacaacttggtcaacttgatttgtctgataactttctctctggtgaaatcccctctacaattggaaacttgagcaatttatattatctttacctttataaaaacagtttatatggttctattcctgatggagtgggaaatctccattcactttccactatccaactgtcgggcaacagcctctctggagcaatcccagcttccataggcaacttggcccatttggacaccttgttccttgatgtaaatgaactctctgggtccattcctttcaccattggaaatttgtcaaagcttaatgaattatatataaactccaatgaactcactgggtccattcctttcaccattggaaatttgtcaaagcttagtgcattatctatatccttgaatgaactcactggatcaattccttccactattagaaatttatcaaatgtcaggcaattatcagtttttggaaatgaacttggtggcaagattccaatagaaatgagcatgcttactgctctggaaggtttgcatctagatgacaatgattttataggccatttacctcaaaacatttgcattggtggaacgttgcaaaattttaccgcgggtaataacaacttcataggcccaattccagtgagtttgaagaattgctccagccttataagagtcaggcttcagagaaaccagctaactggggatataacagatgcttttggtgtacttccaaatttggactacatcgaattgagtgacaataacttttatggtcaactttcacctaactggggaaagtttcgtagcctcacaagcctcaagatctccaacaataatttatcaggtgtaataccaccagaactagctggggcaaccaaattagaactgcttcacctgtcctcaaaccatcttacaggaaacattccacaagatttatgtaacttgaccttgtttgatctttcactcaacaacaataatcttacaggaaatgttcccaaagaaatagcatcaatgcagaaacttcgaactttgaagcttggatcaaataatttgtctggcttaatcccaaaacaacttggaaatttgctctatttattggacatgagtctgagccaaaataaatttcagggaaatattccttcagagcttggcaaactgaaatttcttacaagtcttgatcttagtggaaattctttgagaggaacaataccttcaacgtttggagaattaaaaagcttagaaacattgaatctctctcacaataatctttcaggtgatctctctagctttgatgatatgataagcttgacatctattgatatatcatacaaccagtttgagggcccacttcctaaaactgtagccttcaacaatgctaaaattgaagcattgagaaataataaaggcttgtgtggaaatgtcactggcttggagcgttgcccaacatcaagtgggaaatctcataatcatatgagaaagaaagtcataacagtaattttacccattactttgggcattctaataatggcattatttgtttttggagtctcgtattatttatgccaagcttcaacgaaaaaagaagagcaggctacaaatttacaaactccaaacatatttgcaatatggagttttgatggcaaaatgatattcgagaatattattgaagccacagaaaactttgacagcaagcatctcattggggttggagggcaaggatgtgtttacaaggcagtgttgcctacaggtctagttgttgctgtgaagaaactccattcggttccaaatggagaaatgctcaatcagaaagctttcacaagtgagatccaagctttgacagaaattcgacaccgtaacattgtaaagttatatgggttttgttcgcattcacaattctcatttttggtgtgtgaattcctggagaagggcagtgtagagaagattttgaaggatgatgatcaagcagttgcatttgattggaacaaaagggtgaatgttgttaaatgtgtagcaaatgctttattctatatgcaccatgactgctcgcctccaattgttcatcgtgatatatcaagcaagaatgttcttttggattcagaatatgtagctcatgtctcagacttcggaacagccaagtttcttaatccagattcatccaatcggacctcattcgtaggaacctttggatatgctgctccagaacttgcatacacaatggaggtgaatgagaaatgtgacgtgtatagttttggggtcctagcatgggaaatacttattgggaagcaccctggtgatgttatatcttgtttattgggatcatctccatctactcttgtggcctcaacactcgatcacatggcattgatggataagttggacccacgtctccctcatccaacaaagccaattggtaaggaagtggcatcaattgcaaagatagcaatggcctgcttgactgaaagtccacgatctcgccctaccatggagcaggttgccaatgagctggaaatgtcaagctcatctttaatggattag

SEQ ID NO: 114040 - DNA, 604 bp, Glycine max
  Peptide Sequence Number=SeqID_230818
agtgttggcaacatgcatcacagataacagtttgaatgcgaatgagagattgaaggctatccaacttacagagagtcacactgttgacaatgaagctgaaagagctcgacttcttgctgatcatcctgatgatcctaaaaccatagtagcagggaaagtgaagggaaaactgaaggttacaagagctttaggagtgggctacctgaaaaagaaaattctgaatgacgcattgatgggaatccttcgagttcgtgatcttaaaagcccgccatatgtttctactgatccatcattgaatgtgcacaaaatctcagattctgatcaatttgttatagttgggagtgatggcttatttgacttcttcagcaatgatgaagcagtacagcttgtagagtcttatatcttgagaaacccttttggtgatccagcaaaatttcttattgagcaactagttgcaagagcagctgattctgcaggcttcagcatggaagagttgatgaatgttccggatgggaggaggaggaagtaccatgatgatgtgaccgtaatggtgatcatccttgggatgaatcaacggacttcaaaagcatcaatttgcctctag

SEQ ID NO: 114041 - DNA, 880 bp, Glycine max
  Peptide Sequence Number=SeqID_230819
atgaatttcttaaaccaggagatgagcatgcttagtcctgaaggtgaactgaaaataagttttggctatcaatgcaatagtgatagagctatatcttgtaatgaaatccaaagaacaagcagtttctcttggttgtctggtgctgccttaagtgcaaatgctacacttgccaacacaaacatctgcaatggtgtaataggagaagaaatccttccaagtttggactctcctaaatcgtttcgtagggtgccctcttcaccaagttttccaaagttggacatgttatcatcttctgtcaatagtagtttgtcaaacctaagttgcagcccatccaccccaagtaatatgcttgaatatgacccttttacgttaagatccataagtgctccttccagaagtgaaggttttcttaatggcatggaagttcaagttgctggaggagctgctggtgaagatagagttcaagcagtttgttctgaagaagatgggtggctcttctgtgcaatttatgatggctttaatgggagagatgcagctgactttctggccggcaccctttatgacagtatcatatcttattttaacatgttatactgggatttggaaccagattccctaaaagcttctaacaatgagagtatgggtggatcctttcaatataattttaatgatagtcttaatcttcaggagcgtcaatctctgtcaaaaattaagggaaacaattctagtcttgactgttttgcaaacaatattccacattccaagtcgaaagcatctcctaaatcattttcacaaactacagtacttgatggcctccaacatgttcttagtcaggctgagaatgatttcctatacatggttgagcaggaaatggaggaac

SEQ ID NO: 114042 - DNA, 351 bp, Glycine max
  Peptide Sequence Number=SeqID_230820
atggtggtccgtgccttcgacggcacccgccaagaggttaggggagagattgacctccctgtacagataggcccccatacctgtcaggttacctttcaaataatggatattaacccgacttacaactgccttttgggacgcccgtggattcactcggtaggagtcgttccctctacactccaccaaaaactaaagttcgtagtagaggggcatttggttattgtgtcgggcgaggaagacatcttgtgtcgagggaagaagcctagagtatcaagaacctctggatttgaggtcaaatcttttcaagggggaggggatgatgcaatcctacctcccaagggtattggatag

SEQ ID NO: 114043 - DNA, 570 bp, Glycine max
  Peptide Sequence Number=SeqID_230821
atgactcatggggatcctccagtagagtattggaatgacttgaaaagtgcccttaggaagaggcacatcccctcctactataaaagggagcttatggacaagctccaaaggcttggacaagggagtatgagtgttgaagagtctaggaaacaaacggaactactccttttgagagctgggcttagggaggaggaaaaaacaagtattgctaggttccttagtggacttaatatggaagtgaaggacaaggttgagctcgttccatataggaacttagatgtactagtccaactttacataagggtagagcaacaacttaaaaggaaggctacttcaaaatcttatggctctcactcttatccaaagaaagacaaaggtcaaggcatcttaggggctgcaacttctaagaaaaaagatgataaggggaagaatagaaaaggaaaagaagaacaatctttaatggttaaggagcagtgtaaggagacaatctctgcatcttctccttgcaaaggaacacttgttagcactgccatacctcttaagcttgaggttattcctcaagtattttga

SEQ ID NO: 114044 - DNA, 891 bp, Glycine max
  Peptide Sequence Number=SeqID_230822
atgaaggaggattcctctaagtctaccccatctgatcatcagccatatgatcaaggaaacccaacccatcaagatgaacctaaggatgatgagtttaagtttgatttgacgtctaaatgggcacttgcagttggcaaggtcggcgtggatgatactgtatgtgaaaagtacgaaattaacaaggagaagtggaaccagttttgtcaaagccgtagagacccttcgtgggaggatttgcgaaagaaggcacgaccattcagaaacaaaacattgcccctcacttgttgtctcatgatgaagatggtccgcacaaagaaaactggtcaaatgacgttagagacagtaaaggaaattgctgacaagattgcctcacatggaagctttgtcgcccatggacatcaggatgtactgacttctgccattgggcaactagaacaccctagtcgtgtccatgctgctgaagtcggtgtcacgatcaacaatactttggatcggctccaaagccctcccggacttgcactgcttcctaagcctgagattggtccttctactgctcgtgtcagcacaaaggagagttgtgttggtccctcagggcataacccaaaaatggatgctaatgctcgcattcctgtacccagtgaagaggttcaattagtggggcagacacttaacaccttccttgcttggccgacacatcttgtcaggtgtttctcagaacatgataaacagggagctgagagaccagaggaacctatagataagttagatcctgatgttgatcccctatatctattgacattgaccatcccacaactttttcttaagccgttacaagttatgtgggatgctattgtgtttggggtgcataatgaaaacttcccttgtacataa

SEQ ID NO: 114045 - DNA, 720 bp, Glycine max
  Peptide Sequence Number=SeqID_230823
atgggtcctcttgtgatttcttcaaggtttctttggtatttttgctttgttctaagtgcagttagagtagtccacgtacaagctaataacggttggcttaacgctcatgcaacgttctatggggccaatcaaaatcccaccacccttgggggagcatgtggctacgatgacacctttcatgctgggtttggtgtgaacaccgcagcagtgatgtgtgactatagggcagacccaaaatggtgccttattagtcgcggggtgacagtaaccgccacaaacttttgccctccgaacaaccacggagggtggtgtgaccccccttaccatcacttcgacatgtctatgcctgctttctttcgcattgcacgacaaggcaatgaaggcattgttcctgtcctttatagaagggtggcatgcaaaagaagagggggagtgaggttcacattgaaggggcaatccaacttcaacatggtgatgatatccaatgttggtgggagtggggatgtgaaggttgtgtggatcagaggatccagaagtggggcatggctcccaatgcacaggaactggggagccaactggcagagcagtgcagatctcagaaaccaaagactctcgttcaagatgacattggttgatgggaagacactagtgttcctcaatgtggtgccttccacttggaggtttggacagactttttcatccaagagtcagttcttttag

SEQ ID NO: 114046 - DNA, 504 bp, Glycine max
  Peptide Sequence Number=SeqID_230824
atggcttctcaaaccttgcatgacacaaagaaatctcaagctaggcgagcattacgttctctagcaataggcattgcggttcccttcaccctcacgctaaccataatcatcctcttcggttcaggacgcaagtacaaccaaataatatccaagccattttggtttgcaccactttggttcattcacttgtccatattgggctcatctttcttcatgggtctcgcagcgtggctagtgtgggccgatggagggtttcaaggggagactgatgcgatgtctctctacatagcccatgtttctctaagcattgtgtggcatccccttgtgctcgttatgggtgcttattggcttgctttgatttcttgtcttgtgaattttgtgaccctctttttgtgttacttgaggtttagaaaggtgaacccttttgctaaagatctagccaaaccgtgtttggcatgggctgcatatctttgtcttgttagctttaagctaatatttatttga

SEQ ID NO: 114047 - DNA, 207 bp, Glycine max
  Peptide Sequence Number=SeqID_230825
gacgcggcgggcgcgggcggcggagaggtggtgacggatctcattgaagtcctgctccggcgtgccgaacttgccggcgccgatggtgccgcggaggacgaccagcgtgaggaagaggcagaggaaggtcacggtgctgtggcggcaggcgcgatgaatctgccggacgcgccgtgttccaaggcagcactccagcattgttgttaa

SEQ ID NO: 114048 - DNA, 123 bp, Glycine max
  Peptide Sequence Number=SeqID_230826
atgggttgtttagcccttcatgattatgaagggcttaactatacaaaaaagtttaaggtacctactgcacaaaaatttagaaaatgcctaaattccaatgtttcacacaaaaagaaagaataa

SEQ ID NO: 114049 - DNA, 2085 bp, Glycine max
  Peptide Sequence Number=SeqID_230827
atggaaatgaaggcaaagaacaacaagaaggtagggagtgaattgggttgtggtctcatggggagaattctccacctcaaaagccataagatgagaaaagcatctgttcattccctaccctttaagaatgcacagagtgatgatgatgtcaaaagtgaagaatcaaaggtttcaagaaaaagatccactggcactgagccaccacacaaaccgagtggtgtagaacaaaaacctgccagaaaaagtgcctctattcaccaacaaccttgtacaaatcgaaacaaccaacatcagaggcattcagatgttgctgcaagaagctcaacatcatcgtcctctagtacctcaatttcaactaaggttgttcaacaaaacaaggacaaaagtcatgagagaaaaccacaaggacagcccactggaaattctcttgtgcttgctaggataagtactagcaatgagaataatgagaacaacaagtctcaattgaaactcactgggaatttgcttgtgaataacaccccaagaaggaagagtgtggaatacatgcctaagagtgcagagttgaactctgtgcccagttcttacaccaatgcaagcaaaggcttgatggggaatatcttgaataggaacagcgatggcaataaggttgcacagtttttgagtccaaggatgaaaaaagtggaccctgaggtgtcgaaatccatgggaaatgatgcatacaagcagggaagatttgaagaggccttggctctgtatgatcgagcaattgcacttgattcaaataaggcaatatatcattgcaacaaaagtgcagctttaattggcttaggaaggcttcaggaagcaattgttgagtgtgaggaatcaatcaagctggacccttcatatgtcagagcccacaaccgtttggccacaatatatttcaggttgggagaagcagaaaaagcactgaattgcaatcagataaccccatatgttgattcaatacttactttccaagctcaggctcttcaaaatcaccttaaaaaatgcatagaagcacggaaagtcaatgcatggagtgatatactaaaggaaacacagtctgcaatatccttaggttctgattcagctccacaggtctacgctttacaaattgaagccttgctgaagctcttaagatatcaagaggcctataccatctacaataaaatgccaaaattttcaattgattggtgtaccaagatatttggcccagcttgtagcgcttacctattgatgataggctcaatgatttacttggcatctggcaggtttgaggaagctgtgacagcagctcagcaagcagttaaagttgatccaggcaatagagagctgaatgcaatggtaaagaaggccagagcagcaacatcagctagaatgagcggaaacttgctcttcaaggcttcgaaattcatcgaagcatgtgccgtgtacaacgaaggactagagcatgatccacacaactcagttctactatgcaacagagctgcatgtcgttccaaacttggtcaaaatgagaaagcaattgaagattgtaacgcggcacttatggttcagccaagttatagcaaagcaaagttaaggagggcaaattgcaatgccaagttggaacggtgggaagctgctattcaagactatgaaatgctattaagagaaaggccaggggatgaggaagtggcaagggctttgtttgaagctcagctccaactcaagatgctgcgtggtgaagatattaaggacttgaaatttggttcaaacttggtttccatctcaagtaatgatcggttcagacattatgtaacctcacctggtatggctgtggcgctttttaccaacaaggcaacccacaagaaagtgttgcttgtgttggagcaaatcagcaagagattcccatcagttaatttcctcaaggtggaaatcgaagaccacccctacttagcaaagtcagaaagtgtgagctctatcccagccttcaagatatacaagaacggatcaagcgttaaagaaatttcaggaaacaaccacgagttgttagaaagatcagttaaattgtatagcagctga

SEQ ID NO: 114050 - DNA, 261 bp, Glycine max
  Peptide Sequence Number=SeqID_230828
ggccgtccaaggtcggttctggctaccaggagacacatctttacagccgatgtcaccgaacacatgatgcaacagagcttccctttgatcaccatgcacgatggtgtcccatctgttgcccagccatggttccaatatctctctgagaatagtttaatagctggagatgaggtaatattcttcttcagatttgacgaacacgtatgggaagttctatttagaaaagaagttgtatgggatgatgaggacctctccaactga

SEQ ID NO: 114051 - DNA, 117 bp, Glycine max
  Peptide Sequence Number=SeqID_230829
atggtaacagccggtatgattatcatagtagaggtggggaattgggctgccaatctcaatccagttgtgccaaggtgtgaaagggagtcaagctacattgaatttcttatgggttag

SEQ ID NO: 114052 - DNA, 630 bp, Glycine max
  Peptide Sequence Number=SeqID_230830
atgggaggaaaaagtgagaaaggtgaagttatggagtggccagctgcaaacacaaaggctttcattgaaaaaatttatgagagagtgaaaaatgggcaattacaaaccttcaaaactacaacatgggaagaaattaacaaggacttgtttgagatgatccaaactaattatggtgtggacaagctgaagtctaagtttaatcgtttgagacaaatacatcgtgatttttcaactttgctagcccgtaccggagtcacttgggaaatggaatccaacaaagtgaatgcccttgatgaagtatgggacgaattgattaagaaaggaagacattacaagaatttcaagaaacatggttttgagtacgactatgatatccttggtgacatattcaattcaagcacaacaactgggaaactaagtcatgcttatactcaagatccaccaaattttgatgaggagagagccatggaaggtgatttccttacaaaggggattcatattaatgtttccgatgatgagaaggatgatatcaaagggcttaggcacaaaaggaaggaaatttttcttcaggacgtcattgtgtacattatgcttggtataatggtaagatatgccattgaattcatctga

SEQ ID NO: 114053 - DNA, 126 bp, Glycine max
  Peptide Sequence Number=SeqID_230831
atgtatgaagttgggttggggacccatgaaagttggcacagactaaatcaacaaggacaattggtgatagagtcctacaatacaagcaaacaaggcctcgaggcttattgccataatggttcataa

SEQ ID NO: 114054 - DNA, 171 bp, Glycine max
  Peptide Sequence Number=SeqID_230832
atgtcaactatcaaaagtaacgtcataaccaaagattctgaggttggtgccttgcaagaaaaggtcgttcaactggggatcaccgagggtatcaatatgcttaaggcatctctagaatccaacatggttctcaccactgtttttctcaagaacaatacatgcattatctga

SEQ ID NO: 114055 - DNA, 1950 bp, Glycine max
  Peptide Sequence Number=SeqID_230833
atggattcagagacgagtagaggtgcttctttgacggtgaagtatttgcaaatggggatatggtggttctcagtgatgatctttgttgggtatttaatggtttggattgtgatgcccaccaacatcttctttccacattggtttccagatattcaagctaaggcagattcaatatacttcggcagacaagggacaaccatactcatttacacgtttccaattttattaatagccactttagctagtctatatttccacttggagcaaaaacgttctaatcacaataccgaaaggtgggaagtcaagctggaatattcagccctcgctttaggcattgttgggtatatttgcttagccttattgttctttccggtcacgagagggtcttcaattttgcggttcattggcttaacttcagagggaagcatcaagtatcatatctggctaggacacattgcaatgaccctcttcacagcccatggtctaggttatattattttttggggaaagacacatcaaatcttggagatattcaaatggaacaaaattggcgtctcaaatgtggctggagctgtttctctgctagctggattaatcctgtgggctgctaccttaccttccataaggcgaaaagcttttgagcttttcttctacactcattacctctacattgtctttgtaatcttctttgtgtttcatgtgggattttccaactcttgcatagtacttccaggattttacctattcatgatcgaccggtacctgagattcctacaatctcagcagaaagttcgcttagtttcggcacgtgttttgccttgtgaaactgttgaactgaacttcgccaagaacataggactgtgctatgctcctacaagtaccattttcataaatgttcctagtatttccaagttgcagtggcacccttttacaatcagctcttgcagtgatactgattctgatactttaagcattgtcatcaaaagttcaggaacatggtccaatactttgtaccagaaactatcatcttcaattccaatatcccaccttgatgtttcagttgaagggccctatggaccagcttcaaccttttactcaaggcatgagctgctagtgctggtgagcggaggaagtggcattactcctttcatttccataatccgttcactaatttttaaggccaacactgaaggcagcaaaactcctagagttcttctagtatgtgccttcaaaaagtctattgatctcaccacgatagacctcatcctcccagtttcagccacttgcaccgccttcgatatctcacgcttgcagcttcagattgaagcctatgtaaccagagagaaacagccagatatgaatgacaaaaagctaattcaaacattatggttcaagccaaatgcattggatgaaccagtttctgcagttttaggacaaaacagttggctctatcttagcattatcatctcatcctcctttatgttattccttctacttattgccatcctaactagatattacatatatccaattgaccataatactgacatgatatacccttatttctcaaggtccagtctaagcatgttattcatatgcatatctatagcctttgtagcaacatctgctttcctatggaacaagaaacagaacaaggatttggggcagattaaaaacatttacacatccaattcatcaacttctccgggttcaggatactacaatgctgacagagaattagggagtcttcccctccaatccctcgtccaaacagctaaagtacattatggagaaagacctaacataaaaaaaattctctctggctgtaatggatcaagcattggagttcttgttagtggcccaagaaaaatgagacatgaagtagcatcattatgtacttcttgttcaacagatgacctacattttgagtcccttagcttcagctggtga

SEQ ID NO: 114056 - DNA, 771 bp, Glycine max
  Peptide Sequence Number=SeqID_230834
atggcaacacgaactggtcgcttgtttcaaaaccaaaacctcaatgtccacgttaatggaggaggagctgtttctgggaaggctgatttaaccggacagaggaaagttggggctgggggaagaaaaccacttggagatctatccaatgcagggaacctcatcaaccaatttgatggaaagaaagcccttgacggttcattgaacacaggcaaaccctcagcctctgttagtcaggcaccgaaattgcacaagtcaaagaatcttgaaagtgacaaaagaattccagcttctgagaaattactcactcgtggcaggaaagtactttctgacatttcaaactctgggaagccacaggttcctgagataaaaaataagaagaccctgaaaccaatagaggagtctcttccccccagtgcaattgccgaagaacaaatcttgcacgatcataagaaatgcatccaatcacagtttgaaactgcagatgtgcatcagtttttcaagactgttggacttgacgatgattcagatgatcacatggaaatttcctttgatctgtccgcaattagtaaactgaagtctgagagtgcatatttggagttggaggaggtaactgagtggttgcctgaagtgcactctctatctgctctgcatggtggttccccagcagtagtacactgcaagactccaggcttgtcaagttacagaacaatgtggaatgattctactgtcaatttcaagttgatagagacaccaaaattgtccaaaaaataa

SEQ ID NO: 114057 - DNA, 623 bp, Glycine max
  Peptide Sequence Number=SeqID_230835
atgtatgaggttttcttctacactcaccatctctacactctctacatcttattttatgccatgcacgtcggcgttgaatggatgtgcatgatttctccggggattttcctttttctcattgatagacaccttagattcttacaatctcgccaatgtgctccgttgctatcagctcgccttttaccttgtggtgcacttgaactcaacttctccaagaatccaagtttatactataaccccacgagcatggtgtttataaatgtgcccaagatttccaagctgcagtggcacccttttacagtcatttcaagttgtaacatggaaacagatattctgagtgttgccgttaaaactgggggtagctggtcaaacaaactttatcaggaactttcctcatctgctttggatcatctcaacgtttctgttgaaggaccctatggaccaactacgacttcacaatttttaaggtacaagcagcttgtgttggtgagtggtggaagtggcatcactcccttcatatccataatccgggatctcatatttcaaaaccgacaagaacaagaatcccacgttccaaaagtcctacttgtttgtgctttcaagaattctgctgatctaaccat

SEQ ID NO: 114058 - DNA, 543 bp, Glycine max
  Peptide Sequence Number=SeqID_230836
atgaggagccacacattccttaggataacttcacttttggtgtttattgggtggctcacggtttggatcttgttgcctacaaaggtttacaagaacacctggacccccaaactcaaaaccaagaacaaatctcttgcttttcacattccccgttatgctcataggggccctgagctgcatctatctccatcttcacgaaaaaggaacggaaaagctaccttccaaaagcggaggagttgtaaacagatggttatgtttcttgagacgtccatttcttgtgatgtctccaataggaattgtcacatctatggagattatttttgcactcatgtttgtcgcactcttgatatggtccctttccaattacttacataccagctttggacacctccatatgcacaaggagggcgagaaagtgtggcaagcaaagttcaggagtgtatccctgagacttgggtacataggaaacatatgttgggcatttctattctttccagtgacaagaggatcctctattcttccccttgttggactcacatctga

SEQ ID NO: 114059 - DNA, 1149 bp, Glycine max
  Peptide Sequence Number=SeqID_230837
atggattataaggccaagcattatctttttaggaccattgatagatcaatcttcgaacaaatcttggataagaacacgtccaagattgtttgggattccctaaaaagaaaatttgggggcaatgaacgtgtgaagaagtcattgctcaatgcattacgaagggagtttaaggtacttgaaatgaaagaagcagaaaccattattgaatattttgcaagagtaatggtagtggcaaacaaaattaggagcaatggggagaatatgcctgactcaaaggtggtggagaaaatacttcgaacattgacagagcggttcacctatgtagtagtttcgatcgaggagtcaaatgacacagcaacaatgtccattaacgagcttcaaagctctctggtggttcatgaacaaaagtttaaaagggccgcagtggagtgctttaagtgccacaatttggggcattttcaatatgaatgtccccaatggaacaaagaggcaaattacgcaaaattggatgaagaagaagagctccttttgatggttgttgtacaagaaaatgaagcaacaaggcaggatgcatggttcttggactcagggtgttctaatcatatgtgtggagacaaaggtatgttcacaaacatggtagaaggacataagcactctgttaagtgtggaaataactctcgaatgcctgtagctggaaaaggcagtgttagattggtatttgatggcactacttttcttgttcgagatggcttaatcacgcacacaaacatgagtgccaattgtatgtttgtccttttcaataaaagctctgaagtaactgcacctattgaagaatgtctacacacttcttctgatctcacttacctttggcatcaaaggtatggtcacttaagctacaaaggtttgaagacactacagacaaagaaaatggtgcgtggactacctcaactggaagtctcaagtgtcacttgtacagactgcttcaccgacaaacaacaccgtaatccaattcctaagaagagtgaatggcgtgctaccaaggtcttggaactcatacatgcagatatctatggaccaatagaaccaatctcaaatagtggaaagtggaatatcttatgtttcgtcgatgattgtagtcgtaagggctga

SEQ ID NO: 114060 - DNA, 1398 bp, Glycine max
  Peptide Sequence Number=SeqID_230838
atggttcccaaacctttttggactaaagctgtaaactggactagaacaccttcgagtttgaggttgtgtagcacacgtgcacataccagaggcaaaatgagtgatgagtcaaaggcttataatctttttgaccctaagacaaagaggattgtaattagtaaggatgtcatgtttgaggaagagaaaagtgatgatgatttcaatagtgaaaaaagtgaagggaagcataaagatgagggtaatagtgataggtttgtggaagacatggagtttaatagtgaaggtgagagtgatggaaataatgcaaggggtagtgaagctaggaatgaagcggggagttcacaagaaaatgtgattcaagggagagaaaggaggcagttggcttggatgagagaatttgtgagtggtgaggggttgagtgaaaaagaagaagcagaggcctacgcggtgcaagatgttgttggcgatgatccaactcagtttaaggaagctgtgaagcatgagaaatggagaaaggctatggatagtgaaatcaactcaattgaaaagaatcagacttgggagctcatggatctgctagcaaagttgaatgagctgggtgaaattgataagtataaagcacgattggtggctaaggggtactctcgacaacatggaatcgattttactgaagtttttgcccctgttgcacgcatggatacaataaggatgattgtggcactagcagcatgcaggggatggaacatatttcagttagatgttaaatctacattccttcatggagaattgagtgaggatgtgtacattgagcaaccaaagggatatatgaagaaagggaaagagcacaaagtttacaagctacataaagccttgtacggccttagacaagcaccaagagcctggtttagccatatagagtctcattttgtgaagaaaggatttcaaaaatgtccaaatgaacaaacgttgttcatcaaaagaggaacgagagataacatattaattgttagcatttacattgatgatttgatttatactggtaatgacaagggtatgatgattgagttcaagcaatctatgatgcaagcttttgacatgactgacctagggaagatgagattctttcttggcattgaagttttgcagaaacaagaagggattttcttgtgtcaaagaaaatatgccactgatatcttgaagaagtttgcaatgtatgaaagcaatcatgtgaaaagttcaattgttccaggctttaaaattaatagagatgttgatggcgcaactgtggatgacacttatttcaagcaaattgttggaagcttaatgtatcttacaactacaaggagtagtgtcatagatgtccaagaagcaaccaattattactctctcaactactga

SEQ ID NO: 114061 - DNA, 900 bp, Glycine max
  Peptide Sequence Number=SeqID_230839
atggctatccaacaacccggactaccccaacttcatcggacccaacaaaccccgcgtcctcctcgtaaccgggtccacgggattgagattttctacaacatggctctcttggacgcggaaatggcagggttttgggccaagcttccgttgattcggaagctcttgctttctcaccctgaagtggagtttctctggtggatggacagtgatgcaatgttcaccgacatggcctttgaggtgccatgggagaggtataaagattcgaactttgttatgcacgggtggaatgagatggtgtatgatgagaagaattggattgggttgaacactggtagttttctgttgagaaactgtcaatggtctttggatattcttgatgcttgggctccaatggggcccaaggggaagataagagatgaagctgggaaagtgctcactagggagcttaagaataggcctgtttttgaagctgacgatcaatctgctatggtttatttgttggcaactgggaaggagaaatggggtgacaaggtttaccttgagaatcactactacttgcatggttattgggggattttggtggatcgttatgaggagatgattgagaattatcacccggggcttggtgatcataggtggcctttggtgactcactttgtggggtgcaagccttgtgggaagtttggggattaccctgttgagaggtgcttgaagcagatggatagggcctataactttggggataaccagattttgcagatgtatggattcactcataagtcacttggtagccgtaaggtgaagagggtgaggaatgatactagcaatcctcttgaggttaaggatgagcttggattgcttcatcctgctttcaaagctatcaagctctcttcttcttga

SEQ ID NO: 114062 - DNA, 402 bp, Glycine max
  Peptide Sequence Number=SeqID_230840
atggctaggcgagttgaggcagccacagttaagctccaagggccactactcgtggatgaaaatgactttcgcttgaggggaagactgtcatgtgaaagagactcacatttgagggaaagattgttgaagtacaagtgtgaggcaacaacaacatatggcatgatggacaacatgccttgggcatgcattataaaagttggtaaaggagcaatcctaggccacacatggtcagaaaacatgaaaaggaacaaagttgggccaaaagtggaccacccagaccaaatttcaccggttgaacctggttcaagccaatttgatgacatcatcatcgatccaacaacatctgatccaattgttaacttgacttacctatcacttcagttgattcgagccaagttttaa

SEQ ID NO: 114063 - DNA, 897 bp, Glycine max
  Peptide Sequence Number=SeqID_230841
atggcactcagacccatcgacaacgctcttccgacaacaaccccagagagacccaaaaaacaacctaaaatcgctgttgcaacccaaaaacaacaagatcgtgcttccgtcaacggcgaaaacgtagttccattgccatcatctgaggatgccactgttgactatgtctcctccgacaaccttaaacccttggcggaccccgaagttaagattcagagtttggtggaagatttggattcgaaaaattggatcaaggtttgtgaatcgttgaatgatgttaggcgcttctcgttactccactcctctcttctattcccaatcttgggtaaaattgtgttggtggtggcgaagacaatgaggaaccctcgtagtgctctttgcaaaactgctattatggctgctgctgatattttcagtgcatttggtgacaagctgcttgaaccagagacctctgatgcatttgatggcttgctgctacagctgctgctgaaggcatcccaagataaaaggtttgtgtgtgaagaagctgatagagcacttggcataatggtgggctccatgacccctcttccactgcttaagaaactgagggtatatgtgagtcacaaaaaccttagggtcagggctaaggctgctgtttctctctccaactgtgtctccaagatggggcttgaagaaatggagcagtttggtttggctgaactgattgaagtggcggcggatttactgaatgatagacttcctgaggcaagagatgcggcacgaagtattgcaacttcgatgtacgaggcactgacaaaggactcggaagagatgatggaattgtggcagagcttctgccaatccaagttgccaccaatccatgctctttcaattttgaaaatagttaagccctaa

SEQ ID NO: 114064 - DNA, 207 bp, Glycine max
  Peptide Sequence Number=SeqID_230842
atgcagagcaatgagatgaatcgagaaatgagagtgattgagagatttgatgggtttaaaaaatggaaagagacgttggggggttatgtgtgtaacggtaacatttctaagtgggaagctttgtttgaaagtgaaacgttgcctgctgaatctgataatgccattgaattttcttccaaattatcacagatttacaacgttatttaa

SEQ ID NO: 114065 - DNA, 989 bp, Glycine max
  Peptide Sequence Number=SeqID_230843
agggaattccaacaaaaaattggccctttgagggttcagtcagtggcaacaaccactccaggagtcaccaaggcttcaccagaaggcaagaaaactttgaggaaaggcagtgttattgtcactgggcttcctctggattaggcctggccacggccaaggctttggctgagacaggaaagtggcatgtgattatgacctgcagggatttcctcaaagctgagagggctgcaaaatctgctggcattgctaaggaaattgtgtctcttgatagtgtgaggcaatttgtggataacttcaggcaatcaggcaggccactagatgtgcttgtttgcaatgctgcggtttacttgccaactgctagggaacctacatacactgctgatggctttgaactcagtgttggaacaaaccatttggggcatttcctcctttcacgccttttgcttgaggacttgaacaaatctgactacccttcaaagtggttgatcattgttggctccatcacaggaaacaccaacaccttggctggaaatgtgccacccaaggctaaccttggtgacttgaggggactagctggaggcttgaatgggctaaacacttcagccatgatagatggaggatcctttgatggcaccaaggcttacaaggacagcaaagtctgcaacatgtttacaatgcaagaattccacagaagataccatgaagaaactggaatcacatttgcttccctttacccaggttgcatcgccacaacaggcttgttcagagagcacatgttttatccctttacatgtgattttgaagaatccttgtttctcatgtttgaactgttgtgttcttgtgtgtttactggagctggaatgcagcctctgcttcgtttgaaaaccaattgtcccaagaggccagcgatgcagataaggcttgcaaggtttgggagattagtgagaaacttactggtttggcttaagtggcactatggcagcttctaa

SEQ ID NO: 114066 - DNA, 1179 bp, Glycine max
  Peptide Sequence Number=SeqID_230844
atgggtgcgatgaccgcaaaccggaagcgctccgaagaatgcatgaacgtaaaccacacaaattccgattctccgagaaaacgcgccaaattctcgatcaaacccgttccgtccgccaccagcgccgtcgcgagactctcccggtacccagaggttcacgcgccgttggcgagggaggttcacgcgccgtgccggtcgcgaaaattcgaacgctctagggttattgtcagtgccggcaacgtcatggggaactttctggcaacgaagttcaaggaggcgaagcgttcggcgtcggcgaaatgcaggaacctggtggagaaggggaaggaggtgattgaggtggacgcagagacggagagtgaagagcgttacgtggattcgagtgtggaagaggcgcgtggcgatggtgacaaggttgtcagggttcagcagcagtcgcagtcaacgttgtcgtttgattcggagatgatgaatgcggagttgaagatggtgagtggtgggaaggtgtggggttatgagacgcagcgtgatttggaaaatgttcatatgtataagaagttgcttgaggatgttgggaggagaagtggcacgcttcagaggctgaattttgagattgatttgaatgagaagcgcagggaacattataatttgttgcggccgaagaaggaattggttgaggaacaggaagtgccgcaagagccttttgttgctcttacaagtgaggaggaagatgaggttgaatgtgccttttcttccaactggaggaggatcttggttacccacgagaattctaacattgtgatcacgggagagaagtttcagtgccttaggcccactggatggttaaatgatgaggttataaatttgtacctggaattgcttaaggagagggagcaaagagaaccacagaaatttctgaaatgtcattttttcaatacctttttctacaaaaagttaataagtgggccgaaaggttatgatttcaaatctgtcagaagatggacaacccaacggaaattgggatacagtctacttgaatgtgataaaatatttgtacctatccatcaagagatacattggtgcttggcagttatcaataagaaagataagaaattccagtatcttgactcaatgaaaggagaggatagttttgtgctagaaaagctgtccaagatctaa

SEQ ID NO: 114067 - DNA, 1607 bp, Glycine max
  Peptide Sequence Number=SeqID_230845
aactcggtttcagatctgaatcgcaatcgtttgggagatccacagtggctgcattctccgttcaattctcgcacctttcatgctcttctccacgtgcgaacagatcttgaaaattggcgcctcaacgacgttcgcagcgccacgcgagtggccagatgccgcagggcaatgccgccgccgcagctgcgctgctggaccacggcggcgatgctggcgacgccgtcatggcgcggtggctgcagtccgccggcctgcagcatctcgcctctcccctcgcttccaccgccatcgatcatcgactcctccccaaccttctcatgcagggtgtattactctatgaattttgagctgtcctgcagtttgagggatgaatttggtacgggctatggagcacagtctgctgaggagaagcagaggcttttaaagttaatgagaaacctcaattttaacggggaatctggttcggagccatatacgcctaccgctcaatctttaggtggagtggctgggtcggatgggttttattctcctgagttcaggggggattttggagctgggcttttggatcttcatgctatggatgatacagagcttttgtctgagcatgtagtttcagaaccatttgagccatcacccttcatgcgtggggatactagagtatttgaagacgatttcgatccaattaacagcaagctggagagcggggaagcagatactgatgcatcaatttccttacctatgaatagcacaagggaaaataatgttgctaagattaaagttgtggtacgcaaaagacctttaaacaagaaggagcttgctaagaaggaggatgatgttgtaactgtagctgacaatgcatatttgacagtccatgaaccgaaactaaaggttgatttgacagcttatgtggagaagcatgagttttgttttgatgctgtgcttgatgagcatgttaccaatgatgaaggtaaggctgcgtacaacatccctcccccataccttcgcatagcgaagagcctctgggcaatgggtcactccacttgcattcactattacgatgctaataatgctttgctttcaggaagtggcaaaacatacacaatgcaacctttaccactcagagctgcagaagaccttgttcgacagttgcatcagccagtttaccggaatcagagatttaaattgtggcttagctactttgagatttatggtggaaaactttatgatcttcttagtgacagaaagtgggtattcaatcttttatatcactacgttgggaaactttgcatgagagaagatggacggcagcaagtttgtattgtaggactgcaagaatttgaagtttgtgatgtacaaattgtcaaagaattcattgaaaagggaagtgctgcaagaagtacaggatccactggtgctaatgaggagtcctccaggtcacatgctatcttgcaactggctgtaaagaagcacagtgaagtgaaagcgagcaagcgaaacaatgatgggaatgaggcaagaagtgggaaggttgtggggaaaatttcttttattgatcttgctggaagtgaacgaggtgctgacactactgataatgatcgtcagacacg

SEQ ID NO: 114068 - DNA, 381 bp, Glycine max
  Peptide Sequence Number=SeqID_230846
atgaatgttgaagaacgcaaaataggggaggagcttgccacccagctcgcccaggcgagcaaggttgcttcctccagaagcaacaaccttctggaggaagaatctggaaggcccaagtgggccggattgctatttctttcgaagaagttacggaaactcacggattgtgcaaaaacacctcttttttatttctgccacattacggaatttcacggatcgccaatggagaaagagaaaatgcatgtggtgaccagtgagagcactgataacctcgtcgctagacacgaacattccgacgaaggttccgagaaacaaaccgtatctcagtgtttccttcagatctgccacaatctcttcgccgttcgaaattcaaaaccataa

SEQ ID NO: 114069 - DNA, 375 bp, Glycine max
  Peptide Sequence Number=SeqID_230847
atgcacactacacatcaagttaaaaatatcaagaataaccttgcaattatcataaatgccactatcactatagcaaggaaaaggtatccacctacaccaaacttaacaaaagataaggaatcaagacaagtacacttaaagccagatgtcgcaacatgcccttttgtgggcgagcgaaggcgaggctcacgggtgcgctttccaaaggaggaaagatgcgcggagtcgccaccaacgtttatttgtggaaaacgtcgggaaaatcgaaggagaccggtcaaaatgaaaatcctaagttcgggagttgtatttacgtttgaggaaggtattagcagctctcacgtttgtctcaaaggacaacaacctattttttag

SEQ ID NO: 114070 - DNA, 277 bp, Glycine max
  Peptide Sequence Number=SeqID_230848
atgggggttcaaatagcaaccaggcccacttgggccttccaggatgttcctccaaaaacaaccgccttctggaggaagcaacctagatcgcctgggcgagctgggtggcaagcatctccttccttttcctataaatatgggaaggagggaagaacaaaaaagttcaaccctcctgaaaatccatgccgaggcgcttccgtaacgtttccgtgggtgatttcacgaagattttcaaccgttcttcgtttgttcttcgtcgttcttcggtcttcaactg

SEQ ID NO: 114071 - DNA, 141 bp, Glycine max
  Peptide Sequence Number=SeqID_230849
atgctgcaaccaagacaacaacttctcaagtatacaggcaattcaaacaccaaaattagaaaccctctgaaaaagccgaatctctttggcagcctcatattccaccccctcttcctcctccacctcactggaggaagataa

SEQ ID NO: 114072 - DNA, 1077 bp, Glycine max
  Peptide Sequence Number=SeqID_230850
atggaaggtaacaaggacgaagcattacgctgcgttcgcatcgccgaagaagccatcgcgtcgagaaacaaagaccgcgccctcaaattcctcaaaatcgcgcaacgtctcaaccgcgatttgcccctccaatccctgctcgacaagtgcaaccgcctcgattctcacaccgcctccaccgcaggcggcagcggcgcctctctggcgaacggccactctcctcgtcgcgagggcttagacgtggaaagaaattacacggacgtgcacttaattagggaaatcaaaggaaagagcgattattacgcgattctaggattagagaagagttgctccgtggaagagattcgaaaagcgtatcggaagctctctctcaaagttcatcccgataagaacaaagctccaggctccgaagacgcgttcaagaaggtttccaaggctttcaagtgtttgagcgacgacggttccagaaggatgtacgaccaaaccggaaccgccgccgacgatttcgagagcaccgaggtaaacacgttccggcgtagaagaagaagaacggcgacgacgcgcgatttcttcgaagacgagttcgatccggacgagatattcagggcgttcttcggacactccgacgtgttcggaagaaacaaccacgtttaccgaacccgcggcgggatggggaatccgaatcatcagcataggcatgaattcaatgctggaggatcgggagggaggcatcacaatgtgatgcttctgattcagctcttgccgtttttgattattgtgctgctcgcgtacttgccgttttcggagcctgagtattccttgcacaagcattacagctaccagattccgaagaccacggatcggcacggggttcagttcttcgtgaagtcggcggcgtttgatgtgaattatccgcccgggagtgatgctcgtgaggcagttgaggagagtgtgatgaaggattataggagtatgctgagaagatactgtcaggtggagatgcagagacggagctggaataggaatctgccagctcctcactgtgataagctgcataactttgcagtgatggcatga

SEQ ID NO: 114073 - DNA, 3432 bp, Glycine max
  Peptide Sequence Number=SeqID_230851
atggaggaaacggtgtctcgcgtaatctccgagctagaggatctccgtggaaaccctcaaccaccaccactctccgaacaaaccctaacgaatcttctatttctcctcaaacactctctttcagagtctctctacgatgagctttcatcgaagaatctctctccgtcttctctcattcctcccattgcttccgcaatggactcttcccctccgcaccactctcttctcgcttccgatgtcttcctctcgcttctcctcgctccgaacgcacccgtttttacactctttacaccaatgtcgtttctttccttcctccgctccctccgccgctcctgcaaggcccactcccaccctggcccggcccaagacaactcgcagaatggcaaacgaaagcgcccgggtcgcggtcgcgcgaaaaatccccaaaacgaggacgattcgcccgacactagttcccaacacgaccccagggtgctcctccgcgtgctggagaagctagtcgaagtgatgggtttaatccacctcaaccgcttccccgagactctgaagtcgctgatccaaaccgtggctgaaatccccgtgacctcgctcaacacgtgcgggaacgcggcggtgtatagcagactgcttagcctctgctcgcacgtgctgaaggaagttctcaaatccgagcacggtgaaccttccaacactgctgcggaggttttgaaatcgctgtgttcgcttgttctcatggcgaagtcgcaggcgaggacttttgcgctcggatttgtcacgagtcttggtaatcaatgtgatgatgtgaaaaaggcgctggttaattttccgaggtatttggcgaagaaggcgccggagaaggccgagccgagagcattggctgtggagtccatcatggaggttgttaaagtgatgggttttgatgatcaaattgcgtttgtgaagtatgttgtgcagatggctcaggggaagtccagtcttcggcttttggcggttgatctcattttgaatctggtgatgtcgttgaaggatccgttgggcgtggagagtgaagagagtgaggtgtgggggatttggtgcttggaggtgctgttgaaaaggtgttctgatgtgagtggcgcgattcgggcgagggctttgtcgaatttggcccagctggtggggtttttgtctcgcggtgagaggactagtgtggttctgaaggagtttatggggtttggaaaggttggtgatgggaatgttgaaggtggaatgaatgacatgctgaggagaaggtgtatggatgataaggcagctgtgaggaaagctgcattgcttttggttactaacttgacttctcttcttggaggcgccattgatgaagtggtgctcaagacaatggggatggcttgttcggatccacttatcagtatgcggaaagcggcaattacagctctatcggaggctttcagaacattctctgctgaaacagtaataactgagtggctacattcagttccgcgtttaatatctgacaatgaatcaagcatccaagaagaatgtgagaacatgtttaaagaacttgttttggaccggataattagagctgcaactgctacctcttcatatagcgagcctttgtctaatagaaagatgaaaggaaaaggtttagacaatgagatggagatgttttttcccaatggaactctgtatcttctgagagagatttgccatggggaggtgagcccttgggtgaagaaaatttgcacaaatctgggcaaaaagaatcgtataaatcacaaaattgttaccgcacttcaaaatataatcagggtgtcagagtctatctggctgagtcactccatgccaatagaaaaatggactgccccgccaggtgcttggtttcttttgtcagaggtgtcaacattcctttcaaaagtagtagactgggagtttcttcatcatcattggcaacttcttgacaaacatgaagtggaaggtgagttcaaaagcccatttgtacaaagaaatgcatctgaagaggaagaaagcatagaatgcaatcatgttgcctgggctagtgaccgagttttcctcttacaaacaatttctaatgtttctgtggagctgccccctgtacccgcagctgatttggctcataacttgctcaaacgggttgaacaattcaacatgcattcaacagaggttgatgctcatttaaaagcactaaaaacattatgcaagaggaaagcttcaaatctcgaagaggcagaagcattagtcttgaaatgggtccaccaagttctctccagggcttctggaataatagaaaaattcatttcagagaattcagaacaaaacgcagaaggtagcttcttcactccacctagaagtgggactagcaaaggcaggaaatcagtagcaaagtccaagtcattgtctaaagcagtaacagcgatttatacagttgggtcggtagttattgtttgcccatctgctgatatgagcaatttagttcctctgttgcatacaatcatcacttctgggagttctggtcctaaattaaataacctacccagcccttcaacttctttgcaacaggaagctccctctttttatattcaagggtggctagctatgggcaagctttgccttgctgatgggaagctagctaagaattatattcctctgtttgtacaggagcttgaaaagagcaaatctgcagctcttcgcaacaacattgtggtcatgatggcagacttttgtgtccggttcactgctcttgttgattgcaaatattcgccttgctattctaacttctttttcatggaagttatcagttacataacaaagatcacaaggtgtctcttagatccctgtgaacttgtgagaaggcaaacgttcatattgctttccagattgctgcagagggactatgtgaaatggagaggagtgctatttcttcggttccttttgtcacttgttgatgaatcagaaaagataaggcagttagcggattttctctttggaaatattttgaaagtcaagtctcctcttttagcatacaatagttttgttgaggctgttttagttctgaacgactgtcatgtccataatgggcatcgtgagtctcaaggatcacgaaaggaaagccaaatcttttccatcaggggtactgatgaagagtcaaggtctaaaagaatgcacatttatgtttctttactaaaacaaatggcccctgagcatcttctagcaacctttgccaagttatgtgcagaaattctagccgcagcttctgatggtatgctcaatatagaagatgcaactggacagtctgttctacagatcgaacggctggtcggagtgggatccaataactcaaccggtttggctcaggcatcggaaacccggtgtgacctgggcaagtttatggtcagaccagcaaacagcgggtaa

SEQ ID NO: 114074 - DNA, 426 bp, Glycine max
  Peptide Sequence Number=SeqID_230852
atggcacaaaacggtgtttctcacctcacaaagatctcctactttgagcattctcccgatcccttccaactccaaaaagttgttttgtgtgaaatgccaaagcctttagctacgattttgtgcgatggaaacatctcgttgtcgttgaccaagtgcacgaagtcgtcgacattcctcctcttcatagcatcgttggagagcagaatcaggaattcatgggtgttgattgttggaactttcgagaaggtgcaaaccatgcaaagaggaggagatcatggacatgctatggaacacactgttgcaggaatcaaggttagaggaccaactggtgtccatggcggagaaggaggaggaggcttcacaatgaggggcagggcgagttcgaatctggaaggggtaggtggtcatgaagaagttgccgactag

SEQ ID NO: 114075 - DNA, 255 bp, Glycine max
  Peptide Sequence Number=SeqID_230853
atgatgatcacgatccttcctaacggtgttgtccatgctcttcagctctcaaaagccctcaagtcgttgttggatcttgatgctgttgtggagggttgttatcactttattgtggttgtgctaattaccacaaccatggtgatgagaatcctgaaactggccaaatatatgctaaatgcccaagtggagaaggatgaaggcccagaggcagagacactattaagactattaattgttgttgaagacctagattaa

SEQ ID NO: 114076 - DNA, 531 bp, Glycine max
  Peptide Sequence Number=SeqID_230854
atggattctggcaacagtggaagtatctcttcaagtggtgatgaagaatacgattcacgagctgatcacacagtactcccttccactttcatcaataaccaccaccaccaccctccttcccaatttggctccatctcacaacaccctcttgttgcttcttctcattaccaacaacaccaacctcacccttctttgtttgatctctctccaagctacctccacgccctctctcaaccaaactcattcctcaacttggacaccaccacatcctcgtcgcaacctcgaagatctgaacccgattgcacccttaatgttacctcatcaccacctccaccaacaacaacaaacatagaccaatgtttgttgggttctcaaggaggcctcaacgtggacaatgcaagacgagacacaattctgttcgagtcaggtaagaccagtaaccttggtcgcaactcgaagaagcgaaccagggcttcgaggagggcaccaaccacggttttaaccaccgacacatcgaatttcagggccatg

SEQ ID NO: 114077 - DNA, 831 bp, Glycine max
  Peptide Sequence Number=SeqID_230855
atgggcttcttcataagcaggagtacattgaaagtcatgtcattgattacttccaagcgttgtatgcctctcccaatgtatgttcaagacaacatccctctcttggtttcatctcaggataatgattgtcttactaaaccttcttcattggatgaagttagacaaattgtgttctccatgaatgggaaaggtgctccagggtcggacgtggtgttgaaccctaaattttcggaggccgctgccattagtgactatcctccaatagtgctagcaaacttccatttcaaaatcattgcagacagggtgtcaggcgtaaggagatccattctctcggctacttttctaactggcggaagacattcttaccttagccttctctcgcttggtctcctcggagccacttcttctaatacgaagcactacaacaagttttcaaggagtacaaggaagcctctaggcaatgcctttatctatccaaatgtagattctttgctagccttcaagctactaaagtctctcctgcttcccattgtcgataaaattaaagctaagttgtgctcctggaaaggtaaacttctatctgtgatggggagggttcaaacgatgggttggatcaagggcaattctgatggggcgacacagggaagccttggttttgcactcgtgagtgttatttttcgggatgataagggtgctgctattagttgtttgacctccttcattggggttgctgttgtgtttgaggcccaactgttagcaactattcttgctattgaaacgacaaaaagtaagaattggcattctttttggcttgaatgtctttgctggtga

SEQ ID NO: 114078 - DNA, 129 bp, Glycine max
  Peptide Sequence Number=SeqID_230856
atggcttggatcgaggttggattttatttgcgattatttcatataaggatttcatgtttaggattggggttggaagatgatgttagagatagggggagcaacaagaacaacatgtggactaaagcttga

SEQ ID NO: 114079 - DNA, 282 bp, Glycine max
  Peptide Sequence Number=SeqID_230857
atgcctcacccacttgtgttgcctgatgatacaacaaacatgccatatccacctgtagcagcacctgttgatgctgagatgccccaacatgcagtggttgtttgccaaaagatagcaaaaagcttgcaacgcatgttagatatgaggatggtgactgctggaactgatgcatacactataatagaccagtatataacattagccaggggtcacgaaaatgtttatgttcggtcaagaagaaggattgatacacaggggagagatggtggtggacgaggatga

SEQ ID NO: 114080 - DNA, 1164 bp, Glycine max
  Peptide Sequence Number=SeqID_230858
atgcgcttgctctcatcttcgatggacaaaacagtgcgactgtggcatttgtctagcaagtcttgtctgaaaattttttcccacagtgactatgtaacttgcatccagtttaatcctgttgatgatagatacttcattagtggatctttggatgctaaggttcgtatatggagcattcctgatcgacaagttgtagattggactgatttacatgagatggtcactgctgcttgttatacgcctgatggtcagggtgtgctaattggtacatacaagggtcgctgccatttatattattcatctgaaaataagttgcagcagaaaagtcagataaatttgcagaacaggaaaaagagatcgaaccacaagaaaattactggcttccagtttgttcctggaagttcatcagaagtacttatcacttcttctgattctcgaattcgacttgttgatggtgttgatttggttcataagtttaaagagtgtgtattaagtgagagcccaagagaatttaattttcacaatacacataaatggtcaagactgattttacttaaaaaccatccatggtttcggaatgcaaatagccaaatttctgcctgcctcacagcaaatggtaaatatgttgtctcagcaagtgaggattctcatgtatacatctggaaaaatgaagctgattgcagacctaacaggagtaaaggtgtggctgtgacaagcacatatgaacattttcactgtaaagatgtgtcagtggccattccttggccaggtatggatgatacatgggagatgcatgatccatattttgcagaagaacctgagcttgatgatgatggggatgaggtcttttcggccaatcatcctcctactcctgtagaggaaaatctatgttctgagggttcccaatttgcttcaggttgcaatagcagtccacttcatggaaccattgcaagtgctacagatagttattttcttgatagaatttctgcgacatggcctgaggaaaaacttctaactacaagggaccgaagccctcaggtaagtgtggatttatctaaaggggtgaatcaaaacatgtcagcctggggtatggtgattgtaactgccggccttcaaggggaaattaagattttccaaaattttggattgccacttggtatataa

SEQ ID NO: 114081 - DNA, 564 bp, Glycine max
  Peptide Sequence Number=SeqID_230859
atggggatagacccaattggttggattgctagggctggaaaattctttgaggtacaagaaattccttcatttcataagctgcaatatgcattcatgagtatggagggtgctgcgacatattggctctacatttggagccaaaacaacccagattcagattgggagtcatttttcacagctttgataaaaagatttggagatcgccatggtaacctcatctttgaaagattgagtatcttgaaggaagaaaagccaactgagacaaaaatccacataaaaaaatgggagacttcaacagagttcttgaaagggaggaccaacattttagagcgaaaacacatgttgcgcaagatattgaatgaagaagttgattcccatgcctctcaacaagacaaaaatagcatggagggaaatttaatcaaaaaggaagtcgaagctggtgattcaaccaagccacgttgttttcaagattcagatttccataaaaagattgttatggtgaaacaaaaatcattcatgaaggtggttggaacaacaatggtgctggaatcttggaatgtctaa

SEQ ID NO: 114082 - DNA, 2835 bp, Glycine max
  Peptide Sequence Number=SeqID_230860
atggaatttcgtatatttgaccttcacaggaagctacaacaacactctggtttgcctcaagctcatcaacatccaatgcaagaacagttggacaaaagaaacataattaagtttgattctagcagattcaacaggtctatagaagattttaccttatctatctcaaaatacagagataaaacaggaaatactctcttaaattgccgtgtagaggatgaattaaatgaggatgcatcgcagccaaaaaaattgtttgatcatgtaacatttacatctgcttgcaaacataggccaagccagaaaaatcatgaagaaagttctgagatacaaagattatatagcctaggaaagtttgatgaagtttgttgttcaaactccagaagatattccctgcaggacttgtcagaactgactgaaaggagaatttcagaactacattattcagaggtattaggaaaatgtgatgaagaatatactgtagacattgcatcaatttatgagagcttgattagttcatcgggcgctacttatgcttccttaaaggatgtgattttggatgagctgctaatagctatctctacttccaaagaagaaagaaaaataagggcatcagtatctattctgacaacaataatttcaaggaacaagtcaattatagaagacgtcaagaagaaaggtttaaggttgtgtgatctggcaagtgctctaaaacaaaatgtccatgaggcagcaattctaatctatttaataaatccttcacctatagatataaaaacattggaacttctgccaatattagtggagattgtatgcacttcaaatagttacaagaataagcaagagtcacttcttttgacacctcatgcagcatcattgatgatcatcgaagaactagtaacttcatttgactatgccacaaataacatgcatttggccaccatcagttctcctcatgttctcagcggatttttagaagttgccaggaatgataatctagaagaatttttctctttaactactattcttataaaatgcatgcagtatgatgcccagtgcagaaagtatgtgtcgcaatttactcctcttgctccctttatccaccttctgcaatcagaaaacacacgcgccaaatgcacagctcttgaattttttcatgaaatcctttgcataccacgatcatcagctattagtctgctgcagcgtatacagcaagaaagcagcatcaatatcatgcagatactattgcattgtgcacatcagttacaacctgatcaccagcttttagcagcaaatattttgcttcagttagacatactgaacttccctgataaaggcatcttcagagaagaagcagtgcagatccttctcagagcaatgacatctgaagaaagctcagaacagatattatctacatccattctatcgaatcttgctggtacatatgcttggacaggagaaccatacacagctgcatggttgctgagaaagacaggcttgacctctccctatcaccagaatatgataagaaacttcaactggctggatcagagtctacaggataccagcacagatttgtggtgcagtaaaatttccaaatgtatcataagccatggggattctgtcttccatactttagagagggtgctaagaagcaagataaagagggtttctagagactgccttatagccatttcatggcttggttttcaaatatcaaaaagcccagacagcataagttattctgcatctgaggttatactaagtggaattgagcagtttctgcatcctgggatagagtcagaggaaaggcttctagcatgcatgtgcatgtttaattatgcctctgggaaaggaaagcaaaaactaatgcatttctcagaaggagtaaaggaatcactaagacgcctttcaaatgtaatttggatggctgaggaattacacagagtagccgatttcttgctgccaaacatatcagtctgggatattagggggcactcagccagtcttgtatgggacattaaagagcacaagaagtctgtgacatgcttttcacttcatgagccgtcagacagccttttaagcggttccactgataaaaccataagggtttggaaaatgatccagagaaagctggaatgtgttgaagttatagcattgaaggaaccaattcatcatttgcgtgcacatggtgaaacaatttttgcaattagcgaaagccacggattaaagctagttaatgaatcaagagtgaccaaagatattttgaaaggtaagcatgtgaagtgcatgacagtggctcaaggaaagttatatattggatgcacagattcaagcatacaggagtattccacaacacacaaccgtgaactagaaatcaaacccccaacaaggagttggaggaagcaaagtaagcccatcaatgcagtagtagcatatagagactggctctatagtgcaaataagtatgttgaaggcacaacattcaaggaatggaaaagaactaagaaaccaaaagtttcaatttttacggacaaaggagataatgtggcggccatggaagtggtagaagacttcttgtacctaatctccagctcttcaccaaacaacattcagatatggttgaggggggcaccaaaaaagttggggagaatatcagcaggaagcaagataacaagcatcctcgcagccaatgacatcattttctgtggtactgagacgggactaatcaaggaaatgctgtatatcaaatatcagggtgatattattcctttcaaccatgagtttgcaaatctgaagcaagataatattccaaaacatataatctctatctattaa

SEQ ID NO: 114083 - DNA, 156 bp, Glycine max
  Peptide Sequence Number=SeqID_230861
atgtggttgggttatttcaagttcaacaactataactccatcttgcatcgttactccaaatcagaagctcactacttggacgatggtcttcatggtgcaaaagagataggggagcaacatgagcaacatggtgaacaagctaaggctaaagcttga

SEQ ID NO: 114084 - DNA, 531 bp, Glycine max
  Peptide Sequence Number=SeqID_230862
atgaaggacgacatctccagaaagtgctttcagcaactcattagtgccgttgatttctgccatgaccgtgatgtcactcaccacgatttgaaatctgaagagatactcctcacattgtgcgacacgtcggcctatgtggcaccaaaggttctcaagaagaagggctacgatgggtccaaggcgtgcgacacgtcggcctatgtggcaccaaaggttctcaagaagaagggctacgatgggtccaaggctaatatatggtcttccgagggccaaaagttgatctctaatttactcactatggacccacgaaagaggtattctattcctgacatcatgaaggaccctaggtttcaaattgggttcatgaggcccattgctttttccgtgaaggagtcagtggtggaagataacattgatttcaatagggatgatgttcctaatgtgaattgtaatagcaatggtggtggtaatagcaacaacaacgatgatgaggaagtgattatggtgtaccattgctggaaattgtcttag

SEQ ID NO: 114085 - DNA, 348 bp, Glycine max
  Peptide Sequence Number=SeqID_230863
atgacaagattgaatggactttggattgttgtgagtgctttcaaggtgagcgtggagtatggtggaatcaaaagcactgccaatcaacctcctcctcgtcaagttagttctgccacccaggatccagggtcctctaacactctggctcttccagcttcttgcggcattgccattgtctttattacatcggtgcatatgctgaccttaagtctcgggagttggggaaactcctttgtccgtaagaagatttgtagaggacaaggtcccggagattccaaggattctcagaaaggaggaccccaaaatgccttggttgttggtccaactatcccatccacaacaccgtaa

SEQ ID NO: 114086 - DNA, 837 bp, Glycine max
  Peptide Sequence Number=SeqID_230864
gtcatcagcggtcacttgggatgggtgagatctgttgcagttgatcccagtaacacatggttttgtactggttctgcagatcgaactatcaagatatgggacttggcaagtggagtattgaagctcacattaacaggccacattgaacaagttagaggtcttgctgttagcaacagacatacttacatgttctctgctggtgacgataaacaagttaaatgttgggatcttgaacagaataaggttattaggtcttatcatggtcatctgagtggtgtttattgcttggctcttcatcccacaattgacgttttactaaccggaggacgtgattctgtctgccgggtttgggatatacgaagtaaaatgcagattcatgctctttcaggtcatgataacactgtctgttctgtgtttacgcggccaacggatccccaagttgttacaggttctcatgacactaccatcaagatgtgggaccttagatatggtaaaacaatgtcaactcttacaaaccataaaaaatctgttcgagcaatggcccagcatcccaaagagcaagcttttgcatctgcttcagctgacaatattaaaaagttcacccttccaaaaggagaattttgccacaatatgctctctcaacagaaaactatcatcaatgcaatggctgtcaatgaggagggtgtgatggttactggaggcgacaatggcagcatgtggttctgggattggaagagtggtcacaatttccagcaatcccaaacaattgtccagcctggtatgctcttaggatgtttagtaatttgccacttagttctatcatacccacgagattga

SEQ ID NO: 114087 - DNA, 651 bp, Glycine max
  Peptide Sequence Number=SeqID_230865
atgggtggatcagctatattgatgtctagtagagtccaagatatgcataaggcaaagtataaacttcagcatattgttagaacaatcactgcacaggatgatcaatctcatggatgtgtctaccaacaagttgatccagagaacaaggaaggtatatccatctcaaagaacatagtaaatgtgtctggagatgcactgaagaaaaacatagcttctctaggaccattggttctgcctctgaaggagcaattcttgtacttgttttcaattattcgtaacaaaatttggagtgcaaggaagataagcatgtacactccaaatttcaaccatgcttttgagcatttctgcatacattcaggtgggagagccatcattcaagctgttgaaagaaacttgaggcttaggaaacaggatgtggagccgtcaaccatgactctttacaggtttggaaacatttcatcttcttcgatttggtatgagttgagctacatagaagcaaaagggaggatgaaatgtggtgatagggtgtggcaaattgcatttggaagtggattcaagtgtaacagtgctgtgtggaagtgtgtttgtgatgtgaagccagacactgccactgcatggagggatacaattcattcataccctgtggatatt

SEQ ID NO: 114088 - DNA, 231 bp, Glycine max
  Peptide Sequence Number=SeqID_230866
atggtatctggaggccaactggatagagagcctctatggggagtgtcatggtcaggtagaactcaagggccttcagctcattgtactattgcatgcatgcttatggcactggagtttcatatagcatatgtgcctggggatggacccgagcaggtggagaaggaggtggtggtggtgatgattgatgatggtgaaaggaggacgaagaatcagacacatgttggtgtctga

SEQ ID NO: 114089 - DNA, 556 bp, Glycine max
  Peptide Sequence Number=SeqID_230867
ggcattcaatttgcttaaggagaagttagtaaatgcttttgttgttattgcccctgattggtcactacctttcaagctcatgtgtgatgctagcgatttagctgtagggacaattttagggcaaaggaaaaataagcctgcagaagatgggataatcaaagagacttttcttgatgaaagtctcttaattgttgttgctatttcaagagcaccttggtatgctgacattgtcgactatttggcatgcaaggtgttcccaatggatactaactaccaagggaagaagaggcatatgtctgaagacaggaaatatttttgggataatccatacattttcaggttccttaactttaattctaagctttcagggaagaataggttgaggcaattgaacgagctagatgagcttacactgatagtctatgagaatgaaacattgtataaggagaggaggaagagatggcataatacaaggattaagcaaagacaattccaagtgaaggagaaggtgcttgtgtacaactcttgccttcatctatttcctgggaagctttga

SEQ ID NO: 114090 - DNA, 1629 bp, Glycine max
  Peptide Sequence Number=SeqID_230868
atgaaatgcgatgcgaggatgataaggttaagacatggagctaacaagtttggttgttttggtaaatcatggaccaatgttcgtccttccttccattccctctcatattcattcccagctacagatcccactgtactgcacagagttctcgaacgctgtagagtctctacggatttaaaaaccgccactaaaacccatgcaagagttgttgtacttggctttgcaacttacccttctctcgtggcatctcttatatcaacctatgcccaatgtcatcgaccccacattgcccttcacgttttctccaggattttggacctattcagcatgaatttggtcattgagagtttagtgaaaggtgggcaatgtgacattgccaagaaggtgtttggcaaaatgtctgttagagatgtggtcacgtggaactccatgattggaggttatgtaagaaacttgcgcttcttcgatgcattgagtattttccggaggatgctgagtgccaaggttgaacctgatgggttcacctttgcttcggtggttaccgcatgtgcacgccttggggctcttggcaatgccaagtgggtgcatggtttgatggtagagaaaagggttgagctgaattatattttgagtgctgcgttgattgacatgtatgctaagtgtggtaggattgatgtttcaagacaggtttttgaagaggttgcgcgtgatcatgtgtcagtttggaatgctatgattagtgggttggcaattcatgggcttgcaatggatgcgaccttggtgttttcgaggatggagatggagcatgttttgccggattctattacttttattgggattttaactgcttgtagtcactgtggattggttgaagaaggtcgcaagtattttggtatgatgcagaaccgctttatgattcagccgcagcttgagcattatggaaccatggttgatctcttgggacgagcagggctcatggaagaggcctatgctgtgattaaggagatgcgtatggagcctgatattgttatctggagagcacttttgagtgcttgtagaatccacagaaagaaagaacttggtgaagttgccattgctaatatatctcgcttagagagtggagactttgtgttgttgtcaaatatgtattgctctttaaacaactgggatggtgctgagagagtgagacggatgatgaaaaccagaggggttcggaaaagccgtggtaagagttgggttgaattgggggacggcattcaccaattcaatgcagcttatcagtctcatcctgaaatgaaatcaatttacagagtgctggaaggtttgatccaaagggccaagttggagggattcacacccttgacagatctggttttgatggatgtttccgaagaggaaaaggaggaaaatttaatgtttcatagtgagaagttggccatggcctatgcggtcctgaaaactagccctggaacaaaaatcaggatttccaaaaacctgcgtatctgtttagattgtcataattggattaaaatcgtgtcaaaaatattaaacagaaagataatcgtgagggatcggatccgttttcaccaatttgaaggcggtgtttgctcttgcaaagactactggtag

SEQ ID NO: 114091 - DNA, 321 bp, Glycine max
  Peptide Sequence Number=SeqID_230869
atgtataagctgcactccgagaagtaccggaggacaaggtcccagaataacagatatataagttgtactccaaggagtgaacgagggtacgcagcggcgtctgatgcttctccttcgatgagagggggattggatagcattagtgtaatggagaagggtgtgacaaaaaacagttcgggcccatcggggacctcatcagcttgggccccggacccaatcacgggttactacaggcccatcaatcacaccaatgagattgacccggtggagcttcgaaagatgctgttgaaacacaaagtcagatcatcaccatcctcctag

SEQ ID NO: 114092 - DNA, 243 bp, Glycine max
  Peptide Sequence Number=SeqID_230870
atggccatcgctgaagatattaatgacatgtcatttatcagtgcacaatcagctgaagtcacctcacatacaacagacaagggacatgatggctgggagaaggctgaaaatgaagtgacaagtttacagaaacaagtccaggcactgactctcagaaattcaaaacttgaagatagagtcacctatctagaccgtgcacttaaggagttagtaaggcagctaagacaaacaaggtatttataa

SEQ ID NO: 114093 - DNA, 897 bp, Glycine max
  Peptide Sequence Number=SeqID_230871
atggacttcctaattggccttccaccttcacacggtggcaccaagctccacttcagtacggcgtaccatccacagtccgatggtcaagcggaggccattaatagggtgttggaacaatatttgagagcttttgttcatgatcaaccccgacactggttcaagtacttatccctagctgagtggtcatataattcctccgttcacagtggcacaggagactccccagtggaggcagtagacacgttgctcacctcgcggcacaacattcatctcacactacaatgttgtttacaaaaataccagaccctcatgaaacgtatggctgataaccatcgcagggatcttacatttgacgtaggtgattgggtatacgtcaagttatgcccttatcgacagacttcactccaacacacttattctaagttgtccaagcggttctatggtcctttctgcattctggagcgcatcggtgcagttgcttatcgcctccagttgcccaccacctctaagatacacgatgttttcctcatttccttgcttaaacctcaccatgggacggacccgacagatagccaggcactccccccttctagctgggataaccaccctgtcattcatcccttgcacatcctggattggaagcttgatgatagtgttgctcctcccatccaattcgtcttggtccaatggcacagttcgcctcctgaagatgccacatgggaacactggagtgagttacaagctgcttacgaccttaaggacaaggtcggttttcagggggaggaaattgatagcaatatcggaaccatccctccagggccaggcaccattgaaccagcaacttgcagacccacacgtgccactaacaaactgaagtatctagaagactatgcatga

SEQ ID NO: 114094 - DNA, 939 bp, Glycine max
  Peptide Sequence Number=SeqID_230872
atgccaaggatagacgggttactagacgaaatcggtgacgcttcctggttttcaaagctggatctccggcaaggcttccaccagattcgtatgcatgaggacaatataccaaaaattgctttccgcacacatcagggtcattatgagttcacggtgatgcctttcgggttgtttaatgccccctctactttccaggccaccatgaataatcttctctggccgttcttgcggcagattgcggctgtcttctttgacgatatactccgcatctttgcagagcaacgtctgaactatctcgggcacatcatctccccacaaggggtggcaccacccaaacaagatccaggccttgactgcatggccaatacccgccactatgataagtttgtttggagcccagcagcacaagccacattcgagcaactgaaaattatgatgactcaggctcctgttctcaccacacctgatttttcagtgcctttcaccttggagacggatgcttccggcacctccataggagccgttttgcttcagcagtcccgtccaattgcattttttagcaaacaactatgcccgcggctacagaaggcttcaacttacgtccgcgaactccatgcgataaccacaaccgtgcgcaagtggcgtcactacctgttagggcaccactttgtcatcatgacagatcatcgtagtctgaaagagattatgactcaagtcatacaaactccagagcagcaaatctacctttctaagctacttggattcgactacacaatccagtataagcctggaccatctaatgtcgtcgcggacgctttgtccagaatttcggcacccacttcttccctcctgatcatatccatcccgcacaaccttttcctggaccaattgaagcaaacactgacgcacgatgaagcttaccaaactctcctgcactaa

SEQ ID NO: 114095 - DNA, 146 bp, Glycine max
  Peptide Sequence Number=SeqID_230873
ggacttatttgaatttccgtagttttaaggatattactcgtttccggcctgatctcaagctgctgatatcaagtgctacacttgatgcagagaaattcagtgattactttgattctgcgccaatattcagaattccagggagatga

SEQ ID NO: 114096 - DNA, 333 bp, Glycine max
  Peptide Sequence Number=SeqID_230874
atggagaacccaactgcctcattcaaactgcattctcagttcaaagggaactacaccaacctctcaatgcaaaaatatagcagtcatgtggttgaaaaatgcctcgtgcatcttgcagagatcaagtcaaggatagtccaagaatttttatcttttcctcactttgagcagttgctacaagacctatatggcaactatgttgttcaacgtgctctcggagtgaccaagggctttctgcatgcatctctagctgaagcagttcgcccctacaaaatgttgcgcaccagcccttattgcaaaagggttttctcgaggaacctgcttaacaagtga

SEQ ID NO: 114097 - DNA, 1380 bp, Glycine max
  Peptide Sequence Number=SeqID_230875
atgaaggcggagacggtgacgctgttgctggtgaacctggcggggataatggagagggccgacgagtcgctgcttccgggagtgtacaaggaagttggcacggcgctccacaccgaccccaccggtttgggttacctcactctcttccgatccatcgtacagtcctcctgctaccccgtcgccgcctacctcgccgtgcgccacaaccgcgcccacgtcatcgccgtcggggccttcctctgggccgccgccaccttcctcgtcgcgttctcctccactttcttccaggtcaccgccgtttcttaccaacaacaaggaagaggttcaggggattgggaaggtgaacttgagggagaaatggaagtagtagataaatcatcatatgtggttttggaagatggcaatatggaggaagaaaaggcatttaatgggattggccttgcacttgtaacacctgcaattcagtcccttgttgccgactcaactgatgatagcaatcgtggcatggcttttggatggcttcaactaacaggaaatgttggatcaattattggaggcctcttctcagtgttgatagctccaataacagtctttggtatccctgataatggtacaaacagtagaaggcaagctccaaataaaacattttggtctgaagtgaaagatctggttcaggaatccaagtcagttttgaagatttcatcttttcagattattgttgcccagggtgtcactggctcctttccctggtctgctttatcatttgcaccaatgtggttagagctgactggcttctcccatgagaaaactgctttcctcatgggtttgtttgtggttgccagttctattgggggattgtttggaggaaagatgggagatatcctatccaagcgctatccaaattctgggaggataattctggcacagataagctctggatcagcaatccccctagcagcacttcttttgattggtttgccagatgatccatccacgataatatctcatgtggggattttggcccagcatgtttatgggtataagcccattcctgaagggtctagtgaatctcaagagattttaacagacagagagaatgctgcatcattggcgaagtctctttacactgcaataggaattccaatggctctatgctgtataatctacacatttctttataggacctatccgagagacagggaacgtgctaagatggaggctttaatagaatcagagatgcagctaatcgaatcaggtggtttagctatggatagagagtttgagtcagaggaattgtctattgtggattatgatgatggtgatattgatgatgatgagaacacattactctacaggcagttgacactttccaaagaatag

SEQ ID NO: 114098 - DNA, 1476 bp, Glycine max
  Peptide Sequence Number=SeqID_230876
atgagaaatgaagaactaggaacttggttgaacgggttttccaacaacaacagcatccttcaccgtggccacgtcacctcaccaccacaacctcaaccttcttcgagtgttttctccatgatccatgatgatggtgttgatattgatgcgatgctgtgtagtgattttgctagaatgagtgtttttcacgaactagggaatgttggtgccaaaaccagaggatatggtgctaatgttatggattcatcatacccacatgcattcttaaactcacactcaccttgttcttttgatgcacatgcacatgttcatgaagaaatgggtaccccattacctacttggggtgtttcagttccttctgatgtgaagggacacacttttggacccccaatggagtcttcttctcatacccaaaggagcaacacttgctatgggcacgttccactgcaaaacccatttcatgctacaaggccttttgtagtggattgtgatgtgaaaaaacccattgtgttctctcaaagtcaaaccatgatgcaaccaaagattgctatgaatgtaaacacgccatcatcacattgtttccctgcagcaaaagaaagaggaacaacaagtgtagctgtaaccaccaatggtgatttttctcactctagagggaacactttggggtttcaatttgacggtggttttgtcctacaagagaagaatgtaaaatgctatgctggtagagggtgtcattctttgtggggttgcaaagagagtttacctttactagttcaacaagcagtgggagaggaacttcctcaactcattcctcctcgtgttgctcccactagacatgaaaagaatggcattctcgccagcgatgtttcgctttctctgcggccattgttgtacaattttagtcctttgtctaagttccatggctacatttactacctggctaagcaccagaacggttgccgcttcctgcagaggatgattgatgagggcacctctgaacatgtgctaatagtgttcaatggagtcatagatgatgttgttgagcttatggtggacccttttggcaactaccttgtgcagaagttgcttgatgtgggcggagatgatgaaaggttgcaggttgtgtcaatgttgacaaaagaaccagggcagctaatcaaaacctctttgaatatacacgggactcgggtggttcagaagctgatcacgactgtcgactctagaaaacaaattgcaatgcttatgtctgctattcaatctggttttcttgctcttattaaggatctaaatgggaatcatgtcatacagcgttgcttgcaatactttagctgtaaagataatgagcagtttctaaatttgctggatacttcatctctgggattttcatattttcaagcctatgtttatctctggtcacttcagaaatttctaaaaggtaagccaactgtggaaggaacaaaattcaccatctattga

SEQ ID NO: 114099 - DNA, 372 bp, Glycine max
  Peptide Sequence Number=SeqID_230877
atggggtgtccacttaagatgccacaaaggaggttctcactgaagagaacttggagccagacaaagaggtggaggaaagagaggtattggcatctccctagattgtacatcgacattcctttcattgagaaaataggcttaagggaacttgaacccactaatatctcccttcaccttgcaggccgttttatggtctatcctagaggggtgatagaggatgtgttggtgaaggtagataaattcattttccctgttgatttcatggtattagacatgaaggaagatcaaaatgtccctatcatattgggacacctttttctgaatacttgtgatctaattgttgaagttaggcttggtaggcttaccctctga

SEQ ID NO: 114100 - DNA, 189 bp, Glycine max
  Peptide Sequence Number=SeqID_230878
atgggttcaaggcctataactgcacttgaaaaggcaatcaaaatccaatttggtgttgtgagggaaagcgttggtgatgatgagggtgttgtgctgccatgtcggtacgatgcggggctaccaatgttgagtgagggtgagcgagggagagcatcattgagtcaaagtgtggggtgtagtgtagagtga

SEQ ID NO: 114101 - DNA, 327 bp, Glycine max
  Peptide Sequence Number=SeqID_230879
atgtacatagaaacaacaaagcaacataagtcaaaaaaagagattgaggtggagcagcatattcttgccttgaagatcgaggtggagcagctcgcaatacccaacaacagtaacttcagcttagctaggaagcacgtcacactgaggccacaacacgaggctcagctgagggtggtgcgacaggggctcctttcctggaaaacagtcattaagggttcgttcaaaaatagtgaccgagggtacatggtgcgaaatgggtttgttcagtggaaagggattcgattgagcacagtggaagctttcaatctccaacaaagtggacaataa

SEQ ID NO: 114102 - DNA, 393 bp, Glycine max
  Peptide Sequence Number=SeqID_230880
atggtgatgtggaaacctaagcttgaggatagaattagtagaaattttcacactaaagtctctcatggattgtctgataagttttggcgatgctcaaaagacttgttagaagccaagatggcttggagatggcgtgtggaaccatctgcaacaaaatttggtcgttctatacatattgatgaggtctttcaacagacccatataagaaaggatactggtgaatttgttgatgaaagatcaatgggaacaaatctgttagtggaaaaaccaagggatgactctatggggctagagaccttgctcgtgattatcaaggtggagatagtagcctcacataaaaaaggaaggcatcaagtaattgttcacctaattcaaaagagattatccagctaa

SEQ ID NO: 114103 - DNA, 315 bp, Glycine max
  Peptide Sequence Number=SeqID_230881
atgcagccatctgtttcacctttgttcaaagaccatgacccacttcaattcctccaacttcaacaacgacagacacgtctaagaaaatacttgcttgtccaggagttggtcttagactcagttcaatcacagctagtgctcattcctttggacttgtgtaagcctaagcttatagctcccacaccagttgtggccaaggctcctaaagctgataaggagaactgttcaacacaagatcaggatcaggctcagccagccaaggatagctctagtgcaacaagttttgatcagccaacagctacaatgtcattttga

SEQ ID NO: 114104 - DNA, 747 bp, Glycine max
  Peptide Sequence Number=SeqID_230882
atgtcagcaacggcgcaggcaccatcgtcgaccccgacagttgtttcatttctagcgaggccgagtcccagaaactcgtcatcgaaatacaaaggtgtggtgccacaatcgaatggtcattcgggagctcagatttacaagaagcaccagcgtgtgtgggtcggcactttcaacgaggaagacaaagccgccagagcctacaacatcgttgcacaacactttcgaggccgcgacgccgtcaccaacttaaagccttttgctgccatcgccgagtccgagttcctcaactcacattccaagtttgagatcctccttcacaagcacacctatgacaacaagcttcagcacaacacacgcggtggcaggcgccgtcacaatgccgacaccgcgttgagcggcgtgtgtgacacaaaagcgcgttttttgcacaagctattcacaaagggtctcgacctaagtatcattattaggtggtgcacggtgactgttaagtctagtgtacaggctgacttgggtgatataaacgtcaaggtgctcatatgggttagtggtaccatagtacttctcgatggtgaggttcttctagttgggaaggagggtggcttccatgacaccgaggaaaaagcctcctcaccattaaggataagtcaatctagccctctacatggacttcttcaggctaatgattcccaagttggtttttgctgctatgttggttcttgtgcgtgtgattgccataattcttag

SEQ ID NO: 114105 - DNA, 483 bp, Glycine max
  Peptide Sequence Number=SeqID_230883
atgcaagcttaccatcttcttgtaaatcaacgtgtgaatgtactttatttggataccacatattgcaacccaaaatacaggttcccttccaaggaagaagtgctcaattatgttgtcaaaatcacaaagaaccacctcaaaattcatcctagaactttagtggttgttggggcatacagtattggcaaagaatgtgtatatcttgcaatttctaaggctcttgggtgtttcttcatagtaacgatctactttctgatgttgaaatgcagcctcagtgtgaaacacaattttgctaaccaggtgctacttgcttatggtttatctagctcgaggcgtgcaccagatgctattcatccctatggctattccaaggaaagatttgtttggtccttgatatctgctgttgggatcttttgtcttggttctggtgccaccattgttaatggagtacagaacttgtggattgcacagtgttatgattga

SEQ ID NO: 114106 - DNA, 720 bp, Glycine max
  Peptide Sequence Number=SeqID_230884
atggcctctacatctgaaacacttggaaacaagatggctatgggaatgggatcattaactgcagcttccttggcaatgttggttgcctttgcaaatttggcaacaactatggcaacagttgaccccactgcagccactaggaaagaacatgttattgagctctacatgcatgacattctagggggcagcaacccgatagctcgatcgatgactggcttgttgggaagcatatacgatggtcaagtaccctttgcaatgccaataggattcaacacccaagggacaaccatccctaatgccaatggtgctaaccccactgttaatggagtttttggcatcccactaggaactggattggcaggtacttcatttgcaccaaactcaagcaacaacaacaaccaaaacaatgccccgctgcagttaggacctcatggactgagactaagctttggtacaatcattgttattgatgatatattgacctctcaacctgagttggggtctcaaatagttaggaaggctcaaggtgtatatatggcaagttcagtagatgggactagacagatgatggcttttactgccctgtttgaaggaggggaatatgggaagttcaacaatgcaagggggtttgtcgaactgattgctcttatcccaccaggacagattgccactgatggtgcagagacactgctaaggatcactatctatttgaaacactaa

SEQ ID NO: 114107 - DNA, 426 bp, Glycine max
  Peptide Sequence Number=SeqID_230885
atggatgattctaatccctttctcatacaaaccaatgataatcctagtttaagccttatcactcatcctctatccgacgagaattataattcttggaagaaagccatcaaaatggcacttctcggcaagaataaatttggtttcgtagatggttctattctcgaacctccattagagcacttcagtcatgctttatggcagcgaaatgacagcatcgttgcttcttggcttctcaattctcttacaaaggagatacaagtaagcatcattcattgctgcactgctcaagctatttggaatgatctcaatgagagatttgaacagaagaatggtccattgattttccagttgaaacatgaactagcaaatctgcagcagggatctatgtctgtctcatcttattattccaagttgcgatccatttag

SEQ ID NO: 114108 - DNA, 294 bp, Glycine max
  Peptide Sequence Number=SeqID_230886
atggcttgtgttaggctgataaattcggtgaatgctttgcaatttgcggagtggctcttggatggacttgctggtttcttgatagatttttttattaagaaacatttgggaaataatgaggcacggttaacctatcatgcattagcctgtaaagaaattacaaacttgttctatttattgctgtataaaaatgttgttgctgcaatgctacagtggaaatggagaactggaagcggtgggggtagcagttaccagaaaaaactatctaagagggttctaaaagaatcttcgtag

SEQ ID NO: 114109 - DNA, 184 bp, Glycine max
  Peptide Sequence Number=SeqID_230887
atgaagagtgttgagtaccttcttctcgccgaggaaatttctgatcttgatggacttgttgttgccaatgctagctttgatcggaaaatgagcgtacacgaatctcattttgtatcggtatcccttggtgatgccggtgatcaaattctcaatgtggctgagggcggtgcggatggcggtggag

SEQ ID NO: 114110 - DNA, 579 bp, Glycine max
  Peptide Sequence Number=SeqID_230888
atgttgcggaactttacggattgcgcaacaatgtttcttttttactttcggaatgttgcggaactttacggattacctaacgatagggttaagtacctcgaggcgttttaccctctacctttccctccatctccaaaaactgagcttcctcattccattcccaccaccaccatcccacagtcttcctttctgcttccacaccaccttcttcgccaggaaaaagcttatgagaccccatgtgactactttgatggcaaatggatccgagataggagaggccttttgaacaatagtacaacctgtggtacaatcaaagaaggccagaattgcataacatgtggaaggcctgactctggctatctatactggagatggaaaccaagtcaatgtagtcttccaaggtttgagcctcaaacttttctccaactcattagcaacaagaatgtagcttttgttggggactcaatgcctgggaaccaattagagtcccttctttgcatgatatccactggttcaaccccgaatcttgtctaccggaacggtgacgacaacattactgtgctatcaattgggcactag

SEQ ID NO: 114111 - DNA, 846 bp, Glycine max
  Peptide Sequence Number=SeqID_230889
atgcagcatccaagaatacctcatctagatattgtgcataatctcctacaatatatcaagggcactccgggtcagggtctttattttccagccagtaactccttcaacttatctgcatatgcagatgctgattggggaggatgtttagacacatgcaggtcgacatctggttcatgtgtgtttctaggagatgttttaatatcatggaaatcaaaaaagcaaaccactgtgtctaaatattcagcaaagacagaatatcgagctctttcctcagtttcaagtgaagtaatttggctaagacgattactcctgcactttgagatttccatcaaatctaccatgcttttctgtgatagcaaatttgcaattagtctagcatctaatccagctcaccatgaacgatccaaacacattgatattgattatcacttcatttgtgagttagtgcagtcaaacacccttaagcttgttcatgtgaaataccaacatcaagttgcagatatcttcacaaagcccttaatgcttctggctttctcttcttttacccgaggaaagcaaatgaatgcaaagagaagagaagatatggttggtgtacttccaaagagaaaaatattgatgcggtatggggagtcgcaggggaaccaggacacgacggcgtacaccatcatacccgaccacgacattcggtcaacggcgcaaggcatgactcaagctcttcgcgctagtgagcacctctaccgcctgataggcagtgacagctactcccttgattggcgggtgcagttctgcgtgtgccctacacctgcacccgatcgatgttccgtgagcttagacggtgtttcttaa

SEQ ID NO: 114112 - DNA, 357 bp, Glycine max
  Peptide Sequence Number=SeqID_230890
atgcctttcatagggttgaggagtttttgggagaggcaaggatatgcacgtgatggtgaatgtagaagaggcacaagggcacttggggggtttttcaagatgaggtgttggattatttcaaggagctcttttgcacaaaagagaggaaatgattctatggaaaggaatatgaatgctctcccctatgaggcaaaggtggctttggttaatctagttactaaagaggacgaggttggtgatgaagtttgccatttcggggctaaggcttttgctacgggtacatttgatgctacagtgatagagactttgttggcgcttattcctaaaggggatgtttcaaagactttcatcctataa

SEQ ID NO: 114113 - DNA, 405 bp, Glycine max
  Peptide Sequence Number=SeqID_230891
atgctactcagacgccgtcgctttgataaaaccacgccacttgccaccgcactcccccaaaagctaacacatcaccaaagctcattccgagagacagagagaaagatgagtgaagacgcgaaaaagaacattgccggagctctaacggcgaggcccaactccgatgaccagaaaccatcgccgttaccgtcaccggcgccagccgtcccgccgaagaaggtcatcatcaagagcgccgacatgatccccgacatgcagaaggaggccgttgatatcgccgtcgccgcgtttgagaagtacaatgtggagaaagacgttgcggagcagataaagaaggagttcgataagaggcatggacccacttggcattgcatcgttggtcgtaattttgtagaaattgagtag

SEQ ID NO: 114114 - DNA, 561 bp, Glycine max
  Peptide Sequence Number=SeqID_230892
atgtctcagaacttcacgaattgcctaacgatgagtgccaagtacctcgaagtggtcaaacgagggtcgcatcccaacaacagatggttcctggacgaaattaggaacaaccttatggagatcaggacagatgcattgaagctgttagtaattttgaggcggcatgttcctcgtgccgcagcaacagtaggagtctggcttaacatatttcagtttcttatactaatgtctatatgcaccaactgtgctattttagcatggctatatgatgaggagggaaaatggaaaatagagcctggacttgcatcaattttaatcatggagcatgtcctcttgttgactaagttcggtttctctcgcttctttcctgagatgtaccatataactactattgagcaaattgagacaatagatctaaagccaatttttttattagtgtttgggccacaagagcaaaatctgcgttctcaaggtggaagcggcaatatgattttcaagagtggaccatttttcatatcttccaaagctaaaggtagaggagaaatgaatgttgtagactga

SEQ ID NO: 114115 - DNA, 1437 bp, Glycine max
  Peptide Sequence Number=SeqID_230893
atggatcacaatatggtttgtgaggctactctagtgagttggttacttccttctcaggatttagtggctatgaatgtggatggtagggtcttgggggacccttcaagattggggtttggtggtcttgggatggagcattcatccaaacataggaacaagatagaatggggatgctcaatagagtctgatgacagggatgatgtagataagtggagtaggaccctagctggaaatcaagccagtccaattcaagcagtaccatctcttttgggacaaggtgggaaaattcaagattcgttgataacaacaggtcaactgaatatggcacctatgtccaacatccaaatggccatgccttcgacaaggaaatcgcttagtgccataggccaaatcggcttgccaccattaaggcaaccagctgaaaccatgaggaagtactttgggatacaactgaaaccaatggagggtcttgtatataggaaaccataccttgaatgggttgacaaaaagttgaggaagaagctggtggcacaagaatgtagttatatgaatcaactagcttcaagagctatcggaatgaagcattttaatagaggtaaggaacaaaaatgggcaagtaaaggacaaggtctgcatctggtgccatttgttgatactgatgagtatgatgccattacaatcccaaaaaaagctgagattatggcaaatgaaatcgttaagggcaaaccttactatagttcggtgttaaaggttgccaagaccaaaaaatctactactgttagtgcggttgggaggctaaaatccttaatcccacggccagcttggacacctcatgagatggttaaagggcataattcatccaaatgcttgtgtcaattaggtttggtgcttaatcctggtgtgaggatgtctatcattgatgatgaacctattcttgatggaggtaagcagatgacaaaatttaaagtggaaaacggcataagaattttggagattaacgtgaaaaatagtgattatccaagtggtcaaattttcaagccttttgctagttttcaagaaggggaatggatagttaatcgagaaaaagaaagactgataccaactagaacttttaccaagatgcaaaaaaggagattcaaaaggaagaagccaagcaataagatgaagcaagccttgtccttaattggtgaagtaaaaggtaaaggttctaatgatgtatcatcttctgaggtaataaaggctttacaaaaggctttcagtttggaagaaggtagtctagtggcttcttttaataaagagcaacatatagaggaagaaggagaactcaataaggtttatcaaaaagataaggaagaagaattgtgtgtcgatttgacagataagatggttcatccaatagatagtttgtcacaattgattgatccagttttagactag

SEQ ID NO: 114116 - DNA, 381 bp, Glycine max
  Peptide Sequence Number=SeqID_230894
atggggagacatctaaagccattttatatcagagctcacattaacaacaaaacattaagtcaggtgattgtagatggtggagatgtgttaaatgcaatgccaactaatactctaaagaaaattggcaaaggaatggagaatttaacaacaacaaacatgaaaatgattaacttcactgccggtgacactcatgctttgggtgtgttagtaatagatataacagttggaaccaaaaccaagaagacaatattatttgtggtggatgctaaaccaatgtatacttgttacgacacaattgcatccgtgggatcattggacgatactgctttagcgtccagccctaagaagacaagtgctttagcacttggcttacaatactaa

SEQ ID NO: 114117 - DNA, 570 bp, Glycine max
  Peptide Sequence Number=SeqID_230895
atgtctcccacaaagggtagaggggaggaattaactattggagataggagaagatgggcttatgtgaagagggtttggcccgtcaacaatagaaacacattgggaaacaagtggataaggtccaatgacccgaaagaaatgaacggggctagatcatgcgggctgggttgtggatcatatttcataatttcctatcctgggatattgtcaagatgtaagggtataaaacctgaggtgattaaggaatatactgttgaagaagaggtagaaataaagggggatccatcattatctagaactgtggcatctttgaaggcaatgttaaaggagctgaaaagaggaaatgaggcatactatgtggagttaggaatgctaacactttatgacttggatttgcaaagaacagtggaaggactggagggagtgttggaggaatatgcagagctttttcaagaagccattgaactacctcctactagaagatgtaatcatgccgtagagataagggcaggctctcaaataccatatatcaggccctacagttatccccatcaccaaaaggaagaatag

SEQ ID NO: 114118 - DNA, 351 bp, Glycine max
  Peptide Sequence Number=SeqID_230896
atgagtgaagaagccaaaaagaacttcgccggagctctaacggcgaggcccaactccgatgagccgaaaccggcaccggtgccagctgttcccccgaagaaggtcatcatcaagagcgctgatatgatccccgacatgcagaaggaggccgttgatatcgccgtcgccgcgtttgagaagtacaatgtggagaaagacgttgcggagcagataaagaaggagttcgataagaggcatggccccacgtggcattgtatcgttggacgtaattttggttggtccttgtttgctttaaaaagtgtgattgattctgtgtcatggttggagtttagaagtgatgctgaaacctag

SEQ ID NO: 114119 - DNA, 450 bp, Glycine max
  Peptide Sequence Number=SeqID_230897
gttgctgcaaaagtgataggagaagttcaagccctcattatttttcctctcataccatatgctatccttgcagtgttttacatgttctggatttcagctgctctccatttgttcagctctggcgaggttgttcagaataattgcaactctaactgttgcacatatgatcttattgcaaaacgggtaaaatgcgatcgttgttgtggttatagcattcattacacaccacatattggagttgccatccttttccacctatttgggtgttattgggctacacaatttttcatagcttgctcctcaacagtgattgctgggtctgtcgcgtcttattactgggcccgtggtgaaacatccaattgtgtttatacttgggtcaaatggtcctgtttggttaaacttctcaataagcaagcacttataagagaagaaaataagaatgtaaaatga

SEQ ID NO: 114120 - DNA, 219 bp, Glycine max
  Peptide Sequence Number=SeqID_230898
atggtgggtttgagtgtagtgttggaagcacagaaaggtagcgttagcaagaagactccacaagtgattaacaaaacaaccatgcttagtagtagcaacatcaacaacaacaaacactcttcttcttcttcttcagaagcagcagcaaagtttctagaccaatgctttctctgcaggaagagactcttgccagggaaagacatctacatgtacaagtga

SEQ ID NO: 114121 - DNA, 762 bp, Glycine max
  Peptide Sequence Number=SeqID_230899
atgagttctctaagtgttcagttgagtatggcatgtaatgatgctgaagaaattgaagaattcaaggcattaatgaagactgaatttgaaatgatagatttgggcaaattggcttatttcttaggaatggagtttgtgaccgtcctaagtaggatcattctgcataagaagaagtatgcaatggaggtcttgaagaggttcaatatgactaactgtaatgcttcaattactctagctggagtgggagtgaaattggataatacaagtaaagatgatgagcttgttgatccaactttgttcaagcagttgataggatcactaagatatatgtgcaacaataagccagatatcagttttataattggcctgttattagcagcaccaatttcatggtgttctaagaagcgactagtagtttcattatcaacatataaagcagaacatatagcaggctcatttgttgcttgtcaggctatttggcttgattcattactaacagaattgaggatcaagttgaagaagcctataaaattgtttgtagataataaatttgcaattgacttggccaagaatccagtctcccatgaaaggagcaagcatattgagacaaaatttcactttctaaaggaacaagtgaaccaaagtgtgatcattgttgtctattgtcctactgaatcacgagtaatatatgtgatgactaaggcagcaaagattgaaagatttgagaagctaaggaaagctttaggtgttgtagcattttga

SEQ ID NO: 114122 - DNA, 318 bp, Glycine max
  Peptide Sequence Number=SeqID_230900
atgcagccagaaattccatttctttctgtcttttcctccatgaagaggcttatgcgttacagtcttgggtctgtggctcttggctctctgattgtatcatttgtagaatcaatccgctttctgcttgaagttattcgtcgtaagctaaaagtctcaagtcataggcatgacagctgcttaggcaaggctgcataccaatcttctcaatgttttctcagcatgtgttttgttattgtggtgcaagtaaggccaatggaagtgaaagccgattctcttgtacctgttgcatttatgattgatgtgttccttagaggctga

SEQ ID NO: 114123 - DNA, 1782 bp, Glycine max
  Peptide Sequence Number=SeqID_230901
atgtacccatctctatgtgttgcatcatggaagggtgtgagacatgaatttgaagctggttcaaaagcaacaatcatggtactccttaaagatgcatttgggaacagtatctctcagacgtctgaagtgtcttatttgcctgattttaagttgtatgtgctgcatgaaaatggttctgttgcaagtgctccagatatctctaacatagggtggaatgagtttgattatgtagtcattgagtttgttgtgacgatagcgggaaagttcttcttgagcttagaaggaggaaatcaaaccttgaatggttctccattgccattgaagcttgacatctctctccctcaaataacaggaactatagatgtctctaactgtatcgccaaatggaacattgaatcacatgcatggcaattggcttccaagatggaaatatttatacatcagttagatcaatatggaaatctggtttctggactgtatccttttgattctgaagttgttgaaagagatacaaacttgtcaataccgatatcagatcttcactttgaggaagtggatgctggaattcagttgttttcgtttagcaatttggagccagggaacttcctgctgaccatatatgattccaagcatgataaaagcatttccaatatgccatatgtttatactgtttttattggttattgtgatggtgttaaaagtgttgttaatggatctggtttaaatgattcagtagctggtgtaaaggcagaattctctgtttatttgaatgacatctatcaatatccttcccctattgaagcaaacatacttcaagtacaaattttaagagaaaatgactcctacagcgcttcaccaatcatatatcctatgctaaacaataatgcgagcacaatagcttcaagagtgagatatgatggaattagtcacatggaaaccgccccgtcaccttcaatagagcttggcaacaatcctaatgggagcgggagctttgtcatggccagtgcttttcatgtgaaatacataccagaaaaaagtggcttttatgatattaacatacattgtgggaacgtattattgaatgagggacattcattcaggaaagaggtaaaagcaggtgaagtaaatgtttccctgtcaagtgttgtgaggttttcttcaaaggtgccaaagctgtcgaaaaatgaaatagttgtgcagcttgtggattcatatttaaatcctgtcctctcacaacaatcaaggttgaaattggagattgctgcttctaccaatagttcaggctttttaactttggacattaaggataataaggatggatcatacagctgcagctatatggccaaagatgttggcacttacgagatttgtgcttcctttgatggcaagcgtttcttgtcatgtcccttcagtatcaatgtgtatagctgtgaatattttcctaaggctaacaatgatacaatatctatttgggaggatcagtccattgcccttgatgccttagcaaatgattattttgcgggtgataaagcaagtatagttgaattctcaaaaccagatcatggttcacttatgcagaatggaaggatctttcgttacactccttataaagggtattatggaaacgattccttttggtatacaatttctgatataaatggaaatcttgctactgctttcatgtacatatctgttctcaatgttccacctcagtttgtttctgttccaaatcaactgcaagcaacagaagatttgataagccctagatttgggtatgtataa

SEQ ID NO: 114124 - DNA, 1587 bp, Glycine max
  Peptide Sequence Number=SeqID_230902
atggttgctgaggggaaatcccaaaagccatacccaacagctgctgaggtagtggaagagctaaagagaatgggggacataggagttccaatagcagccatgagccttgcgggatacatcaaaaacatggtcttagttgtgtgcatgggaaggttgggaagccttgagctagcaggtggtgctttggccataggcttcaccaacataacaggtttctcagttctctcaggtttagccatgggaatggaacctctttgcacacaagccttcggttcaagaaacttctctttggtctctctcactttacaaaggacaattctcatgttattggcagcttcactacccatttctctcttgtggctaaagctcgagcctctcatgttatggcttcaccaaaaccctgaaataaccaaagtggcaagtgtctattgcttcttctcaatccctgacctaattgcaaatagcttccttcacccaattcgaatctatttacgtagcaaagggacaacttggcctctattgtggtgcactttgctttccattctcatacacatccccattgtggctttttttaccttcaaacttcatcttggtgtgcccgggattgctatgtcagcttttgttgccaacttcaacaccctttttttcctcctatcatacatgctctacatgcgtgtctcaaagggatcactttccatgcctttactattatcgtcaacctgccaactgccatcaccatcaccacaacaacaacaacaacaacatcatcatcaagaccaaacctcattaaaaacaacaacgctaggaaaagagtggggcatgctaattaggttttccattcagagttgcttaggagtgtgcttggagtggtggtggtacgagttcatgacgattctcgcaggctacctgtataacccacgtgttgctttagcaactgctggcatagtgatacaaacaacatctctcatgtacactttaccaacggcactaagtgcttcagtgtcaactagggttgggaatgagcttggggcaggtcaacccgagagggcaaaattgtcaacaattgtggcaataggactgtcacttgcaagttcaatattagggttgttgtggaccacaatagggagggagagatgggggagggtgttcacaagtgatagtgaggtgttggaactaacaatgagtgtgttgcccataattggggtttgtgagttagcaaattgccctcaaaccacaagctgtggaatccttagagggagtgctaggcctggtgttggggcagggataaatttttactcattttaccttgtgggggcaccagtggcaatagtgatagcatttgtttggaaactagggttggtggggctttgctatggcttgttggcagcacagatagcatgtgtggtctctattctagttgtggtatacaacacagattgggaaagggagtctatgaaggcaaaaagcttggtgggaatatttaagagttcatgtgatcatgatcatcattatggagaccaaacagtgaaatgtgaagaaggtctcttgtctttctcaatgagaaagaatagcgaccaaaaaaagtga

SEQ ID NO: 114125 - DNA, 396 bp, Glycine max
  Peptide Sequence Number=SeqID_230903
atggatagcgagccatggccttctatttcagaagctgcaaaagatttggttagaaaaatgctgacttgcgaccctaaggaacgcattacagctgctgatgccctcgaacacccttggttgaaggaaggtggtgaagcatcagacaagcttccagacagtgctgttttaattaggatgaaacggtttagagcaatgaaccagatgaagaagcttgctctgaaggctgatattgaccagagtaagactattgactactttgaattcattgctgccactatggatcggcataaagtggagaaggaagagagtttgttcaaggcttttcaatactttgacaaggataacaatggattactcttcagttccttagatcgatcctctatatatactgcttaa

SEQ ID NO: 114126 - DNA, 1041 bp, Glycine max
  Peptide Sequence Number=SeqID_230904
atggccgttgggggattctcccttgatgcttcttcagccaacaatggcttcgacggcaagataacactctcagttgtcatcacatgcatcgttgctgcatccagtggtctaatttttggatatgacatcggaattacagcaattaatggaccaactcgtaaccctaatcgtcaagcagtggtaatcacggtaccggtaactggtggtgtcactacgatgaaaccatttcttgaaaaattcttcccagcaatattgaaaaaggctgctagcgcaaaaacaaacgtgtattgtgtatatgacaatcagttgttgacattatttacgtcttcccttcacctggcggggctagtttcgtctctcttggccagccgcgtcacgacggcgttaggtcggagaaacaccatgatttttggtggttgcatcttttttgccggtggtgccattaatggtgctgctgaaaatattgctatgttaatcttgggtcgtatcttgcttggtcttggagtcggtttcacaaatcaagcaacgccggtgtacctatccgaaattgctcctcccaaatggcgaggcgcatttagcactgggttccaattctttgtcggcatgggtgtggtggccgcaaactgcataaactatggcaccgcacgacatccatgggggtggcgtgtgtccctcggcctcgccacggtccccgcaaccatcatcactattggagcattcctaatccctgacaccccaagtagcctagtggagcgcaaccaaataccccaagccagaaacgctctccgcaaagtgcgtggccccactgctgatgttgaactcgaattgcaacacgtgattcaatcgtcccagacttttaaaaaatacaatgagagaaataatatttgggttgaccgatcgcacaatcgactcaaccctcgttgttggcctcggccttcgccttgtccatgtcaacccctgatagtagcaccgtgcacgaatccaaagcacccagacccagaagagaaatcatcacaccaaagtacttgcacgattacgtaa

SEQ ID NO: 114127 - DNA, 3426 bp, Glycine max
  Peptide Sequence Number=SeqID_230905
atggctgatcacgcgatcaggaagacgacgacggatagactggaagacgccattgctcgtctgtccaatagccaagcctccctcaccgacaagtacactgagctctcagggaaagttgattcgatcctggatcatcttcgtctgaatcacgtcaagctcgatattcctaggtttgatggacgcgacccgctaggatggatcttcaaaatcactcaactgtttgactaccagaacacgccggaagaagaaaggatcacggtggcttgtttttatcttgacggtgcagccctaagctggctctcgaatccagggttgccttcgccgttcatgttaagctgtttcatctctggattgtcatcggagatacgtcgagaggttttagcacttcaacccatctctcttccccaggcaactgcgctcgcaaaacttcaagaagacaagctgaaagatcgacgccattcttccaatcgtcctaacaattttcctcctccgccaaaccacactaatcatcccagctcaaaaccaaaaccgccatttgttcaacgaaccacagaagaaatcgcttttcgcagagaaaagggactttgttataactgcgatgagaaatggagtgctactcatcgttgttttccttcatctgaaacattccgtctctttggagtaatcaacctcgcatgcctcaccatactcattgatagtggcagcacacacaatttcctccagccccgcatagcccaattcctccaccttccggtacagtccaccccaccactacgtgtactagttggtaatggctccgtccttgattgcaaccagctttgcccagatacctcgctatcactccaaggtcatcatttcaatgtcaccttccatctgcttccgataagtggagctgatgccattttgggtattgagtggctaaaacaatttgggccagtgataactgattacacctcctttattatgaagtttaatcatttgggccaagcaatagagcttcacacggacgtcatgaacgggctagaaccagtttcagcgcctcaagttaaacatcttattcggactgggtctacatcagcgttattccacttaagccttttacccacaaaccaccctgacccaccacaacatcatcttcctcacccagttcccgctatagaagccttactccaccattaccaacatatattccagacaccacccactcttccccctctgagagaagtaacccatcgcattaatctccttccttcgacttccccggtaaacgtatggccctacagatacttgcacttccagaaaactgagatagaaaggcaggtctccgatctcctttctgctggcctgatacgaccaagcacgagcctgtactcctccccagttcttctagtaaagaagaaggacgacacttggcggatgtgcgttgactatcgcacactaaatgcagttaccatacgcgaccattttctgatacctaccattgacgagttgctggatgaactcggtcaggcgtcatggttttcgaagctcgacctaaggcaaggattccatcagatccttatgcatgagcccgatatcgagaaaacaacctttagaacgcatcaagggcactatgagtattgtgttatgcccttcggcttgagtaacgcgccctccacctttcaagccgccatgaacaacttgcttacaccattcctaaactatgcctccatagcaacacctcttactacactattgtgtaaagatgcgttcgaatggactgaagattctcaggcagctttcgaccaactgaaaatggcaatgacttgtgcacccgttctcgctcttcccaacttctcagaaccatttgtcgtcgagacagacgcatcacgaaccaccatgggagctgttttgatgcagaagggtcatccaatagcattcttcagcaaagtctttggccctcggttgactcatgcttcaacatacataagagaactctatgccatcgtggtcgtagtgcgaaaatggcgtctatatctcctagggcgatctttcaccatattgatagatcacaagagcctccaggaactcatgacgcaagtgattcaaacccccgagcaacactattacctctctaagttacttggattcgattacaccattcattacaaggccggcgtgtctaatatcatcgcagacgcactatctcgattgccttctaccttaggccagctgctcctacttttagttccccacttggaattcatcgaggatctccaacgaatgttacatgctgaacccgaattccaggctctactgtccaagtcgagcttcttctggcacggcctcaaggatgatgttaaacgcttcattcgagaatgcaagccgttaccaattccgacagggatatgggaagatatatccatggattttgtcaccaatttcccaccatctcatggattcaccgtcattctcgttattgttgatcgttactcaaaaggtgttcacttgggcgcactacccacgcacttctccgcattcaaggttgcaactttatttctggacttggtctgcaaacatcatggcttccctcgcagcatcgtctccgatagggacccccaaaccgtcgccggcgttaccacactatatccctgggacgaccaacaacgaggcgacgctaagcgcgacgatataacctatgcagcgggacaatgggtttatgtcaaactcaggcccttccgtcaacgatcagtagcaggaaccacccatccaaagctttcgaagcgtttcttcaaacctttccaaatcacggctcgcataggccaagtcgcgtatcgccttcaactaccagacaatgcacgtatccatccagtcttccattgttcgcttttacgtgctcaccacgaccctccacctttgtcattggatacttggcctttacacgttgtcggtcacaagccagtaccacgacccctttgctttctggactccaaaattgataactctacctcccctccaactcgtttggtccttactcaatgggtgggacaaccactagatgatactacttgggaaccctggccgaaattacgcgacgcctaccaccttgaggacaaggtggtgttcggggatgggagtaatgatagcagcatcgtgcacaaatccgaagcacccagacccagaagagaaatcatcacaccaaagtacttgcacgattacgtaattttggactttggagtaatgagaagcatgagaagcagtgttacaggtttgtattgtataatgatagcaattgggagctatgctggtacggttgttgtgacacttatgcataagtatagtggtagcaaggagaggaattggttgtctgataggaacctcaataggggtagattggagaactattacttgcttgttagtgggattcaagtgttgagagattattag

SEQ ID NO: 114128 - DNA, 270 bp, Glycine max
  Peptide Sequence Number=SeqID_230906
atgcgttgttctccaaagaggacgaaagaggaaaaaaaaacgcagtgggaagtgggaacaaatactcaacgctgtttctgtatctgttgcaaattgaaggcaaaggttccaagggggtgggggaaggatatatccaggtttttggtagctagggtgctaagaaccacctgcagactggagcatgtatttcaagcatgccaagcttggaatgtagattatggaggagataaacatcaagcagttttgtatggaaccccagatataatatga

SEQ ID NO: 114129 - DNA, 474 bp, Glycine max
  Peptide Sequence Number=SeqID_230907
atgggtaaggactggggtcctggcactgctgatgcagggtatactgataaaagctctctttcaactgcacttggcccctatggttggccgcctgttggtcagccaaatgctacatgtagagttccatcccctgcatgtgagcaaagatggattctagagatgatggctggtgtaaaggtggcggtgatgagctttgtgggtgtaaccgacacccgagagaactggcagagacctgtgatcaaggctggtgtcgcaacctacccttcggcgggagggcaacgtgtgactcgcgggtgcgtgttccaagaaaggaatacacgcgaagtcgccaccaacgtttatttgaggaaaacgtcggaaaaatcggaaaagggcgcagaatttgtctctgcgcgtttatcactcaacttgcctgcagatgaacgcatgtcatcgggcccgccaactctgatgacaaaaggcgtagaagacgat

SEQ ID NO: 114130 - DNA, 360 bp, Glycine max
  Peptide Sequence Number=SeqID_230908
atgattgaaatagaagaggtacaagaacagatgaaggccgacatggaggccatgaaagagcaaatgaccacaatgatggaagccatttttagtatgagaaaaatgatggaggtcaacacggctacagccattgtcgcaagtaccgccactaagatggacccgactcaaccatctggcctcaatcaagtaggcgcaccgttgggaagtacgggcggcccccattttgtgcaggtccagagtaagcattccttcccaccatatggcttgcctcccaactatacaccacccaatgttgcacaccctctcgatgagaatgtcgataactccactcccgtacccattgagagccaacaaccctaa

SEQ ID NO: 114131 - DNA, 582 bp, Glycine max
  Peptide Sequence Number=SeqID_230909
atggaagtaaatgatggattcttagtaacaaacctaccagttcatttgatcaacacaactgaattgaagcacagatataattatcagtggcagcctcttcagacatatgttactatctcaaagcactttattgtcaaagctcatggaatcagatttctgggcacagtcaatgactgcaatagtgttatgcagcaactattctatcatggaggtgagcgtggagctgtgttaacattgacactaaatgacatggggaactatggatgttatccagattgtgcagagggaatgtcaatgccattatacactgaagctatagttaatttgatgagaaaacagccaatgagttcatttcttgctcacaccttaggatcaatcattgtcattgaatttgtcatcatgtcctctcttggagtgcttcttctgtacttcacctgtaaatgtgcaattcttcttgcacaggaaagaagaaaccgcgaaaaaaggtcttcagagctatctacttcacaaagttcccacagagaaactgaaattgttaaaaagatcaattcaattgtattggcacagatacatcttacataa

SEQ ID NO: 114132 - DNA, 1224 bp, Glycine max
  Peptide Sequence Number=SeqID_230910
atgccctccaaactctatttccaacgaccaactgcccctaacctcctattagatgagaaaggcaagtgtaatttcaaaatctttagtgcaaataacatctatgagtggaatatagatgcccaaatggagtacaatattatgaatacactccagcacatgaccatggtagccatggcttaccaaacatcccatgagtgttcggaggaaacaatcattgatatcttagtggcaggattttccggccaattaaaaggatgcacagtcaaaatggatctcaatggaaaagtcattactaatgacgataataaggagattcctgacgctattaatacatatatttttacaatagcccaacactttattggcgacccatccctttggaaagatcggtccatagaattattatcaaatcttaagtgtagaactttagtagattttaggtggtatagagataccttcctaactagagtttacaccagagaagatagtcaacaacctatctggaaagaaaaatttctagccggtcttccaagatcattaggagataaggttagagacataatccgtatccaatctgtcaatggagatattccatatgagagtttaagttatggccaattaatttcttatgtccagaaagtagctttaaaaatctgtcaagatgacaaaatccaaagacaaatagccaaaaagaaggcccaaaaaaagagagatttaggatctttctgtgaacaatttggactaccagcctgtccaaaacaaaagaaaaaacaaaaccataggaaagaatcccatgaaaataagaccttcaacaaaaagagatttccaagaaggagatactggcataaaccctcgaccagtaaagaaaatgacactcctaaaccaaaaataaaacccaaaataacatgttacaattatggaaaacaaggccacattagaaaatattgtaggttaaagagaaaattgagaaatcttaacctagaaccaaaaattgaagagcagattaataatctgcttattgaaaccttagaggaagaaatagaaacttcatcttccacattctctgaggataacctcaacataatccaacaagacgatcaaccatcgtctagggacgatgatgaacgagaaatcaatactctaacaagagaacaagatctcttgcttgaagcaatcaattccatactagatccccaagaaaagaaggttttccggaaaaattaa

SEQ ID NO: 114133 - DNA, 273 bp, Glycine max
  Peptide Sequence Number=SeqID_230911
atgaggatcacattcacggcaagtgttcgccaagatttgtgtccgttaagatggggaccccatctaacgttggagagggacccgaagcaatttgcttgggaatggggcgtgtgggaccgaaacggcaacgtttggagatgtaaaggctgcgaatattggaggggaaagtgggttattattttgaaaaaagtggcatatatgatatgcttgatcctattaatgaacatggaaggaggagggaagaaagaaggaaggaggaaaaagccaaattaa

SEQ ID NO: 114134 - DNA, 228 bp, Glycine max
  Peptide Sequence Number=SeqID_230912
atggagaatggagaagagaaagagagagagagagggaaggctaaaaaagcaaaaggcaaactagtaattgctgcaattccaagtacccatgggaaaatgagaaaaatatataatcagataggacaaaccaacgagaatagtgcaattgtgaaaatatttctttctgtggatacctaccctcctagctatcttgttacttttggaacgcgtattgacgtttgcgaataa

SEQ ID NO: 114135 - DNA, 627 bp, Glycine max
  Peptide Sequence Number=SeqID_230913
atgcaggcaacctcaacaccttcctggagacacctgtggtactggctgaggaagaatacttacctgcttactcctgatactgtcggatgcccactgatatcagagagattgaggctgctttgtgtattcccgattgagggagctctcatctctagccagatcacatctatggcccagtctaactcctctagacttgggttccttgctcttatcacagctttatgtaggtccaaaggggttgcttctgtcaggctggtcttcgaacgcttgagcccggtcattaacttggcctatatcaggaagaactattggaaccctgatgatctaatagttactattagaggggctaagagagcgagggcaaggccagttgaggctccttccacatctgcagctcctcctccagcacgtacctcagcagctccttctaccccaccttctgcagactttcaacgtcttgaagacatgcttcgaagcatacatcaggggcagattgttttattacaaagtttacagctggtagcacctccagactttattccttctgtagagcagtttaatgagtgggtagcctggcccgggactcagcctccccttcacagggaagacgaaggtcccaccactcag

SEQ ID NO: 114136 - DNA, 177 bp, Glycine max
  Peptide Sequence Number=SeqID_230914
atggcattaaatatattattgagtagcatgttgtcaccccaatggtttttctttgacatgtttcattttgcggatttgccgtgttgttgctgctgcaccatgcttaagagacacgtcaaacggattcatccacatgttggagatctccatggagttgagtctacttatatggcataa

SEQ ID NO: 114137 - DNA, 393 bp, Glycine max
  Peptide Sequence Number=SeqID_230915
atggctagaaccatgctcaatgataattcaacccctaagcacttatgggctgaagcaggattcaaagtttataactcaagaaccttggtagttgaagaagctattcatataaaatttgacaaaaataagcttgataaagatttatcagagctagacaagtcttttgtagatctacgactagacgacaactatatagaaactagctcgtccagaaaaaatccaaagacagaagcatccactcaacaagaagttcaagaagaggctagagcaatgcaagaagagcttgatcagtttcaaaagaatgatgtttggaagttagttgaattgccaaaaggaaagaaagttgttgaagtgaaaaagggtcttttgcaacaaactggacaaaaatggtaa

SEQ ID NO: 114138 - DNA, 477 bp, Glycine max
  Peptide Sequence Number=SeqID_230916
ttggggcaattaaatgggtcaacttcaacggcaagcctttcgcaaagcctatggacttccagctagtgtcgactgtgaaagagtttgaagaaatcctgggatgcccactgggaggaaggaagccatatcttttctctgggttctatccctccacgacaagagttgccaagtaccaagaaagtgttttgaggaaagggcaaaggccttggcaaatcaaggcgaatgggctttcttttattgacatcttggcgcttttgatctttggagttgtcctctttccgaatatggaagggttagtggacctagcagcgattgacgctttcctcgcctttcatcatggcaaggaaagcccgatcgtcgccattttggccatgtatgacacgttcgaccggggatgtgaaaagagcagcgcaagaattgtttgttgtgcactggctctctatgtgtggctggtttcacacctttttctccaagaag

SEQ ID NO: 114139 - DNA, 789 bp, Glycine max
  Peptide Sequence Number=SeqID_230917
atgggtgttaaacattttgaggtgttcaaacgaaggtcgcatgctgacaaacaatggtccctggacgaaattagggaatgtgttattcatcttatcatagaagtgatagaggttgtgggaaagatgaaggagaaagaaggcttaagagacttgggacaacaatctatgaaggaagagataaagaggaaaaaaaataatagagaggataatatggaaggggaaaatcttaaaattcttaattttcaaatgaagtgtgactcgaaggcatatattgagtgggagatgaaagttaagcaaatctttgcatgtcatgagtatagtgaagagaagaagattatgttggctaccatgggcttcgatgacaaagcactcacatggtcgaagcttgaagagaatgcaagagagaggataaggaaacctaagatagcaacatggaaagaaataaaggagtttataaggaagatattcttaccaccttattatgagaaatatgtttatgataggctacaaaacctcacaaaaggtagcaaaagtcttgaagaataccataaagagatgataatgaccattaggaaagccaatgtacaagagcctaaaacttccataacaaggttcctatgtgggcttaataaagacattcgatgcattgtgaagttacaacactataagagcttggaggatatggtgcatcaagccaagaaagtggaaagacgacttgagaggaagcattcctacaagaagacctatcaccatgactcttcccgtggtaaggacaagtctaagaaatag

SEQ ID NO: 114140 - DNA, 438 bp, Glycine max
  Peptide Sequence Number=SeqID_230918
atggctttaagagataaagaggttaaaagaattatacttaccagacccgctgtagaagcaggggagagccttggatttttgccgggggatcttaaagaaaaattagatccttatttacagcctttatatgatgctttaagagatatgattcctcacgagaaacttgaaggttttatggagaagaaagttattgaagtggcacctttagcttttatgagaggaagaaccctggatgatgctttcgtaattcttgatgaagcacagaatacaacccatgcccagatgaaaatgttccttaccagaatgggtatgaacgctaaatttattataacaggggatcctacccaaatcgatttgccaagaaatcagcaatccggactaaaagaagcaatgaggattttgcatggtgtaaatgaaattgttttgtggatcctctag

SEQ ID NO: 114141 - DNA, 483 bp, Glycine max
  Peptide Sequence Number=SeqID_230919
atggttcagcccactaatccaagatcaagtccaagattctccactaagtgtggtaagatgtccttgatagcaggatgcaaacgcctatcatggtacctggacagtggctatttatggtacatgacagaagaaaggtttatgttccaatgcttgactccctatcatggtggaacagtcactttcggaggaaataaaaaaggcagaataaccgaagtaggtcttaagcacaatctactgagcataagtcaactatgtggcaatgatatggtgtgtccttcaataaggatgattatgtcattctatgtaaaaatgggtctcctttatgtagacaaagggggagattgtagacaaaggatcaagctgaatgttttgatgatgccaaaggttcacatgcgtctcaaagctttattcaagacaaagaaattaaagatattcaagatgaatgatcaagacaagtctctagtcttagaaagggtatattaa

SEQ ID NO: 114142 - DNA, 249 bp, Glycine max
  Peptide Sequence Number=SeqID_230920
atgattcgtgatcttggaaaaaaatcttttcaacaagcacatgcccttatgtatgatacattggaaaatgattctaagaagcctttgtatctgaggtgcaagaaatctttgaccctattgttggcggtgttaagtctggtcaatgtcaaggcgagatatgggtacagtgacataagcttcaccttactgcttcaggtagtgcaagaaatgcttccagaggaaaacactttaccaaaaatttattattag

SEQ ID NO: 114143 - DNA, 156 bp, Glycine max
  Peptide Sequence Number=SeqID_230921
atgcatgaatggaaatcaaataatggggctctagggtggaggatagacgaacaactcaaggcaatcaattcgtggggcgctagactcgatggtggaggatgcatgaatgacaatcaattcatgtggctcgggataagatttgagggtggaggatag

SEQ ID NO: 114144 - DNA, 968 bp, Glycine max
  Peptide Sequence Number=SeqID_230922
tacacgccctccccttcagaggacaagatgccctcaccttcagaggaataacggtcctgaccttcagagggcaacacgccttcaccttaaaaggcctacacgccttagccttcagaggacaacacacgctcaccttcagaggattactggtcctgaccttcagagggcaacacgccctcaacttaaaatgcctacatgtcctcgctttcaaagcactacacgtcctccccttcagtggagtacacgtcctcaccttccgaggactacacatcctcgccttcagaggactacacatgctcaccttcagaggactacacctcctcgccttcagagggctagattccctcaccttgagagtactacacgtcctcgccttccgaggactctacgccctcgctttcgtatggctacacgccctcccctttagaggactacacagggtacatgccctcaccttaaaaggactacaggtcctcgcctttagagggctacacaccctcgcctttagaggtgtacacgccctcgccttcagaggactacatgtcctcaccttcagaggactacacgtcttgaccttcagagggcaacacgccctcaccttaaaaggcctacacgccctcgccttcagagggctacacaccctcaccttcataggactactcgtccctgccttcaaaggactacacgtcctcaccttcagaggactaaacgtcctcaccttaagagtgctacacgcccttaccttcagaggactacacgtccccgccttcagagggctacatgtcctcacctttagaaggctacacgtccacgccttcacagggatagatgccctcaccttcagagtactacacgtcctcgctttcatggggctacacgccctcccctttagaggactacacgccctcaccttcagaggactacacgtccccgccttcagagggctacacgtcctcaccttcaaatga

SEQ ID NO: 114145 - DNA, 526 bp, Glycine max
  Peptide Sequence Number=SeqID_230923
atggcgttggctgctgcaaacctgccgcagccgtgtcgtcgtccgcctttcgcgcatgccctcttccaatccccccgaaagccgcctggccgccatcgacattggctccaacagctgcctgctggccatggcccgcagcgacggcgcaaaggtacagctgttcagccaccgcaaggaagccatacgcctgggcagcgccctggacgcacagggagccctgagtctggaggccatgcagcgtggctgggcctgcctggagcgctatgcgcaggtgctgggcgacctgccccgccaccgcgttcgtgccgtggccacgcagacgctgagagaggcatcgaaccgacaggtcttcctggacgagggccagcgcatcctgggctgcgccatcgaagtcatcgacggcgaggaagaagcacgcctgatctatcgcggcgtcgcccagttgctcccacccggtccccagcggcggctggtggtggacatcggtggccgatcgaccgagctgtgccttggccagcagcggcag

SEQ ID NO: 114146 - DNA, 776 bp, Glycine max
  Peptide Sequence Number=SeqID_230924
agcaaactggcgtcgatgcgcgtgccgagcaggcggatgctgatcagcggttcggtgaaggcgaacggcatcagcagcagcatggcgatcgccatggcggtcaggcgcgtcatcgaccagtcgcggccgttcactaccttggcgttgcagcgcgggcaataggcggcctggttgccgctgagcggcggcagcacgaacagcagatcgcactcgcagcagcgctggtggcgcgctttggaaaggggggcgggcctaagctttgggcttctggccatcttcactgtttcaatggttatcacatgacaaaagaacaattctacgcggaattaaaacgtgacctgagcgcgttgctcggcggggaaaccaactttatcgcggcgttgtccaacgccagcgcgttgctcaacgagcgtctggatgacgtgaactgggtcggtttctatctgatggatggcggccagctggtgctggggccgttccagggcaagatcgcctgcgtgcgtattccggtgggcaagggcgtgtgcggcacggcggtggcggaaaatcgcgtgcagcgcgtcggcgacgtgcatgcgttcccgggccatatcgcctgcgatgcggccagcaacgcggaaatcgtgctgccgctggcggttggcggccgagcgatcggcgttttggatatcgacagcacggtttatcaacgcttcgacgaacaggacgaagcgggcttgaaagccgtggtggcggggctttgtgagcaactggaacagtgcgacagtgcgaaatat

SEQ ID NO: 114147 - DNA, 308 bp, Glycine max
  Peptide Sequence Number=SeqID_230925
gtcgactctagaggatcccacgaaaatggatgggattctcatttctagcggtgttgtccttgctgaggtgttgttggctgattcacgattcactcgaccggatatgggttttcacccaacaaaactcaatttcgtgcctagcgatgcggatgaggcgccactcgatgtttccatttgcctgcatgcctttggtattgtggggtgtggttcgtttagtggtgtcaagtcttgcgaacgtgaggacccattccatccaggcctctttgttggggacgctggaggatttcaaagtcccccacgtgaaccac

SEQ ID NO: 114148 - DNA, 1467 bp, Glycine max
  Peptide Sequence Number=SeqID_230926
cactctaaccttcagaggactacacgtcctcactatgagagggctacatggtcttaccttcagaggactacacgtcctcgccttcagaaggattcaggctctcaccttaagaggactgtaggtcctcaccttagagggctacgcaccctcaccttcagaggactacacatcctcaccttcagagggctacacgctctaaccgacagaggactacacgtcctcgccttcagagggttgcacgccctcaccttcagaggactgcacgtcctcaccttcagagggctacgcgccctcacctttagaggactacacgtcctcaccttgagagggctacacgctcttaccttcagagcaattaacatcctcaccttcagagggctgcacgctcttatcttcagaggactacacgtcctcgccttcaaacggttgcatgccctcagcgtcaaaggattgcacgtcctcacctttagagggctgcacaccctcacctttagaggactacacatcctaaccttcagaggggtacacgctcttaccatcagagcactacacgtccttcccttcagagtgttgcacgccctcaccttcagagtgttgtacgctctcaccttcagaggactgcacatcctcaccttcaaatcgctactcaccctcaacttccaaggactacacgtccccaccttgatagggctacacgctgttaccttcaaaagactacacgccctcgacttcagagtagggctacgcaacctcaccttcagaggactacacatcctcaccttcagagggctacacgctctaaccaacagaggactacacgtcctcgccttcagagggttgcacgcgctcaccttcagaggactgcacgtcctcaccttcagagggccacgcgccctcaccttcagaggactacacgtcctcaccttgagagggctacacgctcttaccttcagagcaattaacatcctcaccttcagagggctgcacgctcttaccttcagagggctacacgtcctcgccttcaaacggttgcatgccctcagcgtcaaaggattgcacgtcctcacctttagagggctacgcaccctcaccttcagaggactacacatcctaaccttcagaggggtacacgctcttaccatcagaggactacacgtccttcccttcagagtgttgcacgccctcaccttcacagtgttgtacgctctcaccttcagaggactgcacgtcctaaccttcaaagcgctacgcgccctcaacttccaaggactacacgtccccaccttgatagggctacacgctgttaccttcaaaagactacacgccctcgacttcagagtgttgcacgccttcaccttcaatggactccacgtcgtcaccttcagaggattacgcgccttcacctttagaggactacacgtcctcacctttataaggctacacgttctcaccttaagaggactatag

SEQ ID NO: 114149 - DNA, 330 bp, Glycine max
  Peptide Sequence Number=SeqID_230927
atggaggatgcacgaacagcgcttggcaatcaattcgtggggctcggaactcgacggtggtatcttaagcttccacagaaacacaaagctcccatccactggatccccccttatttcctccatcaaaaacttgaaaacatattcatctatgagttttcctctctcccaactctgatgcaagctccattggagcttgtaggcctaggatcttcttcatcaatggattcctttgcttcttggaagataaatggcagcggaatggggaaggaagagagagaggagacgccacttcaaggagaagatgagtctagaagaagctcaccaccatag

SEQ ID NO: 114150 - DNA, 546 bp, Glycine max
  Peptide Sequence Number=SeqID_230928
atggcccgcaccaagaaaactgggcaaatgacatatgagacagtaaaggaaattgctaataagattgatgtactgactgttgctattgggcgactagaacaccctggtcgtgtacgtgctgctggagccggtatcacgatcaagcaatactttggaccagctccaaggacctcccgcatgtcttcgtctgtggctcttgaagacctggagcagatacagtctcagtttcagtcccagatgcaatcacagggactcgcactacctcctgagccagaggttggtcattcaactgctcatgttagcacaaaggagagttgtgttgattccttagggaacaatccagacatgagtgacttagagacatacgggttatacatcaaagaaaatcctctctgcctggttaccctaggaaaactttatgaggagtcgacaactgttcacaacatccctttgcgccatgatcaagtcaaggttggtgttgaggaagttagagatgcagatgcttccattcctgtacccaatgaagaggttcagttagtgaggtag

SEQ ID NO: 114151 - DNA, 401 bp, Glycine max
  Peptide Sequence Number=SeqID_230929
gataagccccagcgcgccgaccagcaggctaccaaacaggaacggaattaaaccgaacaggataccgacgccgagcccaattcaatacgcgggcgatgcacagcagaacaaaaagcgcgtaggcaatgttaccgctggaattctggcagcggcgggcgtttccctgtatcagattgctggagtcgttatgaagctgaccgacaaaatccgccgggtggcaatcttatgccgtcggtctggcgacgtgggtcgtgagcttctggctggcgggatttgttattcgccgccgtccggcagaagaggcgtaatatccccggcaagacgtggtagcccgggtaaggcgcgcgcggtcggcggcgtggcgttccagcgccagctcgatcaggcggcttatcaggctg

SEQ ID NO: 114152 - DNA, 357 bp, Glycine max
  Peptide Sequence Number=SeqID_230930
atggatggcattgatggagaaaacaaatgcactaccataggcatggaaagaaagacacaaacaggggcactagtggacaaaaagacacaaacaggggaacttgcaagttgcaacacaggggaaaagatgaatatacatttaaaaatcagcatgcaacagggacaggcaaatatcctcatagctaggttccctgaccctaactatggtgttaaaacgaagcctctaccgtgccaaaacgaaggagacttagtatggatttccgaaaacaaagctagtaacagtgctctgggtcaaacacccacatcactacatgaaagagctgagagcatttcgggttttacaaggaacgtcatttga

SEQ ID NO: 114153 - DNA, 315 bp, Glycine max
  Peptide Sequence Number=SeqID_230931
ggcatcaactgcttaattgaatttataagttcatacccgatagcagtagccaatgtcggaagaggagccgttggtgctttagttccgcagctcttgcctgagacggaaagttggcaaaggcttcagacgcggtctccggctcaaggtcaatttatttttgagttcccggcccaagtcaaggcgatgcaatactcgggcgataaggaagaagcagtcccaggccttaggtccagaccagatctgagaactttcgagatggctagtcctggttctgttaagggcctagttctggacttgctcgaccaagtcttaaag

SEQ ID NO: 114154 - DNA, 522 bp, Glycine max
  Peptide Sequence Number=SeqID_230932
ggcacccttgttgatgactggaagtttgattattctattcatgatgctcgccgtatggtctataatgaccaggctgatatgaccggaagattacttgttgggtcattaacctttgattgccgcatcatgcactttattattgttcgtattttacttcccgctcacttgattcggtaccggatgcataaggcattacggaccaatgcacctctcccttatcctcacctcgtcaccctttttcttcatcatttcaaaattcctttggaagatgaaccatttgttcaagtaaaaaggtcttttgttattagtgctggtgcggttatctcatttggttaccgtaaggatgatgatggtcagtgggttcggaaacaagacttacctcagccaatccctgacgaatatactctttctcctccaccgcaaagggttgattcctcttcacttctgaacgatgttctctctgaacttcacagtcttcgagcttttgtgggtgaccgatttgatgctatggatactcgctag

SEQ ID NO: 114155 - DNA, 126 bp, Glycine max
  Peptide Sequence Number=SeqID_230933
atggattcttcaagtgattcagaaaatgaaatcataaatctaggtctcatggcaaaagactatgaaagcggagaagagatgcattcaatgatttgcataaagaatctatcaaacttgccaaattag

SEQ ID NO: 114156 - DNA, 726 bp, Glycine max
  Peptide Sequence Number=SeqID_230934
accacgttgaccccgctgcccgacaacgggccgatccgcaccgcctcgctggaagtggatttcagcaagaccacctggggcgacgccaaggccggccagaccaaggcctcggcctgcgcggcctgccatggcgccgacggcaattccacagtggagatgtacccgtccatcgccggccagagcgaacgctacgtcgcccagcagatggccctgatcgccaacggccagcgcagctccggtgcggcggtggcgatggtgccgttcgtgcagaacctcaccccgcaggacatgcgcgacatcggcgcgttcttcgccacccagaaggccaccgccggcatcgccgatgacacggcggtcaccgacggcccctacaagggcatgaagttctacgagatcggccagcagctgtaccgcggcggcgacgccaagcgcggcctgccggcctgcatggcctgccacggccccagcggcgccggtaatcccggcccggcctatccgcacattggtggccagcacgccagctatgtcgcgcgccgcctgcaggaataccaggccggccagaccaacgaaaccgacaaggcgcacttccagatcatggccacggtcgcgcagaagctgagcgagcaggaggtgcaggcactgtcgagctacctgcagggtctgcacaacaaggccgacgacgtggccgttgccaccacgccggcacaaccggctgccgccccctga

SEQ ID NO: 114157 - DNA, 353 bp, Glycine max
  Peptide Sequence Number=SeqID_230935
atgaggttgatttcccgcctgctgttgtctgtgctggtgctgctgccgctggtagcctgcgccgcaacccctgccaatgccccgctggtcgagggcaaagactacgagcgcatcgcccagccgggcccgttccagccgctggccggcaagatcgaggtggtcgaagtcttcggctacacctgcccgcactgcgcccgtttcgagccgcagttggaagcctgggcagccaagctgccggccgacgtacgcttcaccccggttccggcggccttcggtggcgcctgggacgcctgggccctggcctactacgccgccgacgaagtcggcgtggccaagcgcagccacggcgccgt

SEQ ID NO: 114158 - DNA, 422 bp, Glycine max
  Peptide Sequence Number=SeqID_230936
atgttgttttggttcttcagggttagggttggggttaggattagggattggagatttattattgttgagggagaggtgggagagggggtcaagttcggaatcgaagaggggttggatgaggaagtggcgagaggagggggagatgcgggtgatgaggggctccggggtgccgaggaaggggtggcggctggcgagggggcgaaggttggagacgaaggggagagaggagtcgaagtggaagcggtcgacgtggacgaactggccgagctagaggcggttggagaggatgagatcggtgtcggggtgggagaggaggacgtaggtggagttgagggagtcagagaggtgttggtgttcatggcctgtagcattttcaggagaatgcctgggatgagggaagccattgctattgctctgagtga

SEQ ID NO: 114159 - DNA, 144 bp, Glycine max
  Peptide Sequence Number=SeqID_230937
atgcgtggaggtagcttgaggaaagatcaaacattgaaggatgagatggaaccaggggtggttgttgcgggtgagagatggaaccgaaatgattgtggaacggtggatcagcgtgtgatgatgaatcgtattcatcatcgctag

SEQ ID NO: 114160 - DNA, 1026 bp, Glycine max
  Peptide Sequence Number=SeqID_230938
atggactctggtaacagtggaagcatctcttctagcgatgatgaatatgattcatcccacgccgatccatcgttcctcaatcatttcggttccatctctcacccgcaacaaccatctcttgttccttctcatccctcaatgtttgatctttcctcaagctacttccacgctgtcgtctcacaatcccaccaaaacccacataatcacttgtttaacttagactgtcaagaccaaagatctgaacccaatcgcaccctcccagaaagcctaccatcttcgacatcagcaacaccaacaacaacaaatcaatgcctgttgggtcacgacaacattaatgataattcaatacaacaactcccatcatctccacaaaccaacaacctcgtacgcaactcaaagaaacgaagcagatcttcaaggcgtgcacccaccaccgacaccaacaacttcagatccatggttcaagagttcaccggaatccctgcacctcccttttcatcttccttctctcgacgcatccctctttgcccaaaccctttgctttcaacaacttcatcgaggaccagcttgttacacaacaaaaacaatatcaatgtttctcctaataataactaccaactacttcctgatctatctttaccctatcaacccccaccacagaatctcatacaagatattcactccattcccttattccacccttctccttctcttcactctcttgtcccttcagggcttgctgcaaagtctttatccaccatgcccacacttgatgcgcatgatctgctgggtgctcatgagcatgttgtttctgagggcatgtttctgaggagtgacggtgatgcaggagggataagagacccgttttggtgcttagatcatgggaataatagtaattatggtggctgcaagctcaacatgtcggtttctgcgtcgagcagcttgaaccgtgagaagaacttggagaatgttggtaatgcaaatggaaattcccctagggaaggtaccgtggaagcgtggatttga

SEQ ID NO: 114161 - DNA, 576 bp, Glycine max
  Peptide Sequence Number=SeqID_230939
atggttcaagagttcaccggaatctctgcacctcccttttcatcttccttctctcgacgcatccctcttcgcccaaaccctttgctttcaacaacttcatcgaggaccagcttgttacacaacaacaacaatatcaatgtttctcctaataataactaccaactacttcctgatctatctttaccctatcaacccccaccacagaatctcatacaagatattcactccattccctcattccacccttctccttctcttcactctcttgtccctgcagggcttgctgcaaagtctttatccaccatgcccacacttgatgcgcatgatctgctgggtgctcatgaacatgtttctgagggcatgtttctgaggagtgacggtgatgcaggagggagaaaagatccgtttaggtgcttagatcttgggaataataatagttatggtggctgcaagctcaatatgtcggtttctgcgtcgagcagcttgaaccatgagaagaacttggagaatgttggtaatggaaattcccctagggaaggtgccgtggaggcgtggatttgttcctctgagcaatag

SEQ ID NO: 114162 - DNA, 1527 bp, Glycine max
  Peptide Sequence Number=SeqID_230940
atgaatcttaagaaagcaaagcaatggcactcttggaatttctgggacacggatgaaagtgaaatcaaaattcaaaatggcgcaacggatagtatagtagtgagggaaaagcaggaatccaggctgggaaaatgggccataaagggttttcttttctttgccgagaaaatgagagagtgcatttcgatccacattggccaggccggtatccaggttggaaacgcctgctgggaactctattgccttgaacacggcattcagcccgatggacagatgccgagtgacaagaccgttggcggaggagacgacgccttcaacacatttttcagcgagaccggcgccggaaagcacgtgccccgcgccgtcttcgtggatcttgaacccaccgtgatcgacgaagtccgaaccggtgcgtaccggcagctcttccacccggagcagctgatcagcggcaaggaagacgccgccaacaacttcgcgcgtggccactacaccatcgggaaggagatcgtcgatctctgcctcgacaggatccgaaagctcgccgacaactgcaccggtctccagggtttcctcgtcttcaacgccgtcggtggcggcaccggttctggcttgggctcgcttctcttggagcgtctctccgttgactatggaaaaaagtcaaagctcggtttcaccgtttatccatcccctcaggtttcgacctcggtcgtggaaccctacaacagcgtcctttcaacgcattctctcctcgaacacaccgatgttgctgtgcttctcgacaacgaggcaatctacgacatttgcaggagatctcttgacatcgaacgccctacctacaccaacctgaaccgtctcgtttcccaggtgatatcatccctcactgcctctttgaggtttgatggagcactgaatgttgatgtgactgagtttcaaaccaacttggttccttacccaaggatccatttcatgctttcctcgtatgcccctgttatctctgccgagaaagcataccatgagcagctttccgttgctgagatcaccaacagtgccttcgagccatcctccatgatggcaaagtgtgaccctcgccacggcaagtacatggcgtgttgtttgatgtaccggggcgatgtcgtgcccaaggatgtgaatgctgctgtggccaccatcaagaccaagagaaccatccagtttgtggattggtgccccactgggttcaagtgtggtataaactatcagcctcctactgttgttcctggaggtgaccttgccaaggtgcagagggctgtgtgcatgatttcgaactccactagtgtggctgaagtgttctccaggattgatcataagtttgacctcatgtatgcgaagagggccttcgtgcactggtatgtgggtgaaggtatggaagagggtgagttctcagaggctcgtgaggaccttgctgctcttgagaaggattatgaggaggttggtgccgagtctggtgatggagatgatgatggtgaaggagatgatgattattag

SEQ ID NO: 114163 - DNA, 405 bp, Glycine max
  Peptide Sequence Number=SeqID_230941
atggggaatcatgcatgtcataagacaaaacaaactacaagagagagagagagagcaagttgggatggaagggagcaaaaaatacttaccgggaagaaggaagctgctggaagagggggggtgtttgctgcaagtgagggaagtgagggggaaggagtaaggagtattgcaccagaagggttggcgcaacaccctcacgtgcgtacttgcaccaccgttccctgtacagcacctgcgccctaccctgtacctatgctgatgaccaaaagtggttgtgccactgcagctgtaacaacccattgcgcaaagcttttggcacaacaactgaataccacatgtcagctcctcgttgaattgcgcccctgtctttggcgcaatgcaaataaatatagaccctcttggtaa

SEQ ID NO: 114164 - DNA, 1319 bp, Glycine max
  Peptide Sequence Number=SeqID_230942
atggactcccccatgacggccagaatgctgaaaatgtcagacgacaacaacaaacgaaacgcagaaacgaggttcgttgggattgccaatgcgcccacaacaccatcaccattccttcaccctgaccacgtggccgttgggtcccccatctccagggtccctctctctccttctccagcaccaccaccaccaccacctccctctcccagattccggttggacccagcagaccccatgtgggctcatgatttctctctcgccaacgatttctccagaatcaacctcttcgatcatgcaacccaaaccgatcataacatgcctttccaaccctacgcttcttatttcaatgaaacaggacccctcccatatcatcgtcatcatgttaacaacacccaaaccaacatgggtttggacccttacgcttcttgtttcaatgaaacaggaaccttccgaaccctcccctatcatccccatgttaacaatgcgggtttattcgataaaggttacacttttcccatcccagatgatcacgtgtatcatcacctcgtcgatcagaggaggaggcagccacagggtacaagtgataataactaccagattctcggtgatcgttacgcggtggcttcacagtctctcggaggaggaggaggaagagtcaaaagccccattaggttttctcagataacgcctccgtatcaatatcctcccaatgccaatattaccccatcacattattacgttgctgcaaaagaaaaagctgaactttccccttttttatctcctaggagaatcatcggggaagaccctgctgcagcgtttaggtgtgacaacaatggtgttttcctacaagggagagatgcaaaacactactttgagaatgagtatggttcttacagaaggagtcctcgttatgatgatgatgcaattcatggtgtgggtcggagtgttgttcgtaagaacttttattcttctgctgctgctccttctggtcaaagaagtggtggtgatttctcatcagtgcccatgctgcaggatttttattctgtgcctgacgcgcagtgctacatttacaacatggcaaaggatcaaaatggttgtcgttttctgcagcggatggtggctgaggggacctaccaagatatttgtatggtgtttgagggaatcattgggaatgttgttgaactcatgatagactctttcgggaattatctggtgcagaagctgctcgatgtttgcaccgatgatcaacggctgcagattgtgctcatgctgaccaatcacccagcccagctcgttagagtctctttaaatactcacgg

SEQ ID NO: 114165 - DNA, 594 bp, Glycine max
  Peptide Sequence Number=SeqID_230943
atgtcgcacttcgaggtggtttacggcaaacctccgccgaccgtcgtacagtacttgcagggctccaccgtcgttgccgtgtacgatttgctcagttctcgtgagtctattcacgcttcccttcaacgccgtcttcgcaaagttcaggaagctatgaaggtggcagcagataagcatcgccgggatcttgcgttccaggtcggggattgggtgtatgtacgcctgcgtccatttcgccagacttctgtagccccctcgtatagcaagttagctaagcggttttacgggcctttcgaagtggtggaacgcgtcggacccgtggcttataggtcctggtccaatgggagggacatgcccctgaagattccacttgggaatgctgggaggagctgcgtcgcgtccacaaccttgaggacaaggtcgttttcggggacgggagtgttgatagcaacacgcagcagagcaacacacagacaggagacaatgcagaaaatagcagaccaaagagagtcaggacaaggcctacttacttgcgtgattatgcttagagtaggaagcaattcaaagtcccggaagtcttcctctgagcagtag

SEQ ID NO: 114166 - DNA, 918 bp, Glycine max
  Peptide Sequence Number=SeqID_230944
atggggcatcatctagatctacgacttgtccggaatcaatggcttttgatagatcccaaagtagaatttctgatgtccgaggctaatgaagataaaacatttggagacttcagagagatgggacataggctagctaaggaagttattgcttttcttaaaagcaaaatggacaaagcatcaagatatgggagtctgggagatattaggctaagttttgttggacattcaattggtaatctcattataagaacagcgatagcagatagcataatggagccatttctatgccacctacatacatatgtttcagtatctggtccacacttagggtatctttatagttcaaactcgttgtttaattctggattgtggtttttgaagaagctaaaaggcacacagtgcattcatcaacttactttcacagatgatccagatttccaaaatacatttctctataaactgtgtaaggatggttatgtgccttaccattctgctagaattgaatcatgccaggctgcttcacgtgacacttcaaagaagggtaaactgttcctagagatgttgaatgcttgtttggaccaaatccgtgccaactccatgcaacatcgagtcttcatgcgctgtgatgtcaactttgatgcatctacccaaggcaagaatctggactctataataggtcgggctgcacatattgaatttctggattctgacattttcgcaagttgttgtggttttccttctctgcattcagttctaaagccttcaggcgtaatctctcacccttcagataccaatagtgctcagatttctgtgacagggtgttcaaagaaaagatgcgtcatctctgatgaaaagcttacttgttgccaaggacggatgcacatgaatagctatgcggtaattatcctggtaaaataa

SEQ ID NO: 114167 - DNA, 1317 bp, Glycine max
  Peptide Sequence Number=SeqID_230945
atggcggtacgtagagaccaaggcctctgctaccattgcgtcgacaagtggtcgcaaggtcacagatgcaagccccgtctacatctcctcatagcggacgaagatctcgaaccttcctcgagtttgtctacttctgagtccctgtcccacgtcgcacctgaccccatccaagcgccacaaatcagtctcaatgccatggagggcactccggcaccgcaaaccttccggcttctcggctccttgcaccaccaccaagtggttatcttagtcgacggaggaagcacacacaattttattcagactcgtgtggctaagttcctcgccttgccgactgctccgacggccgccttgagggtcatggtgggcaacggccacaccttggactgtgacacgatgtcctctcaggtctccctctccatccaaggtcacgaattcagattggatttgtatcacttactcatttgcggtgtggatattgtcctaggggtccaatggttaaagcttttgggcccaataaccacagactaccttaaccttaccatgacattccttcacatgggcctacccatcacacttcatgcagatgcaccccccaccccctctcatgcctctgctcatcaattaaaacgcttggcccagactcagagtatatctgctctgttccatatcaccaccaccaccacgcctgtgttatcttcaccaccaccctcgacctcaccaatcccttcacagattgcatcggtgcttgacaaatttccccacatttttgcagaacccacgcaacttccacccaaccgcaacatccagcatcatatacaccttccccaaacgactttggtcaacgttagaccgtaccgatacccccattttcagaaggccgaaattgaaaggcagatatccgccatgctcgccgctaacctcatccaacccagtcactcacccttctcatcccctatcctcctggtcaaaaagaaggatggctcttggaggtgttgcgtggattaccgggcattaaacgccgtaacggttaaagatagattccctatgccaacaattgatgaattgttggatgatctgggacaagcttcgtggttttcgaagctagatttgcatcaaggctttcaccaaatacgcatggcggaggacgatgttcataagacggctttccgcacgcaccaggggcactacgaattcagagtgatgccgttcggcctctgcaacgcaccgtcgacgttccaggcggccatgaacgatacccttaagcctttcttgagaaaatacgtggcagttttcttcgatgatatttttggtgtttag

SEQ ID NO: 114168 - DNA, 571 bp, Glycine max
  Peptide Sequence Number=SeqID_230946
gaaatgggagccaaatacgaccattgttgataatgaggtccttgtggagagagaagtccgaatgcgcctctggccgaacccggatatctgccacgaggttaacataacgcgtgtcttgccgcaaggacctgcgcaattggtccaagaaggtgaaatggggcatgatcagggccagacaagtcgcgtccgccggaacgactcgggaaagcgcatctgccacgacattggcggcgcctggcttgtatttgataatatagtcgaagccaaggagcttcgagagatacgtttgctgctccggggtctgaataacttgggacatcaggtccttcagactccgatggtccgtcaggatcgtgaacgacgtgccgaggaggtagtgacgccacttcctaacagaggaggtgatggcgtggagttcgcggatatacgcagaggccctctgcaaacgtggacaaaacactttgctaaaataggcgatagggggcctagaccatggcttgttgaagagtatggaaggcttgttgggcctctggggaccaacggaattggtctttgcgcaatagcgatgtga

SEQ ID NO: 114169 - DNA, 426 bp, Glycine max
  Peptide Sequence Number=SeqID_230947
atgttgccgcccaggcgagctgggttgcttccggaaaaagcaaccctactacgaaaatactctagaagccccaaattcaaaatttcaaaaattgctatttgcacccccctcattttgataagttcacccccttctttcgtaatttacagaaaaggttatgagaattttacggaagcattacggaagtcccggaagccattttttaaaaaaacgggggagattctttttcgtaatgttacggaactttacagattacgtaatgacacttgttttctttccgtaatgtcgcaaaactttacagattatgcaaccatgccctctttgacttctagaatgtatagaactttacggatttgcgcacaatgcttccttttcgactcccgacatgtcgcgggaccttcccggattgccttacgatgggtgtaa

SEQ ID NO: 114170 - DNA, 198 bp, Glycine max
  Peptide Sequence Number=SeqID_230948
atgaaggccacatttctccccaagaaaagtgaatatgtgatatatggagacaacaaacaaagaccacttgatcaacaaccccaacaattggaagttggaagtagttattggaagttgaaagttaaaaatggaagttggaagttggaagtggaagttactggaagttggaagttggaaatgaaagttattggaagttga

SEQ ID NO: 114171 - DNA, 162 bp, Glycine max
  Peptide Sequence Number=SeqID_230949
atggtaacgtggccacagtttgtggcgcgatgtcgtttcctactttcagaaatggctccgaaaaagatttctgcgaagagatctaggagggacgctatggctgaagggaccagtgccgcccccgagtttgatagtctccgtttccggagcgccatgcactag

SEQ ID NO: 114172 - DNA, 276 bp, Glycine max
  Peptide Sequence Number=SeqID_230950
atgttgtctacacagaaattcagcagtcatgtggtcgaaaaatgccttcagcatattggagacagcagatcaaggatagttcgagaattgttgtctgttcctcgctttgaacagttgttgcaagatcaatatgccaattatgtcattcaatctgctctactttttacaaaggggcctctgcatgcatctttggctgaagctgttcgtcttcacaaaacgttgtgcaccagtccatattgcaagaggattttttcaggaaacctgcttaagaagtga

SEQ ID NO: 114173 - DNA, 1144 bp, Glycine max
  Peptide Sequence Number=SeqID_230951
aaaacctttggttctgcagctcctgatctggatcctagcagtgtatatggtgtatggaggatcgatgatacagataatagtttctcaactcagtcttttcggataaaatacgccaggcaggatgttcatctgtatatgatgattgtgttcaacttatcccgtagtgaatttgtggatttagctacaactgctgttattttaaaatttgaacttatatatgctcctgcaactgaggatggtgtcaacatgcaagcttctctggatgattcctctgctgctatccatgaattccgaattcctcctaaagctcttataggattgcattcttattgtcctgtccattttgatgctttacatgcagtgcttgttgatggctttggtggagttgcttttctagatacgggaaatgtctcacttgttaaagcattattaacttctcgtgatatattggttgaagaactacaaaaaatcagcaaagcaatcaatgaagctttagatatttcagagtttgtgtcaataatgagtaatatgaagttattaaattctgtgctgcaagtgaatcaatttgcaatagatgttgaagttgtaggacaaggcaagccacaaaatggtcttaagggaggaaatgaagctctggattttctggatgttgaaaagctccattccctgtctcagaatgaactggataacaaatcaaggattttaggatttttacgtgatgcatgggtgaaggaccggaaagctgaatggtcaatatggatgctatattctaaggtagagatgcctcatcattacataaacagtaagagtgaagagtcttcccatcgtggtgtacacagacgagtttccagtttgtggaagttacctgatgatcctctccagactgcggctacacgtgctgaacttcatcgaaggagcattgaacaaatgcggattaacaaccgctcagttcaagacatgcagatatttggagatctcttgcatactccaattgtgattgttgaacatgtgatgaatgtaccccgtcgctgtccgagtgcaaattcattactgagacatattgggagtatagattcagatggcttaccaattggcctcagctctgacactataggcaagaaatttgcaacacaaagtaatgctc

SEQ ID NO: 114174 - DNA, 468 bp, Glycine max
  Peptide Sequence Number=SeqID_230952
atggcgaggcgctttgaacacgggcttccaatttttcctaggagtcggagtgcttgccgccggctgcataaactacgccaccgcgaatcagccgtgggggcagatcgagaaacgcttttcatgcgcaaagtcagagggtcccacatggacgtcgaatccgagttggaagaactcattaatgcgaaatctatgattgccgtgtctgctttgctagctatggtgactggtgttcacggtacaaaggacatatcaaagggtaacgcaatgttgaatcagaaccactggacaaagcatagcagttggggtgcagtttatatcactatttgcgttatcccagacatttttgacaatgctatgccacttcaaaccaaaggaattccattggagtcaatgtacaccatatggggcaaacaatggttttggcgtaggtttgtggaaggagcagttaagcaagataatttcccatga

SEQ ID NO: 114175 - DNA, 234 bp, Glycine max
  Peptide Sequence Number=SeqID_230953
atgagcatagcaatattttcagcagctccattaagtgcaccaccagcaaaaaaggtgacaccacccaacatgatggtgtttctcccacccaacgccgccgtgactcggctagctgccaaagatgacactaatgtcaacacttggctgccatacacacagtacatgtttttcgcaccagctgcatttctcagtattgatggaagaacttttcaagaaacggtaccatcgttgtga

SEQ ID NO: 114176 - DNA, 309 bp, Glycine max
  Peptide Sequence Number=SeqID_230954
atgccacgcactgtgaaggtcaagtcggtggcaacattggagaccgtacaggagattggtgtctatattcataggtttcacaatcttgacctttttaagcagggatggtatcggattaagatcactgtgagatgggaggacagtgaaagtttatctttcggaattccagctagtgttgttcaatacgaaggaagctcaatgtggtacccaagtcatgagactctcctagctagcggactagtcctctatgaagtagaagtagaacggaggagtaatgaagcatcatcctcaccattcatatttaaataa

SEQ ID NO: 114177 - DNA, 951 bp, Glycine max
  Peptide Sequence Number=SeqID_230955
atggcggccaccagagcagtaaccattgccagcaactccacatgctctctgcttgcaaagaaaacctttgtgggtggcactgctctttccctcaacaacctcaaattttgtcgtactaggaggtcttacacctgcagagccatctacaatcccctggttgtcgtcaaggaagaaggccaacccgaaacctttgattatagagttttctttgttgacaaatctggcaagaaggtttctccctggcatgatattcccttgcggttaggtgatgatatctttaacttcattgtcgagattcctaaagaatccagtgcaaagatggaggttgccactgatgagtctttcactcccataaaacaagatacaaaaaaggggaagctccgatattatcccataaatctatctgggagcagggagcttcagtacccattgctggccttcgatgattacccttccttccttgatgtcatcttcatctataatatacactggaactatggcttacttccacaaacatgggaagatccatcttttgcaaactctgaagttgaaggagcattgggagataatgatccagttgatgtggttgagattggtgaaagacagaggaaaataggtgaggttctcaaggtcaaacccttgggtgcattagccatgattgatgaaggagaacttgattggaaaatagttgcaatttcattagatgatccgaaggcgccatttgtaaatgatgttgatgatgttgagaagcattttccaggaactctaactgcaattagggactggtttagagactacaagatacctgatggaaaacctgctaataaatttggacttggcaacaaggcagcaaataaggattatgcgcttaaggtcatcacagagaccaatgagtcctggaataaacttatcaagagatcaattcctgcaggagagttgtcacttgtgtag

SEQ ID NO: 114178 - DNA, 1509 bp, Glycine max
  Peptide Sequence Number=SeqID_230956
atggcacaagatgaccactcacaagtaaaaccaaagccttcccctcagcttgtggaaccacgaatctccaccatgattcccacagcttcatggtttacacccaaaaggctacttgctatattttgtgtgattaacttgttaaactatgtggatcgaggagccattgcaagcaatggtgttaatggaagtaagggaacgtgcactgagggtggtacctgcacttctggctctggaatacagggggattttaacttgaacaattttgaagatggagttttatcatctgcttttatggttggacttcttgtggcttctccaatatttgcctctctagcaaagagtgtaaacccatttagacttataggtgttgggttgtcagtttggactcttgcaaccctatgttgtggattttcttttaatttctggtccatttcaatctgtcgcatgctagttggtgttggcgaggcttcatttataagtcttgcagcaccttttattgatgacaatgccccagttactcagaaaacagcatggcttgcaatattttacatgtgcataccatcgggctatgcacttggctacgtctacggtggtttggttggaagtcatttgggttggcgttatgcattctgggtagagtctttgtttatggttccgtttgctatttcaggactttttatgaagcctctgcaattgagaggctttgttcctgctgattcaaaaaagacactgacacctgaaacagttgcatcaggagttcaagttatggaggcttcaaatggaaaagatgagccactgtccttaaaggcagagcttagagataaaagctcaaatgatcattccaagtcaaaatctgtaacccaaatatttgagaagttctcgagatttttgaatgatatgaaagaacttttgcttgataaggtttatgttgtcaatgttctaggttacatagcatacaactttgtcataggtgcttactcatactgggggcccaaagctggctataatatatatcacatgactgatgcagatttgatatttggaggaattacaattgtatgtggaatagtgggcactttagctggaggcttcgttctggattatatgagtaacaccttatcaaatgcatttaagcttctctcaattactacatttattggtgctgcattttgttttggtgccttcttattcagaagcatgtatggcttccttgctcttttctctattggtgaacttcttgtttttgccactcagggtcctgtgaattatgtatgtctacgttgtgttaaaccaagtttgaggcctctatctatggctatgtctactgttgttattcatatctttggcgatgtaccttcctcgcctcttgttggagttctccaggataacattaacaactggagaacgacagcattgattctaacatcaatattgtttctagcagctggaatatggtttattgagcaagaaaatttaatattgagaagtggcactactggacatgaataa

SEQ ID NO: 114179 - DNA, 564 bp, Glycine max
  Peptide Sequence Number=SeqID_230957
atggtgccctgcatttggggatctgaaattaattccaatttccagaaactgcatttctttccaaacaacatggtgctcataagttttagaagagccataaatgcaaccaaatctttatattctggttcttttggggctaatgttgaacatgaggcaactgaagatggtaaatatgatggttcacatagagaagatgaatcagaaactttatctgatattcatgatgaagaagttgatttgtacattcatgatgaggaggggaagcatatcaagaagatactatgggaaacaacaaatagggagtatcttgaggatctcactcaagtttattttttaaaggagcaggcagctaaggaagcagctgcagtagctaacaagaaagcttttgaggaaaaatttgaaaattgttcggaggatatactagcagcaagagagcttgttgcatcttctactgaagccgtggcaaaatccagaaagagttgtcaccattgtgagagagcgagtgtcttgaaatcgcaagggagcgagagcatgtggctcgagaggagtgagcaatgtctgtag

SEQ ID NO: 114180 - DNA, 462 bp, Glycine max
  Peptide Sequence Number=SeqID_230958
atggctaaccctgcggtcagacaacaggaagagcgtgcagagattgaaacgcaccaagaaagcatttttaaagttacctcaatccatcatcagatgaccactgaagagaaaacgtctgaagtctccagtactccagaatattcatgcccagccattgctagctatgttggaggaacagagaaaggtagattggaactcagtgtggaggatcaaaaagtctcttttgacctctttgaggccatgaaacactcagatatgggtgatgcttgttctgatacaacagtgatacaacagtttcctttggaaaaagaattgggtgatgagatagacaacttagtcgataatgaagagtgtgatgatccgaaagacaattgtgttgatcatgtggtttttgaagaattggagaaaatgagaccaccagaaaatcccaaagcagaattaaaacccttccagcacatctaa

SEQ ID NO: 114181 - DNA, 2055 bp, Glycine max
  Peptide Sequence Number=SeqID_230959
atggcgtcttctaagaggccaaatgcggggcccaatgggagagggaaacgccggaaatcttctggcggtttttcgccgttggatgtttctccaggtagcgttgtgttccgtttgctctgtcatgcttctagaatcggcagtgttattggcaaaggtggttccatcatatcgcaaattcgcctagaaactggtgtgaaggttaagattgaggaagctgttcctgggtgtgatgaaagggttatcactatctcgggttcggataaagaggctgaagaatatactgctgagcagggaaaggaggttaatgataatgatgatgttggaagcgaggggaaagatggggaggagaagaatggtagtgatggcaatggtaatgaagataaagaagaaaaagatgctgttcccgttgaagattcaaagagtgagaaggggaattcggctatttggaaagctatatccctagttttcgagaggatggttgagggagtagaggagacaactgaaggggatgaagaaagtaataaatcttcttccttttttttgaggctgcttattcttactgctcaagttggatgcgttttaggaaagggtggtagtgtgataaagagaatggcagctgagagtggtgcacagattcggatccttcctaaagacaaggttccagtgtgtgcatcagcatttgatgagatagttcagatctcaggaagtgtagaagttgtcaggaaagctcttcaatctgtttctcaacagcttttggaaaatccacctcgggatcatgaatccctgtccgccaagtctactgggccatcatctcattcatttgggcaattcccaccacacaaccattcttttgctgctcaaggagaaccttttgctactggtcctcatgatatttctgcttttcattctgcccctcctttgattcccaagtttcatgaagctgccatccacggtcgcacgaggcctttacaagaaatgcttacttttcgtttattgtgtcctgtggagagggtgggaaatataattggcaaaggtggagcaatcataaagactgtgcaacaagagacagtgagtgaaatcaaggttttagaagcccctccagattcagaggactgtgttattgttatatctggtccagcgcaccccgaggatagagtatcccctgtgcaagaggctgtatttcgtgtgcaaactagaatagccaagcctatacccgatgccaatgaccatactatgttagcaaggtttcttgtttcttccaatcaaataggttgtctccttggcaagggtggttccatcataactgaaatgaggaagaaatcaggggcccatatccgtatattaggaaaggataaggttccaaagtgtgcttcagaggatgaagaagtaattcaggtgaatggagaaattgaggcagtgcatgaggctcttttgcaaataaccactagattaaaacatcatttctttcgcgattcatatccatctgtcaattatccttcaaattctccatttctggatcaacttcctccattcccaccttatttaggaaggaggggactttcacctcctgggatgtattctgaccttggtcctccaccttcacatgcgggttttcctcttgatgatcgccctgcttttctgaataatatacataggccaggccttcctcctcacatatctcaaaggaagccttggggtcctctgggggtacttgaaggtggcacacccattggcttgccagactttccaagaggtcctcctagaagaatttcaggatttgcaggggggagccaaccaattatcacaagcaccactgttgaagttgttgttcctcgagcagtggtgcctgtaatatatggggaagatggtgaatgcctaaaacaaatacttcaggtgaacccactgtatctgatctctgatgcaaacattactattactgatccaaagcctggagctgtggaaactaaaattataatatctggaaccccagagcaaactcatgctgcccaaagtcttattcaggcatttgtcatgagtgagagggagtcagtttga

SEQ ID NO: 114182 - DNA, 168 bp, Glycine max
  Peptide Sequence Number=SeqID_230960
atggcacaaaaactcatacaaaatacaactcagaaagtggtttatcagctagcaggaaagcaagaggttgagcaagcatggtggttcttgatgacaaacagtgacatgcttctaatggcagtcgagtgcaatagttttcaacctattggtgagtttggcattgcgtaa

SEQ ID NO: 114183 - DNA, 1263 bp, Glycine max
  Peptide Sequence Number=SeqID_230961
atggcacctatgcagagtattggtgtggcgaccactagtgcttccatggtgttgcctccttcctctccagctctgatggcttctccttctattgttttggcgattatggtgtctccttctctgtcctctcaccctcgtgtctccctagatcacttgtacacctctagtaatgttgactcactgtggggtgcaacttataagctgaagcagaagacctcagttggctttgtgtcaaccttcgacaagaaccttattaggttagctggggtgcagaatgctacggactcaaccaaaatctttttccaaaggagtttggaaattttggaggagaatggacaatggtaccaagaggctgtgcataaggtggcatccttggaggcggaggttgccaaatggagggctaccgctcgtactctttggttagtggaaagccctaaggtggccaatgccactgttgcttttgttgaggtcataaggtcaaaccaccaattgtctttaaaagttgatggtgtattggccaagttgctgcgcaccaaggtagatggtgatgagttgtttaaatgctgcaaggacttgcagatggagaagaaggaagtaggtggcatggtggagagcatggcccgacttaaagagtcagagtccaggttggaggagtccgagctacgagctgccaaggaaaaggaggccagcaaggagcttgaggaagagttgtttctgcaggccggtttctttgcgaaggaccttgacttgggtctcttcgatccctttaaggatgtgaaggatggcgtcttgcttgatgaggaagacattcgtaggaagcaaggccttgtcgatgtagaggtaggactgaggtggtcctgtaaagagttctatgacacgaagtcatctcagagcttctcccctgatgattgtgaggagctatgttttacttgcccttggttaaaggtattgccaaccaatcgagggttgccactagtgagcagaccaaaggggtaccttgggttttgtgcaccaagggcagaccttcagttttgcaagaatgtgtaccaagggtggaccttgggttttgaaggtatgagtaccaagggcagaccttgggtttttgatatggaacttagtaatagaaagggctcaccaagggtgatccttgggtttgttgagtcttggaccggggaggcattgaccctagcctacggagctatgtttggccatggttttggctttgtagtgtggtgtcggattcagagtttcatgagcaactaa

SEQ ID NO: 114184 - DNA, 1857 bp, Glycine max
  Peptide Sequence Number=SeqID_230962
atggggaaaaagcgtgtaatgacgccagccaaggacgttgacttatcttccatcaaatacgaacgtgaaattgtgcaagctccgcatttgactggatttgtatttagattatttgtgaggataattgaagctccggttataggccctatcattatgaatattctgaagaaagaaaataaaatggatgagatattgcggcacactatgatacctgaggaacccatgtttaaacctgaatatccacctcaagaaatggagcctggtgttgttgtccttgaggaagatgggagacctgaagatcgagttgagtatgctctgaagtgtcttccacattatgatgttgctgaatcatgggaaaattcatctgcatcctttcggtactggaaaatacgtgactatgctcatgcttatcaatctagaaaagtaaccccatctatggttgccgagcgcattatctcaattatagaggacaatggaagaaataaacctcctacaccactattgatatcgtttgatgctgcaggagtacgggagcaggcggcagcatctactcagaggtttgaagcaggaaatccattatcgatattggatggaattttcatggccatcaaagatgacatagattgttatcctcatccatctaagggtgcaactacatggatgcatgaggtacgcactgtaaaggaggatgcagtctgtgtatcaagactgcgtacctgtggtgtcatattcatcgggaaggcaaatatgcatgagttaggcatgggtacaacaggaaataatcctaattttggaactacaagaaatcctcatgcgcctgacaggtatactggtggatcttcttcaggtccagctgcaattgttgcttctggactatgttctgctgcactgggaactgatggtggaggttgtgcaaatctaatggcaggttcagtccgtattccttcttccctttgtggtgtggtgggatttaagacaacttatgggcgaacaagcatggaagggtcactgtgtgattctgggaccgtggaaattattggacccattgcttcaacggtggaggatgttttgctggtgtattctgcaatgttgggtgcatcacctgcaaatagaatcagtttgaaaccggcaccaccttgtttgccaactctgtcatccaatgataattcaaatgccttgggatctttaagaattggaaagtacaccccgtggtttaatgatgtacactcaactgaaatctctgataaatgtgaggaagcacttaatctgctgtctaaagcacatggttgtgaaatgatagaaattgttataccagagcttcttgagatgcgaactgcccatgttgtttccattggctctgaatgcttatgttcactgaatcctgattgtgaagacgggagaggtgtaaatttgacatatgatactcgtacaagtttggcactttttcggtcatttacagcagcagattatgttgcagcccaatgtatcagacgaaggaatatgtattaccacttggagattttcaagaaagtggatgtcatagtaacgccgaccactggcatgacagcacctataatacctcccagtgctcttaaaagtggtgaaacagatatgcagactacagcttctttaccagctaaccttatgcagttcgttgttcctgcaaatcttttgggattcccttccatttctgtcccggttggttacgataaagaaggacttccaataggcttgcaaataatgggtcgaccatgggcggaagctactattctgcgtgtagccgctgaagtggagaaactctgtggtgagtcgaagaaaaaacccgtgtcatactatgatgttctgaaggctaaatga

SEQ ID NO: 114185 - DNA, 327 bp, Glycine max
  Peptide Sequence Number=SeqID_230963
atgattcctccagcaccttcacaaataccactaccaactcctctttctgcaagtccagccgattttattttcactcctcagatgcttcactccatgctccagagcatccatagagggcagtccatcatcatgcagagccttcagggcttgggcttgccctccattataagcatggaggagtttgacgcacaagtggcctggccaggagaccaaccttcttcctctggagggggtggggcctccacagcccaggagcctatgactgaggagcccacagcaccagcaccatcaccagcagcagtagaggaggagaccactccagcttag

SEQ ID NO: 114186 - DNA, 678 bp, Glycine max
  Peptide Sequence Number=SeqID_230964
atggctgataaagcaactcagcaagtccatggatctggtatattatctttcaggactctacaaactgctgttggggtgtttggaggtgagagctacacagatataacagatgtgctacctcttatggtggaaaatgcaggaaacagcaatcgtgctgcaatttcaagtctgaattgccctccaattgttgctgttgaactttgtcgggaacatttggaattaaacacaatactaggaggtttacaacactcacacaccctgctcaaccaactaagctggatcccttgggagttcgtccctgcgacaaaaggagaagcatcagcgagtatcaatccctatttcctgcaattgatttttcactggcaaattgatagtaatgaggatacttggtggaaggccgatgttagagagacaaaggaagaacttgcagccagagggcggaagttcatgaactggttggggacaagaaaagagaaggagatagcaattgtgacgcatagagcattgttgttgcatactcttagtgcctttggaaattacagccatcccttggagaagaaagaattatcaaagccctttgccaactgcgagcttcgctccatggtcatcgttgattggtatgaacacaatctaaacaactttaagagctcccttgcacctcagtcggggtttttatga

SEQ ID NO: 114187 - DNA, 483 bp, Glycine max
  Peptide Sequence Number=SeqID_230965
atggctctcaggattcacgttatttcccctttcttctcaatctccaccacctcccccgtcgctctctccacccacaaactcaccatccgacgaatcaactgcaccggcggcggagagggcggcatcaacgacgcatccctggcatcggagttggcggcgagggccgccagaatgaatgcgcattcggtgatggcggaggaggccatgcgcaagagcagaaagctcctcttcggagaactctgcgagtacatgggcctcgacgaagaccaggcccaacacaaatggacctatatggatgatgacgagaaattggttctcgtgaaagcgtttcttgcagagtggggttcccattttcaccccttgtccgcgaggtccacaaaagagatgttggaggaatatctgcgacaagggaactcacctcccaagttaactaattctcctttcttctttgagggactcaacagaattattggttttccctag

SEQ ID NO: 114188 - DNA, 102 bp, Glycine max
  Peptide Sequence Number=SeqID_230966
atgacacacctcttatttgcgtccacgctgtcatcaccgttattgaatcagagagccatcgccgccatctacgcacataacagattcataactttactttga

SEQ ID NO: 114189 - DNA, 507 bp, Glycine max
  Peptide Sequence Number=SeqID_230967
atgccgtggccaattaggttcgttccggtaggcggaagccatgaagatgcgaaatcacgatcgtccggtgagattccgccgtctctccggcgtgaactctacaatgcgggtcgagcgaagcataggaacgaaagggggctagggccgcttcttaaaggcgatgagatctgcccgtgggtgcttcgggaagctttctctgccgttgatgctttcttgattcctgatccgacggatagcgtagatttctcggctgtcccgaaacctgacctgcatttagggtttgacaggggattggggcccacgttgatgacgtggatggacgccaaactggcgtttccggcgtgtgagcgagaagatgatttgtgtttcgacttaaaatctgcaaatattgttgaagtttttgtatacaaggtacctcagtggttgagagataagagtgtttataaacgacttataagtcttgacttccaagcgatgctggaccttgtgactaccagaacaatttga

SEQ ID NO: 114190 - DNA, 486 bp, Glycine max
  Peptide Sequence Number=SeqID_230968
atggagaacaatgaaaagatagctgatttcttcaatagaatcatcattcacacaaatgctatgaagaactgtggtgagaagatttcaaaccaaacaattgtagaaaagatcctgagaactcttaatcccaagttcgatcacattgtcgtagtcattgaagaatccaagaaacttaaggaaataacagtagaagaacttcaaggttttcttgaagcacatgaacagagaaatagagaagccaggggatcatcaggcgttataggacatttttcaacagagtgtgtaatcgcaccaagtagcatagatcacagggggaatcagtcacacaatgattatcaagcacatatggccaagaaagagaatgaagcaaactctgacgaacaacccttgacgctgatgatggttatcgattcagaaactcataataatgaagcctggtacatagattctggatgctcaaaccatatgattggacatagggactga

SEQ ID NO: 114191 - DNA, 1734 bp, Glycine max
  Peptide Sequence Number=SeqID_230969
atgggaaaagtacctttctctaaccctaaccctaaccctaattctaaccctaaattagcgaatggcaagaagacccaatcggcgtccgatgatgcttcctctatcaaccggagatcgaacgacgccgcaactcactcccagtatgtgaccttcaacgtcgcttcgtgcaccaagaaggagctcaacgacttcaagaatcgcctcgtctcggagctcgaacaaattcagaagctaaggaatcaaatcgggtccagcgagtttcaacccgggcagagcctcaacggacatccaaagaaaccgtcaggcaagaaaatttccggcaacaagcgacccttgccatctaattccgcaaaggatttgaaacggtcgcattcggaggttggaaacttgatgaagtgttgctcgcaagttttgcagaagctgatcaaacacaaacatgggtgggtcttcaaagcccccgtcgatgtagttggactgaaactccacgattactgcgatataattaagcagcccatggatctgggtactgtgaagtccaatctctctaagaacgtgtacgccacgcctgcagatttcgcctctgatgtgagattgacgttcaacaatgcactggcttataaccctaagggtcacgacgtgtacaccatggcggaacagcttctggctaggtttgaggaactatatcgaccggtgcatgagaaattcgaaggtagcatagttcatgatcgcgaatctgaggaggaattgcaagccagttcgtggagccaagttgagccagagagggtgaagaaaaaggagaatccgatccctcctgcaaaattgcataaagaacctccaccgcagcaccctgcaagttcttcaaatcctccattggtgcagtctccggtgcgcacaccatccccaatgcgagctcctcctgtgaagcctttgaagcaaccaaagccgaaggctaaggaccccaacaagagggatatgagtcttgaagagaaacacaagttggggttagggttgcagagtttgccgccagagaaaatggaacaggtggtgcagatcataaggaggaggaatggacatttgaagcaggatggggatgagatcgagctagacattgaggctgttgacacagagacactttgggaacttgatcgattggtgactaattacaagaagatggttagcaagattaagaggcaggcattgatgggcaacattgacaacaacaacaacgatgtgcagtctaacaaaggcaacggggaattgccttctagcgagaaggttgatggggggccagttgaagtgaagaagccaaagaaagtagaagcaggggacgaggatattgacattggggatgagatgccaacgagtatgttcccccctgtggagattgagaaagataaagatgttgttggaggccatgcaagtagtagttctagtagctctggcagttcaagcagtgattcgtcttcgtcaagcggtatttacctgcccctaacaattcggattcggggagttcctcagggagtgattctgaagcagacaacgggcactcgtagtagtcagtgggtttttggaactaatggtcatgtagatgaagaaaatgcttttgcttcattggcttcctttgagggcgtggctcgaatacatggacgagggattgtgaccgttgtttgttggttcgttttgggagtagcggtttgcattgtggcgctgtccactccaggatttgtggtgtga

SEQ ID NO: 114192 - DNA, 1011 bp, Glycine max
  Peptide Sequence Number=SeqID_230970
atgtctgaaagtgatcttatgcaaccccctgaagggtaccctgtgtcttccgtcaagcttcatgcacatgaagtcaagtttcttgcttctaaaagggattgggagtttggaagcggtgttctcttctaccaccgtctcaacaagggtttgatcttttcagacgctgttgggttcaaaggttgccgagaaattgaagggccttatgttgagtatcttgcagaacagtttgggaagcctgttttgctttcaggacctttcatacctgagccacccaacactgtttttgagggaaaatggggttcatggcttgaaaggttcaagcttggttctgtggttttctgtgtacttgggactgaatggaagttaccacatgatcaattccaaggactattgttgggtcttgaacttacagggcttccttttttggctgttctaaaagttccaattgggtttgagacaattgaagctgctctaccagaagggttcaaagaaagagttgaagggagaggaattgtccacagtggatggatacaacaacaattgattttggaacacccttcagtaggctgcttcattacgcattgtggtgctggttcattaaccgaggcactagtaaataagtgtcagatagtgttgctgccgcaggtagatgctgatcatatccttaatgcaaggactatggctacaaataaggttggggtggaagtggagaagggtgaagaagacgggttgttcacaaaggagagtgtgtgcaaagctgtgaaaattgtgatggatgatgagaatgagcttgggagagagataaagactaatcatagtaaagtgaggaagttcttactgaaccacaagttggagtctacctgtgttgatagcttttgccagcagcttcgacatttactcatgatttccaaagatataggtagatacatctttggtggagatgtcaatacaagggtgttcaccatagaagcgtcccaagtggggttactcaaagtggacgatcttgagtaa

SEQ ID NO: 114193 - DNA, 3672 bp, Glycine max
  Peptide Sequence Number=SeqID_230971
atgggtagtagcagtaagaaaaggaactctgcttcagaggaacaaacccttgccgccgacgaatatcccaaaatgctcaataagaaacagaagaacaccaccaccgatgatgatagccaacaacaacaaccttccgtcaagcccatggagaggaagaagaagcgcaaagccttggacaaagggaggcgccgaaccgcatcccaacccgaccccaaacctgtgcctccgtccacggattcgcctagcactagtggcggcagcgctatgccggagttccacattggcgtgttcaaggacctcgcggcggcgtccaagtcggcgagggaagccgccgcgaagcaaatggtgacggagttgaaggctgttcagaacgcttatgattcgcgcgagaaggagagtggtgagggtggattgaagttggaagcggagaaagacgatggattggataactgtgctccgtctgtgagatacgctgttcgtaggcttattcgcggtgtttcttcgtccagagagtgtgcgcgacaaggttttgctttaggtttaactattttagctggcactgttcataacattaatgtcgcgtcatttctcaaacttgtagtcaatttgctggaagtaacttcatcaatgaagggtcaggaagcaaaagattgtctgctggggcgcttatttgcttatggtgctctggctcgatcaggaagactcatacaggagtggaatatggataaaagcactccatacttaagagaatttatcagtgtacttatctctcttgcaaataaaaagcggtacttgcaagagcctgccgtctcaataattttagacttggttgaaaagttacctgttgaagcattgatgaatcatgttcttgaagctcctgggctcaaggagtggtttgaagctgctatagaagtaggaaatcctgatgctttgttccttgctttaaaagttagagagaagatttctattgatagctctgtatttggtaaactgctgccgaatccattcagctctagccagcttttctctgctgatcacttgtcctccctgagtaattgcttgaaggaatcaacattttgtcagcctcgcgttcatagtgtctggccagttttgataaatattctgttgccaaatactattttgcaattagaagatgcagcatcagcttcaaattcattaaagaaacacaaaaagagtcgaaaatctagctcctctgatgaagaaattgcgaagaatcttcagtctttttgtgaaataataattgaaggatcccttctcatttcatctcatgaccgtaagcactttgcttttgatgttctgtttcttcttctccaaaagctgcctgcatctttagttccagttgttctgtcgaacaaagttgttcagtgcctggtggatgtactatcaacgaagaacacatggctgtttaaagtagcgcagcattttctgaaacagctgtcagattgggtgggggatgatgatgtcagaagagttgctgttatagtggctattcagaagcacagcaatggaaaatttgatcgtataacacgatcaaaacttgttaaagattttatgtcacagttcaaaactgagcctggttgcatgctttttattcagaacttaatgaacctctttgtggatgaaggtaatgcccctgaggaaccttcagatcagagtcaaactacagatgaaaattctgaaataggatctattgaggataaggattctcctaggaccaatgggaattctgattttttgaagagttgggttatagaatcccttcccagtattttaaaattcttgaagctggaccatgaagagaagttccgagtacagaaagaaatcatgaagtttctggctgttcagggtctgttcactgcatcacttggctctgaggtgacttcgtttgagttacaggagaaattcaggtggccaaaatcttccgcatcgaatgctctttgtaagatgtgtatagaccagctacaattgttattagcaaatgctcagaaaggggagggtagtcgtcctttggctaatcgcgttgagccaaatgatcttggttcttacttcatgaaattctttggcaccttatgcaacattccttcagtttccctcttccggtctttagatgatgtggatcaaaaggcagtaaaaaaattgcaggcaatggaagccagattatccagagaggaaaggagccatgactgtagcactgatgctaatagattgcatgcactgagatacttgcttatccaactgcttctgcaagtgcttcttcgtccaggggagttctccgaagctgcatctgaactcatcatttgctgtaagaaggccttttcaacttctgatcttcctgagtcctcaggagaagatgatgtggaggttgatgatgcccctgaattgatggacgttcttgtggatacattactctctctgcttccacagtcatcagctgctatgcggtcttccattgaacaggtatttaaatatttttgtggtgatatcactgatgatggactgatgcggatgttgcgggtcattaagaaaaacttaaaacctgcaaggcatccagatgcagcaagtgcagatgatgatgatgaagatgatgactttatcaatattgaagaagaaattgatcaagctgagacaggtgagagtgatgggcagacagatgactccgagtcagtagttgaagtggaggagactgatcatggccattccgaagcttctgatgattctgatagtgggatggatgatgatgcaatgttcaggattgatacatatcttgcccagatgtttaaagagaagaaaaatcaagctggaggtaagcctcaggttcttatggtttactcaaatttggctcaggcttttgttaaccctcatacagcagaagttagtgagcagcttggacagcgtatatggggaatattgcaaaagcaaatatttaaagcaaaggattatcctaggggtgatggagtccagttatccactcttgaatctctgttggaaaaaaatttgaaactagcttcaaaaccatttaaaagacagaagtctgcatctaacccttcaaagcaatcagctgcctggaaccgacagaaaatgatttgttcccttgcccaaactgcgaccttctggattttgaaaattattgattcaagaaatttcgcagagtctgaattggagaggattgctcaaattttcggtgaagtgttggtggggtattttgacaataagaagtctcaaatcaaatctgggtttttgaaagaaataattcgaagacgaccatgggttgggcatgctatacttggcttcattttggagagatgtggaagtgccaagtcagactttcgacgagtggaagcacttgagttggtaatggaaatattgaagtcactgacatcaggaaataatgatgaacagaatgcatcgaagaagattcttaagaacagttttgataaactttctcggctgatgaaagaattggtgactaatatgccaagtaaaccggcaaggcggaccgaagtactgaagttttgtgtcaaggccttggagatcttgtctaagcacaatctcaccaagaattttgttaaaactttggcacctgatactcaagctgcccttgaggtgcaacttggtgagcaattcattagtttgaagaagctggaaaaataa

SEQ ID NO: 114194 - DNA, 216 bp, Glycine max
  Peptide Sequence Number=SeqID_230972
atggtggcggtggccggtggatataactttttgccaagtaacgctataaagaaagaaaaggtgttaattaatcttgctaagatgagtgagatcaaatatggctatccatatccagctcaaggtccttatcaggggccgcctccggtggcagcacctccacagtactatgctgctccaccgcctagaagagaaccaggtttccttgagggatggtaa

SEQ ID NO: 114195 - DNA, 759 bp, Glycine max
  Peptide Sequence Number=SeqID_230973
atgaacccaaaacagctcctcctcctcttcttttctctctttctcacaatcactttctcgttgaacgaaagatttgaagcctgcgatgccaagacatgtgggaacgggcagaacataagctacccattctacatccaaggcaagcaaaaacccttttgcgggcagccaggcttcgagctaacgtgcagccacaagggtttcccaattctgactctcatgtacaccccatacacaatccaccaaattttctacgacaaccaatctctccgagtgtccaatcccgtcttttcacaaccaaacctttcttcttgtattgccccgactcagaacctcacggtcggaaggtacagattccgagtcgctccgaaccagagggaactgttcgtgctgtacggctgcgactcagcggcgcttcagaaaacggtgccggagcggaggatctggtgttctgcggcgggaaacgaaacgacgtcggttgtggggttggataagggggatcgggatttggtttcggcgcgggagagttgtaagggtggtgctgtgaatgcgacggtggatgatttgaaaggaggggttagagaggcgctgcagagagggtttttgttgctttggaatgcgactagctgcagcgagtgcaagagtagtggagggaggtgcggcttcgacatcgaccctcgtgtctatgcttttaggtgttactgtcctgataggcctcatgctgtcaaatgtaccaatacagagggaggtagactcacttga

SEQ ID NO: 114196 - DNA, 1200 bp, Glycine max
  Peptide Sequence Number=SeqID_230974
atgttgatgattgggttgctcctacattgcaaaagaaaacacagttcctcaagtggtcaattccaaacaagaaatactttttctattccctcctcaccaaatgcagaagtcgaaagtggcagtgtgtactttggagttcctctcttctcctacaaggagcttgcagaagcaacaaaccgttttgaccttaataaacaaattggagatggaggctttgggactgtctacaatgggaaactcaaagatggaagggaagttgcagtgaagcacttgtataatcataactacaggcgagtagaacagttcatgaatgaaattcagatcctcacacgtttgcgccacagaaatcttgtgtcactctatggctgcacttcacgtcagagccgtgaactgctgcttgtgtatgaatacattccaaatggcacagtagccagccatctccatggggaattggcaaagcctggcttactaacgtggtccttacgaatcaaaatcgcactagagactgctagtgcattgtcttatcttcatgcttctaaaatcattcaccgcgatgtcaaaactaacaacattcttcttgacaacagtttctgtgttaaagttgcagattttggcctttcaagactattccccaatgacatgactcatgtctccacagcaccacaagggaccccgggttacgttgacccggaatatcaccaatgctaccagctaactagcaagagtgatgtgtatagctttggagttgtgctcattgagctaatatcatctatgccagctgttgacatgaacaggcataaggatgaaattaacttgtcaaatctagccataaagaagatccaagaaagggcattgagtgaactggtcgacccttatttgggttttgattcagacaaagaggtgaagaggatgatagttgaggtggcagagttggcctttcaatgtttgcaacaggacagggaattgagacctcccatggatgaagtccttgaggtattgaagagaattgaaagtgggaaggatgagctaaagcatctagaagaagcagttcatggttctggttctggggtttcacataatgtaacaacctcatcattggatgaagctggattgttgaagaataggaagccaccttcttcaccaatatccgttactgatagttgggaaagtaaatccactacgcctaatgccagttcttaa

SEQ ID NO: 114197 - DNA, 345 bp, Glycine max
  Peptide Sequence Number=SeqID_230975
atggtggaaagggaaaaattcaatcatatagagaaaaggttgagagccattgaaggagacgaagattatgtctttgctgacatggtagaactgtgtctagttcttgacgtcgttatccctttgaagttcaaggtgtcgggtttcgataagtacaaggggactacttgccccaagaatcaattgaaaatgtacaacaggaaaatgagggcatactcgaaaaatgaaaaattattgatgcatttcttccaggaaagtcttactggggcaatcgtcacctggtatactaatttggaaccttcccgaatccattcttcaaaggacctaatggttgccttcattaggtag

SEQ ID NO: 114198 - DNA, 438 bp, Glycine max
  Peptide Sequence Number=SeqID_230976
atgagtgaaatagaagaggtgcaagaacagatgaaggctgacatggaggccatgaaagaccaaatggctgccataatggaggccatgttgagcatgaagaaaataatggaaagcaatgcggctgcagttgccactacgagtgccgccactgaggtagacccgactcacctatcgggcctcaaccaagtaaatcgtccaacctcagacatggtaaggcagggaggcgaagtgttaggaagtatggatggcccctattttgtgaaaattcagaacaagcatttcttcccaccatatggcttgcctcccaactatactccatccaatgttgcacacactcccaatgagaatgtcgacaactctacaccgatacccattgagagccaacaacctcaatctgatcatgcacatgtctctcaacccatggggggagacacatga

SEQ ID NO: 114199 - DNA, 630 bp, Glycine max
  Peptide Sequence Number=SeqID_230977
atgacctgccctcttgatgagtcgatctcttgctttcacataaaggtggacccttgggtactagtacctatcacctttagaggactatatgtcctcgccatcagaggactacacatcctcgcctgcagagggttgcacgccctcgcctttagaggactacgcgtcctcattttcagtgtgctctatatccacaccttaggagaatataagcaatattctgcccagcgaccacaatgccaatctccccctgcaaatgtatcagttggtctgtgccgtcatgacatagggatcacgcccacaagacgcccagtggaccaaaagaagtccaacagggccctggggtttccagctttggttacgggcctctgtcaatcctacagggtgcccgtccccccagcgagttcatgccatcgtgacataggaatcgaacccacaaagacacccagtggacccggagaagtccaacagggccctggggtttccagctttggttacgggcctctgtggtcctacagggtgcccgtccccccggcaaggtcacgtcatcatgacataggtaaggatcgcgcccgcaagacacccagtggacccgaagaagtccaacagggtcttggagttgtcaagctctaa

SEQ ID NO: 114200 - DNA, 450 bp, Glycine max
  Peptide Sequence Number=SeqID_230978
atgcaagaccaagacgagggtgtggacgcccgatttgaagatgtccggagtgcaagccaaacgttgtcgtcctggaggtcctcgtcactgaccactcactccagcagtggcatcaggtcttacacgtggggtcagagaggatgcaccacaatgtcaggtcttgaactgctgtcgcgccaagttgcggtcagcggcgacgtggtggtcgggccggatttctctcttgtcctagtcaaggttgtggcggcgcaacatggtggcaaggatgcccagatccaaatctctcgcgttcggatttctctcttaatatccagtgatgctggactcttctttccagaaatcatggttatgttgtttctcttcttcaatgtgcagtggaaagggaaaacacaagaagcaataggcaagaagcaatttctggtggattttaaccgccagaaaatgaattaa

SEQ ID NO: 114201 - DNA, 1681 bp, Glycine max
  Peptide Sequence Number=SeqID_230979
atgggtgacaacaattatgggggctcgattaagcaacccattatagaccgggaggtcatctctattgggagttcctcatcggaggatactcgtcgaggtgcccctgacaatgagtcctcctctttggagaaggtgagggcttcgcgtcatattggtggggcacttcttgccctcgcaggaggggagcttgtcccggttactataatcctccctccttctgcttctgggggtgtaaggagaggtagtggtggcagagatgtgaagctggcgagcactaaggactcttgcaagttggtcgttcaggcttgtgggagtgatgacttcttgttatgccaggtgaagttggcaagcactgaaaactgttgcaagttggccattcaggcttgtgggagtgatgacttcccgttatgccaggtgaagctagcgaacactgaggactcttgcaagctggttgttcaagcttgtgggagtgatgacttccggttcttgagggatcgtttgtttatggtcatggctactggtgtcatggctgatggctattttggagcagctgttgatcttgctggacgcaaaagccattctttctcttcctttggcgagcgatcccgtcggtggcttggatggtattatggtaacttcgttcggaggccactcgtgaagcaggttggacctgccggtgggaatttgccaccgtttgctgctgctcttgatgttagagaagagggtcaacctgttggagatgttggccctattgctgttgttgcagaggctgcaaggttgacgcccagtgtgggtcaccctttggctccaccgattgtcgaggctcctactgctgatgctactactcttgctccttcacctcctcttatatttgttgttcaaaaggtcactcttattgctgctgaaattattttgtcagttgctatggttggttctattgtggtgccatcgtacaccgttgtggcacctttgtcgagtgctggtgtggcaaccactagtgcttccgtggtactgcctccttcctcttcggctccaatggttctaccctctactgttttggcggtggcgtcgccttcttcttcttctcaccctcgtgtcttcctggatcatttgtacacctctagtgatgctgattcactatgggaggctttgcaatgggtggcatccttggagggtgaggtcgccaaatggagggctattgctcgcactgtttggagaacggagcactcaatggtagctaacaccaccattgcctttgctaaggccgtgaggttgaactttcgattgtcttccaaagttggtggtgtgttggacctggctggcaaggtggagggcattgcgacggagggggacgggcttacgaagatggttgctgatttagaggctcgactgaaggagtcagagtctaggttggaggagtctgagttacgggcttctagggagagaaaagctaacaaggaacttgaggaggagttgcttgatggtgtcttccttgatgaggaggaaattgttgcggaggaggctattgatgaggagcagggtgttgtagagcaaggcggtgatacccatgtcttgtcacccatttggtgggacttccttctgctctgtggagcttctcctttgatgcttgtgaggagtatgcttgacttgccactggttgaaggtcttgttgctcaatctg

SEQ ID NO: 114202 - DNA, 648 bp, Glycine max
  Peptide Sequence Number=SeqID_230980
atgaaacattgtagttttgtgatcaagcataagggtttcatcattcaatggcatcaatattcaataaaggtgtcttctgaattcataaatgcagataaatctgggggagagggggtgattgcccatggagagcaagtatatcttcgggtcaaagaaaaatgctcttcaaaaagatggtttgccagtgatgaccttaactcccttgaagaactaattggaaggttaaggaggctgaaggagaatgtggggtttatagtaaatcgtgtcacagcaattcaggctggtctagacagctggcagtcagagcaaataaacaggaagctgtactatctttcgttcctttccataatattcctccctttgtccatcataacaggagtctttggcatgaatgttggaggagttccatggacaggtcaaaataccccagagctaaaagaaggttttcgtaatgtcatgttactgtgtgttgctatgttatttcttgtactactctgcttcattttcccggccctttatacccgtatagcggctgcctggcgaaataagagagctatgggaagaagctggtcactgaacaggaagtcattgctcaggagatcattaagaataggagagcaggagcgagggggctatcttcggatttga

SEQ ID NO: 114203 - DNA, 837 bp, Glycine max
  Peptide Sequence Number=SeqID_230981
atggaactagctcggcatagagttatggagaatggggtaggtgaggagatggagggtgaaacttcagcacgggttcccctcagggagcgccgtgtctaccctgctcatccttcatgcttggtgaggaagagagcttatatatttgatggcatggggaacttttatcataaggattgggatctagcagacctttttcaaaaagaagagaaggaatcgggtgtaggagaaggccgaggaaatgagttttcttggtaccacgttgaattaccgaaaggaaatcaaaagttgtcacaatctgcacaggacctgattggtgttttctgcccacctttgaaactccaagacattctttcacttgttagcaatggacccttttgtgctcatgtagatggggcgcttgtcttccgggttaattcgcctggtcctccctccagcgacttcacatttaggattgctgctagagttacagaacattcagtaattaccgtttccttgggacgtgttcccaggttaggcttctcacgtgtgggtgaatctctactttcggagattcctagtgttgaaagttcctatccttcaagaggtcagcagcaggaaaggacagtgatcaaggagcatgttcttgaattcttattgactatgaatcactctgaggaagctgacaaccctgtgcctagatctgtctcaaatcttgtagttcacataattgacacacatgtagatcagattcaagaccttgtgactaagcttgagatggagttggactccgtggagcttgacttggataaaggtgatttcgtgataaactccttgatcccccctcccaatccattctga

SEQ ID NO: 114204 - DNA, 246 bp, Glycine max
  Peptide Sequence Number=SeqID_230982
atggtaccgagcgataggcggagagggaggcggaagcgacatcacggcggcggagagagcggagcaaggaggccatggccggaagagaagaggagattgattgatcagaaaggaaatggagaaagagagagaaagtcagagaaagaaggttctagatcgataacccaaacggtgtcgtcggacatccttggctacgtggcacgcaggaattccacgacctctccttggttggttggtactttttga

SEQ ID NO: 114205 - DNA, 300 bp, Glycine max
  Peptide Sequence Number=SeqID_230983
atgtgtcaactatgcacaggtggccttgttggtgcttgcatgcttagcgcaactatagcttgcttagtgcgcattagtgaatttcggcttagcactcatcttttcgctcagcggatggactcaagcagtgcacttaatgagattagcccttcttccagattcttcctcgcgctcagccaaaggagtgttgcgctcagcggatgggtcgctaagctagaagattggcttagcgagtgtatggaaatcagcacttcacaaacttacctaattaacctgaaattgagaggaaatgattattaa

SEQ ID NO: 114206 - DNA, 238 bp, Glycine max
  Peptide Sequence Number=SeqID_230984
atggaagagaagaaaagagagacagagctacattgtactgctcatgtctcatctacgaaaggagtttggatttacaaaggggaggaagcacaagcacaagcactagcagcgtgttgttattctcctccattacagcaaaaacagaatcagaaaataaaaatggtagccaagccttgccttgccgctttcacactgagggttatgcaggcattgaggtttttgggtttggggatggccg

SEQ ID NO: 114207 - DNA, 180 bp, Glycine max
  Peptide Sequence Number=SeqID_230985
atggaggagaataacaacacgctgctagtgcttgtgcttgtgcttccttccacaacatgcaatgacccttatgcccttccccccaaacagatgagacatgagcagtacaatgtagctctgtctctcttttcttctcttccattgcgtccaaaaaggcagacaggatggagccaggcataa

SEQ ID NO: 114208 - DNA, 141 bp, Glycine max
  Peptide Sequence Number=SeqID_230986
atggaatggggaacttacttggattgttgtgtgctgaagatgcgtaaaagatgcaagaagaaagcaagaatgcagaggggcatgcgcttagcggttgatggatcgcatagcgctgctatggccgcaaggaattgggcttag

SEQ ID NO: 114209 - DNA, 288 bp, Glycine max
  Peptide Sequence Number=SeqID_230987
atggctaagacaactaagcaatccttgagtaattggggaccgaaccatgttcttactttgatagtggacaatgccacatccaatgatgttgcaatcttacttctcaagaagaggctaacctcatggaatagtttgataatggagattatgttcacatggaattccaccaacttaatgttggacactgcattgaagcactggaaggcatttgaagagtttgaaatggaagatatgaaatatgctgataagttacaaaatgggggtggtgtttctatatttgaagattag

SEQ ID NO: 114210 - DNA, 111 bp, Glycine max
  Peptide Sequence Number=SeqID_230988
atgaaatacttctctacttctcaaagtatgtgctgcatagctgcaacttcaaggattaaggtaggttttgccttgacagatatccactcttccaatttaaggaacctctga

SEQ ID NO: 114211 - DNA, 231 bp, Glycine max
  Peptide Sequence Number=SeqID_230989
atgaaagcggttattgaacgctacaacaagctaaaagaggaaacccatcacctcatgaatccggcttcagaagagaaggtagcagtatttgtgacctgcaaccccaattatttcactactttgatggctataaaattgagactgaagccccccaatccaccatctctactaccttccgacttcccaagcattcccacactttcaatgaccttcttagacagagaaagttga

SEQ ID NO: 114212 - DNA, 306 bp, Glycine max
  Peptide Sequence Number=SeqID_230990
atgggcatcaataacaaccaccacacatactggtgtcataaaacaaaccaccctctattgcatctatttacccaattttctgctagactctttggcctcataaaggaaagggaagcattgggcatcaatcaacctcttaaagagttttggcagacagaagcagcaagcttgaggcagcagcttcagtacttgcaagaatgccacaggcaattaatgggggaagaacttacgggtttgggtattaaagaactacaaaatctggaaaaccaactggagatgagtttaaagggtgtccgcatgaaaaag

SEQ ID NO: 114213 - DNA, 381 bp, Glycine max
  Peptide Sequence Number=SeqID_230991
ctttactacttgacttgaaaggaacagtagaagtggagcaaatgcaagctataatgatggcactagagggaggaatacgagtggaggtgacactgtatgagccacgttctctcagaattgataaagaagtcgttgatggtagagaagaatcaagcggtggcaaagactggggttctggtgaatttaatggagagactaaagctggtggaaatatgagaacaggtacagaggtcattgaaagtgtgggaatgcttgggaagtcggaaggtagtagagatgatgcggaaactacaaaaatggagatacaagactttttccttttcagattggaaggatgggttgagttgtggctttgctcactaaactcaggtggtagtttag

SEQ ID NO: 114214 - DNA, 231 bp, Glycine max
  Peptide Sequence Number=SeqID_230992
atgatggcacatcagcaactagagaggggttccatgaaaatgatgcaaaatgagggtttgaaggggggtaaaggagagacagaggcaagtagaggatatggaagcagagacatatgtgaccacaccaacaaagaaatccatgataagcatatcagtgtaggttgccaacaagccatgtcgagaacaatgaaaatcataagttggaactcccgtgagcttgggaacccatga

SEQ ID NO: 114215 - DNA, 210 bp, Glycine max
  Peptide Sequence Number=SeqID_230993
atggaggagaaagtaaagctgaaaattagtggaggtttaaggagcacctacttgaagctcttgtgctttgataccacttgttggaagcttgcttatgaagcttctatagaggctgaatctttgagcttcaataagcctagcacatgggaagcttccttgagaagcaaggaaggtagcttccttgggaagcaaggaagaaagctttcttga

SEQ ID NO: 114216 - DNA, 1433 bp, Glycine max
  Peptide Sequence Number=SeqID_230994
atggaattccgcgtcatgccttacagcgaagggcagtggctgatggtggcgcgtgacgtcacccagatgcaccagctggaaggggcgcggcgtaacttcttcgccaacgtcagccatgaactgcgtaccccgctgacggtgctgcagggctatctggagatgatggacgatgccgggatgaacgagcgcacccgcagcaaggcgctcaataccatgcaggagcagacgcgacgcatggacagcctggtgaagcagctgctgacgctgtcacgcatcgaagcggcccctgccattgatctgaaagagacggtggatgtgccgaccatgctgctgctgttacagcgcgaggcggaaaccctcagccagggccggcacagcatccatttccacaccgacccgcatctgaaggtgttcggcaatgatgaacagctgcgcagcgcgatttccaatctggtgtataacgcggtgaaccacacgccggatggcacgcgcatcgacatcagctggctgcgcaccaaacagggcgccgaatttaaagtgtgcgacaacgggcccggcatcagcgaggagcatctgccgccatgcgctcggccaccacaccacgcggctggagatcagcagcgtgccgcatcaggaaacctgcttccgcttcgtgctgccaccgcgcttgattgtggcgaacggaatccgcgagaatgtggcgcagtaaacgccaccggactctgtgatgaaatcgctgctgctctcccttttattactgtgcccgctgctggcgacggctcagcaaagcatgctgaccggcaacctgagcagcgtgggctcggacacgctgggctatctgatgacgctgcggcgggatcgtcgacggcgccgaccgcgctggccgccggggccgctcagcttggcgccatgagccggccgatgcaggtggatgagcgtcagctgtttatcgcgcgctatggttatgcaccgctggcggtgccggtggcgatggatgcgctggtggtggtggttaatcaggacaatccgctgccgtccatcagtcagccgcagctggatgcgctgttctccgtgacgcggctatgcggcgcacagcaggtgccgcaacgctggggcgatgttggcctgcatacggcgaactgggcaacgcgcagtattcagcgctttggccgtaactccgcttccggcacctggggctttttcaagcagcaggcgctgtgtcgcggcgatttccgcgctgacgtcgcggagtttcccggctcggcggcggtggtgcaggcggtcgccagcacgccgaacagcatcggctatgccagctttggctttcacctgagcggcgtgaaaaccctgccgatcgtcaccgccagcggcgacagcgttatgccagatgccgaatcgatccgcagcggccgttatccgtggtcgcgcccgct

SEQ ID NO: 114217 - DNA, 171 bp, Glycine max
  Peptide Sequence Number=SeqID_230995
atggggaatggacacgtggactttccaaaaccgagggcgcttacttttcctgctttcaggtttggcgaaaaatgcgtcaaaatggctcttcactctgtctgctttctattattgactattgtatccgttgcaagtaacatccagttaagtgatttagagttcgtatcttaa

SEQ ID NO: 114218 - DNA, 760 bp, Glycine max
  Peptide Sequence Number=SeqID_230996
atgggggagacacatgaaataccccaccacaatctagtcaacttcgagcttcgcctcagatatgccactaaggggcgagcagctggtggtgtactcctgccaaacactttggagggccctcaatttcgcccacaacccttgcattttgcggcggggaaagtccctcctgctatggtggaaaaaggaaaattggatcatatagaggaaatgctcagggccattgaaggaggtggagattattcctttgctgacatggaaaagttgtgcctagtacccgacgtcgttatccctccgaagttcaaggaaagtcttactggggcagccgtcacctggtatactaaattggaaccttctcgagtccattcttggaaggacttgatggttaccttcgttaagcagtatcaagatttggcagcccaagtggcgccccctatgatagtgtcgcaacctacccttcgacgggggcgtgacgcgggactcgatggggcatcttccaaggaaggaaaatgcgcagagtcgccaccaacgtttattcgaggaaaacatcggaaaaaccaaaaatggaaaaaggtcgaaggtcttcgtattttgaaaatgagggttcgagagtcatttacgcacgaggaagggggaggagcttaccgcccaactcacgcaggcgagctggtgacttactctagaagcaacttgctcgcccaggcaagctcagcttgcccaggcgagctggttacttctcccctaagtcttctaatggacccag

SEQ ID NO: 114219 - DNA, 507 bp, Glycine max
  Peptide Sequence Number=SeqID_230997
atgatagtgaagaatgaagattataaattggttgagtggcaaggagttgggatgggtttaatttggctgtgggcattggacccaggaggtagcgaactgaaaagtgcaacaagtaaatttgcacagtcagagaagctcggacaaggtggctttggtgctggggttaaggaatatgcaactgaagttaagatcattagccaattgaggcacaagaatttggtacaactccttggtttgtgccatggaaaaaatgatctccttcttgtatatgaattcatgccaaatggaagcttagatttccatttatatggtgggaaatacttcttgacatggccggtcacaaaccaccttaaagtagcagacccaaagctatgtggagcatttgatgcggagcaaatggaaagattcaggccttctgtaatgcaagtgttccaaatgcttaagtttgaagctgaattgctaattctgccagtggatgcctttgacaaactactagctatcctttaa

SEQ ID NO: 114220 - DNA, 672 bp, Glycine max
  Peptide Sequence Number=SeqID_230998
atggtgaggactttgaaccctctaaaggcaagaactttgagccctctaaaggcgagaactttgagccctctgaaggtgacaactttgagtcctctaaaggcgagaactttgagtcctctgaaggcgagaattttgagtcctctaaaggagagaactttgagtcctctgatggcgaggactttgaaccctctaaaggtgaggactttgagtcctctaaaggcgagaactttgagtcctctaatggcgaggactttgagccttctaaaggcgagaactttgagtcctctgaaggcaagaactttgagtcctctaatggcgaggactttgagccctctaaaggcgagaaattttgagtcctttgatggcgaggactttgagccctctaaaggtgagaactttgagtcctctgaaggcgagaactttgagtcctttgatggcgaggactttgagccctctaaaggcaagaactttgaatcatctgaaggcgagaactttgagtcctctaaaggtgagaactttgagtcctttgatggcgaggactttgagccctctaaaggcgagaactttgagtcctctgagattcaaagtaaagaatcaagactcaagattcaagaatcaagagaagactcaatcaagataagtattaaaagagtttttcaaaacattgaataa

SEQ ID NO: 114221 - DNA, 2043 bp, Glycine max
  Peptide Sequence Number=SeqID_230999
atggctacttcccatgttggtctccatgcaaccagccacctattctgttatgcaaggggaatcgttttctttcttatgattacttttgtaaacccactttcatttcattaccaagggtttgagtataatgatgccaggattgaaggtgatgctactttgtcacattcagaaattcaacttactgcaaccacaaggtaccaaagcaatgcttacagtgttgggagagtcacaagttttaagttattgcaactgtgggacatgagctcaggaaaactcaccgacttcactaccgaattttcatttgtcatttactcaaacgagactagttttggagatggcttcgcttttttctttgcagatccaaagcttccactttcaaatcaaatacaacaaggaggtggtcttggtcttgtggatggtaaccgattattaaagccaactaaatatccatttgtagcagtggagtttgacacacaccaaaattcctgggatccacctggcactcatgtaggtataaatttcaactctatgagatctaacataactgttccatggtccattgatattaggcaaatgaaagtttattattgtgcaattgagtacaatgcaagtacacataatttaaatgtttctttcactggaaaccaaatcaatggcaagccaataaaaagttatatctcatgcaatgttaatttgagagattacctaccagagagggttatttttggcttctcagctgctacaggatttatgtttgagatgaacacattgttgtcatggtcattccgttcaagtttaccaagtgatgagaaggtgtcaaatcaaatacctccaatggcagccccaccaatccaaaatccttctccttcaccatttcccactgctaatattagccctaaacaagagggcaacaaaggtttattgaaggggatagaagcaggtataggtatagctgcaagtttccttattttagggttggtttgtatttttatttggaagagggctaaattgaaaaaagaagattcagtttttgatctgagcatggatgatgaattccaaaagggcattggacccaaaagattttgctataaagaattggcaagtgcaacaaataactttgcagaggcccaaaagattggacaaggtggttttggtggtgtttataaaggctatttgaaaaagctaaactccaatgttgctataaagaggatatcaagagaatctaggcaaggtataaaggaatatgcagctgaagttaagatcatcagccaactgaggcataggaatttagtacaactaattggttggtgccacatgaagaaagatctcctccttatatatgagttcatgcaaaatggtagcttagattcccacctatatcgtggaaaaagcatcttgacatggcagatgaggtacaacattgctatggacttggctttggcagtgttgtaccttcatgaagaatgggagcagtgtgttcttcatagggacattaaatccagcaatgttatgttagacttaagtttcaatgctaagcttggggattttggcttagctaggctggttgaccatgagaaaggatcacaaaccacaattttagcaggtaccgtgggctacatagcccctgaatattgcactacagggaaggctaggaaggaatctgatatatacagttttggggttgttttgttggagttagccagtggaagaaaaccaattgaccttaatgccaaggaaggtcaaataaccatatttgagtgggtttgggagctctatagattgggaaagttacttgaagtagtagactcaaagcttgggggagcatttgatgaggagcaaatggaacatttagtgattgttggcctttggtgtgccaatccagattatacttccaggccatctgtaaggcaagtgattcaagtgcttacgtttgaagctcctttaccagttctcccacagaaaatgcctgagccatatcaccattctccaacaatgagtactatttttgcttcagtttcttctctctctctggctacatgttag

SEQ ID NO: 114222 - DNA, 730 bp, Glycine max
  Peptide Sequence Number=SeqID_231000
atgcagactctgggtttgttggttgctcctgttctcggtttctacctgaggttccttcgtttctctcttcgcttccttcttctcatgttcatggatttcccttccaccttcaagttcatcacgcaagccagtgaactcggttgtggcttcctcctcctcggttacttctcgcgcctcttcaacttcctcggcctcctcttgatcttcttcttctgtctaaagtttctccgctctccgctcctcatctccaaccacgagaaatcgtcgtcgtcgtcgtcgagagacgacaattcgaattcgaaggaggaggagaatttgttcagagaggagagtttggaggacgaggtgttcgacgtaatgtcgctcaggaggatggtgaaggaggagcggcagcggtacaacgcggcgtgcgcggagatcgagcaggagcagggggcggcggcgtccgcggcggaggaggccatgtccatgattctgcggctgcagagcgagaagagcgccgtggagattcaggccaagcagttccagcgcgtggtggagcagaagcaggagtacgatctcgaggtcatcgagtcgctccggtggacggtggtgcaggtggagtcgcagaagaaccttctagagcgtcagttaggggttttgagagagaggcttagacagttcgtcaatgatcaagagatacagcagcttcaagaacaagaacaagaacaggaactccaaggcacagcca

SEQ ID NO: 114223 - DNA, 803 bp, Glycine max
  Peptide Sequence Number=SeqID_231001
gtgcttctgtaatgcttgcagaattggcaatggaagctggtttgcctgagggtgtcttaaatatagttcatggaacccatgctggaatgcacatatatgctagagcagcagctaaagggaaacgtgttcaggctaatatgggggccaaaaatcatgtggttgtaatgcctgatgctaatgtaaatgctttagttgctgcaggttttggtgctgctggtcaaaggtgcatggctctcagcactgttgtttttgttggaggctcaaaactgtggtatctttctctatcaagaatggttaattctttccatccttttgataatactggtgactgttccaagtatttcgatttgtttgtgatgcagtcttgggaaagtaaacttctggagcatgccaaagctcttaaagtaaatgttggaactaaacctgatgcagaccttggtccagtcattagcaaacaggtcctagggtatgaatctggcaattttattgacccaaccatcttatcagatgtcactgccaacatggagtgctacaaggaggagatctttggaccagttcttctcatggaggctgatagcttggaagaggccataaacattatcaatgaaaacaagtatggaaacggtgcttctatatttaccacatctagtgtggctgcgaggaaatttcaggccgagattgaggctgggcaggtgggcatcaatgtttccagttcctttgccctttttctcatttactggcaacaaggcctcatttgctggcgatctcaatttctacggtatagtgatttctccctaagctag

SEQ ID NO: 114224 - DNA, 842 bp, Glycine max
  Peptide Sequence Number=SeqID_231002
agaggctcaaagtcctcgccattagaggactcaaagttcttgccttcagaggactcaaagttctcgcctttagaaggctcaaagtcctcgccattagaggactcaaagttctcgcctttagaggactcaaagtcctcacctttagagggttcaaagtcctcgccatcagaggactcaaagttctctcctttagaggactcaaaattctcgccttcagaggactcaaagttctcgcctttagaggactcaaagttgtcaccttcagagggctcaaagttctcgcctttagagggctcaaagttcttgcctttagagggttcaaagtcctcaccatcagaggactcaaagttctcgccttcagagaactcaaagttctcacctttagagggctcaaagtcctcaccatcagaggactcaaagttctcgtctttagaggactcaaagtcctcgcctttagagggttcaaagtcttcgccattagaggactcaaagttctcgccttcagagaactcaaagttctcacctttagagggctcaaagtcctcaccatcagaggactcaaagttctctccttcagaggactcaaagtcctcgcctttagagggttcaaagtcctcaccatcagagaactcaaagttctcaccttcagaggactcaaagtcctcgccttcataggactcaaagtcctcaccttcataggatgcaaagtccttgccttagaggactcaaagtcctcacctttagaagactcaaagtcctcgcctttagagggctcaaagtcctcgcctttagagggctcaaagtccttgcctttagagaaatcaaagtcctcgcctttatag

SEQ ID NO: 114225 - DNA, 981 bp, Glycine max
  Peptide Sequence Number=SeqID_231003
atgtctacatccgagctatctggtggagcacgaatccattacatttttcaatccatctttgtcagaagtttagaggaggtggatccgtgtgaagacctaactgatgatgacatccgtactgccatacagaatgctactgggcccaaatcagcattgtttgttccagaagtgccatttgaagtccttgtgcgaaggcaaatatcgcgtctattggatccaagccttcaatgtgccagaatgtgcctaaacaaaatcccttctcttcagatcagccatcgctgtatggtgactgaactgcagcgattccctttcttgcggaagcgcatggatgaagttatagggaactttctacgagaaggccttgaaccctcagagaacatgattgcgcacctcatagaaatggagatggactacataaacacttcccacccaaattttattggtggaagcaaggcattagaaatagctgcgcaacagaccaagtcctctagggttgctataccagtttctaggcaaaaggatgctctggaatctgataagggatctgcctctgagagaagtgtgaagtctagggctattctagcaagacaagctaatggagtagttactgatccgggtgtccgtgctgcatcagatgttgaaaaaattgtaccctctggaaacactggtggatcaagttggggtatctcatcgatttttggtggaggtgatagccgtatgactatgaaggagaatatagctagtaaaccacatgctgaaccagttcacagcattgagcaatcaatctctatgatccatttgagagagccacctcctatcttgaggccatcggagagcaattcagagacggaagctattgaaataactgtgacaaagttgcttttgagatcatactacggcattgtcagaaaaaatgttgaggatcttatccccaaagcaattatgcacttcttggtactttactacttcatatccttgtag

SEQ ID NO: 114226 - DNA, 240 bp, Glycine max
  Peptide Sequence Number=SeqID_231004
atggggttgtgcaaggtttcattttctgtattgtgtgtgttggggttggtgattgtgagtcacgtagcctatgctctagactcaccatcagactacgtcaatgcacacaacgctgcaagatcagaggtgggtgttcaaaacttggcatgggatgatactgttgctgcttttgcacagaactatgctaatcaacgtaaaggtgattgccaacggggagaatcttgcaatgagcacgggtga

SEQ ID NO: 114227 - DNA, 648 bp, Glycine max
  Peptide Sequence Number=SeqID_231005
atgcgtagaggaggtgagggagagaacatggcagtgcctcaactaacttcaagttccagcacgagaagattgagcctaagaacaacgagaccagaccctttcttgtcgctgtgcaaatgcttcagcttcgttgtcgttctctctgccattctctgcatcgccgttaacgtcctctctgctattcgctccttcaaacaccaatccgatattttcgatggcatatttcggtgttacgcggtcttcctagcgtgtttcgtggttctggctgagacggaatggaacttcatcatcaagttctggaaggttctggagtattgggttggcaggggtatgctgcagatttttgtagcagtcatgactagggcattccctgactatagtggggagcgaaaagaacttgtaattttccagggcatagcgtgctatatgcttcttgcttgtggctcaatttatgttgtgtcgggttctatgtactatattctaagagttactgttccattgtattaccatttgaagggaatcctttgcgttggtttactgaaacgttctcgccagaagcaagagatctctagagagcaagcagaaaaggatcttcaggagttggaacggcgtagagaagaacttgaacaactgcttataacagaatag

SEQ ID NO: 114228 - DNA, 2190 bp, Glycine max
  Peptide Sequence Number=SeqID_231006
atgggaagcaactttctctctccgccagctaagcgctccgcactcgacccgaatccgtttcctccaaacggaccttcaaagcgctccaggcaatccaagcctccgccgccgctctccgtgccgcccggccacgtagccttccgcctcctctgcaacgcctcccgaatcggcggcgttatcggcaagtctggctccgtcatcaaaactctccagcaatccaccggcgccaagatccgaatcgaggacgcgccgcaggagtcgccggaccgagtcatcctggtgattgccgacgccgcactcagctgcaaggttctgctgagaaacgaagaagtcgttgaggtgtcgaaggcgcaggaggcgctgctgaaggtgttcgataggatcctcgaagtggcagcggagatggaaggagtcgacgttggggacagggtaatgtcttgccggctggtggcggactcggcgcaggctggctccgtcatcggcaagggcgggaaggtggtggagaggatcaagaaggaaaccggatgtaaaattagggtattaactgatgatttgccactttgtgcctccgcttccgatgaaatgatcgagaacctgaaggtgagagcttggttgctagcagttaatgtcgagaggatagaaggcagagtgtcatctgtaaagaaggcacttgttgcggtctcccaacggcttcaagattgtccctctgttaatagaataaagatgatgggaaacaaaccttatgaaatagttcagtatgaaactttagatgcacttcctcgtgagattttaactgcagctccacgtgggactttaactgtagtaccacatgagactgtagatcatcttttgcttaggagctctgcactttctactttatccagttcctctaacagctatgccaccagagttcattcactgtcagcagaagttaatagagtctcatccttggaaccaaaagcacttcagcaggaagtctccttcagaatactttgttcaaatgatagagttggaggagttattggaaagggaggcaatattgttagagctcttcagagtgagacaggggctacaataagtattggtcctttggtagctgagtgcgaggatcgattaattactattgctgcttcagagaatcctgagtcaagatattcaccagcacaaaaggctgctgtgcttgttttctccaggtccattgaggttggttttgagaaggagctagactctggattaaataaggggtcaactgttactgtgcgtcttgtagttccatcaagccaagttggttgtttgataggaaaaggtggagtaatagtatcagaaattcgaaaggcaactggggccaacataagaataattgggactgatcaggtgccaaaatgcgcatcagataatgatcaagtcgtacagatatcaggagagttttcaagtgtgcaagatgccttgtataatgctactggtagactgcgagataatctttttgtcagcacacagaatagtgctggaacaaggagcctttcttctctacgagttgataccagtccctatgggatacagcaggattttgttcctcatggaagccaactgcctgcaaccacttctcactgtctgagtagacatacttttgctcagggcattgatcatcttggtctttctagaaatttagatcatccttcgtcaccagggttatggactagaaatttagaccgtacttcttcacctttgttatggactagaaatttagactgtccttcttcgccagggttatggactagaaatttagaccgtccctcttcgccggggttatggactagaaaattagatcgtccttcttcaccggggttatggacgcagccaacagtggctgggataaattcaagaagcattaatgattttagtttgggattgacatctcgaaaaggcggcttagaacttgtgagtggaagtaaatctgctatcgtgactaatacgacagtcgaaattgtggttcctgatgatactattgactgtgtatacggggaaaatggtcgcaatttggttcgtctgagacagatatcgggtgccaaggttgttatccatgaacctcgtcccggaacaagtgacaggattattgtcatatccggtacaccagatgaaacccaagcagcgcagagccttctccaagcatttattcttagtggctcatga

SEQ ID NO: 114229 - DNA, 2058 bp, Glycine max
  Peptide Sequence Number=SeqID_231007
atggcttccctatcatcatctcgaaccacaacacagtttaacttaccaaactccaaattgtgttcctctcttccattctcattctcaacaagaccctcatttcttttctcttccctcaacaaattctattcctactccaattctctgcgctgctctgcctccgtggaagacaccgaatgggattgggaacgatggcaaaaccatttccacgtggtcgatgaacaagagcttctcctcgacattctcaagtctcgcttaggtgatgctctgcgtttggaggattatgaagatgcagctacacttaaggtggccattgccactgtagctaccaaggacactgttggaacagccatatctcatctcaagagggccatagaggaagagcggtacagtgatgcagctttcttgagagatgaagctggcactggacttgtgggttggtgggctggaatgtcaaaagacattaatgatccacatggtctaattattcgcataactccagagcacggaagatatgtagcaaggagttatagtcctaggcaacttgctacttctgctgctggtgttcctctatttgaattttttcttacgaagaataaaaatggtgaatttaagtcacaggttgtgtacttaaagcggagagaggctttccatactcccccgacaacatcctctaaagcgttggatgctgctgagagattgagatcagtggagtcacctgaagatagaagtgagctagttgttgggagtcctgaagatcctgaggttgttgatgataggaatgataactctgatccatctgaggcaatgcctggatttcagaatgtcttgaaagatacaattcctggtgtaaagatgaaggttttgaaggtcacaactccagacaaggtagacaacgatacaatatctaaggtgattgagcagataactgatgatgaagggaatgaagatgaagattcagatgaatgtgctggtaaggacaatgagacagaaaatccagaactgagtgatatcaaaactgaaactgatgacgagattgaattaaattctagtgtggaatcttttgaacgtgaagaacaaaataaaattgcagtcaaagttatcgttggtggtcttgttcagaaacttcccagcagtttgactactagaaatttgcttcgagttcctgctaagctggagaaaaccggacaaggttcattttcccttacctttgaaaaggtagccaatcaacaggttggtcatggcaaagggaagccttcatcagataaatcaacaaaaattcaacgccaaaatagtgttgatggtgttatggttaatcttgctaagttgattggaagggggaaggtgctgaaagatttgggagaattaataagtcttagtcttagccgggcttggaaccatgaacgattgtcagggtcaacaatgttcagtcgcattgaaataccaacttctttagatcctttaaatggtctatacattggtgcacatgggctttactcctctgaagtaattcaactgagatgtagatatggccaatggcaagaagatggtgggcctaaggagccttctgatcttgagttttgtgagtatgtggaagctttgaaattgactggggattcttatgtaccagttggccagatacttaaaaatagaaatatcgacagacactcaagttgcacctgcactttaatgcaaggtataacctatgctgagggaaaatattcaatgtattctgtttggttgcaatttttcctctgggaattaactaatcaatgcagtattgacccagggtttaatgtagcatttcgagcaaaagtaggaaagaggtatcagcttcctcttaagggaataattcctaaagaatttggagtgattgcacgctataaaggtcaagggaggcttgcagagccaagattcgagaatcctcgatgggttgacggtgaacttgtgattctagatggaaagtacatcaaagcaggtcttgttattggatttatgtacttgacccctgagaatccttttttggtcctcttcaatcggctgaggcttcagaaatag

SEQ ID NO: 114230 - DNA, 1074 bp, Glycine max
  Peptide Sequence Number=SeqID_231008
atgccagtttcccgagaaaattcaatttgggcagttcggaatcgggctcgcagctcttgcggccacgcaatcgcagtcttctccgacaccagagtgtgcattggcggttatgtcctcgtgctcttcatcttctacacgcaacaacctcctgatctcccctccgattccgatgcgcttcgtcgcacgttgccgttctcctccggcgtcttccactctccggaggaggctttccgcttggactaccagaagatggaggaggagttcaaggtcttcgtctatcccgacggagatcccgaaacctatttccacacgccgaggaaactcaccggaaaatacgccagcgaaggctacttcttcaagaacatcagagagagccgattcttcaccgatgatccgcgtcgagctcaccttttcttccttcctatttcttgccacaaaatgcgaggcagactgcctagcatagtttccgatgtgaattgtaatgcacatatgaatatgcaggggttgactaacgagcgtatgattgatgaagtagagaagtatgtggagcacctaaagtttgagtacccttattggaacagaacattgggtgctgatcacttttttgtgacttgtcacgatatcggtgtcaaagctactaaaggagttccacatatgatgaaaaattcgattcgagtgatttgttcatcaaggtatgacgacgacggctatattccacataaggatgttaccctcccacaagttcaactgccattttttcaccctccaggaggaaatgacattaagaataggaacactcttgctttctgggctggtcgttctgattctagattgaaagaagatctaatagctatttgggacaatgatactgaaattgacatacagaacagcagagttgaccttcgagcgactgggccagtggtatacatggagaaactttataaatccaagttttgtttgtgccctcatgggcctatcggcagcagtcgtatcgcagactcaatccactttgggtgtgtgccagaaaactattatagttattggaaagagtctccagactccaatagggagtaa

SEQ ID NO: 114231 - DNA, 480 bp, Glycine max
  Peptide Sequence Number=SeqID_231009
atggtgagaaggaagataccgatcaagaagatcgacgacgtaactgcgaggcaggtgacattctcaaagaggaagagtggtcttttcaagaaggcacgtgagctctctcttctctgtgatgctgagatagcactcatagtcttttcacctggtggcaagctcttcgactatggtagttcaaggataagttctgcttgggaacatcttgcaaggctatgtgtggagttagaccttagaagggcgtctgcattcaatatgttttgcttgtggaagatatatggacataaaatagatcaatgtgatcatgagaaaaaccaattaagaggctatacttcacggaatcacgaagatgtaggccaagccaagaatagagaacaagttgtcaaggaggggaaatcttcgattatcaaggagaaatccactgtgaagtttcgtccctataacggagagcatgcttgctcttatggaaatccactatga

SEQ ID NO: 114232 - DNA, 2052 bp, Glycine max
  Peptide Sequence Number=SeqID_231010
atgactcggcgcaagcgatcatcatcatcttcttcttcctcgaccaagaaattcgaggttttcgaattcaatgacgaagacgagaacgtcgagaagacctctcggaagattctccgcaagttcgcaaaccctagcactagtagtagcaggtctcgctcttccaccgtcaccaaatacgacttcctccaagccttggcgagcggtaccaattccaaacctctctccgatgacgttaccgccgatcctattgacctcgattccgagcaagaagaagaaatgaagcgctcaccggaggaagttgccaacaaacccttagaggttgttgttgatgatgatggtggtggtggtggtggtggtggtggtggtggagatggcggtgttgttgataatcgaggaaaatgtgataatcggtgttcaatagacacaccgctgctagactccgctgatgaagagattccaggccacactgatttcgctgaaagcgatttggactcgaaaaatcagtcacttgatgtggtttctgatgacggcgatagtaatcaaatgagttcctcttcgacttcaacttcaaatccctcagaagatgaagggggaaagaaatcagattatggcattttaaataatagtatcatgacaactgaagtaggagaggagagaccacaaaaaacaatgaatgagggaagctttgatgaggcctttgatgaggttatttatccaaagggggagcctgacgctgtttctattagtaagagagatattgagcttttacagcctcagacattcattaatgatactatcattgacttttatatcaagtatttgaaaaagaaactcccaactgatgaacagaacaggtttcactttttcaatagcttcttctttcgtaagcttgctgatttagacaaagatccatcaagtgcttgtgatggtagagcagcatttcaacgtgtacgcaaatggacaagaaaagtgaacctttttgaaaaggattatatcttcattcctgtaaactacagtcttcactggagtttaattgtcatttgtcatccgggtgaagtgtcatgcttcaaagatgaagaaattaaggaatcttccaaagtaccttgtatcttgcacatggattccctaaaaggaagtcataaaggtctcaagaatgttttccaaagcaattggttccctccactggaggtttctctgaaacgatctcatatacagagcgtaatttatgatatatttgaaaataattctttgcaagcacctcatactgattgccttgacaaagatcttcttttagaagaccctgccattattgtcaatcccaaactggaagaagattccctaaggggttgctgttatccaacagcttcacccataagagttgcatcatgtttgacaggacctggacttgtttccaaggacttagtggctgttgtaacttcacgttctgcttgtctgcagatgtcagcatgtcatcagaggggcttcctgtcaccattagaggaaattgaagagtctagtgaggagactgttttatcattagagagagaaaattctcaagttggtatattggcatatgatttcccagccacatatgtcagcaatgatcatggagcatcagaaacatttcaggttgggttctctgtaaattttgtggaagctgttgagagccattctcattcaagaacatctactggtgtatcctggatcccatcgaatacagctactcatgaagaccagcctcttgagaaaatcgaagagtccagcattcctgataagacagcgcttgagtatttatcaacctcagtctctggtgaggagcttacagactacactgttccggattctcctgtcgcaaatgatgttgatgtgagtgttgaatctcattcctcattccggaataatatgaattcagtaacccatcaaatatttgatctgactcacaatacgagtctcgaagataatactttagttagcaaggaagagtcactagcatttgaatctgatgaacgagatgccaagaggcctaagcttatgaatgcagggtggctataa

SEQ ID NO: 114233 - DNA, 375 bp, Glycine max
  Peptide Sequence Number=SeqID_231011
atgggtcagttgaatggggaagagatccaaggattgacaataaaagaattgcagaaagtggaggaacttcttcaaagacgttggaccactatttcaaaaattaaggatgaaaaaattatacaagagatcaatcaccttaaaacaaagaagccaagtgacctaaatctggaggcttatgagacctcaacaatcctaaaatgtgtgaatgatcgggggggacgattcgcaacccttcaagtgccaacgcctgaaagacccctcaaggtgtcaaacctaaaagttggacagtccataatccctctagcgttgagcttgaaacacttgaaacacataattcagtctgcttctgtggtcaccacttcccaaaactcttaa

SEQ ID NO: 114234 - DNA, 186 bp, Glycine max
  Peptide Sequence Number=SeqID_231012
atggcgagaaagaagataccgatcaagaagatcgataacataaacgcgaggcaggtaacattctcaaagaggagaaaaggtcttttcaagaaggctcaggaactgtcaactctttgcgatgctgagattgctctcatagtcttttccaccactagcaaactctttgagtacgctagttcaagatag

SEQ ID NO: 114235 - DNA, 146 bp, Glycine max
  Peptide Sequence Number=SeqID_231013
atgtcaagcatgcaacaaatacttgaaaggcgtgatcggcattcagggattcaaggattagttaatccatctattggtcaacagcttggaagtgactcccttggcatcctgcgaaaggaaatagaacataagactaatgaaatgag

SEQ ID NO: 114236 - DNA, 849 bp, Glycine max
  Peptide Sequence Number=SeqID_231014
agggctacacgccctcacctatagaggagtacacgtcctcggcttcaaagggcaacaagtccaaacctttagaggactacatgtcctccccatcaaagggctgcacgccctcgccatcagagggttgcacgccctcgccatcagaggactacacgtcctcgccatcaaactgctacatgccctcaccttcagaggattacatgtcctcaccttcaaagggttgcacgccctcaccttcagaggactacacatcctcacctttagaatgctacaagtgctcaccttcagaggactacacgtcctcgccatcagagggcaacacgctctcgcctacagaggactacacgtcctcgccattagagggctgcacgccctcgccattagaggactacacgtcctcgccatcacatggctgcacgccctcaccatcaaggaactacacgtcctcgccttcaaagggctgcacgccctcgcttttagaggactacatgtcctcgccataaggggactacacgtccgcgcctttagagggctgcacgccctcactttaggaggattacacgtcctcaccatcagagggctgcacgccctcgccatcacaaggctgcacgtcctcgccttcaaagggcaacacgtccaaacctttagaggactacacgtcctccccatcaaagggctgcacccctcgccatcagaggactacacgccctcacctttagagaattacacgttctcaccttcagaggactacacgccctcaccttcagaggactacacctcctcgcctttagaatgctacaagtgctcaccttcagaggactacacgtcctcgccatcagagggctgcac

SEQ ID NO: 114237 - DNA, 1341 bp, Glycine max
  Peptide Sequence Number=SeqID_231015
atgaagctgaagaaaggaaagaaagggtggatgactatcaaaattgaccttgagaagacttatgatagattgagctgggacttcatcaaggatactttccaagagggggatacaaccgatgaaaggagtgatcattgggtctgttgggaaggaatttgttcaccaaaggagattggaggtttgggattacgacaggctcgtcatgttaatgatgtctttacgatgaaagtggcttgggaactttgtaccaaaaatgatgctttgtgggtacaagttattagagccaagtataattgtggggagttggggtttcctgttgtgaataaagctagaaatgactctaatctgtggtcagtaatcaaatctgttagggataaatttgtaactgggtgtgaaggaaatgtggaagatgatgagttaatttggagagctagtaataaaggtgtgttagatatcccatcagcttacaaaatgattgccaatttggatggtagacagagtattcctatctttattctggtttggaggtgggaaggatatgagaggtggaagattgctaggagggctcttcctaccaaccttgctcactggaataggaagatgactttggagtttttgtgcctgttgtgtaataaggagccagaatcagtgatgcattgccttcgagacagtgaggaggttagacaacttcatctaggttttatgcgactgaatgtcgatggagcgtgtggaggggttatcggagatcatacaggaaagtttcaaggagcttttgcttgcaacctgaaatcttgttcaattactcaattggagttgtgggccattcttcatggtatcaacatggcaagggaacgaggttttatggcgttggaagttcattcggattctgaagaagctattcaaagagttcaaggtttacaagaagttgaatggggaagagctgctaggagtaaaaattcaggaattacagaagctagagaaactaataaggaaagcgccactagcttcagcactgtcctcaccgcctcttggtgccactgtgcaccaccgcattcggcggcactctgggaccccagttcaccttccgatactcctcatccccaaccccaaccccctccaaaagccaccgctcgttctcgactcgggcactgcttaagtgggagaagcgaaaaatgtttgccacaagtcggcgagaaaatggtggagtttaggaagtcgagcaggatcatttcggcattgtcggggaggtgtttgagagaaatgaggtggagcccaatgacgccggtgaggctgagtggggctcgtggggtagagggaggaggaggaggagagaaaatataa

SEQ ID NO: 114238 - DNA, 126 bp, Glycine max
  Peptide Sequence Number=SeqID_231016
atgagtgatcacgcgttgaacgcaacgacatctaggcttagcgagtatggcggcgagcatgcccttagcaggggatttgcgttaaaaacgcttttgggtttcttcatgggaccttcttcacgctaa

SEQ ID NO: 114239 - DNA, 828 bp, Glycine max
  Peptide Sequence Number=SeqID_231017
atgcaccccaccaaataccttggactggacgaggaatcaacgaaggtggacgggactcaatatagaacaatgattagttcactactttatctcactgcatccaggcctgatatcatgttcagtgtttgtctatgtgcaagatttgaaaaagaaccaagggaagttcatctaactgcagtcaaacctatatttagatatctaattggaactcctaattttggtcttatgttcaaaagaagagaaagtttcagactcacaagctattgtgatgcagactatgttggtgataaagttgaaagaaaaagaacaagtggaagctatcactttataggtggcaacttagtaacatggatatgcaagaagcaaggctcaacttcattgtccactattcaagcagaatatatgtcagcaacaagtttttgtgctcaacttctctggataaagaatcagtttgaagattacagtatctatgagagtaaaattcccatcttttgtgacaataaagttgtcatcactctttcgaaaaatccagcattgcactctaaagaaaaacatatagaaattaaaaatcatttttataagagattatgtttaaaatgggataatggacttgtcgcaacgtgcccttttgtgggcgagcgaaggcgaggctcacgggtgcgctttccaaaggaggaaagatgcgcggagtcgccaccaatgtttatttgtggaaaatgtcggaaaaaccgaaggaaaccggtcaaaatgaaaattctaagttcgggagttgtatttacgtttgaagcctctcacgtttgtctcaaaggacaacagcctattttttag

SEQ ID NO: 114240 - DNA, 525 bp, Glycine max
  Peptide Sequence Number=SeqID_231018
atggtgtctcgtccattctctaccaagagaaaaggcaacctttacaaaataagactgggagaactctcggatcaaaaggtgtcatgcctattgtctataaaggaaaatcactggttatggcatagaaaacttggtcatgcaagttggaggttaatctccaaactgcaaaaaagcaaccttgtaagatgtctaccaagtatgacttataaggatgatttactttgcgaggcatgtcaaaaagggaaacaaattgaaaactcttttaccagtaaaaacattgtttccacctctagacctctccagctactgcatcatgatttgtttggtccaaccagaattgcatccaccggtggaaagagatactctgaaacttcaaaggcattcaaaagagccttagtagttgaagaagctattcatataagatttgacaaaaataagcatgataaagatttatcagagttagatgcgtcttttgtagacttacgattggatgatagctctatagcaaccaactcgtccagatag

SEQ ID NO: 114241 - DNA, 306 bp, Glycine max
  Peptide Sequence Number=SeqID_231019
atgtgggacactctagctgtaacatacaaaggaatgccaaaagtaaagaggacaaactcagtctcctcactcgacaaaggaatcagaagagaaaagtccttagctctcagtagtcagaagaataagaaggcatcatcatccagagaacaagtcttgagaagttcatcaaaagcacttaaagtcgatgattcatctgataattcatctgaagaagactcaaaaatgaagatgagctcacctttatatgtcataaaatccataagatgtgaagaaacaaaggtgggtccaagtgatgaagctccttaa

SEQ ID NO: 114242 - DNA, 705 bp, Glycine max
  Peptide Sequence Number=SeqID_231020
atgagttttgaattgcaaaaagttgcagttgggctaaacgcttattcaccgctaagcacagcttcagtgcctttagccaggctcaacgcaagactggcgctaagcccaattccacttactcaagctaagtgcgagggtggcactaagcgcaagtgcacagcattccacagtgcctattttgggaaaagagccctagaagcagcaaagaggaacaacttgtgcattgaagcagggatcacgattggttccctgagagtaatacgtaggcctgagccccatctctctttcttgtttgcttgtttgtatgtgtttgttgatgtacatggtgaggttgcattgaggaagtggatgatggacaaagatacactgaggtgtagtaggcggagaggttcaaagaacctagaggaattagcgagtggtgactacccgacatttgcgatcactctcgactgtcatccatatgattttgtaagaccatcaagacctgggaggattggtggggaggtcgtggagcatccgcagaggatgctcaaatggattagtagctacctctacaactacacaatggaggaagaggcacgcctccacccacattttggatacatctggtgccacgttttgttgttagatgagcctcatgtgccactaatcaccatagaggcaaatgcttcatatgactacccatttgagcatacctctttgtga

SEQ ID NO: 114243 - DNA, 1737 bp, Glycine max
  Peptide Sequence Number=SeqID_231021
atggatggtcagggtcacggaggagggagcagagcagaagcggagagatggctttacacagcgaacaaggttttaagcgcacgtgacctgcacggggcccgctcattcgcgatccgggcccgagagtccgacccgagatacgagcccacggagctccttctaacggtcattgatacactcatggccggcgaggcccggatcaacgaccacttcgactggtacgccatcctccaagtcctccgttatactcagaacatcgactacatcactgcccagtaccgccgcctcgccacccaactcgaccctcaccacaaccccttcgctttcgcctctcacgccttcactctcgtcaacgacgcgtggtccgtactctccaacccaaccaaaaaggctttctacgacaaccaactcagactcctcactcaacccgctcctcctcctcaaccaccaccgcctccgccgccgccacctctcgcttctcctgccccggtggccttctttccgattcagccgccgcaaccgaacctaaacccgaaccaattccctcaaagggaaagccctaggcctagagtagaggtggagcctccaccgccgccgccgagtcaggtggacaatgcgaccgaattgactcgggcgagtgacgtcgagaccgaaggggtgagtttctggaccgcatgcccttactgttacgttatgtacgagtatccgaaggtgtacgaggattgtactttgcggtgccagaattgtcggagggggtttcatggggtggttgtaccgtcgccgtcgaaagatggtacttttggctcattttgcagttggggttttttccctgtggggttttccggggatttcaaggacattaacgggtcttcttccaagtggaaccctttttcccctttgtttccttgcgctttgcaggggggtgaggagaatggtaggtaccagaaggggccttgggttttttacgatgacgacgagtctgcggagttcgtggagggtggttccgacacgacggaggatgattccgatgatgatgactggcgtggcgggaatcagaaggggaccacgaggaaaaggaaaagaaggaagaagagtagcaatgttggtggtggtggtgatgttagaagggtacctactacaattgagaggcctagaagaggggttcagaatagtgatggtaatgacaatgtggagaatggtgaggctgtggatggtggtactggtggtgctattgcggtggtggtgccggaatctagcaagaaggcggtggcattgggtggatcaaggaggaggagtgagaggaatttggggaagttggatttgaatgtggagtttagcaatgaggtggaggagcctatgtatggcccgggtgaagggaatgtgaatgggaatgctgaggataatattgaagggattgggttttttgaggggctggatgagttccttagtagcttgcctattctcaatgttgttgctgatgataagttttgtggctttgctctcatgttttgtaagagacatacatcgctcaatgagtttgtctacttgaccaagattttaaaagtgccaactaactggcatttgcctacaactacaagtccaatggggtatatgtgcttttatattattcttcgacaagtgctatggtgggtaatgatcgttaaagcttacactaggttcagcggtggtattttcctaggtgcttttagtcctctacttcattttaagcgaaaataa

SEQ ID NO: 114244 - DNA, 1508 bp, Glycine max
  Peptide Sequence Number=SeqID_231022
atggggtgctatgaagagcacaaggtcatttccgctacctacatgctaagtgggaaagctaaagattggtggaagtttactagccaaactttactaagggaggagggagtcatagcttggggggccatgatcgtgggagagtatgcatcaaaattcaacgagttgatgaagtactttccatattacagaaatagtgagaatggagaggacatttatgcccagttcaagaatggtttgagggctgacatccacactatggtgagcgtgttccagctcattgatctactaacgttagtaagcaaatgtcgcatctatgaggccagtgccaaagggaagcaagtggagcctaagaacaacaacaacaactactactactactactactacagccaggttaatggggcacttactgaaggattgctgatctgcaccttagaggaacgacaaccatggaagtatggagccaaggttgactacaagaacaacaatggggtgaagccaaaggtggcaggaaaggtgtttgtgataagtgggtctgagagtctagatttccatgtgtcttctttgccatatgaagtcgtagtgtctacccctattgacaaaccagttactacttctagtgcatgcttagactgttctatgatggtcaacaacaagaatttctctatgaatttgatttgtttgcctttttctcatcttgatgtggtgttgggaatggattggttattgtccaaccatgttattctcaactgtaaaaacaagaccttgatcttcggtgcttgtgcccaaaatatcctaggatcttcaagtttagagatctcacatgcaagtgaagccaaaagggtagaaaacgttaaagcctttatggttttgtccaataccaaggagtctcttaatattggggggatgcctatagtatgcaaatttcctaaagttttccttagagatgtgattgagttaccacctgagagggcacttgaatttgccataaacctagtgcttgggtctagtcttgtatcgatagcaccatactggatgtctctgatggagttagctgaagtgaagaagcaagtagaagggtttttgaataaacagcttgtgagaccaagtgtgtcatcatggggagcgccaacactcttagtaaagaagaaagacaagagcatgaggatgaccgcatttagaacgtgttatggacactatgagtacttagttatgccatttggtgtgactaatgtacctattgtattcatggactacatgaactggatttttcatcaatacctgaacaagtttgttgtggaattgaagaagaggttcacgtctgcaccaatcttgattttgcctgaccttgagaagaagttcgaagtgtactgtgacgcatcaggacaaggacttggttgcattttgatgcaagaaagggagatgattgcatatgattcaagacaactgagactgaacgaagtgaactatcctactcatgacttagaacaaatggcaatggttttcgc

SEQ ID NO: 114245 - DNA, 238 bp, Glycine max
  Peptide Sequence Number=SeqID_231023
aaaagaacacgctttacggcgcccttaccgaacccgtgcaacagctagagtaatgggtgaagtagaggaggtacaagagaagatgaaggccgacatggaggccatgaaagagcaaatggccacgatgatggaggccataatgatcatgaagaaggtaatggaagccaatgtggttgcagttgccgttaccagcacagttgctaaggtgaacccgatgcccccatctggcctcaattaa

SEQ ID NO: 114246 - DNA, 309 bp, Glycine max
  Peptide Sequence Number=SeqID_231024
atggcgaggacgtgtagtcctctaaaggtgaggacgtgtagtcctctaaaggtgagggcgtgtagccctacaaaggtgaaggcacatgaccctttgacggcgaggacgtgtagtcctctgaagttgaaggtgagggcgtgtagccctctcaaggcgagttcatgtagtcctctggaggtaagggcatgcagccctctgatggtgaggacgtgtcgtcctctcaaggcgaggacgtgtagtcctctgacggtgagggtgactagtacccaaggtgagggcgtgcagccctctcaaggcaaggacatgtag

SEQ ID NO: 114247 - DNA, 1041 bp, Glycine max
  Peptide Sequence Number=SeqID_231025
tacctatcgccttttagagggctgcacgttctcaccttcagaggactgcacgtcctcaacttcaaaggattgcacgtcctcgccatcagaggactacacatcctcgccttcagaggactacacgttctcgccatcagagggctacacgccctcgccttcagaggactacacgtcctcaccttcagagggcttcacgtcctcgccttaagagggctgcacaccctcgccttcagaggactacacaggactacacgtcctcgccttgtagggctacacgccttcaccttcagaggactacacgtcctcgccttcagaggactcctgtcctcgccttcagaggaatacacgtcctcgccttcagaggactacacatcctcgccttcagaggactgcacgtcctcgcctccagaggactacctgtcctcgccttcagaggactccacatcctcaccttcagagggctacacgccctcaccttcagaggactatacgtccccaccttcagaggactacacgtcctcgccttgtagggctacacgccttcaccttcagaggactacacgtcctcgccttcaaaggactcctgtcctcgccttcagaggaatacacgtcctcgccttcagaggactacacgtcctcgccttcagaggactgcacgtcctcgcctctagaggactacctgtcctcgccttcagaggactccacatgctcaccttcagagggctacacgccctcaccttcagaggactacacatcctcaccgtcggggggctacacgccctcgcctttagtgggctacacgccctcgcctttagaggacttcacgtcctcaccttcaaagggctgcacaccctcatctttagaggactatacgtcctccccttgagaggactatacgtcgtccccttgataggactacacgtcctcgccttcagagggctacacatcctccatttcagaggactacacgtcctccccttcagagggctacacgctctcgccttcagtaggctccacatccgcaccttaagagaatttaag

SEQ ID NO: 114248 - DNA, 424 bp, Glycine max
  Peptide Sequence Number=SeqID_231026
ggtgaaacttcctgcttttattgttgaccacagagtggtacctggagatatgtcgcgggggtcaggagaccttggggacgtcaggcgagctcctggcagtcaacagataaaaggaaaacaagaccacaaagcaaggaggcttgtggtggctggccagctgcttgaaaacgaggtcaggaagctaaggaagcctctggtaatcgattaccaagggatcgtgatggcggcgcagctaatccgtgatcgagtagagatggagtgcctagagggagcttgggagaccctcgaaggtaacacgaggtgccgatttcggggcaccattcgattcacggctacttctttggtgcatccagatgaacctgcacggacgcttcagcgcacggtggagtggacagctccttggattagctttgtgtatttttga

SEQ ID NO: 114249 - DNA, 447 bp, Glycine max
  Peptide Sequence Number=SeqID_231027
atggactctcaaaaagcctccacttctggttatgatggaagtaacaatactaagcaccgcgatgtcattcagctctatgaagctcaacagaggaaaaaggccaaagaagaagttggtgttgttgctgagaaagaaaatgttgcctctatccaagctaaagcatttgctaaatctgtggatgacaccattgtacctgggatcatcattgttcttacgaacactggtgtgatggacgaaactcctgaggagtccaatatagttatggctgatgaagttgaacacaacgttatagaacctacgtccaagcagtctaaaacttcaaatgtggctacttctagagataagggcgaacctgatgctatcatagttactctaccagttccggcctcactcctctcaactatgcacaacccaccactgtcactagagatcaagtacaagatatga

SEQ ID NO: 114250 - DNA, 846 bp, Glycine max
  Peptide Sequence Number=SeqID_231028
atggcagctcctgcaccattctctctttcttctgatcccttcgcttccaaatctgccacatcaacgatctttggtcctgccgcgctgaaaaaagggaactttgagcaaacccatttcggaattttcacggctttaaggagaaatcaaggtttcactttaaaggcttcaatggggcctccgggatttacagagaaacttaataacaacaagctaaagactttagctgatgctgaagatgggtgtgatatatttaatgacctgaaagataggtttttaagttttaaaaagaataaatacctgaaaaatattgaacattttgaaaatcttgcaaaggttcaaacaccaaagagtggacccacagaaacgaatgcggctcttgaatttgcggtgaactcccttctggttgagaacatcttagtcattggccacagctgctgtggtggtatacgtgccctgatgggtatgcaagatgatgatgttgaaaaaagttttataaaaagttgggtcattgctgggaagaatgcaagaaaaaaagccaaggctgctgcttctaacctcagctttgatgagcagtgcaagcattgtgagaagggaaagggggtgggggtgggggtgggaagggtaggcactagtattttgacagaagaatcaattaaccattccttgttaaatctacttacttacccctggatagaagaaaaggtggcaaatggagaactctctattcatggtggttactacgactttaccgattgttcatttgagaagtggacattggattaccggggaaccaaattggaggaaaatggcaaaattgctgccaaaaacaaaatattttggtgttga

SEQ ID NO: 114251 - DNA, 411 bp, Glycine max
  Peptide Sequence Number=SeqID_231029
atggcggctcgtggtgggcaccggtggtcgtgggtgatggaagaagagtttctagggtggtttggacggagttataatctgcagatctcgctatgtgagctcgtctcgctaaacagcgcaattccttcatgggttggaattttgcttagcgcgcttctcacaccaagcgagaggtcctttaatggtgattttccaccatggagatgcagcggaagacaaaggagaagaggtgagaggaggcgccatctactagggaataagccatggaagaaggagcttcaccaccaagatgagccttggataagaagcttggaagaatgcttcaatggaggaaaagaaagagggagagaaagagagaggggggagcacaaaattgaaggaataaaagagggagagaagtggaactttgaa

SEQ ID NO: 114252 - DNA, 150 bp, Glycine max
  Peptide Sequence Number=SeqID_231030
atggagcacatggccaccaatcatgttgattcgattaattggatactcaagaaatttgtcaataggtacgctggtaaaatcaacatatttaaggtcatcgaagatgcacagaaaaaggcaaatgctcacactgttcttgagtttgattaa

SEQ ID NO: 114253 - DNA, 972 bp, Glycine max
  Peptide Sequence Number=SeqID_231031
atgaatgacacggcccacaacaaagcagcgatgccacacacctgtctcatgatttcgagaggtttcgatcaatctatagctaaaaaatacgaagcaaccgtgtcgctcttgtgggtggaaaccataccgcagccaggttttgcagtcgctgaaattctcccctccctagatcgctggctttgtttgttttcttttctctcttccaactttactcaattaccattaatcctcgatctcggtgtttctcaaaaggatctcatcttatcgatggaatttagcacgatgaagaagaagaagaagaagcatttgcacgatggaagaacaattgctctcaaccccgaaactgaaactttcctcgttatcaggattcccgatgcgcttgttttgcgcattgtgtctcgctcgttgatcgtggccatggttctcgcagccttgcctttcttgggaactgttctcgaaggattctatttctcgtccagttttgttcccaatctcgacactgggtctctcgacgtgggactattgaattcgattctccatgatttcgctgaagagggtctcctcagagagaacgataaggcactcattgtgaactctcccgttcccgatatcttcagagaaaagattgatgctgtcatgaattctgattgggagagtaagagcttgttcgctgatgagtcttatgattttgtgttcacctctggtgccattgatgctgagtttattgatcgcattctgaaaaatgatggcattgtggctctcccgttggggactaaatcgtcaaactctgctttcaaagaacaatctaattataaggttgtttcccttaagcgatatgggtttgttattgttgcattgaagaaaactgggccagccattaggttgttggtagattctgaatattcttccccaaagaggaagcttttggcgataaaaacaaagacaggccaaggcgtggggttaattaattga

SEQ ID NO: 114254 - DNA, 378 bp, Glycine max
  Peptide Sequence Number=SeqID_231032
atggcctcaagcaaattattcatcacagctttccttcttgctctgaccttctcaagcatgagcatgagcctagcagctcgccatcttatgcaaacaagtactgcaccaaatttgccgggtattccaagtttgccttcaccaacattgccacctttgccttcacttccaacactgcctcaggccaatgttccacctttgcctactatcccaacacttccacaacctaacctaccatctttgccaaccactttgcctccacttcccagcagcatccctaccattccaacactcccacagctcaacattcctccattgccctcaattccaaccactatgccctccatcccattcctctccccaccaccttccactccttaa

SEQ ID NO: 114255 - DNA, 486 bp, Glycine max
  Peptide Sequence Number=SeqID_231033
atggagggcatagtggttggaatagtgaatgtggggattgagggagtgttgggcaatgaaggaatggttggaatgctgctgggaagtggaggcaaagtggtaggcaaagatggcagggtgggttgtggcagtgttgagctgaatgagattactatagagtgggatttggacagtttcccaggatggttctattccatgaacccaacccccaaaccaagatcatctgatcctacttatcttcaactgggtggaagtgtgcgaataaatggtgaaggtaacctatactctggccagtccgttactggtggaaatggaggaaatatcactcgaggaggagaattgcccatattgggcattgtgggtgccataagtttcctacttgcttggacattgctaatggacaaaagtgacaaagcaatgaagaagaatgataagagaaacacacggaaggaggccattttagtagtatatggtcgaaatcagtaa

SEQ ID NO: 114256 - DNA, 378 bp, Glycine max
  Peptide Sequence Number=SeqID_231034
atgcagccaacgatcactgaaagccagaaccaaactccaaggatacgagtgcctatgtatccaataagcagaaaggggaaggaaggaatagtggttgggactgtggggaagtttggaagtaaagtggcagcaagtggtggaagagtgacctgtggaacagttggaatggttggaagagatgggattgtaggcaaaggcaaaggtggcaatgttggttttggcaaaggcaaatttggtgcagtacttgtttgcataagatggcgagctgctaggccaaaatccatgcatgagaaggaaatagcaatgaaaaaagccaagatgaagcagctgttggaggccatggcaaaagacttaatgaatttgctttgtgataactga

SEQ ID NO: 114257 - DNA, 180 bp, Glycine max
  Peptide Sequence Number=SeqID_231035
atggagcatcatatatatgtttcacttttgtctttgagcaaatatgcatctggcttcatatttggggtccgcagtgaccaggtgataagctataaccaaagcaaaaatgaagatgccaagaaagttggcaatggctcccaaggtttcatcatcaatcatatctcttacaagaaaaaataa

SEQ ID NO: 114258 - DNA, 324 bp, Glycine max
  Peptide Sequence Number=SeqID_231036
gatatcaaacatcaatccaaagaagaaaggagaagattcctccttagccccaaaatgctatgaatgcgatcaacctgggcacaggagattcaattgtcctatctttaaaagaagaatggaaaaatccgacaagaggaatttcaaagaaaagaaagcatacatcacttgggaagataataacatggattcttcaagtgattcagaaaatgaaatcataaatatgggtctcatggtgaaagactatgaaagcgaagaagagataatgtcttctaactatgacttatctatttcttttgatgaacttcaagatgcattgaatgattt

SEQ ID NO: 114259 - DNA, 693 bp, Glycine max
  Peptide Sequence Number=SeqID_231037
atgccaccttggaaatttagcatgctgcttgttctcatcacaataaagggaaaaattgattggtggatctttctttcagtggcaatacatttgatttaccatatcacagagttatcaccagatataaaatcaaacaactccatggcacaccctacactttctgagcatgaaaggaagcgactatgccgtgtaatggattgtcaaaaactctccattgatgcttgccttcatgctgcccaaaatgaaaggcttccattaagggttgttgtgcaagttctattcgctgaacaggtaaagataagcaatgcactagccagcagttctgtgaaagatgttgaatctgagagtcatgcaatggttacaaaccggaaaacacttcttgaagggacaccacaatcattccaagaaggatggacagctgctaaaaaagacatcaacacactaaagtttgagcttgagagtgtgaaagccaagtacatggagcttcaaaatgatctggctagtttgcagaaacaatttgataagatgctaaagcagaagcatacttctgcgtggagcagtgggtggaagaaactcagcaaacttggaaggacaacacatttagtggaaaatcaggatgattctcctaagattccagattcacttgaacaaaacagaaagactactagaaggtggagaaactcaatatcctga

SEQ ID NO: 114260 - DNA, 885 bp, Glycine max
  Peptide Sequence Number=SeqID_231038
atgggggtggagtataagtgctgtgatatggagttttacaaacgcatacttatagttgtgctgcttttgatgttcgctggattgatgtcagggctcaccttaggactcatgtcattgagtctcgttgatcttgaggtccttgctaagtctggaacccctcaggatcgcaacaatgccggtaatttctctccttgccttatggaacatcaccatctgttggactttttgctggggcatcgacataaagcccttttccacagagctgaattgaaaacactagtatatctgcatggccataaggctggaaaaggtggggaactgacatatcatgaaacaaccatcattgctggagcactggaacttgctgagaagacagccggtgatgccatgactcccataactgaaacatattgtattgacattcattcaaagcttgataggtatttgatgaatctgatattggagaatgggcatagcagagtccctgtccattataatcagatcaagaatgtatggacaattgacccagaagatgaagcacccgtgaaaagtgtgaccatatgcagaattgcaagggttccagaaacgatgccactatatgatattttgaatgagttccaaaagggccatagccacatggctattgtggtcaagcactgtggcaagacaggttatcaatcttccaataataatgcctatgactcagcgagagatgcaaaggtggatattgatggtgagaagcctccccgagagaaaaaattgaaaaccaagatgtcatgccataaatggaaaagctttccaaacccaaataacttgaagaagggtagtcctcagagcagaaaatggtcaaagaatatgtactcagatattttggaaatagattga

SEQ ID NO: 114261 - DNA, 1590 bp, Glycine max
  Peptide Sequence Number=SeqID_231039
atgggttatgagtatcttttgggagggattatagcttctagcttggtgcttgtgtttgttgtatatggttctgtctcaaagaagatgaccaaaggttcagtagtacatgcagaaagtaatggtggtagtattatacggacatcatcagaaaatagaaaccaccatcaagaaatctcagaaactacggacatcatcattgtcggtgctggggttgctggtgcagcccttgcttacacacttggcaaggaaggaaggcgagtgcatgttattgaaagggacttgactgaaccagacaggattgtgggggaattgctacaacctgggggttatctcaagttaattgagttgggtctccaagattgtgtggatgagattgatgctcagcaagtctttggctatgctctttacaaggatgggaaaaatactaagctttcttaccccttggaaaaatttgcctctgatgtttctggaagaagctttcacaatggccgtttcatacaaaggatgcgagaaaaagcttcatctcttccaaatgtaaaattagaacaaggaactgtcacatctctactagaagaaaatggaatcatcaaaggggtaaactacaaatccaagagtggacaagaggtcacagctaaggcttccctcaccatagtatgcgatggctgtttttccaacttgagacgttctctttgtaacccaaaggttgatgtgccatctcattttgttggtctggttctagagaactgcaatcttccgtatgcaaaccatgggcacgttatcttgagtgatccttctcccattttgttttatccaattagtagctctgagattcggtgtttggttgatgttcctggccaaaaattaccttcccttggtaatggtgacatggcacgttatttgaaaacagtagtagctccccaggttcctccagagctgcgtgagtcttttatagcagcagttgagaaaggaaacatgagaagcatgccaaacagaagcatgcctgcatctccttatcctacacctggcgcccttctcatgggagatgccttcaacatgcgtcaccctttaaccggagggggaatgactgtggctttgtctgacattgttttgctaaggaaccttcttagacccctgcatgatctgcatgatgctaatgctctttgcaaatatcttgaatcattctacaccctgcgcaagccagtggcatctacaataaacacactagctggggcactgtacaaggtgttttgtgcatcccctgacccagctagtaaggaaatgcgccaggcatgttttgattatttaagccttggaggtgttttctcagatggaccaatagctctactctctggtctaaatcctcgtccattaagcttggttctccacttctttgccgtggctatatatggcgttggtcgcttactcataccattcccttctccaaaacgcatgtggattggagctagattgatttccggtgcatctgctatcattttccccattatcaaggctgaaggaattagacaaatgttcttcccagtaactgtgccagcatattacagaacaccccctaccaatttggatgattaa

SEQ ID NO: 114262 - DNA, 1092 bp, Glycine max
  Peptide Sequence Number=SeqID_231040
atggcggaaactcggtgtttggcaattatagacgaagaggaaatagaagtagacgacgatgacatctacgagaacattgaagctcccaagttcgtcgacctcaccgcacctgattgtcgccgccccgaccatgaccgccactggttctgcttccgcgttgggtgtgaccaaaagcatgagcaagagttggactctgaggcaatttacaagaattttgttcttcgggttatggcagctagaagtccaaatgtacgcctcagaaaagctttgaatagaagagaagcaagtgcaaacttgaagtgcccccttacagctcctgccaagtcaagggtgtcaaggatggacttaatttcctccttgccacacaagatgactgacaataacgtgaaagttaaacctctttctatggttgctgcaaccccgaatgctaaggtgaagcaatcaccttcggtggccaaggccttgactacaccaaggaatcatcagaagaaggtttccaaggtagaacaatttagaagtgttcagagcaagaaagccttgactgttggtgtgcctaagagcagagtggtggcgaaggctcttgtttttcactcacctaagaaggtactaaagatcaagagttctatagagttgaaaacagcaatgagaacactgtgttcagcaatgaataagcttgaacttaatggagtgaagaagaatggaaaaggaggtagcaactcattggcagtggctacctccaaaaagcaattgaggggaagagaggttaaaagccgtgtgtttgattccttgtattctaataatcgcaaggaaccagaaaccaacacaaagacaagtttgaaggagaagaaagtaaaaaaaggcacgcagaaatgcccggttgctgtgcctcatgaaaatgacactagtcatatggagatagatgagaaatctaggtgtggctctctagaaggatgccatgaatcaggaacttcaggaagtggtggtgaactgtcttttggagatgaaaaatcccataaatcaacaagaggagagagttcagttccagttttgacagaagcttctagaagtgacattacctcgctttcgagttga

SEQ ID NO: 114263 - DNA, 2945 bp, Glycine max
  Peptide Sequence Number=SeqID_231041
tcactcttacacttactcgcactaacaaccacccacctttcgccgccggcatgttcgccggaggaattttccggtacggttctcccactactctgttattcctctgtctcgttgcttccaccctctcagatgaacttcaactactcatgaagttcaagtcctctatacaaagttccaacgctaatgttttcagttcatggacacaagcaaattctccctgccaattcaccgggattgtatgcaactccaaaggctttgtttcagaaatcaaccttgcggagcaacaactaaagggtactgttccttttgattcactttgcgagcttcaatcgcttgagaagatatctttggggtccaacgtctacttgcatggcagcatcagtgaggatttgaggaagtgcaccaacttgaagcagctggacttgggtaataattcattcactggtgaagttcctgatctgtcaagtttgcacaagttggagttgttgagtttaaactccagtggaatttctggggcgtttccatggaaatcattggaaaatctaactagtctcgagtttctgagtcttggagataacctgttggagaaaactcctttccctttggaggtcttaaagcttgaaaatttgtattggctttacctcacgaattgcagcatcactgggaatattcctttggggattgggaatttaactcggcttcagaatcttgagctttctgacaaccatttgtctggtgagattccacctgatattgtgaagcttcagaggctgtggcagcttgagttgtatgataactatttgagtgggaaaatcgctgttggatttggcaaccttactagtcttgttaactttgatgcttcttataatcagcttgaaggcgatctttctgagctaaggtccttgacaaaacttgcatcccttcatctttttgggaacaagttctctggagaaattccaaaagagattggagatctcaagaatctcacagaactttctctttatggtaacaatttcactggccctcttcctcaaaagcttggctcgtgggttggcatgcagtaccttgatgtttcagacaattctttttctggtcctataccacctcacctatgcaagcacaaccaaatcgatgaactagcactgttgaacaacagcttcagtggaactataccagaaacatatgcaaactgcacatctttggctcgatttcgcctgagcaggaattcactttctggtgttgttccttcaggcatatggggcttggcaaatttgaaactatttgatcttgcaatgaaccagtttgaaggtccagtgacaactgatattgccaaagcaaaatctctggctcaactgctgttatcttacaataagttctcaggtgagttgccattggaaatctcagaagcttcttcactggtgtcaattcaactaagttcaaatcaattttctggtcacattccagaaaccattggcaagttgaagaaactaactagtctaactttgaatgggaacaatctttctggtattgtaccagattccattggttcttgtacttctcttaatgagataaaccttgctggtaactctctttctggggctataccagctagcgttggttctcttccaaccctcaattcattgaacttgtcctcaaacaggctttctggtgaaattccatctagtctatcatctctcagacttagccttcttgacttatcaaacaaccagttgtttggttccataccagaaccactggctatttcagccttcagagatgggttcacgggaaaccctggtttatgcagcaaggctttaaaaggtttcagaccatgttcaatggaatctagcagctctaagcgattcagaaacctattagtctgtttcattgctgttgtaatggttctgcttggagcatgtttcctcttcacaaaactaaggcagaacaagtttgagaagcaactgaagactacttcatggaatgtcaagcagtaccatgtgctaagattcaatgagaatgaaatagttgatgggatcaaggctgagaatttgattggaaaaggaggatccgggaatgtttatagggttgtgcttaaaagtggggcagaatttgcagtgaaacatatatggacttcaaatctaagtgagaggggaagttgtaggagcacctcatctatgctaagaaggagttcaaggtcacctgaatttgatgcagaagtggccactcttagctcaataaggcatgtgaatgtggtgaagctctattgtagcatcacaagtgaagatagcagtttgcttgtttatgagtttttaccaaatgggagcttgtgggacaggttacacacgtgtaagaataagtctgagatggggtgggaggttaggtatgacattgctttgggtgctgctagaggattggagtacctgcaccatgggtgtgatagacctgttatacatagggatgtcaaatccagtaacatattgctggatgaggaatggaagccaaggattgctgattttggccttgcaaagattcttcagggaggagcaggcaattggaccaatgtcattgctggaacagttggatacatgcctcctgagtatgcctacacttgtagggtgacagagaagagtgatgtttacagctttggggtagtgctgatggagttggtaacggggaagaggcctatggagccagagtttggagagaatcatgatattgtgtattgggtatgcaacaatattaggagcagagaagatgctcttgaattggtggatcctaccattgcaaagcatgtcaaagaggatgccatgaaggtgttgaaaatcgcaacactgtgcaccgggaaaattccagcttcaagaccctcaatgagaatgttggttcaaatgctggaagaggcagatccatttaccacaaccaaaatgattgtgaccattgatgcttaa

SEQ ID NO: 114264 - DNA, 964 bp, Glycine max
  Peptide Sequence Number=SeqID_231042
gacaaagaactcagtttctaataagggaaaagtatctgtagccaagaagagaaaggctgaagaaaattcattggcttctgatgacagagaaaatgagaggcaactcactgagaatgatgaaaaggaaaatgtttcagcccctcatgagaacatagagattagtaacaatgatgacgtgcccaaaaaaaaggctattcttgggagcaagcatgaggattctagaaaaacacaaaagaaattcacatcgacctcaactactcctcaagttctgaaattcagaaaattaaagcccacaaatcctaagccctttaagctgagaactgatgaaaggggaattttaaaagaagcaaacttggatagaaaaattccctcatctttaaaagaaaccacagttaaaggtagtgagtccaaggcaatgaggaaatatcagaatgcgaaccgatcaagtgaaacttgttccacaaaaagtgaacaagacactgataatcattatagcagctgtgatgagaaatcaaaccaaacaacacgagaaaaccaatctgggagcattaaaagtaacaactccaactgcaaggtgcaacgaaaattatctgctacatcacctcttagaaatcctcctggtcctaaacttcagaaagtcactgatctggatgacaatttgaaaagaaaatcccgaatgatgcaacgaaaaattgtaaggcctagaagtgctttgccaaggaagaaagaaagagttgtccttgcaaccaaacttagtgttattgtggaaaaggcatcagatattgtgaagccaaaggaaacaaagccacgtaaaaatgacgcagtttcttcacctacaagtaaaactacaggttccattcacaggcctttttcacggggaaagagagatttaactgttcccaaggaaccaaagtttcagagtctacatgtgccaaaggactgcaccaccggtggacacacataa

SEQ ID NO: 114265 - DNA, 459 bp, Glycine max
  Peptide Sequence Number=SeqID_231043
atggacaaggaatatctctcacagatcccttctgtgaacaagtctggtcgcaatgggttaatcacgcttgacccaatgattgaggtgagcaatagtctcagtgaaaaagagcaaaatcatgttgaaaatggggctaaaaattcgagaaaaggattgggattttttataacttctgcagccaaaacaatgctcacggtagttggcgtggtatcaatattaagtttgtctggttttgtgcctaagttaggcactcgtttcagtgtgcaaggctggtgtcacagagtagaaaatgagagatcgacaactaaaaatgggggtgagagatcaaatattcagtgtccaccagggagaattctggtgtgggaaaatggggaagctcgatgccaagtgaaagagagagttgaaattccattttcagctgttgctgctacacctgatataaactatggttgtggttga

SEQ ID NO: 114266 - DNA, 267 bp, Glycine max
  Peptide Sequence Number=SeqID_231044
atggcaattaggtccctgagagtgaaagatgctatggtataccgtgaccatgttcaagcaataaaatctggtttggtatcaagtattttcacttgtaatcaactcattcacctttatttcaaccatggccttctccaagaggccaacaaactgttcgatgaaattccccacccaaatgtattctcttggaatgccataatcatggcttacataaaagcacacaacttgactcaagcacgagccctttttgactctgcctctcaatga

SEQ ID NO: 114267 - DNA, 516 bp, Glycine max
  Peptide Sequence Number=SeqID_231045
atggaacaagattacaacatattgcatgagatttaccactatgcatgtgtggttgatatgtatggaaaggctaatcaactagaaaaggcagtagaattcatgaggaagattcccttacagatagatgctacaatctggggagcatttcttaatgcttgccagatgtccagcgatgcagcacttgtcaaacaggcagacgaggaactattaaaagttgaggcagataacggatctagatatgtgcagttggccaatgtctatgctgccaaagggaaatgggacgagatgggaagaataagaaagaaaatgagaggatacgaggctaagaagcttgctggttgcagctgtatatatgtggaaaatggtttaaatgtatttacttctggtgataggtctcattcaaaagcagatgcaatatattcaactttgacatgcttgaatgggaaactgtatttatttttcacagaacagaagcaactttatgaaattcagggtgatgttgaggatatattttga

SEQ ID NO: 114268 - DNA, 216 bp, Glycine max
  Peptide Sequence Number=SeqID_231046
atggaagaggaaggcatagggttagtgttggcgagagccacagaacttcgtttgaaaatcagcaactgcatccaaagagccacctctaatggcccctcgccgcacgccgatgacgacgacgatgaagccaccgaacgccttctcaacatttgcgatgcccttgaagccttggagacccagctctcttccttgcagttttccatacaaattgcataa

SEQ ID NO: 114269 - DNA, 681 bp, Glycine max
  Peptide Sequence Number=SeqID_231047
atgggcatggccttaaatgtatttctgaaaaatcctgaattaaatgatactgtgtcttggaacacattgattgcaggatacgcccagaatggctatatggagaaatcacttaccgtgtttgttgagatgattgaaaatggtattggtttcaatgaacacactttagcaagtgttttgagtgcctgctctgctctaaaatgtttaaaacttggcaagtctgtccttgcttgggtgttgaaaaagggttacagttcaaatcaatttattagcagtagcaacgtagcattgttgacttctactctaagtgcgggaatatcagatatgcagacctactcatctcaaggtaacatgacagaagcccaaaggctttttgattcactgttggaaagaaactcggttgtgtggacagctttatgttctggctatgtcaaatcacaacaatgtgaggcagtcttcaaacttttcagagagtgtagaactaaagaagcactagttcctgatgcaatgatcattatcagtgtgcttggtgcctgtgcaatgcaagctgatcttagtttgggaaagcaaattcgtgcttacatcttgagaatgagatttaaggtggataagaaattactgagtgctttggtagatatgtactcaaaatgtgggaatgttgcatatgccaagaaaatcttctga

SEQ ID NO: 114270 - DNA, 270 bp, Glycine max
  Peptide Sequence Number=SeqID_231048
atggtcgaacggagcctgaaaccggaaacggacaccaaagatattgtcgggcacgccagaatgggcgctcaaatgctatttggcgcgcaaaggaaggcacgtgagagcgtcgaagctccgatgaggatgccgtcaccaccatcgtgtaaatcaatgggtggcgatgctggtgatgggatcaccagacgaaaagggcgtcaaacagcggtggatgccgaaaatgcaccggaaaaggagaaaaatcgccggaaagagggacaacgagcttaa

SEQ ID NO: 114271 - DNA, 327 bp, Glycine max
  Peptide Sequence Number=SeqID_231049
atggcaacactaagaaatccttcagagaaacacttaacatgtaggagcagcaaaactacacaaggtgttgttgcatgtcatgatctccatgggtccttttatccacaaactgcttgtccttcccttcaaggatccacctctgccttgacaaggttgatggtatctgaactttatacctacagaatgtctttacagcaacagcagctcaagaagagtagcaaaccagaagcaaaaacattgcaagagtcaacaaccaactacagatgcaatcaaggagctgactttctcctagctcctcacatgattgaaaaccaaactaaagcataa

SEQ ID NO: 114272 - DNA, 1578 bp, Glycine max
  Peptide Sequence Number=SeqID_231050
atggcgcgattctggtttcaagcaattcaagttcatggatccaaccgtttcaatttcaagtcgcaagcgccccaacagatttatgttactaaatatagtgacccaatgaaaaggagagtcatgggagatggattagagagcatcagtgaagcttcttgtcggcctgaagtggagctgggggaactaaagcaaaacattgaatccaagaagaggcaatatcataatatggatcttcaaagttctttgactcaagagcttcaaaaacggttacagcaacaatttgtgatacgacgtgcattagagaaagcatgttatgtgcctttttcacaggatgctacaatagaaaattcaatacccaaggctgcaaaggaactgattaaggaaattggaatattagaattagaagttgtgtatttggaacaatacttactctctttgtatcggaaaagatttgatcaacaaatttcaactctatcaaccaaggaaagaagattggaattagcttcagacactaaacaaggaacatctgcagtgcctggcaatgatgctatctctgacaaagaaatttcagttgtgcactgtagtaatgtcatttcacccagaaattcatctgggtttaagcttaaggaattcaataaccagttggaagccgaaactggtttagactctagtattcatcgatgtcactctgcactatctcaacgaacaacatgctcaattgaagcatctcctgggaacattgagactaaagctgcgattgactcttaccattctctaccattatccatgttagagcaagctcagtgtgctaaatccagttcaaccagcctggcagagcatcttgggagtagctatgttgataatgttccagaaacaccaaattggctttctgaggagatgattaagtgtatatcagctatatattgtgaacttacagagcctacttcacttggtcataaaaatgcttcatcccctatttcattcccatcttctggtaacgagttatcttcacagagtcagggtagtaagtggggatcacaatggaagaagcattcatccttcaatttaaactccactaaccctttccatgtcagagggtccaaagaatttagtggaacttattgctcaatgataaggatacaacaattatgcacagatagccagaaattaaaagaaattgagtacatgctacgaagatttaggtcacttgtttctcggctggaagatgttaatcctagaaatatgaagcatgaagaaaagcttgccttttggattaacgtgcacaattccttggcaatgcatgccttattaatttatggaatttcagccaacaatgttaaaagaatgtcttcggtactgaaggccgcatataacattgggggacatactataagtgtagacctgatacagaacttcattctgggatgcagattgcctcgcccaggacagtggttgcggttgtggtttccttcaatgacaaaaccaaaggttagagatgcaagaaaaggatatgccatacatcgtccagagcctttattactatttgctctttgctcaggaagccattctgatcctgcg

SEQ ID NO: 114273 - DNA, 331 bp, Glycine max
  Peptide Sequence Number=SeqID_231051
gtatgaatgcatcgagaatgatctattgggtactctcaatcttggcattcatagtattgctccatacaagtcaaagggcattgagagggcatcagaactttcagtttgctggaacaacaaagtcaataatactgaaatcttactgagtgaaaaggattattgtatatatgctgcaagcgtaggtgtaacagaagaacttgatcgaccatctggatcagggagttcagaggatagtggatgctcttctcgtaagcgtcctagaaaagagggtcttggaggaggtggtttttttgatctaaacttgccagcagagtttgtagacagaaattga

SEQ ID NO: 114274 - DNA, 654 bp, Glycine max
  Peptide Sequence Number=SeqID_231052
atgacaaacaaatacaactcagtagctgagatcaattctgagaaagaaaatatttcgactaataaacaaacatctagtatcaaaataccattttacatggagacgatgctcgtggactcaaagggagatacagtccatggttttgtcaagcgaactctcatttataagtttgacaaaaacttacaagaagggaaagtaaccacccaccataagtacataattgtgtttcaatacttcactaaggttgtattggtggacaatgcaagtgttccaaactttgtgtatgattgtgtacctataagagacattgtttgtgataaaatacatcttcaaaattgtatttatggagcaagagttgtgttcaatgctgaatgtgaaaaggcaaaggagttggcaacaagaatgtttgagtcaccctctcaaggtttgagtcagataattgactccactgcattaagtatgttagaggattttctgcataatacagctaggaaaacaattggtggtcttaaagattgttttgaggatacttgttttgcagtttttggtactgtgaaacatgttgtagatgatgaggaatggtgttatactgcttgcacatgcaacaaaacagtgtaccctgattcaaagatgttttttgcgaaaatggaataa

SEQ ID NO: 114275 - DNA, 381 bp, Glycine max
  Peptide Sequence Number=SeqID_231053
atggctaatgctccagggaatgacgattttttgagagacgcgatgattgtgtctacaaaccaggagttgatcgataagcaaggaagggtatcaaaggttaaactccttgaaaatgacaaagactcaattgtcatctacaaaggctggcctgaatttagaaggctaaatgaaatttattatcaaagggaaataaggcttatttatgtgggtgaccgtaaattccatgttaggttcttcaaaggagatccagagcttgcaagagtgtttcaacaattgcaggaaaaaatacaagagttgctgacattgatgatcgaagattatcaacgtaccaatggagaaggaggaatcgtgaagacatgctcaatgcaagcaaggaaatga

SEQ ID NO: 114276 - DNA, 636 bp, Glycine max
  Peptide Sequence Number=SeqID_231054
atggaaaccgggaccagcaaggtggcgcctaagcgtacctccaccgtcaatgctggggctaccgccaaaaatttggtagctgagcttcttgacacaagggagcttgttggagtggttcgaggaatcattaagaatatgggcactctttctaggccattcttgaaaatgggttgtatcttaggcctcggagtctctcctacttacaggagaaaaggggttgcactaagacttgtgactgtagctgaagaatggatggcgagaaatggagttgagcatgcattgttagccactgaaaataaaaatgatgcgtctaaaaacctattcaccatcaaatccaactatgtgaatctcagctcacttgtcatatttgtccaaccaattagttcccttacaaagcaaatttccatggatataaaaatagacagagtggacatagatctagcaatttcgttgtacaaaagaaccatgaggaccaaagatttgtatccattggacaaggatgttattccgaaggagaaactcagcttaggaacatggaaatattacaaggaaaaatattccttagtaatcccagagcctagctccactaaagaatgcaaagaagttctacgcacattattcaataacataacatag

SEQ ID NO: 114277 - DNA, 285 bp, Glycine max
  Peptide Sequence Number=SeqID_231055
atgtacacgaaagcacaaagttacaatgaagacatgaatcttacctcgaacccaacggtgacaatgctggtgagactggcagtgaaatgtacctcaggtcaccacgagttccccaatccttgcaccagaaaccaaaaaagttcaagagttcaagataagaatcaagaagaattcaagaactcaagaagaaagtttagagtcaagaatcaagattcaagattcaagatctcaagaatcaagatcaagattcaagactcaagattcaagaatcaagagaaggcttaa

SEQ ID NO: 114278 - DNA, 708 bp, Glycine max
  Peptide Sequence Number=SeqID_231056
atgtgccgtggcggctgccggtcgccacggttttcgcgtttccctcgctggtgctttgtattatcctttctgccattcccctttttctcaccgccccgcggtcaacacagcgataactctatggatactttacgtattggcttaatttccgtgtccgatcgggccgctaacggcatctatcaggatcagggcattccggcgctggaaagctggcttagcgctgcgctggcgacaccgtttgagattgacacccgcctggtgccggatgaacagccgatgattgagcaggcgatctgcgagctggtcgacgaacgtttttgccacctggtgctgaccaccggcggtaccggtccggcccggcgcgacgtcacgccggatgcgaccttagcggtagccgaccgcgagatgcccggctttggcgagcagatgcggcagatcagcctgcagtttgtgccgaccgcgattctgtcacgccagatgggcgtgatccgcaagcagtcgctgatcctcaatctgccgggacagccgaaatcgattaaagagacgctggaagggttgaaagcggatgacggtacggtgaaagtgccagggattttcgcggctgtaccctattgtttacagctgctggaagggccttacgtcgaaacccacccgaaggtggtagcagcttttcggccgaaaagcgcacggcgtgagacaaacttctga

SEQ ID NO: 114279 - DNA, 350 bp, Glycine max
  Peptide Sequence Number=SeqID_231057
taactttcagaggactaaggaaggccagaggaaagaaatctgaggccccttccacttcagcaccagaggcagaaggtccttcttcttctacacttcctccctcttcctccacagagatcccaatgattcctccaacaccttcacagatgccatttctagctccagtatctacaggagaccagtcttcttcttacggagggggtggggcctccacagcccaggagcctgtgactaaggagcctccagcagcagcagtagaggaggaagctactccagagcagattccaaagccatctctagcccctgcgcatgcacctgatgatgccacaccagtggtggagcctgagtag

SEQ ID NO: 114280 - DNA, 141 bp, Glycine max
  Peptide Sequence Number=SeqID_231058
atgatgcatgcacctgactcaacactcagatgcaatgtgggaactgtgctgagtttgtcgagaccacccggttgtgcacgtaacatccctcctcccataggtgatcagcctgggagcccaacggtgttccctaccaggtga

SEQ ID NO: 114281 - DNA, 366 bp, Glycine max
  Peptide Sequence Number=SeqID_231059
atggcattcttgggagagacaagtagtcatacaattgtgaactccacattaggttttatttttccaaatagatccattgttcacaacgacaatggtgtttcctttcaagcttccactccagttcccattcgagcacctaacagttgtgattttcaaatgttaaaaaccagaatacacaatacccttaagctaaccaacaagcaatttttggatgaaatttactaccggcaacctttcacatatgcaggaaaaaatcccaaaaagtttgacattccttccagatgtaccatggatgaactgaaggatttgatcaagaaagttgcgcctgctgggattcccccttatggtattcatgaaacacaaatg

SEQ ID NO: 114282 - DNA, 351 bp, Glycine max
  Peptide Sequence Number=SeqID_231060
atgactgaagacatttttgtcttcgaaatgtgtgtggattaccgtatagggcgtctccgcatgctatcgaacttaatcgtctctgatgataaaagggatttcgatagtcttcggataggaagggtgtgggcgaccatatgttgtctccacgcgtcatcggacttgtcgtctctggatgacgaaggtgcggataactatgaggtatctccacatgctatcggaccctcgagtcacgatagcagaattgagacttttttgcggtctcggccggaagacgttgacatctccgggaagggtgcagatgaccacattggtctctgcgtgtcaatgaggtcgcttgcctctggttga

SEQ ID NO: 114283 - DNA, 160 bp, Glycine max
  Peptide Sequence Number=SeqID_231061
atggctcttctttctttggagatcccactgttccttcttccgagggcaaggatggaaattctcatcatgggtcaaggtttatggtggtttgaggttttggctcaaaaggcttgtagaacggctgaacatgatatatgtcagggtgttggtttggccaacg

SEQ ID NO: 114284 - DNA, 231 bp, Glycine max
  Peptide Sequence Number=SeqID_231062
atgcaggaaagaagactttttcttatacaaagacgatgtagacattttttggtcatgcttatcttccctttgaagagatttaccctcccaagatttgcaatagatgatgggagtgaagcccatggaacacttgcatctgtcacttttctactacttggagaaactttgaccaagtttccagggaatccattgttagaagcttctaaaattgccaacaatgcacctcactaa

SEQ ID NO: 114285 - DNA, 192 bp, Glycine max
  Peptide Sequence Number=SeqID_231063
atggctcctaaaacccaaggactgtccttgtgtgtgccacccacagtgagtgacacacatgcaagagcgtactacgatggtgactccagtataggccacccacaacaagtagcatgtgtggatgagcaccctaacaagcctccagtgtgtgccatccacgacaagtgtcatacatgcaagagcacatcataa

SEQ ID NO: 114286 - DNA, 1644 bp, Glycine max
  Peptide Sequence Number=SeqID_231064
gtcctggctactgatgtcgtggctgatggaatgccactgatgttcaatagggatggggagccccgttttgcgttctactggcagtatgatcccaccaagttcaagtcgtatgatgaggatctgctgacccttgtggagagggtcgacaaagtgatcttggagcaactgctagcctcgctggatgcgcgggctagtttgtctcttccatcagcaagtgatcctctcactaccttggatggaataatgggtgacttcacttggaggccactcgtgaagcaggtcggacctgggggtcaacctactagtgaggttggccttgtcgctgctgctgaggctgcaagattgatgcccactgcgggtcacctttcgaatgagcaggatgtgcctctggctgcactaaccatcgaggctcctgccattgctgttgttgaagctgctactcctgttatccctgccccttcacctcctcctgctgttgatgttgtccaggaggctactcctgctactactaaagttgttgcgccagccgctcaggttggtcctgttgtggtttcgccttccaccgtcacagctactttattaagtgccggtgtgacgaccactggtgcttccacgatgtcgcctcctttatctactccggtggctctccttgctactgtcttggcggctatggcattgcctttttcatccttgtgccctcgtgtctcccttaatcatctgtacacctctagtgatattgactcaccgaaccttattaggtcggctggggtgcggaacaccactcattccgccaaggtcgccaagtggagggctactgctcagactttgtggcgagtagactgccctaaggtggtcagtgccatcgttgcttttgctgaggccgtaaggatgaaccgtcaactgtctttcaaggttggcgatgccttggccaaactgctatgcacccggttggatggtgatgacttgttcaggtgttgcaagggcttgaagattaagaagctggacttgggtggcaaggtggagagcgtggcggttgagaaggacgggcttgccaagaggattgttgagttggaggctcgacttatggagtcgaagtccaagctggctgtggagcagcatgagaaaggctttcagaaggtcgttaggaaggatggtttgtttatgaaggaccttaacttgggtctctttgatcccttggaggatgtgaaggatggtgtcttgcttgatgaagaggagattgttgcggaagaggatgaggttgcggatgaagggcaggatgctgcggagcaaggcgatgatgaccatcatggtcttgtaaaaagtggaatgatgcggagtcatctcaagtttgatttcaacttaattaaaggtcttgtcacccatctgcctaaccagtgtggggatagatcgcttgacctgccgtgttcctcctctgatgcttatgaggacggaccaaggggatgccttgggtttggtagaagtaggtaccaaggacagaccttgggttttgtaagaggtgaacctcgggtttatcaagccttagaccagggacatgtttgtcctgggttttgtcaagcctatggagttgtgtcgaggcttaccaaggatggaccttggattttgtggtcctatgaggatcagtaa

SEQ ID NO: 114287 - DNA, 177 bp, Glycine max
  Peptide Sequence Number=SeqID_231065
atgacactcgctatgggtgacacatactggagatgtggtgatatactcttgcatatatgtcactcgctgtgttatacactaaagacttggcagaatgctcgtgcacgcataccgggagtgacacgtactagaggcttagtactatgctcttgcatgtgtatcactcgtcgtgggtga

SEQ ID NO: 114288 - DNA, 158 bp, Glycine max
  Peptide Sequence Number=SeqID_231066
atgggttgtatacctatgtccgatgttacttatgccattgttgaatttttgcctgtggatatgaattctttgtctagtctagtttattgcatcggtgtgattgtctcgttggagaacttccacacctcctcctccttctctccttgtggtcttccttg

SEQ ID NO: 114289 - DNA, 171 bp, Glycine max
  Peptide Sequence Number=SeqID_231067
atgaagaatcttcacgaaatcgctcacagaaacgagaaaagagggaggtggttgctgcctagctcgcccaggcgagcagggttgcttccaccagaaggcaccgccttctgttggaaccccctgaaaggcccaagtgggcctggtggctatttgcactctcttttttactaa

SEQ ID NO: 114290 - DNA, 246 bp, Glycine max
  Peptide Sequence Number=SeqID_231068
atgcgaaagcgcttatctgaagggcacgtttcaccagaacgcgacacgtggcgtgacttgacaggacgatgggacaggggtggaagtggtggcctgccaagcgctaccactagtggtggggccccaggcgcgaccactagtggtagcctgtcaggcgcgtccactaatggtgggcccagccacgtccctcttccctataaaaccccttcccctccatttcattttcacacaaaaacgttgaagtga

SEQ ID NO: 114291 - DNA, 598 bp, Glycine max
  Peptide Sequence Number=SeqID_231069
gcaacactgcagacgacctaagtccctcctacaagcactatccagcaaaatggactgaccgtcgacatgctttcatcgaccatattatggaggcagacatacccttgtgttggaagccactcaacctcgagcaatacggtgggacaaccggaacaacattgacctggtacggtggacttccacccaagtccttagacagcttcgaccccttcgtcaaacaattcagtgcacaatacgccactagaaggtgtcacttcatgacctcgactgccttggctagtctgcgacaagcagacgacgagtccctcaaaaagttcatggacagatttgggagcatgaccatccaaatccaaaatctcaatctcgagaagcgcgacaaacacgaagcaaacaccaaggccgacttgcaaaagtcgaacaagaggcacaagtcagacaagcgtcagcctctctccaaagggcctaggtacgagcgttacacacctctaacgaccaatcgtaccataattcacgaggaagcattcaacctagaggtacccatccgactaccccagacgaaacctccgaggccggggtcagacacaaccaagtactacag

SEQ ID NO: 114292 - DNA, 315 bp, Glycine max
  Peptide Sequence Number=SeqID_231070
atgagtgaaatagaggaggtgcaagagcagatgatcacaatgatgaaggccatgatgagtatgagaaggatgatggaggtcaatacgactacagttgttgccacaagtaccgccattgaggtggacccaactcaaccacctggtttcaatcaagtaaattgtccatcctcgaatatggtaggtcagggaggcaaagcattgggaaatgcgggcagcccccattttgtgcagattcagaacaagcatttcttcccaccatatggcttgcctcccaactgtacaccacccagtgttgcacatgctcctgatgagaat

SEQ ID NO: 114293 - DNA, 120 bp, Glycine max
  Peptide Sequence Number=SeqID_231071
atgtttgcttacagtcatttcgctaagcgcaagcctcgtgctaagtgcatctttggtcatgcactaagccaagagtctctagcgcttagcactcatcccttgcatctcaggctgatttga

SEQ ID NO: 114294 - DNA, 594 bp, Glycine max
  Peptide Sequence Number=SeqID_231072
gatgctccaggtctacaccagtgtagtcaaatccttcctcaggagcttccagggcgcgccctctgcattaagtacaaatccattccatgggatgcagagtctagcggccagctcctgagggtctatgcaagtgctgcagaacctgcttcccccgcactcggacctgcttgggggatttttcttcaagatcatacagttccgcctctcaagttccctacggaactcatcgtactccgtgatgtaaagaataacattcctctccggaagaatgttccaggagtgaatgttctgatcatatctttcctaagcgccctcaaatatgaatctggtagtgccatagggctccttgggtctggaggcagtagcttttctctctctggaggcggtagtgtcataggaatcaagttagacaggctcgctaagcccaattccaaaacagagaagaaattgcacttagtgagactgactcacttagcgcaagaacaaaaactcagaaaactaaattgccttaggcttagcgagactgactcgcttagtcaccaacagaagaccaacaacctcgttcactttgacctaagcaacacaactcgctaa

SEQ ID NO: 114295 - DNA, 327 bp, Glycine max
  Peptide Sequence Number=SeqID_231073
atggtagcctggcccaggacccaaccttctcttcacaaggaagatgaaggtcccacagcccaggggaggaggcaggtgagacaggtagctactgccactcctgagagatctctcgaggccacttcagagcctcctgcaccagtggtggacctaccctcacctcagtgtacaacagacccctccactcctattgtacagacaccagaggacccgaccacaccagacctggctatggacacttctcctccagctactcctgtacttcatctgacaaatgagaaggatgttcagacacacgatacccaggaccagtcacaggaattctaa

SEQ ID NO: 114296 - DNA, 153 bp, Glycine max
  Peptide Sequence Number=SeqID_231074
atgatggatacctcagagccctacactggggcaatgaaaggaaccatgcataaacctcaagcaaacctaggggcaatgaggggcactgtgcatgagcctcaagcgaacctagggtcagatcaaaagttctcgcccgtcgatgtttataaatga

SEQ ID NO: 114297 - DNA, 234 bp, Glycine max
  Peptide Sequence Number=SeqID_231075
atggcttgcacccacattccagtggaagcaaagatgtcatacagtgctcaatggaatgtcccggaactcctccacgatatgcacatgttgcgtttgagtcgtatcctcggaaaaatggaggttgaggaaccctggcagtggttatggctaccattgcattatcaagcaggccttgtggctgatttggggatggcttttgtggatgattgggtgagaaggattgttattggctga

SEQ ID NO: 114298 - DNA, 384 bp, Glycine max
  Peptide Sequence Number=SeqID_231076
atgcctcaccctatagtggctgaatgcacacaagtcatgacagtggatgaagggtctcatgttcgagccttaactgtctaccaagctagcttgggtgacctcttcgctcatgaataccggtgccttgctgacatgctacgcaaaaacattgatctctttgcctcgcaaccatctgaaatgtcaagaatccaccttgacataatcttccaccaacttgctatctggccccaggccaaacaactcgccaatgtcgtcatgatcaaaaaggccaacgacaaatggcgcatgtgcatcgactacattgaactgaacagggcatgccccaaagatgcataccctatatccagcatcgacaggctagtcgatagatcattcgggttctag

SEQ ID NO: 114299 - DNA, 201 bp, Glycine max
  Peptide Sequence Number=SeqID_231077
atgtggaaattgcaggacttctttttatattgcactaggaaaatcacaaagccagatgaccacaagacacaccagatccggtggttgtctgccagaaaagttgtcagagtcatgatgacaatggcggcagcgaccgcaaaagtcatgggaaaaggagaaagggctgtcagaagaaaagcagcgagcagaaaggtctactag

SEQ ID NO: 114300 - DNA, 546 bp, Glycine max
  Peptide Sequence Number=SeqID_231078
atgtctccatcctacactgtggaaggtttgatgagagacttgttgaagaagttatgcaaggaaaatagggtgaatcctcctcagggtatttctgaaatggatcgagtttcactgattgatgaagtgagaaaccattttcaacaaaagaggaagaaagatgttatagagtctagtatgaaatctcctttggataaggtgcatgaactgaaacctttaactcaagaagaatctatgcaactctttagcaagaaggcattccgatgtcacaaaaatagatattgtccagaagatctcaagaaagtttcttctgactttgttgaaaaatgtaagggtttaccattggcaattgtggccattggtagtcttttatttggcaaagaaaagactccatttgctattgaatcccttccgaacatagggaggtggttgccgcccagatcgcccaggcgagttgggttgcttccactagaaggcaccgccttctgttggaacatcctggaaggcccaaatgggcctgattgctatttgtacacccctgtttactaa

SEQ ID NO: 114301 - DNA, 657 bp, Glycine max
  Peptide Sequence Number=SeqID_231079
atgatgaggaaattgaggatattatacataggatacaagcggaatgactataatggagaaaggcatcaagggttatttgcaatcctaaagtacttaccgaactcaaaggttacactttgtgatatctgtggggatcaaggaatagaagagtatcttgctatttgtaacaagtgtcctgatggggcagaacacatttattgtaacgatgataagttggacaaacttccggaaggtgactggtgggtctgtgaagactgcaggaagtcaccaggtataagttctagatcttactcatcagctaacaggcatggtgtccattctttggaaaaagacagggttttcaaaatgagtgccaaacctcccaaaccctgccacaacactctactgtatagggacttctcatgcaagactttcaaaaatgttaaagcaaaagcaacaaaagattttacttctgagctgcaaacttcttgcaattgtcaaaagaaagctaaagttccttatgcttttagtgataagagatgtgaaaacaccttagaagttgagctagatagaaaaagaaaggctctgaaacaagatccaaattcctcaaagcatgcaaaccaaccaacaaatctctacttagtagggagtcccctttcaaaaaattggagaaggtaa

SEQ ID NO: 114302 - DNA, 1330 bp, Glycine max
  Peptide Sequence Number=SeqID_231080
atctaatttgtcgcagcctgctgcaagcaaaggatcttactcgcaggttgggttttcttatgatgggaatggaaaagaagaaacccatatttcagatgatgacgataatgataacgaggaagaagaagatgatgaggatgatgaggattttaacagtgatgatagcaatgatgaaggaatggaaataattgcaaaagaatatggagttaaaaggtatggttggcttgtttacatggataagaaggctaaggaggaagaaaaaaggcaaaaagagttgatcaaaggtgatcctgcaattaggaagctgagtcgtaaggaaagaaggaaggcttctcagattgaaagggagagagagagagaagccacacggatatctggaactcgtgtgctgcatcatgatccctaccgggaaacaaggcaaagtcctacatatgaagcctattctcgatctagaaggtcaaggtctccgttgcggtcatactctccgtcgcattcaaggcgttattcgcgtagtggtcattctgatgatattcaccgaagcaaaccaaggactcctaaaatagaatacattactgaatttgggggctctggagcagcagatgaacgcaggcctgaaggattttctccaccacgatctcctacatctcaagttgatttgttaaaccggccaacatctggttgcatacttgaggcgttgcatgttgatcctgcttctggtgtatcaattgataaggataagggcactaaagtcttgaaaccgtcagtaagtggttcttcttcagcattagcaaaattaaaggctggtggttctggagggcccttaaaacaaggggagaagaaagaaactcctcaagaaagacttaaaagaatcatgaacaagcaactaaacaaacaaattaagaaagatactgctgcagaacttgccaagaaaagggaacaggagcggcagaggcaggaaaagcttgcagaaactagtagattgagtcggtatagatgccgcagccgcagcaggagtttcagcggttcccctccaagctgtcatgctattttgaatcctctaaaagtgttgtcgcaccgttctaatactatgataaatttgtccaaggaagataccggcgcagtagaagtccaagtagaagcagaagttccagaagatattattctagttctcattcacggtccccttctcgcacacgttctccgtctccttattctcgatctcccagccttgaagctgttgagtccgggtacggcaaagaatgggcctagagccgttcgtgatcagggactatggtcattgcctcattggtctctactctctaccccttaa

SEQ ID NO: 114303 - DNA, 699 bp, Glycine max
  Peptide Sequence Number=SeqID_231081
atggatgctaaggttgcagcactcaagacggaggtagcgagactcaaccacaatgcaaaagctatgcaactcaaagcggattcaaaccacgagaaactcctggatgaccaatacttcaaatacttcatccaggggttgaagaaggtggggtggtatggtttccattcaatgggagcgagaggaagcaatggaatgggcctcacccatcgaaatggcccaccaagcccaactctgggttataggccaggtgtacccagatccgattttggatcaggcagatccaatcgtgaagggaacggaggaaaaacagaattcaacaacgagccacgccatcctttattccaagagatcacgggtgaagggaacggaggaagaacagaattcaacaacgagccacgccatcctttattccaagagatcacggcgtccgccatctttcgtatcaagagctgtttgaacgacgatgaagagaaaggggatgcaaatgtggtggaagtagaggaccaaactgatgaagaaggggacaaaggggaatgcagcatgatgttttcgggaaatactacagctgagatcagccagaaaccacaaaccatgaaagtaagagccatgatcaatggagttcccatcttactgttggtggacagcagtgccactcataattttatatcgacaaagttggtccaggccaatcctgcctag

SEQ ID NO: 114304 - DNA, 108 bp, Glycine max
  Peptide Sequence Number=SeqID_231082
atgagagtgtgtgagagagaaataagggagtgtgtgagagaaaagatgggtgtatttgtagacacggtgagggatgggcggtgcggggaagctcacgcgtgtgagtga

SEQ ID NO: 114305 - DNA, 204 bp, Glycine max
  Peptide Sequence Number=SeqID_231083
atggtggtcctcgacatgcgcacaaggagcataagggaagaattgtatcgcgcattgcctttgtcgcaaaagacgctcaaaccagggaagggggtgtggtttatctggaaaggaatgtgtttgacatcgtatatgggagggtgtgatttttctggaagaggtataggggaggggagaaggagattaagggagtgtatttactag

SEQ ID NO: 114306 - DNA, 714 bp, Glycine max
  Peptide Sequence Number=SeqID_231084
atgggtgcaatatttctacgtcaagcaagcaaggaaaacagcgaaacaagggtgtggtatcccttggcattcaaaagcgccgaaagaaagaaacctaacagcgccatagcgttctctaagctatcgtgcgaggtccctcgacctccgcacaaccccagcaccaaggggctgtgcctgtcgtcgtcttccacgcccatgtcggaacccgacacccaggcgccgccgccgcctccgttcctgctccagcgcccgccgcttctgcagtcggcgtcgccgctcttcaagcagcggtcgtggtcgccggacgccttccgcgacgaggcgtggctccgccgcaaggggaactggaagaaccgccgcagtaagagcgtcaccgatgaggacgtggacgagctcaaggcctgcatcgagttaggctttggattcgattcctcccccgaggtcgagctcgatcaacgcctctccgatactctacccgctctcggcctctactacgccgtcaacaaacgctacaacgactcccttgtcaccaaaaccacgccgtcctcctcctcctcctccgccgcctccgattgcgacagcactccttgcccccacggcagtccccactccgccatcttcaccaccggtgataaccctcagacggtgaagacgaggctgaggcagtgggctcaggtagttgcttgtgcggtgcgacaaagttcagatgtgtga

SEQ ID NO: 114307 - DNA, 474 bp, Glycine max
  Peptide Sequence Number=SeqID_231085
atggttcccaatagagggaggaacattgatgttaatggaagaaacattagacctttgggtttgtctgcatctgcatggcctactctgcagcacgcgaagcagcagaaccagcaatatggctctggcatgagagctgtgtttctcggaaacccttctgggagaagggaatgtgctggcactggcgtattccttcctcggcgagttgatatcccagagtcacgaaagaagccagcgtgttcaacagtgctggttccaactagagtggcgcaggccctaaatctgaatctcgatgatatgatagttggtcagccgcaacacttgcaacgatttaatgcttgtcccaacattgaaaatggtgcagctgtttccaggctgaggggtaattatgtcctttctcaacagaagcgcaacctcaacaagcctcagccagcagggtaccatgagattaggttgccacaggagtggacatattga

SEQ ID NO: 114308 - DNA, 348 bp, Glycine max
  Peptide Sequence Number=SeqID_231086
atgccattgaggcatttcaccgaacacttggtgggcgcgcgtttaggcatcaatagcaagagaacggggacaatgtggcatgggggaaaagaagtttttgaatgtaaaaacgccccccctttcgtcatttttatacattccccagtggagtcgccaactgtcgcaacctacccttcggcgggagggcgacgcgtgactcgcgggatgcgtgttccacgaaaggaatacgcgcggagtcgccaccaacgtttatttgaggaaaacgtcggaaaaaccggaaaagacgcgatctacgaacttttaagtgaaaggttcgggagttgtatttacgcacggggaaggtattag

SEQ ID NO: 114309 - DNA, 405 bp, Glycine max
  Peptide Sequence Number=SeqID_231087
tgcctgtcgcccccagcaaggtcatcaggcccccctactaatcgagctttcatcaagaagtactgcgtccccaggcaggcgcagggcgaaacagcacaacagcctggggatggccggcagcgggcaacagacgcaccgccatcacctctgctcatccacaaaaaggtaagagtgttgcttacgacccatggccgaccaataggcgaccaagtccaaagccaaagtcatagcaggacacacctatttgctcatgatcctaggaatttaaataaaacaagcacaagctcggaaggacatcccctttatccccgaaccgctggccaaaccctgacatatatcatgaccagccgttccacaagccttgagccaaaatcccaacttatcataaaccttgacccagggtga

SEQ ID NO: 114310 - DNA, 276 bp, Glycine max
  Peptide Sequence Number=SeqID_231088
atgagaactcaactgataacccgtgaagggtatgacaagctcaaacaagagctggattacctctggcgcgaagaacgccccgaggtgaccaagaaagtgacctgggccgccagcctgggcgacagaagcgaaaacgccgactaccagtacaacaagaagcggctgcgcgagatcgaccgccgcgtccgctatctgaccaaatgcctggagcaattgaagatcgtcgattactccccgcagcaggaaggcaaggtgttcttcggcgcctgggtggag

SEQ ID NO: 114311 - DNA, 824 bp, Glycine max
  Peptide Sequence Number=SeqID_231089
atgggcgttgagcccaacgccgatctgaaaaccatcaaaacggcctaccgccggctggcgcgtaaatatcaccctgacgtgagcaccgaagaagacgccgagagcaaattcaaggagctggccgaagcctatgaggtgctgaaggacgaagagcgccgcgccgagtacgatcagatccggctgcaccgcaacgatccgaactttggccgccaggcgcgcggcgatcgcggcggctatcagcagagcgcttcatggcacggcggcggtgccgacgcgcaagacttctccgatttcttcgaaagcatgttcggcgggcgtgcggcgggcgggcatcgctccgcttcgcactcgcacggcgggcatggcttccgcggccaggatctggagatggaggtgccgctgttcctcgaggaaacgctgcatggccaaagccgcgagatctcctacaagctgccggtgtacgacgagctggggcggcaggtgagcgaagccagcaaaacgctgaacgtgaaaatcccggccggggtgggcgacggcgagcgcattcgcctcaaggggcagggcgtggccggcgtgggcggcggccagaacggcgatctgtatctggtcatccgcctcgcgccgcacccgctgtttgagatcgacggccacaacctgagcatcgtggcacctctcgccccttgggaggcggcgctcggcgccagcattgaggtgccgacgctgaccggaaaaatcgcgttgaccgtgccggccggtagccagagcggcaaacggctgcgggtcaagggcaaggggctggcgggcaagaaagagcccggtgacct

SEQ ID NO: 114312 - DNA, 174 bp, Glycine max
  Peptide Sequence Number=SeqID_231090
atgggtgttgctattggccctggacccattgctattcgccccagcatttggataaccttctacttcatggcaactggaaagagcattcccatgaggaaaaggcaagatgacattggtgtgtctaggaaggattccaaagagttgaagctgatgaagtggcaagagcttatctaa

SEQ ID NO: 114313 - DNA, 432 bp, Glycine max
  Peptide Sequence Number=SeqID_231091
atgtatatgtctccagggcaagacatgccatccatgtctaatgacacaaacaacatgaagaagacgattatgcacagcagtctctactggggcaaagatgccatagtgcttttccctaggtggcctgagaacagtgttggcatgtacatcttagccctaatttttgtgttcttcctagctatggctattgaagtgttatctaaccagccactcctcaaacctgggactagtccccttgtgggagggcttattcaaactagtgtgcacttatttcgtatcagcttcgtttacatggttatgcttgctgtcatgtccttcaacgccggaatcttcatagctgctgttgtagggcactccttgggattcttcgtcgccaagtttcgcgctcttgccgtcgccaatagggaagacaaagggtcttcctccatctga

SEQ ID NO: 114314 - DNA, 681 bp, Glycine max
  Peptide Sequence Number=SeqID_231092
atgggtggtgttgcatggacagaagaagaagatcacttgctcaagaaatgcatacaacaatatggagaaggaaagtggcatcgtgttcctatactggctggtttaaacaggtgcagaaagagttgtaggctaagatggttgaactatctccgtcctaacatcaagagaggaaattttgcggaggaagaagtggaaatgataatcaaactccacaaattactaggcaacaggtggtcattgattgcaggaaggctacctggaaggactgccaatgatgtgaagaactattggaactgtcatctgagcaaaagactaaatgctctagaagctgaagatagaccaataacaagagatgttcaagtgattaggccccagcctaggaacattggttcaagctcagtgaagagaaggggtggtcagaatgagtctgcaactgacaaaggagttcaacaagagagtagcatgtcctcactgacatttgatgcttctgatggacagaaccacatgcttgaatcacagcaagacaatgacatatatgcatgcttggatcaacagggcattgttagtgagttgtcaatggactttcagttacaaggatttgaagcaatgatgaatggggagggtagtagcagccaatgggattggggtgattacctcttagacatggatttttacgagtga

SEQ ID NO: 114315 - DNA, 135 bp, Glycine max
  Peptide Sequence Number=SeqID_231093
atggttgtgagcgagagcaacagtgagaacgagaggaagcaccgccgcggagatttgaaaaaagtcttaccgctatacacatatagtcatcagtacaagtctagcttacactttaataagctatttttagtctaa

SEQ ID NO: 114316 - DNA, 345 bp, Glycine max
  Peptide Sequence Number=SeqID_231094
atggagagcaactatggtggcgaagtcgttcggatggttggaaagggagaaattgtggtggctgaggctttcagccggaggttccatggaggacaatccctggatcccatgtatttgaaaacaaggaggtccagtgctgatgccgttactgacagagacggcgttgccattggaaacggaaacacataccatatcctcccacctgaaccattgttaaggattgagaagtctttccttgaatacttgtacaagcatgtcttctgtgaatgtgccagcaaagagtgtggggaaattgggatcagtgttgatggcgagggaatcaagcgtttggttgtgactgagtag

SEQ ID NO: 114317 - DNA, 366 bp, Glycine max
  Peptide Sequence Number=SeqID_231095
atgccaatttccacacactcttcctttttcaggttttggtttttgctgatgaaagtgagcgaaattaggggcggattggaaaggaaggaaggaagggaggtgtggcgtgaacgtaggctggttcgcgcgtgtagtacggagaagacgaaaactgtgataatgacgaaaggggggtttaacggttgggattgggtaatttactttttcttagtggtgctggcaagggtagtgtgtgtgtgtgttttgcatcgtggtggtggcccagtccctgttaacagtgacgggaatctagaaacgggaaatctgacggcgccgttatatggcctgcgccgaagcgtcaccaaatggaggattgacacctcatga

SEQ ID NO: 114318 - DNA, 162 bp, Glycine max
  Peptide Sequence Number=SeqID_231096
atgggatccacaaggttgctctccaatgggaagagtaactctcatggatcttggaccacagccccttgtaaagttcttcgtgactatggagcactgcactgccatgtgctagctagctattcaactttgaaagtcgacgttaaaggacatggaaaggtatag

SEQ ID NO: 114319 - DNA, 447 bp, Glycine max
  Peptide Sequence Number=SeqID_231097
atgaattggaaagtaaagacaaaagagaaaagtatgcattgtcttgcaaggtgcctcaaaactcccggtgaggatgcaaggcttgcagattattttgatgtaattgctgggacaagtacagggggacaaacgttgttattccaacttttgacgtcaagatacttcaacctaccatcttttcctcgtatcagatttgaaacatgcatcttgtgcagatggcaacggagccaacattgtttaggcgaagcaagctttgatatggttgactaccacaactacctccgcattcaaaacaatacattaaagggggatttagcatctgcggatgtggctactaaagagaatttggataatctggtttgcaaaatcactctgggaggcaagaaaagggagaaagtccaattcacaatgacaagatgggaagtaaatgatcgccagaatgcatga

SEQ ID NO: 114320 - DNA, 243 bp, Glycine max
  Peptide Sequence Number=SeqID_231098
atgatagtgttcagtacagtgggaacaaatggtttaatagagggtaatacattgttttgttatatcactaacagtaactacgcggtaaattttacagaacctatgctgactattggcagcatcaatcctgtgatgtggaatgacgactggacagttgtaacggaagatggaagcctttcagcacagtttgaacacaccattctgataacacctgacggggctgagattatgactcaatgctga

SEQ ID NO: 114321 - DNA, 969 bp, Glycine max
  Peptide Sequence Number=SeqID_231099
atggtagaagacatgtgtttcctctacaaggaaattcttgttatgaagcctccaaagagatcaccaatgttgttaaggacggcagtcataatattttcgatgataagcacccaagctaggactacatttatggacttcaaagtcattgacaaccattctcagagtatattgaagctaatgaatactcacctactacattatcccaaaccttcatcctttagcaggaacgagtgcgctcataatcctgtattattctttgccatattgtccaatcagagatctggtagtgggtggtttgagacccttttgaatagccacgttaatgtaagctcctatggggagatattttctgttagagagagaaggcaaaatgtttcttcaattttgctgactttagataaagtttacaatttggactggttcaatagtgcttccaagaatgagtgctctgctgcaactggtttgaagtggatgcttaatcagggattggtggagcaccataaggaaatagcagaatatttcaatcatagacgtgtttcaattatatttcttttccggagaaacttgctacgcaggatggtatcaatgctagccaattcatatgatcgttatgccaagctattgaatggaacgcacaaggctcatgctgagattctttcgaagtacaagcctatcataaattctacatcattgctggatgacttgaaagatatggagatgagatctgctaaggctttagaatacttcaacagcactcggcatataattgtgtactatgaggatcttatgagaaatcacactaagctaaaagacgtgcaagagtttttaggattgccacagatggagttaacgagccgtcacgttaagatacatagaggaccattgtcagaccacattcagaactgggatgacgttaacaagacactgaaaggaaccatttatgagagttttcttgaagctgactattag

SEQ ID NO: 114322 - DNA, 234 bp, Glycine max
  Peptide Sequence Number=SeqID_231100
atggctcaacacaagttcctcttgtgtttgattttgcttgcattgatcattttctgccaagggttgcactccattgagggcagtggcatttcaaccacaaatgtagcggcgcttgttgctgacgtgtctccaccaacgccaccctccgcggcggttccaggtcgtgacaatgataattttagacccaccgcaccgggtcacagccccggagttggacatgccgctcacaactaa

SEQ ID NO: 114323 - DNA, 453 bp, Glycine max
  Peptide Sequence Number=SeqID_231101
atggatgagtttcagactatgcacaaatattttactatttttgttgcactatttgcctgccatggttctcttttcgctcatgggaggcagataaaaccattgaatcaacattcctcgctaaacacaaaccctatacttgctccactaagcagaaccagcattaaagtaattgaagcaccaattgtcccaaaattcaaattttctgatgtcgactctggagattcaggtgcagaccatgcaaatgcctttcgacccacaacaccaggaaacagtcctggtgttggtcacaaaaaatttgaagaagataaagttatgaaagtgatgggggcattagttcatagtccagatgttaaaacttccgtggccgaaggatcatttgaaaacgatttcaaacccacagacccaggtcacagccctggtgttggccatcctcgtcaaaacaagaggaattaa

SEQ ID NO: 114324 - DNA, 330 bp, Glycine max
  Peptide Sequence Number=SeqID_231102
atggataacaagtctaccaaaatccattggcaagctccagaatttggagaccttggatataagagacacaagtgttcaattcaatggaaggatattggaggcatgacatccctagaagagatacctccagtgtttatagatgatgatggagtggtcattagagaggtaggaaagctaaagcagttaagggaactgtgggtgcttgtcctatgggggacgttaacaaggttgccaaattggattttacagttcccaaatcttgtgcaactgtctttgcgcattgctcctgatggaggagaagaccactggatcatccaagatgtgccccat

SEQ ID NO: 114325 - DNA, 480 bp, Glycine max
  Peptide Sequence Number=SeqID_231103
atggaggccatgcaagagcaaatgaccacaatgatggaagccatgattagtatgagaaaaatgatggaggtcaatacgactacagttgttgccgcaagtaccaccactgaggtggacccgactcacccatctggcctcaatcaattaagtcgtctagtcccagacatggtaggtcaatggggcaaagtattgggaagtatgggcggccctcattttgcacaagtccagagcaagcatccgttcccaccgtatggcctgcctcccaactatgcaccacccaatattgtacatgtgctctatgagaacatcgaccactccgctcctataccccttgagagccaacaacctcagtttgggcatgcacatggctctcaacccatgggggagacacatgaagtaccccgagaccacactctggccgactttgagccttaccccggatatgccatcgaggggcaaacatttggtggaataccctag

SEQ ID NO: 114326 - DNA, 144 bp, Glycine max
  Peptide Sequence Number=SeqID_231104
atgaaggatgattttgttggtcaaaggaggttgttgtatggagatactggattattgaggtctatgttgttgtacggtaattgttgtggaggcggtagttgtagttgtggacatgagggttgtggagacgatggttgtggttga

SEQ ID NO: 114327 - DNA, 816 bp, Glycine max
  Peptide Sequence Number=SeqID_231105
atggctccctgtaagataaaagccacagttacattgtcccaggccagttatgactcatccagatttgtatcaagggatgcgtgggaccgttacacagataacatcatcgatcagaacattcttttgaagaggaatgtgaagctatacattaatgagtttgatgacttcaaaagagaagtcgagagaaggaactggcacagggagctcactaatttttctgatggaagcatcgatgtggcaattgttaaagaattctatgcaaacctatatgtccctaaggacaaagaacaaaagcaagttagggttcaaaggcacctgattaagttcgatgcggactccctcaacactttcttgaagactccaatggtcttggagcaaggggagaacttacctttttactctaggttctgcaggttgaggccagaccctcaagagctggcaggccggaattactggaacttggatgacccttcggtcacttttctagggacccaaaaatccagggctaaaagatctgaggccctatctccttcagctgcccttgctccccctacttctgctctcccatcagctcccacagccccagttcttccagagcctgcaccagggctagctcctgattatgcagagcttgcaagatgtggtctagcagggaccagttatgagcgtggaggagtttctgcagaaggttgcctagccaggagtccaaccttctcctttgggaggggagggtactcagcaggcactcctgcactggacttaaacgaggaggccatggatcaagacccaccaccaccacaggaccaggatcactaa

SEQ ID NO: 114328 - DNA, 444 bp, Glycine max
  Peptide Sequence Number=SeqID_231106
atggaaaacatatacctccgaattgtctgcgttctcctcttgttttttatcttacaccaccaagatctctatgttgaagggaagaggcatttgaggcctcggttgaacaaacggtgcacgaaagatggtgaaaatttcagcaatgttgtggctcatggtgttggtgatcgtgaaagcagggccaccactgatgatgctgcacaccaaggaagaaaagggcgagtagaatttgaggagaaagattttaggccaacttcccctggtcatagtccaggttctcatctttggtttggatcagttgctgctataattggattggatccaagtggctttacctttggattccaagtgtcgttcattttctactacacaattgtgggctctacgggaagaaagttacgaaagcttagttgtttatttggtttgcctcaatttcgtccttaa

SEQ ID NO: 114329 - DNA, 315 bp, Glycine max
  Peptide Sequence Number=SeqID_231107
atggaggcacagtcagcctggaaagcggaggcgacagtggtgactgcacggaggaagaagattggtagtggtggctggtcacgacaaagtggagttgagctgcagcaagtttggccatggcggcctccaggtagtccatggtggtttggtggctgtaatgagcggtcgtggttgatggcaagggtagaggtagaagttccgacagaagttgttgctgatggatggctgtgtggaaaggatgtcgtgggaagaggtggtttgggctggcatggcagccattggagttcaatgaaagcaccaaatgttatgaactaa

SEQ ID NO: 114330 - DNA, 732 bp, Glycine max
  Peptide Sequence Number=SeqID_231108
atggaaactcgagggagcaaggcaatggtggctgcagagaaaaccgtgaaaaatgggcgtcgatccaatagagaaaggaaaatagccttgacacaagatgttgataagttgaagaggaagctcagacatgaagagaatgttcacagagcgttagaaagagcattgacaagacctttgggatcccttcctcgtcttcctccttatcttcctcctcatacattagagcttgtggctgaagtggcagtattggaggaggaggtggttagactagaagagaaggttgtgaatttcagacaaggtctatatcaggaagctgtctacatttcctctaagaggaatgcagaaaatttgagggactcaatggaccagaactccatcaggagctccaaacatcaaagatcaaagtctttgtcccaaagtgagctcaattcaactaccatggctaggcctcaaatttctcttgctagaagtgcttccagtagaaggctgttctctgacattttcactgatcactctggcaagctagtgaacgggaaactattgcacataaatcaagattcactatcatcaatcccagaagagggacggcgaaaagagaatccactgttttatagctctctgaaggataagcaatctccagagaagaaaacggccaaagtcattgctccagtgaagaagtctccaatcaaaaaagaatcagctgataagtgtgtagatcacttgaagttacag

SEQ ID NO: 114331 - DNA, 795 bp, Glycine max
  Peptide Sequence Number=SeqID_231109
atgagggatattggtacatacaatagtttgtgtgagatcaaagcctccaatgttgacctcaatcgaacaagatatgtagtttttctgatccgtaggttaaagtgtctatctaacctaacagacatattcaggtttctactcgggaaacttgcctccgtgagcatgaaggatcttactcatcaagagaaacttgcattttggataaacacttataattcctgcatgcttaatgcatatttagagcacggcatacccgagagtcctgaaatgattgtagcactaatgcagaaggcaacaatagaagtgggggggcagctgctcaatgcaattacaatagagcacttcatcttgagacttccttatcacctgatgtttacctgcccaaaagctgcaaaacacggcgagatgaaattgcgaagcatatttggcttggaatggtcagagcccttggttacatttgcactttcctgtggaagctggtcttcacctgcggttaggatatacacagcatcacaagttgacaatgagttggaagcagcaaagagggattatttacaggcaacagttggcattacaaaaacaaacaagttaataattccaaagttactagattggtatttacttgactttgcaaaggacttggaaactttgttggattgggtttgcctccaactacccattgaactgagaaaggaagcaattgaatgccttgaaagaagggaaagacagcccctttcacagctggtacaaatgatgccctatgacttcagttttaggttgcttttacaccaataa

SEQ ID NO: 114332 - DNA, 360 bp, Glycine max
  Peptide Sequence Number=SeqID_231110
atgtttgcttctcatgggaaccaaattggattagtaaagctcatacaaggataccgcctttccacttcatcctccaaatccaatggccattatatatcaaccaagagtgagggcaaaaagtcaatcaacttgaaaagaaatgagattgtacttcaggtgtactggcaagagactcttaggggacatgttgcaggaattttaacaacacagagagtcgaaaatatggaagcagatgaggagatggaacataaactgtcctcactttcacttgaagtcattactttggttgaaaatcatgttcactctattctctatttctaccttcagactttccacacctactcagccaagaaaccataa

SEQ ID NO: 114333 - DNA, 504 bp, Glycine max
  Peptide Sequence Number=SeqID_231111
atgacaatagagaacttcacaaaccaagtccgtggagcttctttgagagaccataaagagcctttttttttaacttacacacttgcccatgattatgagaaacacttggaggagcagacacatcagacattctttgatcttgtaaacccatcgagacctaataaatgttttcctggtggaacagataccaagtcccaagtagttgtcttgtgtaagggtcatagcaacgataacccttttgaccatccccataaccaagaaagatacatattgcaaaatgagaagaaaatttactatgttctatgtgcgaacgaagaacaaaaagctttcaaggaagagttatcaggatcacaaccatacaacttttggaagggacacacacttgatgtaacaaagtatggaattatgttaatagcgtggacaacaataagaactgcttcaccccaaaactcacttggaattgaggcaaacaatagaagagaacagacaattttgacaatatga

SEQ ID NO: 114334 - DNA, 213 bp, Glycine max
  Peptide Sequence Number=SeqID_231112
atggagtctaggcacacgtgtcccgtgattgtgaaatggtggagcgatagtgcaagtatcttgaatatgtttccagcaatggataagcttgaagggtctaacgctgagaccatattggcaaccatgactcacttaagagaaagattgttgaagtacaagtgtgaagatgaagtcccacattgggtacaaatgggaaagttgagaaacatataa

SEQ ID NO: 114335 - DNA, 1224 bp, Glycine max
  Peptide Sequence Number=SeqID_231113
atggcaatgcctgaatttgatgcattaacaggaagcaagatttcagctcttgacattggtgctccagttgtccgcatgttatatagtccaacaagagggcatactgtgattgcaattctccaggttagtattggaggagacattggtatgacactgattgaggaaatgatgccaggaaatcaaatgtcacaccaatgtcatgaaaggtttgggtatgtacaaagaaggctactagaagtaccagtgaggaaagtagattgcatgatttttagttttatgagaaggtggagaaggagaccaagaatgacattggaggaagttgttaagagggatctcacgatgaatatatctataaggatttggtctttaactgagcccaatggcattgattctacaatacgatcttgtgattttgacttcgagcaaacatgtgtattgcattcaccagagaagaagaccgagcaaatttcttctgatacagaagttcatctggcattgaccccactacaatctattgtgttttttggattccataaacggttgagtgtgacagttgttggaactgttgaaggcggtagagcacccacaaaaatcaagacagacttgaagaagcctattgtgaatcttgcttgtcatcctcgcctccctgttctgaaagacttagtcaccggtctttcttttaatgatacttcagttctgtccttcttgactccgttgcttttctgtcctattgacaatactataaagcttaatggtgctggtgcatttgcatttcacccaactctagaatggatatttgttggtgatcgacgtggtacactactggcatgggatgtatcaactgagaggcctagtatcattggactccaatcactggaaatatttaaattgaggcttaatgtaacaagtggagaccctttgaaaaataagacgacatacagtagagaaaggagaaagcaacttttttcagttttgcaaagtgcacgcggatcgtcagagattctatgcagcatctactttgaaagaaaaattgtcggccttgggttcatctggagtgttagcggaccatcagcttcaagctcaattacaagaacatcatttgaaaggcattttatggaaggcaatacaaaaagtgctccaatatctcgcttgcccctcatcactattctagacaccaagcattatctgaaggactttccagttatacaggcaagaatcctttga

SEQ ID NO: 114336 - DNA, 1509 bp, Glycine max
  Peptide Sequence Number=SeqID_231114
atggcggacagacacggccgatgctgttgcaattgcaactacggttgttccaataacctggaggacaaatctggccgatgcacttgcaactgcggttggcttgagtccaaaaaccttgatgtcatgaccactgcaattgccatcgaggatgtgagaagggaagtaaaaatattgagagctttgactggacacaagaatctagtacaattctatgatgcatatgaagaccatgataatgtctatatagtaatggagttgtgtgaaggaggagagttgttagacagaatattatcaagaggtgggaaatacacagaggaagatgcaaaagctgtcctgagacaaatactgaatgttgttgctttttgccatttacagggtgttgtgcatcgtgatcttaaacctgagaacttcttgtttgcatccaaggaggatacctcaaagctgaaggccatagactttgggttgtcagattttgttaaactagatgaaagacttaatgatattgttggcagtgcatactatgtggctcccgaagttctacatagagcttacagtacagaggctgatgtctggagcattggagtgattgcatatattttattatgtggtagccgtcccttttgggcccggaccgaatctggtatctttcgtgcggtattgaaagctgatccaatttttgatgaacctccttggccttctctgtcagatgaggcaaccaattttgttaagcgattactaaataaagatccacggaaaagaatgtccgcagcacaggcattaagtcatccatggattagaaacaaggatgtaaaagtacctctggatattctaatattcaagctcatgaaggcatatatgcgttcctcatctctacgaaaagcagctttaagggctctgtctaagatgttaactgttgatgagctattttatttgagggagcagtttgcacttttagagccaagcaaaaatggcactattagcttggaaaatatcaaagcggtcttgatggtaaatgcaacagatgctatgaaggagtcacgcatacctgactttttggcatcacttaatgcattacaatatagaaggatggattttgacgagttctgtgcagctgcccttagtgttcatcaacttgaaacacttgaccagtgggagcaaaatgcacgttgtgcctatgacctttttgaaaaggatggaaacaaggccatagtcatagacgaactagcttcggagcttgggcttggtccatctgtccctgttcacgctgttctccatgattggattcggcacactgatggaaaattaagtttccttggatttgtcaaactgttgcatggcccatctagaagtcttgcaaaaggtgttgatcatgttgataattggcctgaggcaggaaatatgaatataattatagatgttgctacacgtgtctggtattacaaaaccagattgacaatggaaatggagacattgcatacaagtaagaatctgtattgtaagggtatttga

SEQ ID NO: 114337 - DNA, 579 bp, Glycine max
  Peptide Sequence Number=SeqID_231115
atggaaacttgggaagtcaacaactcaaagatcactacccagatcaataattatgttttgcaaacaatagggatgcaagttgagaagtatgatttggctaaagctatttgggaccatttaaaaatgttgaatgatgattttgaaggacttcgttggatgatcttacgccttcatccccttcccaatgttgatgtcgtagttaatgagttgttggctgaagaaatacaacttaagtccaactctagttctgacaaaggaattttctttgcttctccaccagtctttgttgctctgtttactaaatttaaaaaattgcttgctactcagtcacttgacatgtctgcctcttccttaaaaggtttgccttcctctagttcattaggtatgtctctatccatatggattcttgattttggagaatcacatcacatgtcatatgatcccaagtattttgtgtctttaaatcctatcttgtctttatcagtcatgattgctgatggtagtccaatgccattagtaggcactgaatctgggaggctgattgggacagactgtagactaggggactttatatattag

SEQ ID NO: 114338 - DNA, 999 bp, Glycine max
  Peptide Sequence Number=SeqID_231116
atggacatgcagtcttacggcggacttgccacatataaacggattcagtattcaccggattataagggattcaaagctggattgtatgttcatcaggcaaaccacggacagttcaatacttcatggggaagctatgattccagcagtccgtatatcaatcagttcaatatgaaaaatctgatgcctgaaaaggaacaacaacagatcgcaaaagtatacatatccgcttttttagatgttaacctgaaaggagaaaacgtctacaaacctctttttacagattaccgatatggacgaaaatggcttccgaaccatgtttatttcaatcagtttgaagatagtgaaacgacatttgttgcccgttatgaagaagatctcaacttatctaccgccactttaaaaggtgtacagatcacgggtgaaaaccttagcttatggcgggaagcccagcagaagctgatctggaacagtcaaatttcaagagctgcttatatcggctggaatcacagtgaaaccggtaataaaccaggaaaatatacttttactttccctgacagcctccgccaggatttaaagggcaaagcattggcatttaatcttgcagagagcgatgaatcttcggtagcagcccggaaaggaaaaaaagaaactaaaaaggaggagtccgtaaaaaaagatctgcaaaaaaaggccatcgatttcagtattgagctgacggatcaaaacggaaaaaaagcacatttccttttgagtgactgtgcacctttacaacctcaactgaaaaagaacttaaccaaattcagttttttcaatgataatcctgatgcagaatctattccagactatttttattttgaccttgataccgtcagaaaaaagtatccggaactggatctggataggctgaaatcgatctcattgatctttgataaaactccggaaggcgtagttattctggacgacatcagctttgttaaactttctacttctacccattaa

SEQ ID NO: 114339 - DNA, 285 bp, Glycine max
  Peptide Sequence Number=SeqID_231117
atgggatgcaactcacctccaaaaatcatttcaagacagaaggacaaaagaggtaattttcgaagactaagggaaggagatgtggcgttactacgacctcaaggccatgttgtagaagcaagcttcatgatgatgaaccaaacaattttgatgatgccaaaagcccaagtgattgattcaagattgattcaagacttcaagatcaagcatcaagaatccaatccaagattcaagattcaagagaagaaatcaagaagcaacaagtcaagacttcatataggataa

SEQ ID NO: 114340 - DNA, 240 bp, Glycine max
  Peptide Sequence Number=SeqID_231118
atgggatggggcaagcgagcgtataggaatagtagaattgaaacatacccagtgccacgtaatcaactcggcactgaactggtgagaaccgggaaacttgatcaggtgtttaatgtaagaagggtatgcgtccgagtactttgtccgagggttgtgttcactgtgactagagcagtaaacaaaaagaagttgaagtggatggttattgtctccacaatgtcaatggagatgccacattga

SEQ ID NO: 114341 - DNA, 1578 bp, Glycine max
  Peptide Sequence Number=SeqID_231119
atggaaagtcgaaaaaagtggttggtctttaagaattctgatgtctgggtttgtgtgtacagtgtttttgcgaggcaagaaacaaggtcagcaggggtggtggctgagcaagagaggagtgaaggagataagttttggttgagcgtccctccaagaagtgctccaacgagtcctttgggcagtcccagcaacaaaaacgatgatgatttggttccatactattacgtctcacccaaaggaaaccagttctggtctgcaccagagatgcccacatttgactcttcccacccacctcccgccttctttgatttatccgcattacacaccgataacattccttctccccaccaaagcccaactaggctttcttccttatccattcctcccaagttatcccttgacacctctatagcacgtcgtgaaaccactgctcctctcgctgttcaccccttacccttgcctccttgggctgggcctgggccccccttgctttcaccatcttctaccttttccccacctgtggctaagactgaatccttgcccatgaaaaaccagtggcaaaaaggaaaacttcttggtcgtggtacttttggaactgtttatgttgccaccaacagaaaaactggagcattgtgtgcaatgaaggaagcagaaatattttctgatgatccaaagtctgcagagtgcataaagcagttagagcaggaaattaaagttcttagccatctgcaacatccaaacatcgtgcagtattatggtagcgaaatagtagaagacaggttttatatttatttggaatatgtccatcccggttcaatgaataaatacgttcgtgaacattgtggtgcaataacagaatgtgttgttcggaatttcacgcgccacattctttcgggcttggcttacttgcatagcaaaaaaacaattcatagggacatcaaaggagctaacttgcttgttgattctgctggtgttgttaagcttgctgactttgggatggccaagcacctaactggacatgttgcagatctttctttaaagggaagtccatattggatggctccagagctttttcaagcgggtgtgcaaaaagataacagctctgacctagcttttgctgttgatatttggagtttgggttgtacaattattgaaatgttcaccgggaagcctccttggagtgagtacgaaggagccgcagctatgtttaaggtaatgaaggatactcctcctattccagaaacattgtcggcagagggtaaagatttcctgagactttgctttataagaaatccagcagagcgaccaactgcttcaatgttactacaacatcgatttctgaaaaacttgcaacaaccagatgtttcatcttccatgcagctgtataatggaacatccttgatggatatccatagtcccaaagagttgtctgaaaataaacttgatcaaatttctattcccagtgcacatattgctaaaggaaaattagccactgagaggttctttcccgggatcagcattgatgcccctgcaagtgacaagcttgttcactgtggagtttacagcatgaggatatag

SEQ ID NO: 114342 - DNA, 831 bp, Glycine max
  Peptide Sequence Number=SeqID_231120
atggccaaggacgcaaggattgctgcttctctcctgcgccttcatttccatgattgtttcgtcattggatgtgatgcttctgtgctacttgatgatacgggcactttaaagggggagaaaaatgcactgcctaataaaaattcactcagaggatttgaggtcattgacacaatcaaggctgcattggagaaggcttgtccctccactgtttcttgtgctgatatacttactctagcggcaagagaaactgtttatctaagtaaaggtccattttggtatgtgcctctgggtcgtagagatggtacaacagcaagtgagagcgaggcaaataacttgccatcacccttcgaaccagtagaaaacattaccgccaagtttatatccaagggtcttgaaaagaaggatgtggcagtactctcaggtgcacacactcttggctttgctcaatgcttctcgttcaagccaaggctcttcgactttggtggctctggtaaatctgatccatcacttgatgtttcacttctacaaaatttagtgaaattgtgtccaaatcaagctgactctgacaccaatttggctcccttggatcccgtcaccaccaacacatttgacaacatgtattacaaaaacattgtgaacaattcggggctgcttcaatcagaccaggctcttttaggtgacagcacaattgcttcattagtcaacgtgtatagcaagtggcctattatgttcttcagagactttgcggtatctatggagaaaatgagccgcataggtgtactcacaggatcacgggggcaaataaggactaactgtagggctgttaactag

SEQ ID NO: 114343 - DNA, 249 bp, Glycine max
  Peptide Sequence Number=SeqID_231121
atgaaagtcaaagagggaacctcaacggaaagtagtgatgatggggagagtgagaaaataaggctgaacatgcacgaagaagacatggtggttcacgcattgatgactacctacctcagaattttcatatcagagagccccactattgatgcgcatgcttaccctccttgtaaagaaaagatagaaagcgaaatgaagattagttctttgtcagtattcatccgatcaaattccaattccttcatgtga

SEQ ID NO: 114344 - DNA, 368 bp, Glycine max
  Peptide Sequence Number=SeqID_231122
atggttaaggatttgaacatcattgggattcccaagggtcacatctatccccagttgttgatctatctccttgaggaaggatttgacggttcaaatggatgcgtcctattagccacccgaagcttccagaagactataaaaggggttatgtacgctctaacagggctgaatactaatgctagagttggtggtggtgttcctctaattgctagtgctacgacccttgctagtggtgccaatgcttctaagggaagacctcacactggagttgactcacttcacagggaggacgaggccaagtctactctgcctgttcctcttcttaatgttattgacctacacttgaaggctatgttgtccaagtcttg

SEQ ID NO: 114345 - DNA, 915 bp, Glycine max
  Peptide Sequence Number=SeqID_231123
atgtcatcatcatcgaactcgccgtgcgcggcgtgcaagtttctgaggcgaaagtgcacgcaggagtgcgtgttcgcgccgtactttccgccggacaaccctcagaggttcgcttacgtgcacaaggttttcggcgccagcaacgtggcgaagcttctcaacgagctcagcgcggcgcagcgagacgacgccgttaagtccctcgcgtacgaggccgaggcgcgtctccgggaccccgtctacggatgtgtcggcctcatctccgtcctccaacacaagctccggcagatccaggtcgaactcaacaatgcaaagaaagaactcgcaacatatattggcccccaagctattcaaggaattcccgcccccatgctccaacaacaccctaacaacccctttcccggagccatgtatgggaacatgccgactgcgacggccgctgttcacggcgggcagttggtgattcgcgacgcacagccggcgcctcagcagcagcagcagcagatcttggaggcgcagcagttggctgccgctgtggcggcgagggaacagcaagagatgtttaggagttacgaacaccaacagcagcaggagtttctaaggttcagtggtgggttcgatgtgggttcggcttcttctgctggtgggttcagccaagtgtccccagctgctgcctctgctgatcagttgtctccttcgttggctttgggatcattcgataacgcttaccacatgcagcaaccgcagcaagaagagcctcaccatcatcatcatcatcctcatcacattcctcttgaggcgcagctacttctccctccgcagcagaagcaacaaacccatcatgagtcgcaactgccccttcaccagcaacattctgataacgaggagcgtaggagtgttggtccatcttgttga

SEQ ID NO: 114346 - DNA, 228 bp, Glycine max
  Peptide Sequence Number=SeqID_231124
atggatgagaatgagtggggtattggttgggtgagagaacaaaaaggtagtaaaatcagacaacacagcagaccagaccaggggacgttattgatggcatcagaatattcatgtcatccatttaatagtaataatgacaataaagtttccttgggtcacctgtcaattctcatgcaacaaagtcatcacacatatcacatctactacttccttctcatttttagatga

SEQ ID NO: 114347 - DNA, 321 bp, Glycine max
  Peptide Sequence Number=SeqID_231125
atgaagggtagaattaacctagggttagaaagtgagaatgcggtgtatgagtggagaaagagtgaggctttgagagtaggtgggacttatgagaaagcttggactgtgctagagagaaaaacaaatgaccaaagtgaaccaagagccatttctagggcaaaattgggtgtcgaggagtcaaattttgattcggtgcaacaggattttggctttgtgcagaaaattgctatgcatttactggttgtggaaagagcagtgcagaatgagttctgggtgtttgctagtagatcccaacggtcaaaatgtaggcttatgtactag

SEQ ID NO: 114348 - DNA, 186 bp, Glycine max
  Peptide Sequence Number=SeqID_231126
atgatgaatatctccgagcgtgcgagacgagtccaagacccaacgcaggcgctacaacaacaaagtgctctaggagaattaccaggcaagaaaagccatttagtgcaggggaaactccccaggcgagttgcttgcttaaggctgaaggtattagctcacccaggcgagtggcttacttatggctga

SEQ ID NO: 114349 - DNA, 1635 bp, Glycine max
  Peptide Sequence Number=SeqID_231127
atgaaagagattgtgactgtccaagttggtgatttcgccaacttcgttggttctcacttctggaactttcaggatgagttgcttgggttggctgggaatccctctgctgattcagtcttcaagaatcaggatcttaacatggatgttctttatcgtactggatcccttggatctatgagttcacgtggtacgttgtatacggaggttgcttccacaacaccagatgttgtcacctggactggtagagtttccacccaagcctctgaaccttataaaagaaatttgttcctacaaagactttatgaagaagaggaaagcttgaatatgataaatgagatccgtggttcgaataatggttctcaaagtgagtatgaggataaggatataactgaatgcctagaaaatggtgtacagttttggacagactactcaaaagtacattatcacccccggagtctatatgaattaaatggagtttgggcacatgttgaggaatttgacaattatggaattggaagggactcctttgcttgggctgcgcaaggggaagaaattggtgacaggcttcgattttttgttgaagagtgcgaccatatacagggatttcaatttgtagttgatgactctggaggtttctctgctgtggcttctgaatttttagagaatattgtagatgaatatacaaacattcctgtcttactgtatgctgtccaaggttctggttcacgcacaaatcttcagagcaggaagcgtgcagtcttagaggatcttcatgatgctgtatcattttcaagattatcatcctactgtaaacttattgtgcctgttggtaaagcttccagattcctccacattgaagatgcaaagcattaccactcaagtgcagtttatgctgccgcactacactccattagtctaccttttcgaatggttccagttgggcctactgcagatgcttgttctgtttctggggctgtggatgttcacggagtcgtacaaatgttatcaggacaaggaaggcagaatatggtgtcagttctggatgttgccatgccagcaccagctttaactggggaacagaatgaactgtctctgttagagattttgcagccgttgaccccacaaatagcagaggatgttgaagacatgcaggctattgaacacatgactgtccatggagctcttgcatcaggtcatcgtgcttcagttggtgaggtaaaggataccgttgatgctgcttttcgatgtgccaatacaaggccaatgttctgtcatctatctgttgctcttagtcccttgccaatccccttgccttttccatcaatatttgggaacaatgttggccagcacggtgaattgatgagtggtcaaattactaattcttcaccaaaaggatccctcgacatccattccattcccatggctgccagattacgatctagcagtattgtgttaccactcttggagagtaagctgcgaaatcttcatcagtttggaattcaacgaggagcagcgggggctgagttacttaggagttggggctttggccaggaagaattggtggaaatggaagagatgttgtctaaaatggtagcggcattgcatcctcctcagttgtcatcagattcagattag

SEQ ID NO: 114350 - DNA, 225 bp, Glycine max
  Peptide Sequence Number=SeqID_231128
gtgccacagcaggaagggggttggcggagccacgacagcgagattggcctccgcggctatatgcgaagatccttcagcaggagggtgtctggtcccttccgtcgtagtctcgtgtttgccatgaagagtaccatccaaatggacctacggatgagatctcaaaccgctcttcctggactaactgccagaaaactacctgagaatgaacctgggtactcactttag

SEQ ID NO: 114351 - DNA, 219 bp, Glycine max
  Peptide Sequence Number=SeqID_231129
atgttggtggtcatctatcctcatggaggtctccgacggatctcatctcagcttctgtcatcagtggcaatggaagagggttcaaaggaacgcatagggtggtttcaggattttgcaaaggtagaggaggtgctggttgtaaaatgtcaggtatttgcattaaccttagagcctcattaccaaattctggatttggtattattttccacattggaatga

SEQ ID NO: 114352 - DNA, 156 bp, Glycine max
  Peptide Sequence Number=SeqID_231130
atgttgacaagctcctctcgtgatggcaatgcccccactgtgaaccaaccaaaagaccagctcaatcagtttttcaggccattcaacactggaaaaatcccaggactagtcaaagttgctattgctcaatgccaagaattttttggaggcaagtga

SEQ ID NO: 114353 - DNA, 1812 bp, Glycine max
  Peptide Sequence Number=SeqID_231131
atgcctgaggcaccgagagactacaaccttttggagcaaaacaagaaaaccctcgagttcattgaggatgtcactgccaacgcagaccaagttcagaagagggtcctctccgaaatcctctccaacaatgcaaacgctgagtacctcaagagacacggcctccatggccaaaccgaccgcgaaaccttcaagaaactcttgcctgtcataacctacgaggacatccaacccgacatcaaccgcatcgccaatggcgatacttctccaatcctttgctccaaacccatttcagaattcctcactagttctgggacatcaggaggtgagaggaagctgatgccaacaattgaagaagagctaggtagaaggagtttgctgtatagccttctgatgccagtgatgagccagtttgttcctggtttagaaaagggcaaaggaatgtacctaatgttcataaaatccgaggccaaaacccccggtggaattgtggctcgtccagttctcaccagctactacaaaagctcatacttcaaagacagaccctacgacccttacaccaactacaccagccccaacgagaccgtcctctgcctggactcctaccagagcatgtactcccaactcctctgcggcctttgccagcacaaggaggtcctccgtgtcggcgccgtcttcgcctccggcttcataagggccatccgcttcctcgagaagcattggcccttactttgccatgatatccgaacgggtaccattgacaatacggtcacggacctgtcggtccgtgacgctgtgatgaagatcctcaagcctgatgccaggcttgcggatctcatccagtgtgagtgtgggaagagctcctggcagggaatcatcaccaggctgtggcccaacactaagtatgtggatgtgattgtgactgggacaatgtcacagtacatccccacgttggactactacagcaatggactcccacttgtgtgcaccatgtatgcgtctagtgagtgctactttggtgtcaatcttaaccctctttgcaaacctagtgaggtctcttacaccctcattcccaccatgtgctacttcgagttcttgcctgttaatagaagcaatggggtgtcccatgacaatctccacacccctagatccctcaatgagaaggaacagaaggagctcgttgagcttgttgatgtcaaacttggccaagaatatgaacttgtggtcacaacttatgctgttggtgatgtgctgagggtggctggattcaagaacaaggcaccccaattcaactttgtgtgcagaaagaacgtggtgttgagcatagactcagacaagaccgatgaggttgagctccagaacgcaatgaagaatgccgtgacacacttggtgccctttgatgcatcagtgtccgagtacaccagctatgcagacaccacaacaatccctggccactatgtcttgtactgggaactctccctgaaaggctcaaccccaattccaccatgtgtttttgaggattgttgcttaaccatagaggaatcactgaacagtgtgtatcgccaaggtcgagtttcggacaaatcgatcgggccacttgagatcaagattgtggaacaggggacttttgataagctcatggactatgccataagcttaggggcttcaataaatcagtacaagactccaaggtgtgtgaagtttgcacctgtgctggagctcttgaactcaagggtggtggagaagtattttagtccaaaatgtccaaaatgggttccgggacacaagcagtggatcaaccagaattcatcatga

SEQ ID NO: 114354 - DNA, 234 bp, Glycine max
  Peptide Sequence Number=SeqID_231132
atgcaatttggaatgcatcaagaagtttcagattgtgtaattgcattgtctggcaccaaagctattgcattgaaaaactactgcatatcgaaaattgctttaaaaaattgcaaacaatattacttggcaaaaaagcagtctaaagctactctgtcatcatggacctcatacactgttgacccaagagatggaggctttggaggaagactatcgagatggaaatgggaaaaatga

SEQ ID NO: 114355 - DNA, 657 bp, Glycine max
  Peptide Sequence Number=SeqID_231133
atgaaacaacttcaccatccatcagcattagacatgtttgacaaaattattgacgcgtcaaagggaaaacaatttgtcatgtttctggactatgatggcacgctgtctcctatagtcgacaaccctgaccgtgctttcatgtgtgattcgatgagaaaaacaatgaggaaacttgctaggtgtttccctactgctatagtgaccggcagatgcaaagacaaggtgtacaattttgttcgattggcagagctatattatgtaggaagccatggcatggatattaaaggaccaacaacaacctccaaatacaacaaagatagcaaagttgagccaatcctttgtcaacctgccagtgattttcttcccttgatagacgaggtgtatcaacaattagttgaaaagacaaaatcaactcctggagctctggttgagaacaacaagttctgtctttcagtccattttcgttgtgttgatgaaaagaaatggagtgaactggcacgccaagtgaaatcagttttaaaggagtacccgaagcttcgacttatccaaggaagaaaggtgctagagatttgtcccactattaaatgggacaaagggaaagccttggaatttttattagagtcactagataatgcacatgagtgtggaagtgcataa

SEQ ID NO: 114356 - DNA, 234 bp, Glycine max
  Peptide Sequence Number=SeqID_231134
ctagcctcttctccttccaatcaaccccacgacgtggagcaacttcccggctcaaacttccaagttcgtgaacaacttagtttgcatcaaggagtggcagtttgtcaacaaggacattggagtcaagaaaccagggaacatattcaaacaacaactgatacatacttcactgggctgcaaacggatcagtgtgtatttgttgattttatctacttgatggatgctcatatatag

SEQ ID NO: 114357 - DNA, 345 bp, Glycine max
  Peptide Sequence Number=SeqID_231135
atgcatccttattttcctaattcagaagatccaaggtttccaacagctttgggtgtaggacacaatgatcagaaagttcttgttctagcaactacaaatacaccttatgctctagaccaggtgcacctaggagatactccccataacttggctgaaagtgattttgaacatttgactcgcaagacagaggggttttcaggtttagatatatctgtctgtgtgaaggatgttttatttgaacctgttcgcaaaacccaagatgccatgtttttctttaggaatcctgatgatatgtggatcccatgtggaccaaagcaacagagtgcagtacaaactacaatgtag

SEQ ID NO: 114358 - DNA, 285 bp, Glycine max
  Peptide Sequence Number=SeqID_231136
atgcgccatttcccaacatgcagggtatcccgctataaagtgaagtatgacaaatgtagtgatgatttagccacaaaaaatgatcatccatcaaaggtgtgttggtatcttccaataataccaaggtttaagcgattgtttgccaatagagatgacgaaaaaaccttacatggcatgcagatgacagaaaaaatgatggattgcttcgacatcccgttgattcttcctaatggaagacaattgatcgcttgtattcggattttggagaggatccaagaaacctaa

SEQ ID NO: 114359 - DNA, 222 bp, Glycine max
  Peptide Sequence Number=SeqID_231137
atgtacaagccgcacctgtcagaatcacctgtatcaggattgtttcctgagggatcaacccaactcccctttgtgctcagcgaggaccggagggaccaggaccaaccagaggctcaggaggtgcctgagactgcatctgtgactgaaggatatttgcagctaatgaacaagtttcttaactatttgtccttaagattttactgttttttttcttatatgtaa

SEQ ID NO: 114360 - DNA, 438 bp, Glycine max
  Peptide Sequence Number=SeqID_231138
atgtatcgagatgcgtttggatttgcagatattattggtggcaattggacatccgagtcaagatatgaccatttggatttgcagaaatcttctgttttaaatttccagcgtctcgataaattatgggctgccatcggacatccgattcaaaagatatggccatttaaatttgccgagagcttccattttcatgttcaaaaattgataaattttgggcggccatcggacatccgagtcaaaagatatggtcgtttgaatttacctagagcctccgttttcaagttcaagcatctcgatatatcatgggaggccatcagacattctagtcaaaacatttggacgttcgaatttgcccagagcttccgatttcaatctctagcgtctcaatacattacgggcgataattgtacattggagtcaaaagatatggacgtttga

SEQ ID NO: 114361 - DNA, 369 bp, Glycine max
  Peptide Sequence Number=SeqID_231139
atgggaggccatcagtcatctgagtcaaatgatatggacgttcgaattttcccagagctttcgctttcaatctcatgcatctcgatacattacgggcggcaatcgtacattcgagtccaaggatatggacgtttgaatttgcccagagcttcgattttcaagttcaagcgtctcaatatattatgggcgaggttcaattttcaatctcaagcgtctcgatacattgttgatggtaatcggacatccgaatcaagatatgaccgtttggatttgcctaaatcttccgttttaaagttcatgcgtctcgatacattatgggcagtaatcggacatccgagtcaaaagatatggccgtttgaatttgcctag

SEQ ID NO: 114362 - DNA, 354 bp, Glycine max
  Peptide Sequence Number=SeqID_231140
atggtcttgtctatcaaaaagtggccgatgagcctaccctcatggctctctttcacaatgattgatgatcactatgaatggcaaattccttggaaaaaaggtaatgttccctgtcataccctaatttcgtccggggacctttgcttgatgacatgcgacctttctttggtccttgtgaggtgcttggcacccatcattaggcaatttgtgaaattccaggacatgccgaaaaaccaaaaaaatattgatgcacaatccctgggttgcttctggaggaagcaacccagctcgcctaggcgagctaaggtcgcctgggcgagctgggtggcaacctcctccctctttttcctataa

SEQ ID NO: 114363 - DNA, 309 bp, Glycine max
  Peptide Sequence Number=SeqID_231141
atggtgtataggggaaggcaggacgcgtccatcataagtgttaggaatgacatgccatttgctaagattacaaatatttccggtatgagtggcatgactcatagtggacgtatttttgctgctcccgaactactggcaagatcaaaagacaagggaaagctgaaggcggatataggcgagaaggagaggacaggcccgaccgagaatgacgaggcctttgttggaaaaattgtagaggaaggaaatgactttagcaagagggagatatcagctgaggaggcgactgaatttctgagaatcattcaatag

SEQ ID NO: 114364 - DNA, 279 bp, Glycine max
  Peptide Sequence Number=SeqID_231142
atgcgcttagcggataggaggaatttggaagggaatctgtcacgcaggcaagtgcttagcacatcatcagctcgctcagtgagtcgtttgtcaccttccaggcttagcgcgactttggcgttgagagaacattcacttactcgcgctaagcgcgagaatggtgctaagtgcgacgtcgaggtcaaaaagagagagatagagagagcgttgaatagccgtaagagcttgaagagtgaaatacacaaaggcaaagaacagatcaaagaagccaagttttga

SEQ ID NO: 114365 - DNA, 206 bp, Glycine max
  Peptide Sequence Number=SeqID_231143
atgttgataatcattgatcaatataaggaagaggtgaacctagttgctagtcatgggcagatgctggaagatgatcaggcaaaggtatcggttatgcagattgaaagggaagcaggagagagggtgatagagttattgcacggggaagccatgaaatggatgaatagattcgctctcactctgaatgagagtcaagagcttccaag

SEQ ID NO: 114366 - DNA, 380 bp, Glycine max
  Peptide Sequence Number=SeqID_231144
ggattgcacccataagacacccagtggacccggaggagcccaacagggccctggggtttccagctctggttacaggcctctgtcagtcctacagggtgcccgtccccccagcaaggtcatgccatcgtgacatagaattccaacaaggtcctggggtttccagctctgattacgagccttttcagttctacgaagtgcccgttgccaccagtaaggtcatcaggccccctactaaccgagctttcatcaagaagtattgcacctccaggcaggcgcagggcaaaacaccacaacaacctggggatggccggcagcgggcaatagacgcaccgccgccacctctagagcccctcagctcatctacaagggatggagcttag

SEQ ID NO: 114367 - DNA, 294 bp, Glycine max
  Peptide Sequence Number=SeqID_231145
atgccttcgctgccgctggcctgccgcacaccgtgcgtttcgagccgaccccgacccgccgcgtgcacctggtctggcagcggctgccgacaccggcggcgcgggcgttcgtcgaggccgtgctcagccgcgcaggcgcaggctcaggcccttgaggaaattgcgcagcatctggtccaggcaacgccggtagttggtgtggccgggctggcggaacagcgcgcccacttccgacttggacacgttgaaaccggcgctggcgaagatctccatcagatcgacgtcgcgcagctg

SEQ ID NO: 114368 - DNA, 717 bp, Glycine max
  Peptide Sequence Number=SeqID_231146
atggcagcgttcggcggcgcgggtgaagttgccttcctcggccagggcgacggcaaactcgagctgcttgaggttcaccctgctatctcgtttccagatgacagggatgatgatgattcatttccatcatcgctgcagcaggcggacactgtgcaccccgcttctctggaacaccgcgtgagttggcatggtggtcactgccgcacagctgagctatgccgccggactgatcctgctggtgccgctgggagacctgttcgaacgccgccgcctgatcgtggtgatgagcctgttgtccgccggcgggctggtgatcagtgcctgtgcgccgtcgctgacctggctgctggtgggcaccgcgatcaccggcctgttctcggtggtggcccaggtgctggtgccgttcgccgccacgctggcggcgcccgagcatcgtggtcgcgtggtcggcacgttgatgagtggcctgctgctgggcatcctgctggcacgtaccgtggccggcctgctttccagcctgggcgactggcgcctggtgtacgcgatcgccgccggcaccctggtactgaccgcgctggcactgcagcgcgtgctgccgcgcttccaccacagcgccggccttggctacttcgcgttgctgcgctcgatcggtgtgctgttcgtacaggaacccgtgctgcgccagcgcacgctgcttggcgcttgcagcttcgccat

SEQ ID NO: 114369 - DNA, 309 bp, Glycine max
  Peptide Sequence Number=SeqID_231147
atggaaataagagatgaatttctagatgaatccctattcatgatgagtgagagaccttggtttgctgatttggctagctttaaggcagcaagaattatccctaaagatttgacttggcagcaaaggaagaaattccttcatgatgcttctttctatgtatgggatgatccttatttgtttaagataggtcctgataacatattgagaagatgtgttactaagaaagaagccaaaaacattctatggctttgccataactctccatgtggaggacattatggtgaagacaaaatagcagccaaggtctag

SEQ ID NO: 114370 - DNA, 849 bp, Glycine max
  Peptide Sequence Number=SeqID_231148
atggtattgcactcttctttggaaagagcactggttaatcatgttgaatgtctgaccaaggaggaggaacatgaagtgcaaacttgcattcaagagttagatgttgtaggagaaaattctgagagacatactgcgtttgaagaattgaataacagtgggcaagtagaaaaacctaaagtggaattgaaaactttgcctgcacacttaaagcatgtattcttggaagataatgaatccaagccagttattattagtagttctttgaatgaagcaggaatgacagtcatcaaaatgataaggatagtgcttgggaggaatgatagtcatcaaaatgataaggatgaattgatatccacaaggactatcactaggtggagaatgtgcattgattataggaagttgaatgatgccactcgaaaagaccattatccattcctcttcatggaccagatgcttgaaagactagcagggcagtcatattacaattttctagatggatattctggttataaccagattgctgtagaccccaaggatcaggagaagacaactttcacttgcccttgtgctgtatttgcttatcggtgcatgcctttcggtctgtgtaatgctccagctacattccagagatgcatgatggcaatattttctgatatggtggagaaatgcatcgaagtttttatggatgatttctatgtcttcggatcatcttttgatggttgcctatcaaatttggaaaaagtattgcagagatgtgaagagtctaatttggtgctcaattggggaaaatgtcatttcatggttcaaggcatagtgttggggcataaaatctcagtgagcgtgtcatag

SEQ ID NO: 114371 - DNA, 207 bp, Glycine max
  Peptide Sequence Number=SeqID_231149
atgatcgcccttcaagtaaaagaatcacttgattcacgcataaggaagaactacgtaggtctgatttcctcttcaatggagggtgaattggttgcattggatttagaaattgaagcaacctttagaagaaacaacacagagagaaaaagaaagcttttgcacgatagaacagtagcatcaagccgtgaagaggctcactttttttag

SEQ ID NO: 114372 - DNA, 531 bp, Glycine max
  Peptide Sequence Number=SeqID_231150
atggttattgagtttgaccttgaacttgagcaaataggtgtaaaaagaatatttttgtttggagagatagatgaaactatcctcatgagacagcctgggggatttgaaatcagaggcaatgaggattatctatctcaagaaacatacctcaagaaagttcttgaaacgattagaatgtcaaatttgaagcttgtagtgatatctacatctcaacaattcaaattgagtgtaagtcaatccccaaagaaaattgaagagctaacttatatggaaagtatcccatatgctaacattgcaggctcaataatgtatgctatggctttaaagtggatcctaagatatatcaaaggatctcttggtagagttctagtttatggtggagccaaagacaaaaaaggaacaacaactattgaagggtttgtagactctgactatgcatggggcctagatactagaaaatctctcactgtcgaatacatggttgtgactgaggctgtgaaagaagccttatggcttgaagggattgcttaa

SEQ ID NO: 114373 - DNA, 216 bp, Glycine max
  Peptide Sequence Number=SeqID_231151
atgtcgagcttctcgatgtattatgcgcctgaatcggactttcgtgagacaagttatgaccttttgaatttctcgagagcttccggttttcaatttagagcgtctcgatatgtaatgcaccagaatcggtcttccgtgtcacaagttatgaccattggaatttgtcgagagctttcgatgttcaatttcgagattctcgatgtattatgcgcctga

SEQ ID NO: 114374 - DNA, 270 bp, Glycine max
  Peptide Sequence Number=SeqID_231152
atggtgatagcagcaccgacggaggtggcgtcagggcacaccagcagaactgcaaacgcatggcggcgcaggtggtgtggttgtcggagacaaaggaacactccaccgaccaatagatctaccacaaaggtttcaggaaacaccatgggatgctacaccgccaagattcatgacccaaagaagaaatccccattttgctcgacaccttcgacatcatcattggaccttcctccctgtgcgtggattgggagcaggggtcagagattctaa

SEQ ID NO: 114375 - DNA, 1137 bp, Glycine max
  Peptide Sequence Number=SeqID_231153
atgattgagctgaaacacaggagagaagataaagtaaacagggcttcgcagtttctgggttctgttctaagaaaataccttccggaagaatgtgttttaggtccggaaaggtctcagattgcaaggattaataatctgtatcagttccagatattactgaaacttccccgtggaaaaaactatgaaaaatacaaagagcaggcttatgacaatcagaaaacgaatttaaacttaccttctcctataacttctgttgtggagaaaacaattctgtcggctaaagaactcgtagatattaatgtaaacactctggtttccgatcctgtgctgaaaaatgcatcatggggatttgtagtgtacgacccgaaaacaaagaaagtaatttcttcatacaatgaaaacactcctttggttcctgcttctacaacaaaacttttgaccacagaaacagctttgaatctgttgggagagaactatcgttggatgactcagctggaatactcaggaagcatagatgaaaacggggttttaaatggtaatctttatgtcgtaggaagcggggatccatcgcttggaacaaacaaaggcggagcgttatcctatagagagattgtttcagattttcttagtggaatctctcacgaaggaatcaaaagggtaaatggtgatattatcatccagacagcacttttcaaaggtaatatttcaagacttccggaaaatgttgtttggttggaaaataacaactattatttaccggttggaaccacccgtgagattaatccggctaatgaaaaactgattgtaaagaaatcaggtaatttctctactgagaaaaagtatttttatgtatctccttatgccaatcagatggtatatgcggataaatatgaaggagatggtgttcttaccactaagctacctgatgccccggcatatcttgccaatactttaagggcgaccatggtgaaaagtggaattgcagttagtggaaaagttactccgaaaatgacagatcctatgccggagagcagaaagctgatttcagcatacaaatctccgactttgagcgatattatttattacaccaaccagcatagtgataattctttagcagaagcactgttaaaacagtag

SEQ ID NO: 114376 - DNA, 233 bp, Glycine max
  Peptide Sequence Number=SeqID_231154
atgaaatgttgatgatgctgaaaatgcattgtgatgttgttatgttgtgtatgtaccttgggggtgcagtgaccttgttggatatccctgtgaccttgttggatatccctggtgggggaaatagagtggatgacctcgacacttactgcctagttttcctaagtgagagtgtcgtgtggacacgcttaggctatttctttagggatggtaccacattgcatttgagagttgag

SEQ ID NO: 114377 - DNA, 195 bp, Glycine max
  Peptide Sequence Number=SeqID_231155
atggggaaaagaaacatagaagaaacaccgtacagatccaaattaccacatgacaaaaaagaggtcagaattccagcagacaagcattgtgatgcacctccggaagatatagaaccttgccctttgctccttagcaagcctagtgcatctccttccaaaggatttgaatggttcaaagacatgtctagtgcatga

SEQ ID NO: 114378 - DNA, 177 bp, Glycine max
  Peptide Sequence Number=SeqID_231156
atggatggatggttcattgtttgtatagatggtggtaatctccatggtaaggatgatttcttcttcaagcttagtgagccattagctgagcacaccactcctgcagctgagtgcgaggaagaatctggaagaaggatgagttggacacatgcgctaagcgagggctcatcccgctaa

SEQ ID NO: 114379 - DNA, 276 bp, Glycine max
  Peptide Sequence Number=SeqID_231157
atggatccttctcaagaagtaacacctccaaagcttctacctgttaatctagttgatcttaatatcaccacttctgagtactccatgttgggtggactacatgcccaaatgaacacacgcaatcaagcaattgaatgtcctcctggtttacacatatccaaggccacttacatcaagatcattgcaaataaagtatgccctcttctacccattttggatgcaactaagaagaaaggattcaaactctatcactatgttgaaatgcctattaggtag

SEQ ID NO: 114380 - DNA, 288 bp, Glycine max
  Peptide Sequence Number=SeqID_231158
atggaaggtaaaaaagcgattcagattaaacgtagaattagtttcaatgctttgaaaaaaaaattggagataagatttttagtttctggaaaatatgttgctttgcaaatttgtgatgacgaagatgttgaaaccatactcgaaagttttcaacaacaagatcaaatgtcagatatggaattatacatagaaaaggatgtggctggtggttctatgtttcattctgcaaattctcttacatcatgtggaaataaattatctaataatgaggcgcaaccgccaagaaat

SEQ ID NO: 114381 - DNA, 768 bp, Glycine max
  Peptide Sequence Number=SeqID_231159
atggcggccgatcgcgcgcagcagctgacgcagctggcgcgtctggcctttgatcgcgcgtttattacggtactgatcgccgccgcgctgttaatggcgctgggcgccggggcggagaagattattatggcaacggcaaagaaagcagcgaaaacccatatcggcctcgacagtaaacaatcggcaaaactcgccgaagcgctgaacgcgctgttggcgaactatcaggtgctgtatatgaacgtgcgcggctatcattggaacattaccggcccgcagttctttgaactgcacgcgaagttcgaagagacatataacgatctgctgaccaaggtggacgagctggcggaacgtattctgacgctgggctcgcagccgcgtcacgctttcagcgactatctgaaaaccgccgacatcaaggaacacaccaacgtgaccgatgataagggcacgctgcgcggcctgttggaagggtattcaatcttgctgcaacagcagcgtgaactgctgacggtggcggcggacgccggtgacgaaggcaccgcgtcgctgatgagcgattacatcaaagagcaggaaaaacaggcggcgccgcacccggatgatatggcgattgctgcacgactggcgctccagccagcgatgccggcggcgttggctctgccgcaacatgcgccagcggcccacttcatttctactgcgtctcataattccgtcactcgttcgtctaatgccaaccgcgggcattatagccctttccgcccgtga

SEQ ID NO: 114382 - DNA, 396 bp, Glycine max
  Peptide Sequence Number=SeqID_231160
atgcctttggcttgggaggtgcagtccctcaaagaagtaccaagggtttggaatcatgacttcttctgggaatccatgcaaccaggagggggtgatatgcccaaactaggtctccttcaacagattgaaaaggattttggatcatttacaaattttagggaaaagtttattggagctgctctctcattatttggatctggctgggtttggctagttttgaagagagaagagaaacgactggagatagtcaaaacttcaaatgccatttgcccaattgtgtgggatgacataccaattatcaatttggatttgtgggagcatgcatattatctggattacagggggtggcaatggccatatggcatcttaggtggagttgataaaaggaatgagtag

SEQ ID NO: 114383 - DNA, 171 bp, Glycine max
  Peptide Sequence Number=SeqID_231161
atggtttggccgaaaaatgttgttgaagaagccttgattggccgctttggtgctcgcgatgacttcgcttctcctgtttctacttccccatccgccgatgcatggcctcggtgttcaattttgccagaggttcagagaaggaaccccatcggcaatgatctggttccttaa

SEQ ID NO: 114384 - DNA, 369 bp, Glycine max
  Peptide Sequence Number=SeqID_231162
atggaccagatagttgtgagtgtccagaagagcgggaggcggagtgttcttcgctctcagttgagtagtgtagctagtcaattcttttttaggcatgtaataatggttttggttgaaggtttgctgttaagggagtcgattggagacgggtctgaggttcatgggtatgacaacaaagtttttgaagtgtcatctgactcttacttctcagtgtcagatttttctagttcaattaacctctcgacaatcgaggggtctagtgacctttcgacattttttagccaattgccgacaaatatgggtgaaaaggtgggtgagaatgttgtggcttcggtggtggatcccattggcgagacggggacttcttaa

SEQ ID NO: 114385 - DNA, 588 bp, Glycine max
  Peptide Sequence Number=SeqID_231163
atgtcaaggttcagaaacgaggtccgacaagtcggacaaaagcgggacaaaagagaaggaggtaccaggaccgacttacacaagtcggacaaacaacgcaagccaaacaagtgccaacttctcccaaggggacccaagtatgagtgctacacacccttgatgaccaaccgaaccattattcttgaggaagcctttaacacggaggtacccataatgctacctctaccacttccttacagaccaaggaaaacactgaacaaacttagagccatcgtctccatgccgcatctcatgatgaaattcctaaccttgaggggagagattgtgattgccaaggcagaccaaaagcaagttcggcagtgctatgttgaaagcttgaaagtggctccctatcctcccactcgagaaccaatcaggcctcatcccacagctggtggtagcctattgatgacactcttgaaagtgctgaagctcttgataaaggcccaaagtctattgaagaacttgtcaagttgcagctcggacccaaacccaagcaatgcacacagcttagctagaaccttaccagccatgagtacagacacatag

SEQ ID NO: 114386 - DNA, 288 bp, Glycine max
  Peptide Sequence Number=SeqID_231164
atggtcatgaagtctcaaagcataacccaacacatgacagacttagaagaggtgttcagtgaaatccgtaagtacgacatatgcctcaacctggaaaatgcacttttgggggttaaaggtggaaagtttgtggggttcatgatcacacatcggggaatagaagccaaccccgacaaatggacaaccatactaaaggtgcacaatcctaccaacatccaggaagtccagaagctgaacggtagactggtatccttgtccaagtcctctcgaagctcgccaagaaagtga

SEQ ID NO: 114387 - DNA, 946 bp, Glycine max
  Peptide Sequence Number=SeqID_231165
atgagggctggaggttgcacagcagctcgcccaagcgagctagttacttcatccctaagctttctgggacacattcatcctggattttggcaaggctcacaaagggcagaccttaggtttgttgagcctttggagttgcgagactcaccaaggatggaccttgggtttgatgagcatttggagatgcgagactcaccaaggacgaaccttgtgtttaatgagcctttggagatgcgagattcaccaaggatggaccttggggtgaaccttggatttgatgagcctttggagaagcgagactcaccaaggatgcaccttgggtttgatgagcctttggaaaagcgagcatgggtggaccttggatttgatgagcctttggagaagcgagacttaccaaggacagaccttaggtttgacgagcctttggagaagcgagacttaccaacggcggaccatgggtttaacgagcctttggagaagcaagactcaccaagggcgaaccttgggtttgacaagcctttaatttggagaagcgagacttaccaaggatggaccttgggcttggcgaacaatgataagcccaaagtatgctggggagttcctccttccatagacccttgggcttgtcatcatcgtcaagaactcttcataagcttgacctttgaattgagtattgttgtcgatgataatggcataagggaggccatatcaacatatgaggaacttgaccgctcttggggattttggcaatggtcccaaaatgtccatcccccacacggcgaaaggccaaggggaactttattaggaggtgtcaggatgggtgcgtggaacgtccgtgaattcttggcattgtctacacctcctaataaagtcgagggtgttggccttgtgtgtcgggcaatactagatgacacacaccacctttgtcataagggagcgtgccccg

SEQ ID NO: 114388 - DNA, 1186 bp, Glycine max
  Peptide Sequence Number=SeqID_231166
taccctcaccttcagagggctacatgccctcaccttcagagggctacacgcccttgccttcaaaggactacacgtcttcaccttaaaagggctacacgccctcgccttcagaggactacacgtcctcgccttcagagggctacacgccctcgtcttcagaggactgcacgtcctcaccttcagagggctacatgccctcgccttcagaggactacacgtcctcgccttcagaggactacacgtccgcgccttcacaggactacatgtccttaccttcaaaggactacatgtcctcaccttcaaaggactacacgtcctagccttcagaggactacacgtcctagccttcagaggactacacgtcctcgccttcaaagggctgcacgccaacgccttcagagagctacacgccctcaccttcacaggaccacacgtcctcaaaggactacatgtcttcgccttagaggactacacgccctcgactttagagggctacacgctctcgcctttagagggctgcacgccctatccttcaaagggtgacacaccctcgcttttagagcactacacgtcctcaccttcagagggctacacacccacgcctttagaggacaatacatcctcaccttcagagagctgcacaccctcgcctttacagagcgacacgcccttgcctttagaggactacacatcctcaccttcagagggctacatgtcctcaccttcagaggactacacgtcctcgccttcagagaactacacgtcctccccttcagaggactacatgtcctcgccatcagagggctacacgtcctcgccttcagagggcaccacaccctcgccttcagagggctacgcgcctttcccttcagagggctacacgccctcacctttagaggactacacgtcctcgccttcagagggttgcacaccctcacctgcagaggactacatgtccttaccatcagcggactacacgtcctcgccatcagagggctgtatgccctccccttttagaggactacacgtcttcgcctttagagggctacacggcctcgccttcagagggctacgcgccctcgccttcaaaggacaacacatcctctccttcagagggctacatgctctcgccttcagagggttgcacgccctcttcttcaaaagggtgacacaccctcgcctttag

SEQ ID NO: 114389 - DNA, 441 bp, Glycine max
  Peptide Sequence Number=SeqID_231167
atgtttcctttcgacttccggcatgtcgcggaacttcgcggattgcctaatgatgggtgccaagttcctccaagcagtcatgcgaaggtcgcatcccagcaaacagatggtccccggacaaaattagggtatgacaagggggtcgccatgtttgatgggtatcaaaatgagacattcaagttgcgtgcaatgctattttgtaccattaatgtctttccaacatacgagaatttgagtggatacaatgttaagggaaattgtgcatgccttatttgtgaagaaaacacaagctacgtacaactgaaacatggaagaaaaatagaatacactaggcatcgacgacgtcttcgaaaaccttatcacccttactggagattgaaaaaagcttttaatggaagacaagagcatgaaagtgcgctaaaaccattaactggtcaatag

SEQ ID NO: 114390 - DNA, 486 bp, Glycine max
  Peptide Sequence Number=SeqID_231168
atggatgtgtatgctatgttggactatcagaaactaatgaagatgcagctttctttaaatgactgtggaagattcctgaaccatctaaagtgcaggcttttgcttggagattatctttggataggatacaaactaagcaaaactcctcaagacaaatattggtggcttgtatgcaagaatggaaattgtgaagaagacaacagagagcttcatgacacaagcagcaggctcatcacttcaacaacgttgaattctggcccagatgtgaagagtgggtgtcttcatgagggaaatttgaacaggaccccagcacctaaatttcgtggagtacaagtgttcacatatagggagttagaaattgtcactgatggattcagcgaagcaaatgtgattggtagtaatggaattattggagggcatggtttgatgtatagaggtgttctacgtgatggcactatggcagcaattaatttgctttgcacttag

SEQ ID NO: 114391 - DNA, 985 bp, Glycine max
  Peptide Sequence Number=SeqID_231169
atgacatcaaggaaaaggaagagcactgcttctaggccacaggctcagtatgataccaggagattccaatccttggaagcctggaaccgatatacagataacattttggaccagaggatccttccgaaaaggaatgttaagatttatcatactaaattcgacgagtttaaggcagagttggagaggcttaacctacacaaacgcctcgccaaccttcaagagggaagcatagatgtggcggaggttaaagaattctatgccaatttatacagcctagaagaccagagccctaagcaagtgagggtgagaggacacttaatcaggattgatgctgacagcctgaataccttcttagagaccccagtagttttggaggagggtgagacactgcctacctattccagatttacgaggatgaggattgatcctcaagagtttgttgcccctctttgcatccctggtaggggttttgttctgaatgcagagggccatccttggaagcttttgaggaaagatctcaccactcttgcacatacatggagtgtcctctcctactacaacctgactcacacttcccacacctctgatcttagtatggacagagccaagttggtttacagcttagtcacaggcatggacatgaatatcagagccctaatctcaggtcagatttctatcattgcccagagtaactcctctaggcttggatttccagccttggtcactgccttatgcagagctagcggagttacctctggcagtctgacctatgagagcctgagctcggccattaacttggcctacattaagaaaaactattggaatatgaatgatctagcaattaacttcagagggtccaggaagagcctacaggtggtaggtcctccagggtccattctatcagtagagcagttcattgagaaggtatcctggcctggaaccttactttctactgtgggagagggtgagggcccccagtgctcag

SEQ ID NO: 114392 - DNA, 300 bp, Glycine max
  Peptide Sequence Number=SeqID_231170
atgcggaacaagttgatccacaagcttcatgcggatcaacttgatccacatgaaggaacttcatcgaaaatactcctgcggatcatataccttgtacttgatccgagtgcttacctcgacaatggtgacgtgctgaagaagaagaagaagaaacgaacaatggcgccacggagggagcagacaacgatggagaacagagagttgcggatcaacttgttgggtcgcacacggtcgcaaaagaaggagcaagaaggagtcgcgggaagaagaaaagccaattgttgggtgcaaatgttttaa

SEQ ID NO: 114393 - DNA, 627 bp, Glycine max
  Peptide Sequence Number=SeqID_231171
atgtataagccaggtcctaaaaacaaggcactagatgctctcttgtgtcaaatgggttcagtggaatttagggataattccataagcctattgtgggtggattttcccaccattcacaccaagattcaacaagacacagagcttagcaagctgccttcccaaatccagaatgatccagcctcgatgctgcaatatgttcaaggagatggtctcgtcttcttcaaggggcatttggtgttgcccaaaacccatcgagaagactcccttcgaggtcgtctatggttgatcacctccttttgtgctatgcttttggccagagagacattagtgggttctatcacgtcagtattgtttgacagggacaaggctatgcatcaattaaaagctcatttgctttgtgcccaacaatccatgaataaggttcacccactttttcatgtgtcacaactcaagaaatccgtgacaacaagctccaatgtctctactttaccccttagtctgaccatggaagaatcagattttccttttcttgaagttgttcttgctacatgtgagggcaaaactaatggaagttgtgaagagaggttgatcttatggaaatcccaaccaatggaggaagctacgtag

SEQ ID NO: 114394 - DNA, 546 bp, Glycine max
  Peptide Sequence Number=SeqID_231172
atggcctgcacaaaaaaatcaggtcaaatggtgtctgaggcaacaaatgaaatggcagagaggattgattccctagaggagcaggtctcacagggaagctttgttgctcatggacgtcaggatgtattgattgctaccattggacgactagagcaccttggtcgtgtgtctgctgccggagctggtgtcacaatcaaaaactactttggactgacttcaaggggcttttgcacctcttcgtccatggctgctgaagacctagagcagggaatcgcactgccttttcaggctaaggttggtccttttgttgctcatgtcagcacaaaagaaagttgtgtcgatccctcggggcatgacccagaaatggaagactcagacaaatgtggattgtatgttgatgacagtcctccccgactagttgctcttagaagagtttatgaggggtcgatgactatccataacgttcctttgggcaatgatcaagtgaaggttggtgttgaggaagtccgacatgctgatgctcgcgttcctgtacccactcaagag

SEQ ID NO: 114395 - DNA, 336 bp, Glycine max
  Peptide Sequence Number=SeqID_231173
atgctagatccgaaggtcaatgatccgctttatctgatgacattgaccatcccagagcttttcttgaggccttaccaggttacatgggatgccaccatgttcggggtctttaatccagacttcccgctctacataaagcatgaagacctctccaaaatcgcacatggtggtcaatgtctcagcatatcagtgttatggttgtggattctacatctgactgaaacaaagttcaaaacgcgatgtctaccttggaacctacctgaatggcggacactagaagatggtggtcatcctgcccaaggaacacctagttgtctggttttgttcattgcataa

SEQ ID NO: 114396 - DNA, 618 bp, Glycine max
  Peptide Sequence Number=SeqID_231174
atggctagcaacccctccagagctcagaagaaggccaagcttgatacatggttcacaaacgagaataaggagaatgacttcaagatgctatacacagtgaagaatatgagaatacccaagtttctagacttggagtggttttctcagcaagggtttaactttcctgatttgctagaagcacagggtttgtccaagcttgttcagatgaaaggaactttctacctggtgttggtgaaagttttctatacttgtgtctacgctgatatggaaggtaatatgttttctactgttaatggtgtagaaatggttattgaagctgcagttaggaaggcaatagccagactagacataggtggagtctgcaagtttgaagaatctattgatggttacagtaagatgcaaaattatagagaagatgaagctcggcaagagcatacaaaccaatggagtccttttgagtctcttatgatttcaaagatggatgccatgcttcaccttcatcaagagcactcagttgatgttcacaacaccttagaaaacatcaccactaagctagagaacatagaaactaggctaacccttagtaaccttcttaacccggatgatgatgaaacataa

SEQ ID NO: 114397 - DNA, 483 bp, Glycine max
  Peptide Sequence Number=SeqID_231175
atggtgcattgtttggtgaatagtggtgatatcgtagcgacgaagcgagttgttacagatgaggctgctatgacttttgtggcaactttgtctattggagagcacaaaaggaaactagaagaagattcaagattggatgccttagttgggagggtatctgaagaaattccaaaatttgtcgttcaggaatctctaaagaccttatctattaaggaaatgcagagaaaggctgttgaggaggccaccatgatggatacaaatggtgagtctgtgcttgaaaaagtggtgcttgagtctgtcatagctcacttagaagatgaagtgcaatctaccacaaaggatgaagctgtactaatgcctgtatctgttgctgaaagacaagtagagatagaagctaccatggttcctgaagacatggatcatgaaaagaatgattcttttgaagaggatatgtttaagtttgtcattaaagcatctctatga

SEQ ID NO: 114398 - DNA, 570 bp, Glycine max
  Peptide Sequence Number=SeqID_231176
atggtgtacggtggtccacattcaatcatagacgataggaaggcaatgattaggttcctaagaactgaaaacctaacctacatgtgcatactaattcatagcatcctgttcaacatggtgatgcccagattggggtcgcaagactatgttagtgataaggacatattatgcatgtataagttatggtgggagagaagaagcatattaagaacaagatcaagaaggagcctaaggaggaaccactgtcaatggtgggtcagacaatggccacaagaatttgtatttgcgattcttgcaacccctcagcctaagccagcttcaccatcaaagtgggtgaagccgatttgggtgaagttcgagaagtctaaggtggaaaggctaaagagggtgaaggttatgtgtaggaatttcaagaatctcaaattggcttcacccactttgagcaaaaaggaagttgttgccttggaaaaggctaagaagaagtccttatttgaaacaagaaagaaggccaaggttgataaatccttggagaaaaaggaggcattcaacatggatgatgtaacaccctaa

SEQ ID NO: 114399 - DNA, 1044 bp, Glycine max
  Peptide Sequence Number=SeqID_231177
atggttactactctttctgaagcctatagggaccaccctctccaccttcatcatattatccccttagacttttcttcacttaggaccatacctgattcccatgcatggcctcaatctgaagatggtgatgatgataatcatggagctggatcatgcatacccatcattgacctcatggatcctagtgccatggaactcataggccttgcttgtgagaattggggtgccttccaattgacgaaccatggcatacccttgagtgttgctgaaggggttgaagaagaggcaaagaggctcttcgcactccctgccgaccagaaactgaaggcattgagatcggccgccggtgccaccggctacggccgagctcggatatcaccgttcttccccaagcacatgtggcatgaagggttcaccatcatggggtctccatgtgatgatgccaaaaagatctggcataatgactgtgcacggttttgccacataatgaacaattaccagaaacaaatgaaggctctagcagagaagctaacacacatgatattcaacttattggggaatatttctgaggaacaaaagcggtggattggttcaaccaacctctgtgaagctgttcagttaaacttctacccttgttgccccgagcctaaccgagccatgggccttgcccctcacacagacacttccctcctcacaatcctccaccaaagccaaaccaatggcctccagatcttccaggaaggagcagggtgggtccctgtgcaccctcaccctggcaccctttttgttcacactggtgacatacttcacatcttgtccaactcatggtttagatgtgcactgcatcgtgtcatggtgaatagtatgaggcaaagatactcagcggcttatttctatgccccccctatggatcatgtagtttctcctttggttcttgattccttgcctcggtttcgttccttgactgtgaaggagtatattggcattaaggccaagaaccttgggggagcattgtcgttgattagtatgcttaataataactaa

SEQ ID NO: 114400 - DNA, 330 bp, Glycine max
  Peptide Sequence Number=SeqID_231178
atggaagatatggttgatcatttggagcaaaagaagatcatgatggcctttgaggagcctattagactgattgatctctttgctcaaattgacaaatgtttaatgaggaaatatcaacaacaagccattgaatgcattcttccttcaagaccttttcctccatctccacagattacacctattaagcctcatgttaatgacaaaacaaggattgaagaaatttttctgccagaggatatcactttggaggatcctgaatatagtcaaaggttttcagaatgggagaaaactgactatgaacctgaactgagaatgaagttgtcatgctaa

SEQ ID NO: 114401 - DNA, 432 bp, Glycine max
  Peptide Sequence Number=SeqID_231179
atggcttctaggaaaagaaaggcaccttctacgcctacccaagtcagatttgacagatccagattcacttcccaagaggcttgggaaagatacgcagatgttattgtgcctaggaagcctttgcttgagaggaacatggttgtttataccatagagtttgatgaattcttagatgagatagcgagacgccactgggatgaggaattgactgatttcattgatggtagcatcgatgttgccattgtgaaggagttctacgccaacctctatgaccctgaggacaaaacacctaagcaagtgcaggtgagaggtcatttgattaagtttgatgaggacactcttaacacatttttgaagacccctgttattgtggaagagggggaatcactatgtgcttattctagatttgcactcctgaggcatgatccttag

SEQ ID NO: 114402 - DNA, 306 bp, Glycine max
  Peptide Sequence Number=SeqID_231180
atggttgagcaatcggtgctggcactggaaaagcagcaagggtcaaatccagtgttatcagaaggaatccacgattgggtgtttgagtgccatgggtttttgcacaatgcgggtttgatcatcgcttcctttctcttcctcttgtacttagcactgcaagctaaaaagagcttcctcaaactctcccatggccgctcttatatcattatttcctattacgcttccctctggcttgtcagcatcctcaatcttctttggtgcttttcccaggtcaacctattttttctcacaatttcttcaatttag

SEQ ID NO: 114403 - DNA, 252 bp, Glycine max
  Peptide Sequence Number=SeqID_231181
atgaaatgggcgaagttgtggtttataaaggagctcaaatcgccattgggaatggctacttcaagctcaaatcgccagtgctactggctactcccaactgcagtgcaaattgccagtagcactggcgctttccactgcaaaaaagttgtccctccctcctgcaacgctgctgcacgtagtctgaggataacagtcccctactctcaactcgccagtcaaactggcgagtccaagcctgcaaaacgtcattga

SEQ ID NO: 114404 - DNA, 627 bp, Glycine max
  Peptide Sequence Number=SeqID_231182
atgactggcagactgcttgccgggtcattgacatttgattgtcgcatcatgcattatattattgttagaattttgatgcctcgttcttctgatctcgctcaagcctctgaggaggacttgattctgatgtgggctttcttgaccagtcgtccaatcgactgggcccatttggttcgttaccgcatgcataaggcattgcagtttggtgcacccctcccttaccttcaacttgtgactttatttcttcgacattttgaaattcctttggattctgagccttttgtgatagttaaacgctcctttgctattggtgtcggtgcagtaacctcctttggctaccgtaaggacatagataggcagtggttgaagaaggacgcacaacctctgcaagacgagcgtactccctctcctccgcctcaacgagatgattcctcagccctcatgaatgcagttctttcagaatcacgaggcctctgcacctatgttggtgaacgctttgattccttggatggttgtatcgatgccattgatgctcgctttgaaggaatggatactcgcatcactcaccttgaggaggatgtgagttatcttcgtcggtgctttgatcttccaccaccaccttcttag

SEQ ID NO: 114405 - DNA, 401 bp, Glycine max
  Peptide Sequence Number=SeqID_231183
acggagataaacggactcctcgagggctacttaaggcactttagtgcaaaccaaccagaaggactggagctgttggatcctctgacgccccacaccattgcggcaggaggaggcttgcccatcagcctacttttttgccaagacgtggcaggagcgcaacgacctagcccaaacctacttaaactaaaggcttggcccggtctgaaggaagaagaaagtagaccttgtagagaagcggataggagagaccgacccagagaggaacgtgcccagcccacgagggcaccaccagatgttggccaacctgagagcgaggcaagctgggaacgggctgaaactgacgattctaagaccaagtcagagactactggacgtctcgcagagcgactctcaacgaggac

SEQ ID NO: 114406 - DNA, 359 bp, Glycine max
  Peptide Sequence Number=SeqID_231184
gttggcatatatgtagcacttgtgggaagggatcacattatttgtgctatacctgtacctattctttgtgcaagggatgtacaaaaaaggctgattttgtctctatcagagaaaataaaggtttatgtggaatgtgcaagaagactataatgcttatagagaattgtgcccagggtgacaaggcagcgtgtgaggtggattttgatgacaagagcagctgggagtatcttttcaaggtgtactggacgtatttgaaggagaagctatctttgacatttgatgagatccttcaagctaaaaatccgtacaaaggtactgcttccataagttttagggttcaaatttgccatgaattttag

SEQ ID NO: 114407 - DNA, 318 bp, Glycine max
  Peptide Sequence Number=SeqID_231185
atgtcataccatccaaagtacataagttttgttgaacaagtggaaggacaactagagagtctcaagaggacacgggaaaaattccctttgctggtgatcaaagagaatgagcataacaaagaaaaagaaaaagagaagacacaacgagaatatctagttgatgaagaaggtaaaagccttgttgttcgtattccttggtaccatcatttagggataatacaacacatgggtgctcttactcctgaagaagcacaaaggatgaaagacgtagttgagactaacatcaaggaaagagtagtgtcaagagcccaagcttag

SEQ ID NO: 114408 - DNA, 204 bp, Glycine max
  Peptide Sequence Number=SeqID_231186
atggccatcagagtctttggtgatagggctatgacttcagcatcaggatttgtgcatggtcgacaaggggctttccttgctcctacgtatcctcagtctctagtcttacaaaagaaaggaaaacaattccacgacactggtggtcagctagaattgaaacttacaaatgaaatgaaattaccaatgataaagggaagaagatga

SEQ ID NO: 114409 - DNA, 366 bp, Glycine max
  Peptide Sequence Number=SeqID_231187
atggataaatttgacatctttgtccctcatcctctcgtaattacatctttgcttccactggaatgtgggttcaagccattggtttgtttgctcaagcgacatgcactcctgagtttggacttccaagaccgtttaatcaaaaattactcgtgctacacatttggtgagggtgccataaaacgacgagtaaagcaaaaaaggttcaaaaagaaaaaggaaaaatcctttttgagaatcagtcgcttctttcattcttccttgctacaaggttgtgaaaacaagacaacgattgatacctcaaagccctacattggggcaatgaggggcaccatgcataaacctcaagcaaacctaggggcagattag

SEQ ID NO: 114410 - DNA, 288 bp, Glycine max
  Peptide Sequence Number=SeqID_231188
atgacagtgaaggcactgaatcaagcaaggctagaagcaaatatcagagtgtatggggacgaaaagcaccaaaagagatggccaagcccttactcaattgcctctggtgtgttacttttgctttctctcctcaaatttgtgttccatcccttaaaatatttggcactaggagcggttgctgtgggtgcctacccaatcatcttaaaggccattgtctccattcggaaccttaggctggacatcaacattcttatgcttatagcagcacgtaagtacaaggtggattga

SEQ ID NO: 114411 - DNA, 870 bp, Glycine max
  Peptide Sequence Number=SeqID_231189
atgagaaaagttattgggacaattgttatgaatgattatttggaagcaggcaccattgttttcctcttctcaattgcagaatggctagagtcaagggcaagtcataagaacacaaaagcagggttctctgtttcaattctcatagcaaatgcagtaatgtcatcgttgatgaacataacccctcaaaaagcagtcatagctgaaacaggagaggttgtggacgctgatgaggtgaaaatagacactgttttagcagttaaagcaggcgaggtgatacccattgatggagttgttttagatggaacctgtgaagttgatgagaaaactttgactggggaatcattccctgtggcaaaacaaaaggattctactgtatgggctggcaccatcaatttaaatggttatattagtgtgaaaactactgcactagctgaggattgtgtggtggctaaaatggccaagcttgttgaagaagctcaaaacagcaaaaccagcattcagagattgattgacaagtttgccaagttttataccccaggcgttgtaatcatatcagctcttgtagcggtgattccacttgcgttaaaacaacataatgagaaacattggcttcattttgcactggttgttttagtaagtgcatgtccatgtgcactcatcctttcaacgccagttgcaactttttgtgcttactccaaagcagccacatcaggtcttctcatcaaagggggtgatcatcttgaaacacttgcaaaaattaaggtcatggcctttgacaaaacgggtaccataacgaagggtgaatttgtggtcacacattttcaatctctttcagatgacattgatttgaacacattggcttactggtaa

SEQ ID NO: 114412 - DNA, 2023 bp, Glycine max
  Peptide Sequence Number=SeqID_231190
ggtgtcaagcatagagagcaagtcaagccatccattggcagcagcaattgttgattatggaaggtctctctccgttgaaccagagccagaaaaggtgactgaatttgaaaatttccctggagaaggaatatgtggtaaaattgaaggcagagttatttacattggaaataaaaaaattgccacaagagctggttctgaaacagttcctatcttacaaggtgaaattgaaagaggaaagaccactggatacatatacttgggagcaaccccacttggatttttctctctttcagatacctgcagattaggggttcaggaggcaatagggcagttgaagtcattgggaatcaaaaccgctatgctcactggagatagtcaatctgctgcaatgcaagcacaggagcagctggggcattctctggagttagtccatgcagaacttttgccagaggacaaggtcaaaatcatctcagaatttaagaaggaaggcccaacagccatgattggagacggcctaaacgacgcgccggcattagctgcagctgatattggaatctcaatgggcatttcaggttctgcattggcaagtgagacaggcaatataattcttatgtcaaatgacattaggaagataccagaagccattaaacttgcaagaaaagctcgtaggaaagtgttagaaaacattgttttgtcaatcatgactaaggctgcgattcttggtttggccattggtggtcatccacttgtttgggcagcagttgtggctgatgttggaacatgtctattggtcatctttaacagcatgttacttctgcgaaaaggacacaaccatggaggaaaatgttgtagatcttctactaaaccacataaccacaaaaatggatgtggtggcagtcatggtagttcctctcatcatcaccatcatcatgagcatgatcaacaacatcaacatgagcatcatagccacaagcattgttgctcagacaagacaaaaaagatgtcccaacctcagaaatgtggtggtgctcatggtagttcctctcatcatcatcaccatcaacatcaacatgaacaacataaccatgaccaacacgatcaacatgaacatcataatcatgaccaactcgatcaacgtgaacatcatggacatagtcaacatgatcaacatcatcagaagtgtgcctcacaaacatgttcctcaacatgtccaccctgctcttcaaattcaagttttggtggaattgttaaccattgtaacaccatgaaggctcatgatcaatgtaaaggaagtgatgaattccatgaacatgatcactgtcatcatggaagatgtgacaagaatcacgatgaagtccacaagcatgacaccgaagataatcatgcagttgcagaaaaaaggcatggtagttgtttgggacataagaaccatgggacaaagcactgccacaaccaaaatcttgacaaggttactcatgatagtgcttcacatagttctccttgccacctcaatctcccttgtaaaaaagaaagccaacaatttactcataatcattgccacctgatccatggttgtgaaaatctgaaagaccatgaatccaaagatgttttaagatccaaccatgacatccagcatgaaaaatcaggttgtcattctgattttgagaagcatgagacaggtgaaatatccattgacatcatcactgagtatgttgaattagcttcaagtttggaggagaaaggaaaaggttcctgcagggaagactgctcagacacatgcgggaatttggctgctgtgtgtggctgtgagagttcaaatgagagagaagacatcgcatgttgcagaaacgaggactcttcaaaagaatgcaaggaatctccaattatgcatgtttgtgatggtttaaataagagagaagttggtggatgttgcaagagctacatgaaggaatgctgtgccaaacttggtcactcatcaagacctagatttgtaggaggtttgtcagaaattattacagaatag

SEQ ID NO: 114413 - DNA, 914 bp, Glycine max
  Peptide Sequence Number=SeqID_231191
caacatattctggaagacagccgggcaccgggatcaccgccggctattcgcagtacgcccaatgcgatggtgcctcgcgtgacttcagtgcgcgcaccggctgggcgttgggggactacggcagcctggccctgttcgccgaatcgtccaactccgacgccacctcgcgcacccgccagcgtcccgacgccatcgccttccaggccgcgcaccccgagctggatgtgcccaatccggtgcagcgctggggccagccggagctggaaagccgccgcgtgggcttcaacctgaaggccaatgccagcgacaccctggagctgtatgccttcggcctgtacagccacagcgatggcgtcagcgatttcaattggcgcaacccggataccaccactggcgcgtaccgtacgaccagcatcttcccgggctggaacctgcgctcgctgtatccggtaggcttcagcccgcagtacggcaacacgcagaacgacctgcagctggtcgctggcctgcgcggtgagatcacccccaagctgcgctgggacctgagcgcctcgtatggccgcaacgcaatcgactacagcctggacaactcgatcaacgcatcgcttggcccggacagcccgacctccttcgacctcggccggctgacccagaccgagaagaacgccaatgcggacttcaactacgaatgggacgtggctgcgctgtcgaagccgatcaacgtcgccttcggcggcgagttccgccaggaaacctatcaggtgcgtgccggtgatccggcctcgtacgcggtgggcccgggcgcggcggcggggctggaagccaattccaacggcgcgccgggcttctccgccagccaggccgggcagtggagccagcgcagcaaggccgcctacgtggatatggaagtgccg

SEQ ID NO: 114414 - DNA, 1215 bp, Glycine max
  Peptide Sequence Number=SeqID_231192
gcggttgccgcccagcgcgcaacgctggaaaccgagcgcgatgcgctgcagcagcgctggcagcaggagcgtgaactggtcgatcagctgattgcgctgcgggcgcgctgcgtgacggagggcgaagccgcgctgcgcgatgagctggacgcgacgcaacggcagctgcagcaggtgcagggcgaagcgccgctgctgtttgccgccgtggatgccagcgtggtggccgccgtggtcgcagactggaccgggattccgctggggcgcatggtgaaaaacgaaatcgacgcggtgctcaatctcgccgatacgctcaaccagcgcgtgattggccagcggcacggtctcgatctgatcgccaaacgcgtgcgcacctcacgcgcgcgcctcgacaatccgaacaaaccggtcggcgtctttatgctgtgtggtccctccggcgtcggcaaaaccgaaaccgcgctggcgctggccgagtcgctgtacggcggcgagcagaacatcatcaccatcaacatgagcgagtttcaggaagcccacaccgtttccaccctgaaaggcgcaccgccgggctacgtgggctatggcgaaggcggcgtgctgaccgaagcggtgcggcgtcgtccctacagtgtggtgctgctggatgagattgagaaggcgcatccggatgtgcacgaactgttcttccaggtgttcgataaaggctggatggaggatggcgaagggcgccacatcgacttccgtaacaccatcattatcctgacctccaacgtcggtacgcagctgatcagtgcgatgtgtgccgatccggagctgatgccggatccggaagcgctgagcaccgcactgcgcaaaccgctgctggaggtcttcccgccagcgctgctggggcgcctgctggtggtgccgtattacccgctgagcgacgcgatgctggcggaaatcgtccggctgcagctgggccgcattgttcagcgcctcgccgataaccacggcatcagcgcgcagattgacgattcggtcatcagccagatcgtgcagcgctgcacggaagtggagtccggtggccgcatggtcgacgccatccttaccaataccctgttgccgcagatgagccagatgctgctcagcgcccacgcccgcgatgaacgctatcgtcgcgtgcaggtacgctgtgagcagggcgagtttgtttgccagttcgatgtctaa

SEQ ID NO: 114415 - DNA, 402 bp, Glycine max
  Peptide Sequence Number=SeqID_231193
atggatataggtccgacattctacaccgtggatacattaagtgggaaaagaagaaaaaggaatcgttttacaatgagagagtggtttgcttatagactgcaatgcagacccaatgaaggtcaaactttgctgcattctaaaaaactatttcgacaatttgttgctgaaggatacacaatgattgaatcaaaaagactttcctatgttagaaacaaccaaaagaaactcagagttgacaagttctgtagcttacaacaatcatcggatgctggaaatacaaaagacatgtacacagtggaattccaaaaacgaggacttcctcatgtccatttattgttatttttacacgtcaacaacaaatatccatctccaaacgatattgatcatattatatcagcatag

SEQ ID NO: 114416 - DNA, 301 bp, Glycine max
  Peptide Sequence Number=SeqID_231194
gcagactctagaggatcccacgtcaagcaatacgtggagtactcccgatatagcagtaaaagcaagacgcgtaggcggatcaactcatcaagttcccgttgaaataggatccacacaaggaaaagcacttgccattcgttggttattgggggcatcccgaaaacgtccgggtcgaaatatggctttcaaattaagttccgaattagtggatgctgccaaaggtagtggcgatgccatacgcaaaaaggaagagactcatagaatggcagaggcaaatagagcttttgcacattttcgttaa

SEQ ID NO: 114417 - DNA, 225 bp, Glycine max
  Peptide Sequence Number=SeqID_231195
atgatgcctccagcgacgaaggtttaccgcatttgcccaggtgttactgatgttgagggttttccaggtggacaccatgacacatcagttttgagagattttgaaaattacattgctttgagagtcaagaatgcagagcttaagttatctttccatggaaggaagatgactaagttcgatagacctgctctagagattgaaggcattgtggctctagtggactaa

SEQ ID NO: 114418 - DNA, 429 bp, Glycine max
  Peptide Sequence Number=SeqID_231196
atggtttccttttcttttgaatcctgttcatcttgtggtgtgcatttacctggaatatgctctcctccttttttgcagggtcacgaagggaagttctctgtttatgtgcatgcatccaagacaaaaccagttcatgtgagccgttattttgttaatcgggatatacgcagtgaccagatccacatcatagacattttattttatccagagcagaaaggtgaaatagtagccccatcacctggcctcatgagatgccgattttgcaatgcaatagtgatagcaagtttaattgcttgttgttttccagtagtctgtggttttctagtgatttgggggaaaatttctatggttgatgctgagagacgactattggcaaatgctcttcaagatactgacaaccagcaatttgttctactgtctgataggtaa

SEQ ID NO: 114419 - DNA, 291 bp, Glycine max
  Peptide Sequence Number=SeqID_231197
atgaaagaagaggcagacctgacaacttcaatattgcggagatggagtagtttcaggattttgcaaattgtatggaggtcatcgatatccctccccaaggaaagcggttcacatgattggagtaaaggagcatttggggagattgatcaaaaaatagactcaacaatgaaggagatggatattattaatggcgaattctcccaaggaatggtagataaggcaattgaaaggaataagttgacaaaggagttttggaacttggtaagattgaaaaggagtttcattctttag

SEQ ID NO: 114420 - DNA, 354 bp, Glycine max
  Peptide Sequence Number=SeqID_231198
atgtatgagctagaagcatgcttaaatgataacaaaggtttaaggcatgaaatcaaagaagacctacttccttcctcaataggaggagctgataatatcagcggaataagatcaaacggacagataggaagtaagaatgcaaatttccgggttttatttgtggctattggcctgcaatggaatcccggggggaatactttggcggttgctttgaaaggattcttgtcccaatctgtttcagaatcttcgtctgattctgaggccatttctgcccaggtctttttggctaattttggtattttagtgaggcctatatcctctaaggccaagagagtttgtattgaccaggcatag

SEQ ID NO: 114421 - DNA, 675 bp, Glycine max
  Peptide Sequence Number=SeqID_231199
atgaagcaatcaccaagtcaatggtacaagagacttaatgagttcattgtctctcacgggtacatcagaagtccctatgactcatgtgtttatcatagtaaggtgaaagacgattctcacatctatctattgctctatggggacgacatgctcaaagcatctcaaaatttgttggaaattcagaaggtgaagtcactactcaatagtgaatttgagatgaaagacttgggagttgttgaaaagattttgggcacggagatcaagagggataaagtccaaaagaagttctttatgcataagaaggaattcattcaaaaagtactaactcattttgggatggcatctgcaaagcaagtatgtagtcccttggcaaagtccatttgtttatttgaactcaatactactcagtcagaatcaaaaaaggaatacatgtctcatgttcctaatgcaagttttgcaactagtctaatgtatgatatggtatgcaccagatcgaaccttgcacaaatagtcaatgttgtgagtaggcacatgggtatcctgggaaggaacattggcaagttttcaatggcagcagaatggagaaggaagaaagatgattggagatgccacttcaaggagaagatgagtcaagaacaagctcaccactataggaagccatggataagaacttga

SEQ ID NO: 114422 - DNA, 453 bp, Glycine max
  Peptide Sequence Number=SeqID_231200
atgtctaacaatgcaaaagttctgtcgtacaagaaactcctaaaagcctataaccttgaaaatcaagcaaaaagtaccaaacttttgcgccgtaaaccaatttttattcgcacaagtggcaatgagtctggaggagttgataccatcaaaccatgccaagtcttatctatattccatcttcatcagaagagggttggtactttctaccctggttattggtctctcagttcccttttttggtctggtgatgtcattgattggatcattactcacaatgcttgttactttgatactaccctgtgcttgtttcctaagaatcttgcgaggcaaagtgacacgaacacaggcagcactttgcattacaattatcatagtaggtgttgtatgttctacttttggatcatactccgcccttgccgagattgtgaagagtttgaggggatgaagttttga

SEQ ID NO: 114423 - DNA, 474 bp, Glycine max
  Peptide Sequence Number=SeqID_231201
atgggattggttatgtttagtgctagagaacagtatcaccacattgaactagtgcacaaaaagagcaagagagtctacttgaagcctaagagagattataagaaaggatcagaagttgtccatatcatggcttctcccaacaaaggctatttcacattttctatggtggagtgtcctcacataataggacaagttaagatgttgattgtgggggttgaggttcttattgatggaaacttaatgctaaagaagaaaagggataagaagaaggagatactaacatctcctcagaaattgggcataacagacttagagcctacaaacatctttcttcaccttgctgaccgtttagttgtatatcctagaggggcaattgaggatgtggtagttaaggtgaccaagtttatctttgccattgattttgttattttatatatggaggatgatgaggatgtccctatcatattgggatga

SEQ ID NO: 114424 - DNA, 327 bp, Glycine max
  Peptide Sequence Number=SeqID_231202
gtgcattcaaaactctttgggcggcaagaagcaaattactcgagtttcacatgctacaggggattaacaagatatgtgcccccatatattgataccgttgggtatcgggtgttcttgggcttgaaccagtactttgttgcttcagatgttggccatggcaagatgcagtggtatgctttccatggggaacccccttcaagtgaccctttcccagaaggtaagaagaagaggcttttggatctctttggtaattggtgcgatgaagtgattgcactcatatcagaaacgacaaaacatatgaacactgagtacttaaggaaaccttga

SEQ ID NO: 114425 - DNA, 303 bp, Glycine max
  Peptide Sequence Number=SeqID_231203
atgcatgctttgttagggtcattcaacagtgggaactggtctgattctaaagtctttggtagtacgggactaagttgttgtgttatcacgagggattgggtcttggttgcgtttagtcttacaagaaggatctgcgggcgaggcttgatcaggactaggctaggatattgtcgcaacctaccctttggcgggcgagcgaggcgaggctcacaggtgcgtctcccaaaggaggaaaatgcacggagtcgccaccatcgtttatttgtggaaaatgtcagaaaaaccgaaggaaaccggtcatga

SEQ ID NO: 114426 - DNA, 384 bp, Glycine max
  Peptide Sequence Number=SeqID_231204
atgcaacaaggacagacagatatccttatagctaggttccttgaccctagctatggtgttaaaacgggttcctctcggtgtggggtttcaacggagaacaacgatggtttgtggtggctaatggtggttgtgggtgatggagaaagtgcttgggacgttagaaatggttttggaagaaagaaaggagaagaaatgatgtttttcctaaggtacacgaaagcaaaggctgaaacaccaacgtttgagaaaatccaacggttaacgaaggctggacagtgtttttaccgagaaagctcatgtagcttcctcaagaagcttcatgaagaggcttcctcaagaagcttcctcgtggcttctttgagatttctcaagagacttctttga

SEQ ID NO: 114427 - DNA, 372 bp, Glycine max
  Peptide Sequence Number=SeqID_231205
atggtgggttacacaccttcaagcattgcggatttggttttcgccggtgaaaggatcaaagtgggtctggaagaaggcaaatctgatcatcctgctttgatgaatatgaaaattggggcaaatgaaaaggatgagaatgagggagaaacccttgctatgactgccattcctacacggtcaaatttcccatcagcccaacaatgtcattactcagccaataatagtccctctcacccaatcatccacaaaggccatccccaatcatccacaaagcctgcccgccgcacatccggtgccaaaacaccaaccaaaaaggaattttatagcaaaaagcctgtaggattcaccccaaattccggtgtcatatgctaa

SEQ ID NO: 114428 - DNA, 396 bp, Glycine max
  Peptide Sequence Number=SeqID_231206
gatggtgatcttgatttgaatgcttcccctcaagcacttgacaaattgttgggtcatgtgcttgcttttaaggtcaggattcaatcaaaattcaaaaatgcagttgtccttagatactcaaaagacctggatttgatcaatgttgttctcaagatgctgccttatagtgagacatgttccaaaatagatccttccaatgttgattgcaatgatgctacacaagttgaacgtcaatctctgtctgtcacagctgaccatgatccggttgcgggattgcctttaacacccaaaaagcggatgtcatatgatgaagccgatgatgagttagggagctctcaaatttcgtcagcccaactatcgtctaacaaattaacaagacattctcataagagctaa

SEQ ID NO: 114429 - DNA, 171 bp, Glycine max
  Peptide Sequence Number=SeqID_231207
atggccgcacagcgagacaattatcgcttagcggcattatgtaaaaggcacacccccgtttggcgaaacatgggtcgcttagcggctggcgaggagcccgctaagcctaaggtcagccgcatggatttgcgcttagccaagggtaggctgtgcttagtggcactaaattga

SEQ ID NO: 114430 - DNA, 1101 bp, Glycine max
  Peptide Sequence Number=SeqID_231208
atgtcttcaaggaaaagaaatagcgtcggttcaaggcccactgctcaatatgatacatggagattccattcctttgatgcttggactagatatactgacaatgtgttgagaagacacatattagctgagaggaaagtggaaatctatcacacaaagttggatgaattcaagggcaagctgaagaggcgtaattttcacaagcccctcaccaacttagctgatagtagcattgacctcgcattggtgaaggagttttacgccaacctctacagtcccgaggggccttcacctaaacaagtcagaattcggcgccacttaataaggattgatgcagacaacctcaatgcctttctagaaacacctgtggtgcttgctgagggtgaatttttgcctgcctactcaagatactgcaggatgcctactgataatagagaaattgaagctgcactgtgcatacccagccaagggtttattctaaatgctgaaggtcacccggggaagatcctcagaaaagatctaaccacccttgctcaggtctggagtgttctatcctactccaacctggctccgacctctcacacatcggatctgactgtggatcaagctaggttaatctttggcctagttactcaactggacatgaatgtcgaagccctcatttctgggcagattacttctatggcccagtctaactcctcaagactcaggtttcctgctcttatcacagctttatgcaggaccagaggagttgcctccgatagtcttgtctttgaacatctgaacccacctcctcctcacagtaacgacgaggatcccgccgctcaggtaccacatcagccagcggatgagtcatcagagtcttccattcttgagcccttaattaggaagaggagggtagttataactcaggaagccgcaaccactcctgaaaagtctcttgaggccactccagagcctccggcaccaattgaagataccacttctccacagcaggcggcagatccttcaacgcctgaagatcaaaccacaccagtccagtctccgaacgcctctcttgtatctactcctgtactgcatttgactgacaaggaggaggtttag

SEQ ID NO: 114431 - DNA, 1326 bp, Glycine max
  Peptide Sequence Number=SeqID_231209
atggcaagtctgatgacacgcagaaaccaatatggtcatctactccctttgtcgaaggctcgatgtctatcgaccgaaactacattagtctctccttttcgaaatcctgagacaatcaagtctgatgacacacaatcaagtccaaagacacgcaacaaccaacatggttgtctgcaccctttgtcgaagacgcgacatctatcgaccgagactactttagtctttacttttcgtcatccagagacaatcaagtacaacgacaagcagcaaccaacatggtcatcttcaccctttgtcgaagacgtgacgtctatcgatggagactactttagtctcccttcgtcatccagagatggcaagtctgacgatgcgcatagaccaatatgtcaatctactcactttgtcgaagactcgatgtctatcaaccgagactacattagtctcccttcgtcatccaaagacggaaagtacgatgacgcgcatagaccaatatggtcatctgctccctttatcaaagattggatgtctatcgaccaaagacaatcaagtccgatgacacgcagtgaccaacatggtcatctacaccctttgtcgaagatgcgatgtctatcgatcgagactactttagtatctcctttttgtcatccaacgacaatcatgtccgatgacacgcagcaaccgacatggtcgtctgcaccatgtgtcgaagacgtgtcgtctattgatcgagactactttggcctctccttttcatcatccatagacaatcaagcgcgacatctatcgatcgagactactttttgctctacttttcatcatccagagacaatcaagtccaatgacatgcagcaaccaaaatggtcgtctccaccctttgtcgaagacccgacgtctatcgaccgagactactttagtcttccttcatcatccagagatggcaagtccgatgacacgaagagaccaatatggtcatctgctacctttgttgaagactcgatcgaccaacatggtcgtctgcaccctttgtcgaagacgcgacgtctattgaccgagactactttagtctcaacttttcgtcatccagagacaatcaagtttaatggcacgcaacaaccaacatggttgtctacaccctttgttgaagacgcgacgtctatcgaccaagactactttagtctcccttcgccatatagagacagcaagtccgatgacatgcagcaaccaacatggtcatctgctccctttgtcgaagactcgatgtctatcgaccgagactactttagtctcccttcctcatccagagacagcaagtccgatgacgcgtag

SEQ ID NO: 114432 - DNA, 162 bp, Glycine max
  Peptide Sequence Number=SeqID_231210
atggcaagcaaagacagctcgtggcggtcatcgggggtgagtggtggtggaggaggagcttgggggcattggggagggtgttactatcatcatcctcataaaaggatgaagagcatgcagctagcctatgtcttatggcaggatcataaaaagatgaggtaa

SEQ ID NO: 114433 - DNA, 2037 bp, Glycine max
  Peptide Sequence Number=SeqID_231211
atggaacgcaggaaaacgctcacgatgaactgggacggcctcggcgacgttgacgacgacgacaccttcttcgagtcctacaaccgcctctccaccgccgctccccttgacctcccttcttcttccgacgatgacgacgacgatgatttcgatgatccccgcctctccttcgtctctgctgcctcgtctcttcagtcacgaaaaaacagggcccctccgccgaccgacaccgcttcagattacggcatatggatggctgcccccgtgtcaatcaccgagaggcgaaagcgattgctccacggcatgggcctagacgacgaccacaaggagttctcaaaagccacgaacgtagtttcaaagaagatcgactctgctccttcttctaactcctctgagaaaaaatcaatacttttaactacttccttgccggttactattccaccttcggattcttctgtttcggaacacaaaaaaacagagcagtcctctgttcatttagttctcgttcgttctcgttccgagggagacgtcgatttgttctccatggagaggtcgaggaaggaaaatttcatcgggaagcagtcgaagcagcggcttacgagaaccgccacggaggtggccttcccgcgcggaggaaacggaaccggaggcagagcggtggtgagagattccgacgacgcagcaacctcaaagcgaagcgtggcgaaattggagaactcgggagtgggagcgtttttcttgattagaaatctggacaccgggaaggagttcattgtgaatgagtacggcaaaaacggagcgtggaataggctgagtgatttgcagacggggaagcagttaacgatggaggagttcgagaggacggtggggaagtcgcgcgtggtgaaccagcttatgaggcgtgcgcatacaggaagcaaccacaacgacggtttgtcgcgcaagctttcttcgagctcttacatttcgaggagtttgaggatgagcaagagaagaggtgctgcgttgttgaagaacattaaaggcgtggcgagcgggttcatcggcgagcgagagccgataacgatgccggtgccggtgatggaggcgaagaatcagtgggtgagagttcggcagactgggaaagcgcacaaggagctctctgctttgcatctgtgtcaggagtttcaggctcacgaggggtgcgtgtggacgattaggtttagtttggatggacggtatctggcgagtgcgggagaggatagggtgattcacgtgtgggaagtgcaggagtgtgaggttatgtctctcaggcctgacgagggaagtctcactcctcttcacccctcgcttcttgcatcgtccagtgagactccttctttgtctagtgagaagaagaagaaagggaaattcggaagcaaaagaggcacagccatccctgaatatgttcatgttcctgaaactgtcttctcactttccgacaagccgcattgctcttttcgtggccatttagatgatgttttggatttgtcttggtctaaatctcagttacttctctcatcttcgatggataaaacagtcagattgtgggatttggaaactaagacttgcttgaacatgtttgcccataatgactatggtgagggtgaaatgcttgactctgtaacctgcatacaattcaatcctatccacgatgattatttcatcagtggttcgctcgatgctaaggtcagaatatggaacatccctgaacgccaagtcgtgaattggactgatatccacgaaatgattactgcagtgtcttatacacctgacggtcagggtgctctggttggttcccttaaagggagttgtcgtacatataggacagaagattgcatactaactcaaactggcacaattgagattcgacacaagaagaaatcccaactacgaaaggtcactggtttccagtttgctccaggcaaaccatcagaagttcttgtcacttcagccgattccaggataagaattttggagagttcagaggtcgttcaaaagtacaaaggtgctgcataa

SEQ ID NO: 114434 - DNA, 411 bp, Glycine max
  Peptide Sequence Number=SeqID_231212
atggttgtacaagctccaacagtgtttattcctgaaggtgcctcaaccaacagaccccccgactttgatggaaaagatttctactacttgaaagatagaatgatatttgagtatgacaaagtaaaagagtgtgaaacaacacaagaaatttggaacacactcaaaaccacacatgggggcaccaatttggtccataagcaagagctgatggatgaaacacaatcgcctaaagggaagatcatagcgctcaaggcctctcagaaaatcaagacaaggaatcaatccaaagcactaaacttagaagtaatgtctgacgttgagaacaatgatgatgagccttctaaggaagatgaagaagaattagcattcttaaccaaaagagtaaaaagatttcttagaagaagaaaatga

SEQ ID NO: 114435 - DNA, 815 bp, Glycine max
  Peptide Sequence Number=SeqID_231213
gttttcgaaatgcaaacagctcaattgcagcttcatttagtccagatgggagatacattataagtgccagtgaagattctcaagtatatatctggaagcatgaagagcatagaagtggaggcagtggaaagggtagaaatgtgctagttacccgttctcacgagcacttccattgtaaagatgtttcagtagcaataccatggccgtgtaccataagaggtgatcctcctctagtgccaacacatcattccaaaagacattcaaaacgttctcaggcaccttctaattgcatagaagacacatcatcgccatctgctacaaacagtaagagaacgcttccaccccttcccaacaagaagagtaataataaccatgccacagaaggtgcttcaaattccccaagggaagaccctgcagcaatttcacacacagaatccggacttaatgattcgtttgtaaacagtaagagaatgatgccacaatctccgatgaaagctaactgccacactgcaggggatgaagacatcgaagcaatttcacgaacagattcaggatttagtgattcatttagttctggctcatcctcagttaggtgtggtgattcaccttcttcatcatggtcctcttcttattcattgttggacagtagccatgtttcttccacagttcttccttcagcatggggcttggtaattgtcacggctgggtttggaggtgaaatcaaatgttatcaaaatttcgggttgcctaaaaggatgggtaggcaaccccatctttttggaggccataacagttcttctcatggcaacacctag

SEQ ID NO: 114436 - DNA, 648 bp, Glycine max
  Peptide Sequence Number=SeqID_231214
atgaagagcactaggcacatacccatagcccctagaacaaagaaggagaaggaaccagcaaagggtggtccttccagcagaggaaaacgcattgcacattctcccttacctcttactgctctaaaggcaaccccttggctttctgaagaacactatgagtcttcttacaagttttgttatgcgaagaaggagatgattcaactaaagtacatcattttagcttggctcataagtgaaggttttgcatttcctaagttaattgagtaccacgagttgaagaagctagtggagatgaaggacacctacactaacttggtttctatgtgcttagttgaaagggcaacaaattatgatgacactagagaaggagttatggctaaccagttgggtctcaaggaagctagattttctttcaacaaggtcgagaagtacaagtctgtgatgaataatccttctacctatgttgttgttgttacaaaagcaaagggaaatgagtgttttggtaccgagccattgattcttaagcataagtttttgccctatgtggttgcttggattattacttcgagggggagcaatcgtgctcaattgaatgaagaggatcttctcattatcattcttatgcaagggaagatgaatattaactag

SEQ ID NO: 114437 - DNA, 507 bp, Glycine max
  Peptide Sequence Number=SeqID_231215
atggtagaaccttcaactattgaagaggcgcttgttgatgaacgttgggttttcaaaaataagttagatgaacatggcttcataactaagaacaatgcaaggctagaagccaaatgttataagcaacaagagggtatagactttggtaaaacctatgctccgataactagattagaagttgttagattgttgcttgcatttgcttgtattatagatattaaattgtaccaaatggatgtaaagaatgcttttccaaacggatatgtagatgacatcatatttggctctactaataaacctttctatgaagattttgtgcataagatgctgggggagtttgaaatgtcaataatgggagagttgaactatttcatcggtctgcaagtgaagcaaatgaatcatgcaacttttctccatcaaactaagtattgcaaggaacttctcaagaagtttgatatcgataaaagcaaggaggttgcaacccatggctacaaattgctaccttag

SEQ ID NO: 114438 - DNA, 159 bp, Glycine max
  Peptide Sequence Number=SeqID_231216
atgggcttgaagaagtgttgtggttgggagtgtgatagacacatggctccattaggaaactgtgaagttgcaaggctatggagcttgtgggtgaaggttgttgcaattgcaaatgaagtgtcattaagagcagggaggtcattaaggcttaaagagtga

SEQ ID NO: 114439 - DNA, 1161 bp, Glycine max
  Peptide Sequence Number=SeqID_231217
atggcatatgatgagttgtttgggaagttgagggagtatgaaatggacttgacaagaatggatgaagaagaagctatagataagaagaataaaggtttagcattgaagaccagcattccatcaagtggaaaaagtgaggatgacaatgcagaagggttagatgctaaaaatttgaacttgcttccaaagaggaatctcaagaagggtaaaccatattcctccaatggctttacttgcttcaagtgtggaaagacaagccacatcaaagtagactgccccatctaccaaaagaagcaagaaggaaaaaagaaaaataagggttcattcaagaagaagaagaaggcatatgttgcttgggatgacaatgaatcaacaacatccattgataataatgaagagaaagaagtaaatttgtgcttgatggctacaaatgaagttgagagtgagctactacatgctttcaatgaaatacatgaagaagcacaaaatttgtctattgcaaataatcttctaaaaggaaaactgaagtggcatgtggataagctagtggaaattcaaaaagaatttttgaaagaaagagcaaaaaatgatattttagaaaaagaaaagaacaagtcttcttgcaattgcactaacaccactaatgtcacttctccttgtgaaggatgtaaagttttagaagtcaaggtagaatacttgctaaaaactttatccaagttcactatggggagagataatttggaagctttacttacacaacaaaaatgtgctatcgaaaaggctagattggcaacagataaacaactatgttatcttgatagcagcttctcagagcatatgacaagagacaagtcaaagttcatgtctctaaaaactaaagaaggaggatttgtaacctatggtgataacaacaaagcgagaattcttggtgtaggcccacttgggccttccagtttcttcctccagaaggcagttgcttctggaggaagcaaccttgctcgcctgggcgagctgggtggcaagctcctcccctattttgctataaatagggggaggagtgaagaagaaaggggttcagccttcttggcacttcttattctctcgaaattgctgaggaaaattgtttccgtgaagaaaatccaagccgaggcgcttccgtaa

SEQ ID NO: 114440 - DNA, 303 bp, Glycine max
  Peptide Sequence Number=SeqID_231218
atggtgaccaatgggacaaagttggaggttcttcctttcaacacaagtgtagagcttgttatgcaggacaccaacattcttggtgccgaaagtcaccctctcaatttgcatgggttcaacttctctatgggaacacagtgggaagtaccttcttgtggctgggtcgccattcgtttcttagcagataacctagcaatcggaaaaggagctctagatagcaccgaaaatgtcatcattgctaacggagaatgcttaaacgactaccttaagataagggatgagttactcacgcttggagattag

SEQ ID NO: 114441 - DNA, 477 bp, Glycine max
  Peptide Sequence Number=SeqID_231219
atgattaatgagattgatattcaagatgaggaggaagttagtgaggaagtgctattgaatagaaaggagttgttaaaagaattttggaatgtggccaccaagcttagtcttggatgcaccaaaaagcaagattttggagcttacttcatgaggacttcacaaaggttgggattttgtaaggtgtcgataaagtggatcaaaggttgtgtggaattggcaccagtctcgatacttgtgaatgggagtcctacggatgagtttggcatagttatgagtgctccttttgtgtactcgggaatccctattggggctaatcccttaaaagaagcctcatgggagcccattattcaaaaagtcaccaagaaacttagtaattggaagcatagacatttgtcttttggagggagaatttgtttgctaaaatccatgcttttggccttactcaggcaaggtttcaaatttggttgttacctatga

SEQ ID NO: 114442 - DNA, 714 bp, Glycine max
  Peptide Sequence Number=SeqID_231220
ctcaagacagaaacttacttaaatgccaaactctcagatatatgcatcgggacttcggctgcaccgacttatctaccgccgcaccaatttcagaatgatggcgttcaatttgatttggttgatggtgctatgtctgctaataatccagcgctggttgctgtgagtgaagtgatacaacacaatgagcataaagaaatcctgttgctgtcattaggaacaggaacaataaaagctgaggagaagttatctggcttctttgatgacttgcttgatgacttgtatgatgacttgtgtggacttaagtggctagctagcagccgtaacgtgttttatgaggctctatatagtacaaacatgatccattactatcttgcgacggtgtttccaggtgttttgcctgcggataactatcttcgaattgaggagtataacctggatccatccatgaaagaaatggataatgctgacaaggaaaacatggataagcttgaaaaggtaggaaaaagccttttgctccaaaaagctttgaggatgaatgtgaatacttttgtcccagttgaactagaccaaacaaatgctgaagctcttgacaggttgtctgagaaattatatgcagagaggcagttgcgtctgaaaaggaaatctatggaaaaaggaggaagccgaattattgaatctgtcaaagtcccttctggccgaatgcatgcaacttaa

SEQ ID NO: 114443 - DNA, 657 bp, Glycine max
  Peptide Sequence Number=SeqID_231221
gccagctcagctcgcccaggcgagccaggttgcttcctccagaagcaacagccttctggaggaatattctggagggcccaaaaaagcagaagttgaagttgttgatgttgatgttgatgctgatgttcaatatctaaataggtcaacaaccttcaaaaggttttcaagcaattcaaatagaaatgcagaagttgaagctgatggtgttgatacagatgttcaacctctaaatagaggattcggtgaggaagaagggattctacaagtcttatcctccaccacctccgccaccgccaccaacaatgttttagaaataagtgttcatgaagccaagttcatggggcatgcaagcctgcctcttgtgtcacagccagttgagaaagaaagccttcttgtggaatctgacgatgatgatgacaacgatgacacagaaactgaggaccaagacgttgaaggaggaagaaccgttgatcagaacaatgacaggggaaagggtccacctgttattggtggagaaagttcaaaaacagatggtgatgaaggaccagatatggataagaaggctaatgagttcattgctaagtttataaagcaaataaggcttcagagaattgagtcaatcaagaggagtacaaggagtgcaagaaactcttcaag

SEQ ID NO: 114444 - DNA, 234 bp, Glycine max
  Peptide Sequence Number=SeqID_231222
atggaaaatgctaaacacatgcccactcctatgagcactgcttgctatctggataaagatgaaactggtcagtcaatagacatagagaaatatagagtaaaaagcaaaatagtgtttgccttatccgctgcagaggcgaaatatatttctgctggaagttgttgtgcacaaatagtatggatgaaacaacaactttctgattatggcttaatgcttgatcatattcccatttag

SEQ ID NO: 114445 - DNA, 258 bp, Glycine max
  Peptide Sequence Number=SeqID_231223
atggatcccatcacaatactcgtcgcccttaaaaggtcttacaattgtgagattgcacagttcatagttcccaactcaatgttagacaagtggtatcagagcttcattcttgtacaaagtttagaagcttcaagaaaaagatggcctcagcaaattccttatttccagaagggaattctatcaatagacctccaatctttaatggagagggttaccactactggaaaacccgaatgcaaatttttatcgaggcaatag

SEQ ID NO: 114446 - DNA, 471 bp, Glycine max
  Peptide Sequence Number=SeqID_231224
atggatcggtcagcaacttgtaaagtcattctcatgggcatgatttccaactctcccaaccttctacgcatggagagcgacattaggttgatactggctcccaaatcaatgagagcctttcccatagtgacttcaccgattgaacaaggaatagtaacacttccaaggtccttatgttttggtggaagaatttgtagaagcaagcttcatgatgaatcaagattgattcaaagaagttttgatgataacaaaggtgatgacaaaaagctcaaagatcaagaacacttcatgataacaaagatgatgatctcaagaatcaagtttcaagattcaagttccaagaatcaagaattaagagaagacttaatcaagataagttttctaaaagtcataactcttctaatggttctcttgaccagacatgaagagtctataaaagcaaggctttgttttgcatttcaaaaatcttga

SEQ ID NO: 114447 - DNA, 504 bp, Glycine max
  Peptide Sequence Number=SeqID_231225
atggctctcgcctgtagcattccgattgccttttgtgccagagccgacgacgcggtcaatcaaccgcttccgggggaacaagctatgcctcccgctcttcctgttatgcaggaagctgctaatcgggctctgccctacccctatcaaaataatgagattatagggggggacagtgttgaatccatccaacggaggcttttggggagattcccctctccttcagcccatgagattcaaatggcccggattgaagccgaagacctattcgaggtcaaggtcgatatttgtcaggtcatggcgggccttcacccaagcggggattggatgggacggggggctagagctctggataatcttcgtaccgccactggagaggagtccttaagtaagctccttcgaatgcgggaggacctacagactgcgggtttgcagtccgcaaccttccggcaattggccgacagagtggcattccgggcggatggagatcaacactctgccacctag

SEQ ID NO: 114448 - DNA, 702 bp, Glycine max
  Peptide Sequence Number=SeqID_231226
atggctgagaagacaaagaaaaaattggaggaagctactcaatccggaagcactgaggccgtgattgacccttcatctcccattagacgccacatgaagtggaagatggcccgcaccaagaaaactgggcaaatgatgtctgaggcagcaaaggaaattgttgagaagattgcgtcacaaggttcctttgtccctcatggacatcaggatgtcctgacggctaccattgggcgaccagaacaccctgatcgtgtgcatgctggaccagctagaggagtcaatcacagaaaaagtgactcggtagctgatgttatccttcagccagatgcaatcccagtttcagtcacagatgcaatcacatggacttgcactaaggttggtccctcagctgcttgtgtcagcacaaaggaaagttgtgtttatccctcagggaacgatccagacataggtgactcaaacaaatgtaggttgtacatcgaagaaaatcctccccgcctagttgccctaggaagagtttatgagggatccacaatcgttcacaacatccctttattgcatgatcaagtgaaggtcggtgttgaggaggttaaagatgcagatgctcccgttcctgtacccactgacgaggttaacttagtggggcagacacttaacacctttcttgcttggccgacacatctcgtaaagcgtttatcagaacag

SEQ ID NO: 114449 - DNA, 1137 bp, Glycine max
  Peptide Sequence Number=SeqID_231227
ttgtacggcggcgatctggacggcatcggcgccaaactgccgtatttgcagcagctggggttgacggcgctgtacctgaacccgatttttaccgcaccgagcgtgcataagtacgataccgaggactattaccaggtcgatccgcacttcggcggcaacgcggcgctgcagcgtttgcgagtgagcactcacaaggtgggcatgaaactggtgctggacggggtattcaaccacaccggcgactcgcatccgtggttcgaccgccatcgtcagggcgaaaacggcgcctgtcaccaccccgattcgccgtatcgcggctggttcaacttttacccggacggccgcgcgctcgactggaagggcaacgccagcctgccgaagctcaacttcgccgagccgcaggtggcggaagcgatctatcgcggggaaggcagcgtggtgcgccactggctgcgcccgccgtacagcatcgacggttggcggctggacgtggtgcacatgctgggggagaacggcggcgccaccggcaacctgtaccacctggctggcatctatcaggcggtgaagcaggagaatccgcaggcctacgtattgggcgagcacttcggcgacgcgcgccgctggctgcacgccggcgtggaggatgcggcgatgaactacatgggcttcgcgctgccggtgcgggcgttcttggcggggctggacgtagcctatcacccggtgcggctggacgccgccgggtgcgcgcagtggatggacggctaccgcgccgggttgccgcacggccgacagctgatccagttcaaccaactggacagccacgataccgcgcgttttctcacgctgttgcaggggaacccggcgcgcatgcagatggcggcggtgtggttgctgagctggataggcgtgccttgcctctattacggcgatgagattggtctggacggcggcaacgatccgttctgccgcaagccgttcccgtgggacgtcggcgactgggaccggccgctgctggcgctgttccagcgcatggcggcgctgcgtaaacagagcgtggcattgcgccgcggcggttgtcaggtgctgtacgccagcggggaaacgctggtgttcgtgcgcctgtatcagcaggagcag

SEQ ID NO: 114450 - DNA, 294 bp, Glycine max
  Peptide Sequence Number=SeqID_231228
atggccttgctgaaaaactaccaagacatctttgcctggtcgtaccaagatatgcccggtttgagttctgacatcgtacaacatagattacctctaaatcctgagtgttccccggtaaaacaaaagctgaggaggatgaagcccgagacgtccttgaaaataaaagaagaggtaaagaaacaatttgacgctggctttctggctgtcactcggtacccggaatgggttgccaacattgtactggtccctaagaaggatgggaaggtacgaatgtgcgtggttatcgagacctaa

SEQ ID NO: 114451 - DNA, 231 bp, Glycine max
  Peptide Sequence Number=SeqID_231229
atggaggatgaagaagacgaagatgtaggacttcccccagagctagagaggataattgctcaggaggatcgagagatgaagccacacaaagaagagaaagagctcatagacttaggtgccgacagtgaaaagaaggaagtaaaagtaggcacaggttaccttttgtcatatcctaatttcgtccgaggaccattgtttggtggcatgcaaccttcgcttgaccgccgcgag

SEQ ID NO: 114452 - DNA, 1125 bp, Glycine max
  Peptide Sequence Number=SeqID_231230
gtcatagccgatgtgcgggttcagggcggtgaccagcatcagcgagcggtcgaccagttcggcgatgcgctcgcggtttggctggatgccggcggcgcagtgatggtcgcagctggccatgctgtcggtcagcaggcgcaccgaatgcaggaagttgtggatcaccaggggcttgtagacgttcagctagaagttgccgctggcgccgccgatgttgatggggacgtcgttgcccatgacctgggcggccagcatggtgatggcttcgcattgggtagggttgaccttgcccggcatgatggagctgccgggttcgtttttggggatgttgatttcacccaggccggaccgtgggccgctggacagccagcgcacgtcgttggctatcttcatgaggccggcggcgagcgacttgagggcgccgtgggcgaacagcagggcttcgtgagaggccagggcctggaaaatgttgggcgcggagaagaaggcggtttcggtggcgtgggccagttcggccgagaccttggcggaaaattgaggatgggcgttcaggccggtgccgacggcggtgccgccgatggccagctggtgcaggcccggcagcgtggcgcggatctgctgttcgtccaggtcgagctgggcgacgtagccggacagttcctggccccagcgtcaggcggggtcgcgtcctgcaaagtgggtgcggccgatcttgacgatatcgtagaactcagcgctcttggcggcgaaggtggcgcgcagggtcttcagggccggcagcaggtggtgctcgacctgcacggcggcagccacgtgcatggcggtggggaaggtatcgttggacgactggccgcggttgacgtggtcgttggggtgcacttgcgttcttcgccgcgcacgccgcccagcagttcggaggcgcggttggccagcacctcgttcatgttcatgttgctctgcgtgcccgagccggtctgccacacggacagcgggaattcgttgggccacttgccggcgatgacttcatcggcggcgcggatgaaaccgtcggcgatcttgggatcgagctcacccaggtcggcgttgaccttgcggccgcacgcttcaggcgcgccatcgcgatga

SEQ ID NO: 114453 - DNA, 1158 bp, Glycine max
  Peptide Sequence Number=SeqID_231231
atgcagcgcaatcacccgcttgaggactttggccgtgctgtccgggcgcgcgttaagcaggaaacgcacctgaccgtaggcgtagggatagcgcagactaaaacgctcgccaaactggctaaccatgcagccaagaagtggactaagaccggcggcgtgctcgacctgtcgaatatcgaccgtcagcgcaaactcatggcgctggtgcctgttgaggatgtctggggcgtcggccggcggatcagcaagaagcttaacgccatgggcatcatgaccgcgaaagacctgtcagagcaaagcacctacaccatccgcaaacacttcaacgttgtgctggagcgaaccgtcagagaactgcgcggtgagccatgcctgcagctggaagagttcgcacccaccaaacagcagatcgtctgctcccgttcattcggctcccggatcaccaaatacgacgatatgcgcgaagccatatgcaccttcgccgcgcgagccgcgggtaagctgcgcggggagcgccaatattgcacgcagatagctgtgttcgtccgaaccagccctcacgccgtgggtgaggtcttctatggcaatcagtcgaccggcaaggtgctcacgccaaccaatgacacgcgcgacatcacccgggtggccatagaagcgctcgatcgtatctggcttgaggggcaccgctacatgaaggcaggccaacagcgaggcgctgatgcgcgtgatggatggtctcaacctgagcgggaaggggaatctatggttcgcagggcagggtatacacaacacatgggcgatgaagcgcgaaatgctttcgccggcatataccacaaaagtttccgacctgccggtggtccggtgctgatcacttcgcggccgtctgaaacgcttcacgttccgacgtgtgacggtgtggctattatcgacaggtcggtgcggccaaagccaggtgacaccatcctgtttgaggcgtatgggatttgccatatcggcaggctggggccgaattatatcatctgtgaagacggcgacacatacgaaggcgaggcgctggaaaatatcagcgtgattggggtgcagatgtggaatgtagagggaatgtgcggggatgcagtgcataggaaccgcgctgcttcagcgtctgcatcaagctaa

SEQ ID NO: 114454 - DNA, 591 bp, Glycine max
  Peptide Sequence Number=SeqID_231232
atgtcaaatagaaagtatgaatctggttatgaaaaattgaagaaaaaacaaaaagttgaaaagctaattgaatctcaacgtggtgcccttgataaatttgttattattcataaaaatgacgcagaagcaagttcaataggtgaaaatgtgatagaacaaccactgatagatcatactgacaatgaggaaaatgttatagaacaaccacctatagataatactgacaacggtgtagaacaaccacctagagatgatactgataatggtataaacgtgatagaacaaccacctataaataatactgacaacacaaatagtcataattttaatcaagaactagaagataatattttagaaataggagtagaagggaatgttgagcataataacacttatagtgaagtacctacaaatatttatgacctaggactatggaaaaatattgatggaaaatttagagatttaatgatagaaaagggtcctctcagacatgacaattttcaatatccaaaagatgaaaataatagatatttctattcatcatgttatcaacgaacattgtcaaatggagaaaaacatgatagaagatga

SEQ ID NO: 114455 - DNA, 402 bp, Glycine max
  Peptide Sequence Number=SeqID_231233
atgactgataaaaccacgggaaaagcaattgagctggataccccgctgctgcgcggcaaaaccgaaatcacccacatcaccgtccgcaagccgcagtccggcgctatgcgcggcacccgcctgcaggcgctgatggatatggacgtcaacgcaatgatggttgtattgccgcgcgtcaccacgcccgcgcttaccgcgcaggaaatcagcgaaatggacccggccgacctgctgtcgctctccgtcgaggtgctttcccgacggcctgacggtagaggatctggtagcggacatcgctaccgtttttcactggccgccgccggtcatgtacgcggagtcgctgacggacgtgcaggagtggcggcacaaagcaattcagcgaagcggagccggcgacgatga

SEQ ID NO: 114456 - DNA, 837 bp, Glycine max
  Peptide Sequence Number=SeqID_231234
atgaaagcgttgctggccgcacagtcggtgtgcggcgtaaagccgcgcatcctcggcgcgccgggacacgatacgcaggccgttgcgaccgagctgctgagcgtggcgcagagcctgcgcgggtttgcgtacctgtccgcctacggctgcaaaagcgtggaggaggcgatcgcttaccgcgccaacttcagccagcgcgaagggatgctgatctggcctgacttcatcagctttgacaccgtgctgaagcaggacgccaccgcttacgctaccgcccgcgcgctgggcctgcgcgccaaaatcgacgagcagaccggctggcataagtcgctctctaacgtcggcgtcaacggcgtgaccggcatttctaaggacgtattctgggatttacaggaaccggctaccgacgcgggcctgctgaaccagaacgacgtcaccacgcttattcgcaaagacggctaccgcttctggggttcccgctgcctgagcgatgatccgctgtttgcgtttgagtgctacacccgtaccgcacaggtgctgatggacaccatggccgaggcgcagatgtggtccgttgacggcccgctgaacccgtcgctggcccgcgacattatcgagggtatccgcgcgaagctgcgcagcctggtgactcagggatacctgatcggcgccgactgctggctggatgcgagcgtcaatgacaaagagacgctaaaggcgggcaagctgctgatcgattacgactacacaccggtgccgccgctggaaaacctgctgctgcgtcagcgcatcaccgaccagtatctggtcgatttcagcagccgcgtgggcgtataa

SEQ ID NO: 114457 - DNA, 198 bp, Glycine max
  Peptide Sequence Number=SeqID_231235
atggtgtctttggtgtgttggaagctgactttgttgaaccttgctcatgcagaccaaagctttgagtacttcagttttatcaagactggagatgtagttgatgcgattgcagaggaattattgcaagcaaagagcagtagtcagaagacatctcatgctgaaaagcatttgaaatcatcaggtggaaaagtgatgtag

SEQ ID NO: 114458 - DNA, 615 bp, Glycine max
  Peptide Sequence Number=SeqID_231236
atgaacaacatttcttgggacaccatttgcaaccccaaggaccaagggggtcttggcattagaaacatccatgttctaaaccaagcctacttcattaaacttggttgggccctaattaatgatctcaatgtcctttgggttcacatcctttactccaaatataagtgtggagttgctagtattcttaccatagccaaaggccaccactcctcttatatttggaatgttgttgtgaataattgggaccatgtcctttctaacttggcttggtctattaataatggccatattaccagatttttgatggatgacaagatatcaggtttaggcccttttaacatgctcttagaggataatatccctattctaaagaagcactacccagtcttagcctatgtcaaaaatgatagttggagacgagacatcctcaattaccttttgccctctagtgcaagagctcatctctcctctattcctcctcctagagaaaggatggatgatatccctatctggaaggcctttaaggatggtgctttctttattaaggaagcttataactatttgactgcgacccctcctccaatgggaagcaggtccactttctcctctatttag

SEQ ID NO: 114459 - DNA, 291 bp, Glycine max
  Peptide Sequence Number=SeqID_231237
atggagccaagtcatgaaaccctttcccaaggtgtttcaaccctcaccagaccccctgacccgagaggaatctcttgtatgactattgatgaagcttttcaaccaaatgatgtgtcctttctagaccctagcaaagctaataaccctataagggacatgggattcccagggctctctttcacttggtctaggagtaacctcaaggagtgtcttggtagggtgttggccaacccctcttggcaaaaggctttccctgttgcttccattcacttagaggcatggttactttaa

SEQ ID NO: 114460 - DNA, 471 bp, Glycine max
  Peptide Sequence Number=SeqID_231238
atggcccatgctttgttcatccacaaagaatttcatagaagtcctttcttgaccatccatttttcaagacaggatgccaacattgtgtggcataaacccccgccttcctcctataaggtcaacacagatggttcctactctaacaccctcaacactactccttgtggaaggcttgttagagattctaatgggagagttctaaagtctttccatgttaatcttggcaattgcaatgctttgatggctgagcatagggcattgagcatgctcatcctctccccccattatcttagatggctcatctgtgacatcaaagccactttccatgatcatggctggaagactaccatctctcacatttaccgtgaagctaacaggagtgcagattttcttgctagtataggcctcaatgactcctactcccctggtttttgttcaccctctttcccctttgctcaggctcatcattga

SEQ ID NO: 114461 - DNA, 840 bp, Glycine max
  Peptide Sequence Number=SeqID_231239
atgaaggactcgctctccgacctagccatagaccccaaagctattatggaagttattacagatgacttatgttcctatgttgttgatggattatcaagtgcacaaattcattccaaaatagtaaattattactacgctggagctgaagatgaagacatgacctatgaatttcctttcaacccttgtcctactatcctggtccctgtggaatcctatgaccggtggtggttttgggtagaggaattcaaccttgaatatcaaggtttacacctcatatgctttcgttgcggcaaatacggccataatgtcaccatatgtcatatgcatgtgatcaaccctaaggatgccactagggttcctaatgatcaaaatggaagacctaccaaagaaggagatgatcgtaacatgtttgtggtctgtggagtcccaaattcccaaggtcaccaaaaccctaacatggaaagggcttttgtcccttggatgattgccaaaaagcctaaacaacatccacctggccctaaaacctctaagcctacaccaaatggtcaagctagggattctaaaaacactaatgttgatgctcagccttcctcctctacgactagctccagatacgaggccttggaagtggagcctaacactattagccttgacgctggcgttaacaacactcaaattgagatcgccaaacctccccttcctaagacacctaagccatctaacactgaaccctcatactctgggaaatttaaaactaattacaaaaaacaaaaccattccaaaccttattctaagccacacactccatccataccatcttttggtaaaaaccaaacttaa

SEQ ID NO: 114462 - DNA, 249 bp, Glycine max
  Peptide Sequence Number=SeqID_231240
atggaagcgccttcggttcgacgaatcgctgtcgtcgtcttcgtaaccgtctccgtcttctccatcgcactcgttgccgttttgacagattttggcggcggcggcggtgggactctcaccgataccatggcggcggtgtccttgtcgcgtggtttggatgaagtaaccaacacgttcctccctaattcgcatcgcaaactccttaccagtggtaattcctttttccttttcttattttttcattattaa

SEQ ID NO: 114463 - DNA, 261 bp, Glycine max
  Peptide Sequence Number=SeqID_231241
atgggtatgatacctgatagcaacaacccagaggagaaaccttacctgaagcccaagaggaacatcacgcgccctggtcacctgaaggacttgagattgaaccttggtgcaaccataaggttgctgtcttcttacccagagaggtcacagattcaaatcctgaaaacagtctctctcaaaaagaactttctgcatgagtatgacattgcatatgccattgctgtttggtgcaaaaacattgaccattacgagacatattag

SEQ ID NO: 114464 - DNA, 321 bp, Glycine max
  Peptide Sequence Number=SeqID_231242
cttcaaatacatgggtttttccaactgtgagaggggaggcaccggatgcacgagagggtcatgatgcagcacttgttggcaaacgactatttgtgtttggtggttgtgggaaatctgctgataatattaatgaggtgtactacaatgacctttacatattgaatacagaattgttcgtttggaaccgtgctacaacatcaggcactcctccatctcctcgtgatggccatacttgctcatcttggagaaacaaaattattgtgataggtggtgaagatgaaaatgattcttatctgtctgatgtccacatcctagatactg

SEQ ID NO: 114465 - DNA, 369 bp, Glycine max
  Peptide Sequence Number=SeqID_231243
atggtccatgacatctttgtcaaggtgaaactggaagtaacaaggacatcaacagtcctaaatgtgtttggcagtagacgaagcagtgataaatgggtttatggtcccaacatggttggctcatggtacctaacacatgaaactaagaataggaaaacgcaaggatcatgcatgagtaaacatgtaaataaaagcctggaaaatcatctcttcttacttgcgcattcaggggcacagtgccccatgtgtgcaagtaagaaggtgatatggaccttctggcttcccatgacaaaagttgagactaacatacaacgtgtgtgtgaagacatgatgcagacgcgcaaaagcgcaacacgaggatgtacatag

SEQ ID NO: 114466 - DNA, 468 bp, Glycine max
  Peptide Sequence Number=SeqID_231244
atggaagcatcgttgcataatcaagtgaggttccgtaacattccaaaatctaagccgaggcgcttccgaaacgtttccgtaacgttttccgtgaagaatttcgcaaaggtttcaaccgttcttcgacgttcttcattcgttcttcatcgttcttcgatcttcaacgggctgccgtcccttggggcggacgtgtggggtgctaataccttccccgtgcgtaaatacaactcccgaacctttcacttaaaagttcgtagatcgcgtcttttccggtttttccgacgttttcctcaaataaacgttggtggcgactccgcgcatattcctttcgtggaacacgcatcccgcgagtcacgcgtcgccctcccgccgaagggtaggttgcgacagcatgtatatgagctcatagaccttagtgaatctcggattcacagtggattctggatccacattggtttcaggaactaa

SEQ ID NO: 114467 - DNA, 1125 bp, Glycine max
  Peptide Sequence Number=SeqID_231245
atggttgataagaatctttctttcctgtatgaatatgtccagcagtctctggaaaggggtgctctgccctacattccggaggatgagcgcaatggaatggtgaatgtgagcaacttcagaagccaggatcaacatgaatctgcacaacatggtctgagatttgaggcatatgaagttccaaagcctccaatgccgtcaaaacttgctccagtttcactttcatcctcaacagaccttgttccagtacctgagccattgtattctagggagactcacccgatctcatcaatgggagcatcagagacaggatcctcagggcttaagctgaagcttgatggtgttcagaagaaatggggtaggccaatttattcatccccagcatcatcttcctcaacttctacttcccaaaactcagtgaatggggtgactcagatggatgttgcaactgctgtaaattcaaaaggacgtgataattatgatagaagaaagcaacggattgaaatttctcctgaaaagcaaaaacttgcagataaattgtttggtggttcaactaaaactgagaaaagatcatcaactagcaataaggttccaaaggctagtactagtgctgcagacagaactcaggaatcaaaagccgcagctgtacccagtgaagtagctcgggagaaaactaatcaacaatctcctcctccagatttgcttgacttgggagaaccaactgtcactgttgcacctccctctgtggacccattcaagcaactggaaggacttcttgacccaaaccttagttctacagcaaatcgtagtggtgctgctgttacgaatgcaccagatatcatggcactctatgcagagactcctgaaagtagagagagcggcagtggtgactattctatccctgtgaggggggataatgtgaatcttctatcagagttttcaaatgcagctgccagaggtactactgtagaaacaacagtgacgcctttgtcacagtctgtaaagggtccaaatgttaaagattctttgcaaaaggatgcaaaagtcaggaagatgggtgtgacaccctcaggcatggatgatttcagccacccagaattgggtgattcaattagcaggaatgtctaa

SEQ ID NO: 114468 - DNA, 240 bp, Glycine max
  Peptide Sequence Number=SeqID_231246
atggctaagtttgacccagatatagttctggagttttatgctaatgcttgccccatagaagagggagtgcgggacatgcggtcatgggtaaagggtcaatggatcccctttgacgcagatgccctcagtatgccacccactaggcaccccctagacccggataagtctaaacagggccgtcgggtttcttgcattgatcatgggcctctgccggttagtcggggttcccgtcacacctag

SEQ ID NO: 114469 - DNA, 204 bp, Glycine max
  Peptide Sequence Number=SeqID_231247
atgcttccttttgacttccggcatgtcacggaacttcacggattgcctaacaatgggtgccaagtacctcgaagtggtcaaacgaggatcgcatcccaacaaacggatgatccccggacgaaattagggtatgacaccagggatgcaggagaaggccttagggctctcatgagccttaggatagattttaggcccatgggctaa

SEQ ID NO: 114470 - DNA, 513 bp, Glycine max
  Peptide Sequence Number=SeqID_231248
atgttgctgcgcggggtgtatgctgacctcccgcgagcacccgcctcgtggttggttgaaatctgggttcatggccgacttcgccgtgataaaatggtggatgagccacgctcgagaccaatcacgtgcgagccggtcagttctggacccatcgacgaccctttgcgtgcacgcacgctcccaacgagacctcagtctggagaagcgtcctcagtggcggaccgggcccaagtcccctggaagggggcgccagagagggtgagagccccgtcgtgcccggaccctgtcgcaccacgaggcgctgtcggcgagtcgggttgtttgggaatgcagccccaatcgggcggtaaattccgtccaaggctaaatactggcgagagaccgatagcgaacaacggatgggggccggcgatgtgtcccggtcggatgtggaacggtgagagccggtccgccgatcgactcgggacattgaccgacgcggattgcgatggtggcccaagcccgggctgttga

SEQ ID NO: 114471 - DNA, 615 bp, Glycine max
  Peptide Sequence Number=SeqID_231249
atgtcccgagtcgatcggcggaccggctctcaccgttccacatccgaccgggacacatcgccggcccccatccgcttccctcccgacaatttcaagcactctttgactctcttttcaaagtccttttcatctttccctcgcggtacttgttcgctatcggtctctcgccagtatttagccttggacggaatttaccgcccgattggggctgcattcccaaacaacccgactcgccgacagcgcctcgtggtgcgacagggtccgggcacgacggggctctcaccctctctggcgcccccttccaggggacttgggcccggtccgccactgaggacgcttctccagactacaattcggacgccgagggcgaccgattttcatggtgggctttttcccggcaggcgtgccctcggcctaatggcttcgggcgcaacttgcgttcaaagactcgatggttcacgggattctgcaattcacaccaagtatcgcatttcgctacgttcttcatcgatgcaagagccgagatatccgttgccgagagtcattgtatgtaaatgttgtgtcgtgacgactcccgcgggacaccgtctccgggcccccgggagtcgcacttaa

SEQ ID NO: 114472 - DNA, 885 bp, Glycine max
  Peptide Sequence Number=SeqID_231250
atggccattcaccacgaaacttgggctttcgttttcggtcttctagtttcagaggacatgatgataactagaaccacatgtggcaacgtgatctcctttatggtgttccttgctccattaccaactttttaccaaatctacaagaagaaatcatccgaagggtttcaatcactaccttatgttgttgcactgttcagttcaatgctctggatctattatgcatttgtcaaaaaggatgctagcctccttctcattactattaactcctttggatgtgtgatagagacaatttacctagccatcttccttgtttacgccccaagtaaaaccaggctttggaccatcaagcttcttctcatgttgaatgtttttgggttcggagcgatgcttctttcaaccctataccttacaacgggttccaaacgtcttactgtgataggatggatttgtcttgttttcaacataagcgtttttgctgctcctctttgcattatgaaacgtgtcataaagacgaagagcgtggaatttatgcccttcagtttgtccttctctttgaccataaatgctgttatgtggttcttctatggccttctcctcaaggactactacatcgctctaccaaatacgcttgggtttctattcggcataattcagatggtgttgtatttgatttatagaaacgccaagaaagatgagccaatgaaattggaggaactaaatagtcatattattaacgttgggaagctgagcagaatggaaccctctgagccgaatcatgcaacaaaaaatggtactgtgactgagataactattgaggatccaaatggaaaagaaacagaagagggaaacttgaagaacatcatgaattcggctagcaatgtgtga

SEQ ID NO: 114473 - DNA, 1095 bp, Glycine max
  Peptide Sequence Number=SeqID_231251
atggcggcaatcagcaacatcggttcacattttccagggaatttaagcgatgcaaagaaggataataatgttttgaggcttagtttttgttctccacgcaacactactaacatgtctaataacaaacgaagatttttatcggtgagtgcaagttacaatgacagtcctcgaaaaatggacacaacaaatagagtgaatgtgaatggaataaacgtggcagaggctcctctacaagcagggaaattggcaaatgaaagtgcagcagatgaagctattgttaccagcttgcgtggaaggtttgtggaggataaaactgccacaatggagacaatcatgaattttcttcaggaaactgctttgaatcatgtcaccagctccgggattggtggagaaggatttggagcaacccgcgagatgagccttagaaaactcatttgggtggttactcgtattcaagttcaagtgcaaagatataacaaatggggagacgaaattgaagttgatacttgggttgatgcagcaggaaagaatggaatgcgaagagattggataatcagggatcattacaccaaagaaatcataacaagagcaacaagcacatgggtgatcatgaatagacaaacaagaagactatccaagatccctgaagaggttaagcaagagcttcttcctttttaccttaataacaggcttgccgttcctaccgaagaagcagattctgaaaagatagacaaactcactgatgaaactgctcagagaatccgatctggcctggctccaaggtggaatgacatggatgccaaccagcatgtcaacaatgtgaaatacattggatggattttagagagtgtgccaattgaagtgctagaacattataatatgacaagcatgactttggagtttcggcgtgaatgtacacaatcaaatttgttggagtccatgacatgtccaacagcaagagttatggagtccaataataattccaagaacagaaaacccgaactgcaatacacacacttgcttcgtctgcaacaatataaagcagatgttatccgagccagaactgaatggaatttaaagcaaaagcaacagtga

SEQ ID NO: 114474 - DNA, 954 bp, Glycine max
  Peptide Sequence Number=SeqID_231252
atgacatcaatggtggcacccatcaacatggggctacaatttcgaggaaattggtgcaatgtcaacaagaacaagggaagggagtttttgaagccaaactttaattcctcatgcaacactaatattgcattgaacaataaacgaagattttcattgttggtgactgcaagttctcaatgtagtcctgggagaataatgggcacaatcaatgaaataaaacatgttccaatgattcatcctgcagcaggaaagttggcaaatgaaaacaaacaacatacaacccttgttaccttgtttcgtggaaggtttgtgaaagacagacaaaatgatgaatacgacaggggggaggaaattgaggttgatacttggtttgatattgccggaaagaatgggattcggagagattggataatcagggatcattataccaaagagatcatagcaaaagcaactagcacatggacgatgatgaatagagaaacaagaagattatccaagatatctgaagaagtcagacaagaactggttcctttcttctttaataagcttgccattgccagggaagaaatagatcatcagaagatacacaagctcactgactccactgctgagagttttcgatatggagtgactccagggtggaacgacatggatgttaaccagcatgttaacaatgtaaaatacatcagatggatcttagagagtgtgccaagagaagtattagaagattataaaatgacaagcatgactttagagtttcggcgtgaatgtactcaatcagatttgttggaatcaatgagtagttcatcctccaacgtgactggtgcctctaataatgactctgttaacacaaaacctgacctgcaatatatacacctgcttcgtctacaagacactaaagccgagttggtccgagccagaacagaatggcatcttaagcaaaatcacaagtga

SEQ ID NO: 114475 - DNA, 483 bp, Glycine max
  Peptide Sequence Number=SeqID_231253
atggatgttaaccaatatgtgaacaatgtgaaatacatcacatggatcttagagagtgtgccaagagaagtattagaagattataaaatgacaagcatgactttagagtttcggtgtgaatgtactcaatcagatttgttggaatcaatgagtagtccatccgtgattggtgcctctaataatgactctgttaacacaaaacctgacctgcaatatatatacacctgcttcgtctacaagacactaaagccgagttggtccaagccagaacagaatggcatcttaagcaaaacacaagtgatgcaaggttatgaattgaaaactgtggatgctttggatgggcaaagaaatgtggaagaaagaaagggaactgtacaaacttttgcgctcttcctttgcttgttaagcatgcacagtcatggaaattttggaaaaacttgtgagacccacgtgaaaagatttccacgcaaaaacgaacagtaa

SEQ ID NO: 114476 - DNA, 214 bp, Glycine max
  Peptide Sequence Number=SeqID_231254
tcaccgccgtgagattgatcgtgaaagggatgggacaagactgatgcaatcctacccctcaagggtattagatagaagactccaagaggattgggctagagttgctaaagaaggtcttggggttctcataaaccccaagctaagctctagcttctctaggaatcttctcaaggaagtttctcaaggaagcttcttaagaaagcttctcaaggag

SEQ ID NO: 114477 - DNA, 189 bp, Glycine max
  Peptide Sequence Number=SeqID_231255
atggcaaaaaatttctctaagaaattggctatgatgttggtgcctgcagagtgcgtatttgccatctcactccacccatgcacacttcctgtgtgcattgccaaatgcactcaaattctaaagcataagtttatgagtgcatcttgcacgattacctcaacgggaaaactttgtctttgctttggttga

SEQ ID NO: 114478 - DNA, 228 bp, Glycine max
  Peptide Sequence Number=SeqID_231256
atggcagccacaaatttccctaagaaattggctctgatcatggtgatcacagtgatggtcatgttggtcttggagccacagcatgtggagtgtgcatttgctgtcccactcaatccctgcacagttcctgagtgcattgctcaatgcaagaaaattctgcacgcaaaatttatgagtgcatcctgcacaactggctctcagggaaacctttgcatttgcttaggttga

SEQ ID NO: 114479 - DNA, 246 bp, Glycine max
  Peptide Sequence Number=SeqID_231257
atgtcggagtttatactcagatctcttcaccctccgcaagctaaggcgcctcatccctatgcttccaccccaatactagcaccaccatcatcactgcaaccgccacaacccaattatccaccaatctcgacttcgccgcctaccacctccctccctgcgcgtccaccttctccgagcacaccccctacgggaaccaaaaacgctcccaacataattttgttgtataaaaaaagtttagatctatga

SEQ ID NO: 114480 - DNA, 549 bp, Glycine max
  Peptide Sequence Number=SeqID_231258
atgaccaacaaggtagtgccactcccttacgacccgttcagcaataaactcgcagtggaattgccctcggacccaaaggacctgcagcagatattccatgacatgagaaccggcgaaggcttattcaaccacgcagttaagctgttcgcacattgtccaaagagggtctcacccatgaagccttggagctcttcgcccgatcaaggaggagggccacatgcccgacgtggtggctcacagcaccgtcctcgtggcctacaccaacgccgcttagcccaaagaggctctcaaaatgttaaatttgtggaggcttgtaagtacgttttggaaatgatggataaggggatgagacctaatgtgcagacttatacttgtgtgtttgaggggttggtgagggaggagaagcttgatgaggctgcacgattgttggagcagatgaaaggtaagggttttgttcctgatgagaaagctgttagggaggttctagccagtaaaaaagggactgtttttagaaatgttaccaaccttctttttggaaatccattataa

SEQ ID NO: 114481 - DNA, 1944 bp, Glycine max
  Peptide Sequence Number=SeqID_231259
atggcttcaaccataggtatctcttcttccatctccatatacaaaaccccctcttttcaactcttcaaaagaccagccgccacaaccacctccgttttcttcaacacccttccccgtaaccgtgacgccacactctcttccgttccttccgccattgccaccccatccattctcaccgaacaacccttaaagggcttaactttggacgaccttagtaatagcgaccaatttggctatgacttcgaacccgacaccaacgttagcgaccacgaactcgacatttccaagttgggtttaccttcgcccctcgtccactccctccaaaaacgtgggatcatcagccttttccccattcagagagctgtgttggtgcctgcactagaaggtaaagatatcattgctcgtgcaaagacagggactggcaagactttagcattcggaattccaattcttaaaggtctcactaatgatgatgaacaaagtcctcacaggcggtctgggaggcttcctaaagcgttggtccttgcacctactagggagttagcaaagcaagttgagaaagagatacaagaatctgcaccttacctcaaaacagtttgtgtttatggtggtgtttcttatgtaacacagcagagtgcgctttcacggggtgttgatgtggtggttgggacgccgggtagaataattgacctggtgaatggaaacagccttaaactgagtgaggttcagtatttggtgctcgatgaagctgatcagatgcttgctgttgggtttgaggaggatgtggaggtcattttagataaggtcccgactcagcgccagaccatgcttttttctgcgaccatgcctggttgggttaagaaactgtccagaaagtatttgaataaccctttgacgattgatttggttggtgaacaagaagagaagcttgctgaagggatcaaactttatgcattattagccactgccacttcaaaacggacagttctttctgatcttataactgtttatgcaaagggtgggaagactattgtttttactcagacaaaaaaggatgctgatgaagtatcaatggcattaacaagtagtatagcttccgaagcactgcatggtgatatatctcagcatcagagagagagaacattgaatggttttcggcaagggaagttcacagtgcttgttgccactgatgttgcagctcgtggacttgatattcccaatgttgatttggttatacattatgaacttcccaatgatgctgagacttttgtacatcgttctggccgtactgggcgtgcaggaaaagagggtacagccattttgatgtacaccagtagccagaggagaacagttagatcccttgagcgtgatgtagggagcaaatttgaatttgttagtccaccagctgtggaagagattttggagtcatctgctgagcaagttgttgctacactaaatagagttcatcctgagtctgttgaatttttcactgcaactgcacaaaaactggttgaagaacaaggagcaagggcccttgcagctgctctagcacagatgagtggattctctcaacctccatcatgtcggtctcttatcaatcatgaacagggatggactacattgcaactgactcgagattcagatacttctggaagatatttttctgcaagatctgtcactgggtttctttcagatgtttattctcaagctgctgatgaagttggaaaaatacatttaattgcagatgagagggttcaaggagctgtttttgatcttccagaggaaatagctaaagagttgctcaataaggatatgccatctggaaatactatctccaaaatcaccaagctatatgccctcacgacccccacgacgactaccacgacttcaacggtgacagaacaacaatgtcagtgctgccagaggcggagtgtacaggcgtaa

SEQ ID NO: 114482 - DNA, 383 bp, Glycine max
  Peptide Sequence Number=SeqID_231260
ggattgatggggacccggtgttgagaggaacgaggataagggctacgtgggagtacgtgatctcagttgaaggtgggcaactggggatggttgatttatgtgtgatttgtggatgtggagagtcgacttgcaccatcgcccaattgccacctatggtacctggagatatgtcgcgggggtcaagagaccttggggacgtcaggcgagctcctggcagtcaaccgataaaagaacaaagaccacaaagcaaggaggcttgtgtggtggctggccagctatggatcttgagtgatatttgggttatggcctctgaatggggtcaggaagttgagatggcctctggtaatcgattaccaaggggtgtaatcgattaccaggcttag

SEQ ID NO: 114483 - DNA, 343 bp, Glycine max
  Peptide Sequence Number=SeqID_231261
gaaggataaagagcttagaggaagcagcaatggtgttattggaggggaagaaactgaagtccctgaggaaagtgaagaggtgcaagccttgaaagcggaacttgaaagaacacaagtggtcaaggaaaagttcaagccgacaaccattagggtcagaaaagagtgtgacgagctgagggacgtcaacatggccatagctgaagcattagaacaagaaacgaagagggcacgaaaagaagaatggggccgaaacaaacaagtcaagggtggaaggaatgatattagaggacaagttgaaggcttgtcaaaggtcgaagaggaacttgaccaaacagttgagtag

SEQ ID NO: 114484 - DNA, 719 bp, Glycine max
  Peptide Sequence Number=SeqID_231262
gaaggcataggtcacatcttagacctcactcctataggagagaaaaggaaagaaagcctcaagagactaacattaacctcccatacatccatgggaagtacaatgtagaggctaacttagattgggaaataagggtagagcaacaacttaaaaggaagtatacttcaaaatcttatggttctcactcttatccaaagaaagaccaaggtcaaggcatcttacgggtgacaccttctaagcccaaagatgataaggggaagacaatagaaaagaaaccccttagggctagtatgcaagagaggactagctccataaagtgctttaaatgtcttggaagaggacacattacttctcaatgccccaccaagaaaaccatgattatgagggaccaagacatttatagtagccaagatgaggatactacttcaccttcctctagtgaaagtgaaaaagcaaaagggaaagaatctagtgaagaaatctacccccaagaagaaggacaacctttaatggttaaggaggagtgtaaggaggtaagtgtctcctccaagaggttagctaagaaggaaagtcattttgaaataaagacaaatattaaagaaacttcccctcttagacaacctcttgggcttgaggttattcctcaagtaaaggagtttttggatgaggatttgattcgtaagagcttaaatccttgtgctttgttggtgccaaaataa

SEQ ID NO: 114485 - DNA, 315 bp, Glycine max
  Peptide Sequence Number=SeqID_231263
atggaggcggcgagcagcaatggaggttcgcttgcggcaaggagaagacgtgcagaaacagttttcgttttagtgccacaacatgatagaattatcactacttggaactgttgctgctacataagaatggttcttgagttcttctggtttttcaacttgaaggaggctgtgttgcctcttccttccttgcttttgaactgcctggcttttgaaggctggtatcctcttgttgccattgccgagctctcaatggatgttcccagcatgagtttcctcctactttcttcccttctcacatctgagaagacttcctga

SEQ ID NO: 114486 - DNA, 135 bp, Glycine max
  Peptide Sequence Number=SeqID_231264
atgaagaaggagaatgaagaaggaggttggaagaatcactcctccggaattggtgtcacacacaaggttaagtggtggctggacagaaatatagaaatgacaataactgaagctacagggctccaaatgaggtga

SEQ ID NO: 114487 - DNA, 3002 bp, Glycine max
  Peptide Sequence Number=SeqID_231265
atgaaggcaattctgggttatcaagaagtggctgaaattgttgaggaaggttatcccacaatcactaaaggctctacagaagcacaaaaagccctttacatagaaaacaagaagaaagattgtaaagctacagtcttgattcatcagtgtgtagatgatgcacactttgagaagattgcaggcgctgcaacttcacgagaaacatggaagatctgggagaaatgtaatgagggtgtagaacaattgaagaaggtgaaactacaaacgacgaggcgtcaatgtgaattgatgcaaatggagaacaatgaaaagatagctgatttcttcaatagaatcatcactcacacaaatgttatgaagaactgtgatgagaagatttcaaaccaaacaattgtagaaaagatcccgagaactcttaatcccaagttcaaccacattgtcgtagccattgaagaatccaagaaacttgaggaaataacagtagaagaacttcaaggttctcttgaatcacatgaagaaagactcattgaaagagaaacaacgaatccaagggatcatcaaacattgcaggctcatacatcaaagagagtaggcaataattccaaagagtgtgtagccacaccaagtagcatagatcacatggggaatcagtcacacaatgattatcaagcacatatggccaaagaagagaatgaagtagactctgaagaacaacccttgatgctgatgatgattaccgattcagaatctcataataatgaaacccgatatagagattctggatacacaaaccatatgattggacatagggattggctcgtcaattttgatgcaatggagaagagtaaagtaaggtttgcagacaacagagttatacaagctgaaggagcggggaatgtggctattagaagactagatggaagacaagcaatgatcacagatgtactctatgttcctgggatgaagagtaacctgataagtatgggtcaactcctagagaagggattttcaatgaaaatgagtaatgggtctttggaagtctatgatacaacaaagaaaatgattatgaaagccgcattggccagaaatagaacgtttaaggtaaatctgaatactattgaacctcaatgcttctctgctgttacattgtctgatgactcatgcaagcaacccaaaacatcttgtagctcatacaccatttccaaggctaatgatgttctacacattatatactctaatgtttgtggaccatttgatgttccatctttaggaggaaacaagtattttgtttcatttgtggatgaatttagcagaaaactatggctttacttgattaaggtcaagagtgaagtgttcaatacatttaagggattcaaggctttagtagaaaagcagtccggaaagtgcatcaagactttgaggaccgatggagtaggagaattcacttctagtgagctagaagatttttgcaagaagcatggaattgtgcacaaggttattgccccctacactccccaacataatgggatagtggaaagaagaaataggattatattgaacatagtaaggtatatgcttaaacagaaaaatctcctgcacaacttctggggagaagcaaccatgactactgcccatgtccttaatagatgtcctaccaagaggctgaactcaatggttccaaaagaagcatggtctagcaacaagccctcaatcaaacattttagaatctttggttcattgtgttacaaacatgttccagaccaaaagagaaaaaaacttgatgataaaagtgaaccaatgatctttgtaggctataactctacatgcttatacaagttgtacaatcccaagattaaagaagttcttttcaacatagatgtttatttcgatgaatcaaaatcatggagtgaaccacaagccataactgaaacaattccaagattgcagcttaattgggaagaaattgactcaggaaaagaagccacacagggtacattgaatactgagcagcagattatgaacaacagacctagaagaaacaaaaatttccccttaagactcttagattatcaactctatcctaataatgccatttctggtgatggtgacttggttcagcaacttgcactcatggccgatgcggaacctattgatcttgatgaagctattgtaagtgaggtatggagatcaaccatggaagaaggattaaggagtattgagaagaaccaaacctgggaaatggttaaactcaaaccagatggaacagttgcaaaatataaggccagattggtagccaagggtttcatgcagaaggaaggaatagattacacagaggtttttgcccctgtagccagacttgagactatgaggttagttgttgccttggctagttggaaaaattggaagttatggcagctggatgtgaagtcagcattcctcaatggaccacttgatgaagatgtgtttattttgcaacctcttggttttatatgcaaagggaatgaacacaaagtgttgaagttgaggaaggcattatatgggttaaaacaggcacctagggcttggaacaagagaattgacacttttcttcacaatattgactttcagggagtttacataaaattgtttaacatgtgggattgtaacccaacagaaactccagtagaggtgaatttgaagcttgcaaaaggtgagaatgaagcctcagttgatggaaccttactagagatcacattcaatgttggacttgtgagtagatttatgagtgaccttaggcaatcacacttgctagctactaaaaggatcatgaggtatctaaagggaacattgggatatggaatcattttccctcatcaaaccaaagatgatgataatctacatgttgtagcctattcatattcagattggtgtggagatttggttgataggaaaaaagcattatgggataagtatttctactgtctggctctcccatatcttggaactcaaagaagcaatcagtg

SEQ ID NO: 114488 - DNA, 231 bp, Glycine max
  Peptide Sequence Number=SeqID_231266
atggaaaagaaacctatgacttatgtgataaaaaagaagtattggccaaaggaagatacaggcatgccaattttcatacatgaggataatgcaaggtgtcatgttcatcaagatgatccatatttttgtcgagcaacaagtgaaggaggatttgacattcatttgatatatcaacctcctaattcgcctgatctaaatgtgttggatctaggatttttcaatgtcatctag

SEQ ID NO: 114489 - DNA, 608 bp, Glycine max
  Peptide Sequence Number=SeqID_231267
atggtaccgaagtgggtgattagctcagttggtagagcatctcccttacaaggagggggtcggcggttcgagcccgtcatcacccaccacttcgggtcgttagctcagttggtagagcagttgacttttaatcaattggtcgcaggttcgactgaatcgccgggagcgattcaggctgatgcgccagcatcacccgcagggcgaggccccggatgggccgaggcatatcctgcacgacccaccagattcaggaaagagcgcccaatgggcgcttttccgcttcagctcggctgcgttccgataacgaaagggcacatttgcaaggagaacgttatgaccaccatttcgaccaataccaatattggcagcagcagtacttcgggatccggaagcgcatccggcagtagcgatagcgcttcgaaaatcgccagcctgaccaaacaaatcgccagcctcaacgatgaactgaaagacatcgcgaaggacaaaagcctgaccgagaagcaaagaaaggataagcaggagacgattaacgcgcagattcagctgctgcaggcgcaaatccagcagttgcagaagcaggaaaggagaaagcggagcagaagccg

SEQ ID NO: 114490 - DNA, 318 bp, Glycine max
  Peptide Sequence Number=SeqID_231268
atggctccgcacgtgcaaatgaaagcgacgatgtacaacaagattgaaaccatttggcggccgaatttcgaatctcctccgtcagcgagagtcggcgagaaaacggcgattcgaagtgtgaaccctaggcgcaatcggagaatgattttgggaagaggaaaaggagtagatctgagaaggtgttggatgagaaaagggaaaggtgcatgcagtggccaccgaataatggcggcgatgaaggaatcggaaggtttctttttctttctattcttcccagttcccagtgcgaacatacacaacggtacaaaaataaaataa

SEQ ID NO: 114491 - DNA, 435 bp, Glycine max
  Peptide Sequence Number=SeqID_231269
atgggtagtgtgagtatgaacccagtgtttcggagtgaagtaccttttgggtattactactataataataactacactgaacagaacaacaccatgctagagaagaggcaagtattcctgagaagctaccagttctgtagaaaaaagagtttcacagagagaatcaaagggtctttggttcgtgccaagaaaattgtttggctaaggctaaggtctgcttgcaaactcaggaggtccttgaaatgcgctttctattaccgcaggagaaggttcttccagcttttacacaacaacaacaaccgcataaccgaatcttcttcatgtttatgttcgagatgcttggtagtctttgctccggcaaagctgcaagagctgagggttatggtgggggatcctttctttgttaaagagaaaaagctgggaatgggagtgtga

SEQ ID NO: 114492 - DNA, 177 bp, Glycine max
  Peptide Sequence Number=SeqID_231270
atgacccttccatcacccactacctcacaccatcaaaccacacttcctttttctaccacctccacttcaactctaaggaaatcattctctcaacgcgactgccaccatgagttccgcttcatcaactgcctcaagcaaggacagacatattcaacaattctagctttgaatccatga

SEQ ID NO: 114493 - DNA, 445 bp, Glycine max
  Peptide Sequence Number=SeqID_231271
aagaagggtggtggttggggaagggaggggatcaccgtggtggaggatgttaggaaggattgaggaggggggacatgggattaaaggcaagtggtttaagcggtctacatgtaagaaggtggggaatggaaaggtaggtggtgttagagatgggaatagagaacaagtctctttgggaagaagagttatttctagaactacaggaagtgtggtggtgacaacgatcaagcttaaagtggatgattgctggaaatggatgcgggtggcagatggaatatattcagtgtcgtccgcatataggggtttgaagataccaagtagaggatcacaagtacaagtaaactggaatgggaggtggaaacggcatcacacatatctcttggttgcgataaagctcagcttgtgtggtattactgctacagatggttgggaatggtctctgtaa

SEQ ID NO: 114494 - DNA, 216 bp, Glycine max
  Peptide Sequence Number=SeqID_231272
atgggagatcgattagaggacatgatttgttatcttggaaaagagtattttcagcaagtacatgcccctttgtatgatacattgaaaaatgatttgaagaatcccgtattcagggagcaagaaatcattgacattgttgttaacggtgttaagtctaagatgaatttgaagaaatgcataaatgctccaagtgtgggtgatcgaggctgtacctga

SEQ ID NO: 114495 - DNA, 315 bp, Glycine max
  Peptide Sequence Number=SeqID_231273
atggaaaaagctaaaatcatcaaaacaagcctaaggcttaatacaataagccaaaatcttcataagcatgacgtggccacccaacaatcccttggttacagctacgtcaatttcagcaactctcatgatgccgcaaaagcaattgatgtgctgaatttcactccgttgaatggcaaaatcattaggataatgtactctattcgggaccctagtgctcaaaagagtggtgcaactaatgttttcataaaagaatttggacaaggccatggttttgtgaagtttaagagtgaagaatttgtaggattcaatgactga

SEQ ID NO: 114496 - DNA, 921 bp, Glycine max
  Peptide Sequence Number=SeqID_231274
atgatagatgattactcaaggtttgtttgggtttttctcatgcattcaaaggctgagacacagtctcatttaaagaattttgttgccaatgttaaaaggaatgtgatcttctatgaggattgtttttcattcattggccaaaacaaacctgatcctgtcactatccttcctattcctcataattccattgatcaatctaacggtgtctcatcagaatcaccagttgatcatatcatgcatgtgccaaataatactaattctgatcccttgactttagagcagtcctctaatagaaccagaagatctctaagacaggcacatagaccgcaactatatggactgaaacaagccagcaggcagtggtatgccaggctgtctttctttctaatctcacatgggtacaagcaatgtgcttcatatcattctttgtttctcaagcatggattcaacactatcattgctctgttagtttatgtggatgatattgctttgcattgtagaagcaagcttcatgatgttgaatcaagattgattcaagttgttttgatgataacaaagatgatgacaaaaaagcccaagagaatgatttcaagattgagtaaagaacaattcaagaatcaagagaaatttgatttcaagattcaagaaaagatgaattcaagattcaagagaagaaatcaagaagacttcacaagggaaggtacatcctttgtggtacaagtaaagggtacatctacttgggttgttgtgactgagaacaagagagggtacatctcttgtggatcggttctagtggagggtacatccactaggttgttcaaagagaacaagggagggtacatcccttgtggatctttgcttgtaaaggcttttacaaggatgaaaagaaatctcaaggaccgcaggtcgcttggggactag

SEQ ID NO: 114497 - DNA, 795 bp, Glycine max
  Peptide Sequence Number=SeqID_231275
atgccaattgcatctacacccttcttaattattccgaggccatttgatccaacaggtattacacagttgttggacaatgcttttaagataaaggatttaggtgacttgagacacttcttaggttttgaagtagccagaaaacctactggtatcaatctatgtcaaaggaagtatgccttatacattctcagtgatgctagtatgcttggatctaagccattatctactccatcagattatgctactaagctgcatcaacaatcaagaactcctctttcattggaagatgtttcctcttttagaaggttaattggtagactgatctacttgactaatacaaggccaaatatcacttatgctatgcaacatctaagccaattagttgttgctcccacctcagctcatcaacaggctgttgttcgaattctcagtgattctggctgggctggttgcattaacaccataaggtctatcactggttatgctatgatgtacattagtgactcattgatttcatggaaatccaagaagcaagccactgtatctagaagctcatcagaagtcgaatacaaagcactagcccacgccatttgtgatctacaatggcttacctatttgttggaagaattcaaagtgttaagtggtcttgtgaagttgcttctcattccttctacaaatcaattagttgatgtttacactaaagccctaatgcctggtccttcaatggtgattttcaaccatggatatgcagtagaagataaaggagaagaagtgagaggaggcgtcatccactaa

SEQ ID NO: 114498 - DNA, 372 bp, Glycine max
  Peptide Sequence Number=SeqID_231276
atgaacaccaagcctccgcccgtgaccgccgagaagaagatgaagaagaagttggccacgtcggtggagaagccagttctttcggtttttgcattggggatttcctcattccaaattccattcaatgtttaccatataattttcatgccacctagtagaaaggccaacgaaaggatccctttactctggctaggttctgttcagttaggatgtgaattgtgcggcaaaacgctcttgatctctcttgagggccttgtcgaggatgggttgttggaaaaacacgagcttcctcaaccaattgatgcaaagcgggctgcagataggctgatttcaagtgaagggaaactcaaaacacagcttgagaatttttga

SEQ ID NO: 114499 - DNA, 438 bp, Glycine max
  Peptide Sequence Number=SeqID_231277
atgaatacatcatcaaatgtttctgatgctggcccatcaaatttacatgtaccgagaatagtgcaccgatttgaagcgtcattccatgttcagcagaatgccattgaggttcctttgtcttatcatagacaatggtccccaaattatccaaattatgtgttatttgactacgaaggagacaaacattttataaagcttcataaatatggtaaccgtttctattttggtgatggactcaaggaacttaggaaaacccatggcatccacgaaagtgttctcatgcggtttgttggaagggacaaaaatactactttcagtgtggacgttgtgagacctctacaccaaagggcagccccaaccataaggcatcatgtttttaccattgatgtctctgaagatatgattcaacaaaattatcaattggtaggtgtttcttaa

SEQ ID NO: 114500 - DNA, 639 bp, Glycine max
  Peptide Sequence Number=SeqID_231278
atgatggaggtcagcatgactacagtcatttccgcaagtacctccactgaggtggacctaactcacccatccggcttcaatcaagtaaataatctagccttggatatggtaggtcaggggggcaaagagttgggaagtacgggcaacccccattttgtgcaagttcaaaacgagtattccttcccaccatacggcctgcctcccaactatgcaccacccaatgttgtacatgtgttcgaagagaacgtcgaccactctggtcccataccccttgagagccaacaacctcaatctgggcatgcacatgtcactcaacccatgggggagacgcatgagtattgcccacaaccacaaccctttcattttgcggtgggaagagtccctcctgctatagtggaaagggagaaattggatcatatagaggaaatgctaagggtcattgaaggaggtggaaattatgcctttgccgacatggcaaaactatgcctagtgcccgatgtcatcattcctcccaatttcaaggtgtcagactttgacaaatacaaggggactacttgccccaagaatcacctgaagatgtacaacaggaaaatgggggcatactcgaaaaatgaaaaattgttgatgcatttcttctag

SEQ ID NO: 114501 - DNA, 618 bp, Glycine max
  Peptide Sequence Number=SeqID_231279
atgttggataagagagctgcaactctgttttgtgccacatggccctgtgtgctatttgggaaagatggtatgatgtctatggttgttaagtctacgacaaaggattctgtgaaatgtgcagttgttgatggaggagagctcaagtcaaggatgccaaaagttgttcatgaactgaaaaattatttgaaaagttgtggtgttgatatacatgtcatcataaaaattgaaagtgcaaactctataccaaatttgcattcaattatcagtgcatctcatgggactatggttgccagaggggatcttggcgctgagctccctattgaagaggttccacttttgcaggaagagataatcaacctatgttgtaacatgggaaaagttgttattgtggcaacatatatgctagaaagcatgattgttcacccaactccaactagagcagaggtatcagatataacaattgttgttcgagaaggttctgatggaataatgttgtctggagaaacaactcatggaaagttcacactaaaagctatgcaagtaatgcacactgtaacattgcgaacagaagccactataccagtggtaaaatgccacctaacattggtcaagtgttga

SEQ ID NO: 114502 - DNA, 3033 bp, Glycine max
  Peptide Sequence Number=SeqID_231280
atggacatcaaaacctttgctttcgccccatcttctccgccgttaccggtaatcgccgccgccaagctcgccggaatctctccctcgattgatacctctctctctcctgactcacctcccgcatttatcttctccgatgggctcaagttgcatggagcatatgctcttctacgttatatcggccgagttgccagccttcccaatttctatgggcaaaatgcattagaatctagccagattgatgaatggctggactatgctcctatcctctcatctggccctgcttttgagaatgcatgcaaatatatagatgagtacctggagaagtgtacttttttggttggttattcattgtcaattgcagacctagcaatctgggcaggtcttgcaggttctggaaagagatgggaaagtctaaggaagtcaaagaaatatccaaatcttgcacggtggttcaattcaatagtggcagaacatggtactgtgttaaatgaagtcacatcagtgtatgctggcaaaaaaggattgggagaaccaacagcaaccaagtcaaaagaccagtcagtaaacactgataaagtgaagaaggtgaatggggatgtatctgagaacaacaaaggaggaagcaaaccatcagcagaaatagatcttccagatgctgaagttggaaaagttcgcttgcgatttgcccctgaaccaagtggttatcttcatattggacactcaaaagcagctttgttgaacaaatattttgctgagcgatacaagggtcaggttattgtgcgttttgatgataccaatcctgctaaagaaagcaatgaatttgtggacaaccttattaaagatattgatacattgggtatcaaatatgaacaaattacatatacgtcagattacttccctgagttgatggagatggctgaaaaattaattcgccagggtaaagcatatgttgatgacacaccacgtgaacaaatgcaaaaagagagaatggatggcatagattctaaatgcagaaataatagtgtagaggagaatctaaaattgtggaaggaaatgattgcaggaacagagaggggcttgcagtgttgtgtccgtggcaagttggatatgcaggacccaaacaaatcacttagagatcctgtttattatcgttgcaatccaatgccccatcatagaattggatccaagtataaagtgtatccaacttatgattttgcttgtccatatgttgattctatagaaggaatcacgcatgcccttcgatctagtgaataccatgatcgcaatgcccagtattactggattcaagaggacatgggtcttagaaaagttcttatctacgaatttagccggttgaatatggtctacactcttctgagcaaacgaaagcttttgtggtttgtacaaaatgggaaagttgatggatgggatgatgcacgatttcctacagtgcaaggaattgtgcgtagaggtttgaaaattgaagccctgatacagtttattgttgagcagaatgttgatgactcttctctgatactcgtacagggggcgtccaaaaatctcaatctcatggaatgggacaagctctggaccattaataagaagattattgaccctgtctgtcctagacacactgctgtcattgcagacagacgtgttttgttgactctcactgatggtcctgagaaaccttttgtccgcatcatacctcggcacaagaaatatgaagctgccggagataaagctacaacatatactaaaaggatatggcttgaccttgctgatgcagtgtctttatcagcaggtgaggaagtaacattgatggattggggaaatgccatagtgaaggaaatagagaaggaccaagatggaaatatcatagggttgagtggtgttttgcatcttgaaggatctgtgaagaccacaaaattgaaactcacttggctacctgagatagatgaactagttagcctgacattagtggagtttgattatctaattacaaagaaaaagcaattagatgtctacttcatcctatttgatggttgggtagctgatgcatgccaactatttgatgatacaggtggtatgatgtctatggttgttaagtctaagacagaggattctatgaaatgtgaagttgttgatggaggagagctcaagtcaaggcgacttttgaattttagaggaaaaagtgcaacactaccttcaatcactgagaaggattgggatgatgatatcatgtttggagtggataacaaagttgacttctatgctgtttcctttgttaagaatgctgaagttgttcatgaactgaagaattatttgaagagctgtggagatcttggcactgagctccatattgaagagggtccacttttgcaggaagagataatcaacttgtgttgtagcatgggaaaggctgttattgtgacaacaaatatgctagacagcatgattgttcacccaactccaaccagaacagagttcccactaaaagctgtgcaagtaatgcacacagtagcattgcggacagaagccactatacctggtggtaaaatgccacctaacattggtcaagtgttgaagaaccacatgtgtgagatgtttgcctaccatgcaaccatgatgtctaacacccttggaacctcaattattgtctccactggaacggggtttcatggctcaagtgaaaatggtcttcccccacacaaagcaacacctctatttgataagcttgcatttgaaaagacacaacaagcactaggtggacatgttcctatcgtattactaggagacttgtggaagaaatttatttctcatatacaggaattaacaaccgtgtcttgcatttcatctgtagtagcagtgcttgaccataactatcaccttgaggacaaggtgtttttcaatggcataggggatgttaggaagggaataatggctcaacaagatactataggcatatgcacgaatgagagacccaaaaggaagatcaatccaccaaggcatctaaaggatttcatttaa

SEQ ID NO: 114503 - DNA, 928 bp, Glycine max
  Peptide Sequence Number=SeqID_231281
atgaatgactgggggcacaagctaagaaagaattttcgtgatcaaattgaagtttttagaagggaattggagattgcacgagcttcaaatgataatcaagatgttggttccttcttggaggaattccagacaatactttttcagatgaactcaaacaagtcccctgattcagacgatctaaacccaacttttttcaaaaacgtttggcatctctatggtcttgagatttttcactatggcacaacctggcttgaaataggacatttccctccccagcctttccttcccaaatgtatctctattgaacaatcagcctttatagaggatcgttctatcctagacaatgttattttggcctctgagatcattcaccacatgagatataaatccaaagggaaaattggagaagtgactttaaagcttggattagactgtcttcaaactattcaatattctgtgatgatcaatggtgattttgttggacaaattacttctgaaagagggctaaggcagggtgacccattgtcaaatgccattgaggcatctatcttgaaggacattcttgatacttatgacagagcatcagggcaattaatcaatttccagaaatcagaagtctttttcagttccaacacccctcacaccaccagacaattcatctactctctcttgggtgttactaaaaccattggcattaggaaatatcttggtcttccatctattattggtagaaggaaaaaggagattttttgcttcatcaaggatagattatggaagcgaatcagccattggacctccaaaaacttatcaaaagctgatgagcttcagaagatgatgaattctttttggtggggatcgaattctcattctaagaaggacatcaattggctaaattgggacaagttgacgatgataaaagattatggag

SEQ ID NO: 114504 - DNA, 954 bp, Glycine max
  Peptide Sequence Number=SeqID_231282
atgggtattaagggtttaacaaagcttttagcggacaatgccccgaagtccatgaaggagaacaaattcgagagctactttggtcgcaagatcgctattgacgctagcatgagcatttaccagttccttattgtcgtgggaagaagtggaactgaaatgctcactaatgaggctggtgaagttaccagatatgtttttgatgggaagccacctgatttgaagaaacaagagcttgccaaacgttactccaagagagctgaggctactgaagatttgtcagaagccttagagaccgccaataaggaagacattgaaaaattcagtaaacggacagtgaaggttacaaagcagcataatgacgactgcaaaagacttttaaggctcatgggagtgcccgttgttgaggctttgggttctacaggcaccctcagaagcagaggctcagtttatggtgtggcttctgaagacatggattccttaacatttggagctcctaaatttcttcgccacctaatggatccaagctcaaaaaaaattccagtgatggaattcgaagttgcgaagattttggaggagctaaatatgaccatggaccaatttattgacttatgcattctttctggctgtgattattgtgacagcattcgagggattgggggactgacagctttgaaactcatacgtcaacatggctctattgaaaatatactggagaacctaaacaaagagaggtaccagatacccgataattggccatatcaggaggctcggcggctttttaaagaaccattggtcataactgatgaaaaggaacttgatattaagtggtcttctccagatgaagaagggttaataacatttctggtaaatgagaatggcttcaacagggatagagtgactaaggcaatagaaaaaattaaagtggcaaagaacaagtcatcacaaggccggtaa

SEQ ID NO: 114505 - DNA, 405 bp, Glycine max
  Peptide Sequence Number=SeqID_231283
atgatgaaagaccaattttcaaattatgtgatcccgaaggttcttgagatctgttctgaaaatcagcgagcaacattactttctcgcataacacttaatgttgatgctttgaaaaatacttatggaaaacacattgtggctcaatttgaagagctagttggagaatgtgatcagatttgttcacaaggaaccatttgtgagaatttagatccacaaggctttactgctcatgtggaaacaagagatttggaatcatcttctagtaccaggtttgaaaaagaagatggcactagaggaaatgttgatacgatgctaactgaagatccttctaatggccttactcaaccaagcttgcaaattgaagatacagaccatgtcaatatccatgagttaagtgagatttga

SEQ ID NO: 114506 - DNA, 1041 bp, Glycine max
  Peptide Sequence Number=SeqID_231284
atggcgagcacattctggctagagggacattgtggtcgccaacgtctgaatcaagtggactggaaaagcatggaacacgttttcaagtggtggttgtctgaggcctgcacatcagagagacatgagaagtggatggcacagtatggtagggtttacaaggatgctgctgagaaggagaaacgtttccaagtattcaaaaacaatgtgcacttcattgagtctttcaatgctgctggggacaaacctttcaaccttagcattaaccaatttgcggaccttaatgatgaagaatttaaggctttactaattaatgttcagaaaaaggcaagttgggtggagacatcaacagaaacatcgtttaggtatgagagtgtaactaagattcctgctaccattgactggaggaaaagaggtgctgtcactccaatcaaggaccaaggcagatgcggtagttgttgggcattttcagccgtggctgcgaccgagggtatccaccaaattacaacgggtaagttggtgcctctctctgagcaagaactggttgattgtgttaaaggtgagagcgaaggatgcattggtggttatgtggatgatgcctttgaatttattgccaagaaaggaggaatagcaagtgaaacacactacccctacaaaggagttaacaagacttgtaaggttaagaaggaaactcatggtgtagctgagattaaagggtatgagaaagttccttccaataatgaaaaggcacttctaaaagctgtggcaaatcaaccagtgtcagtttacatcgatgctggaacacatgctttcaaatattactcaagtgggatttttaatgcaagaaattgtggaactgatccaaatcatgctgttgcggtagttggttatggaaaagctcttgatggttctaagtattggcttgtaaagaattcatggggcaccgaatggggtgagagagggtatataaggatcaagcgagatatacgtgccaaggaaggtttatgtggaatagctaagtatccctattatccaactgcttga

SEQ ID NO: 114507 - DNA, 789 bp, Glycine max
  Peptide Sequence Number=SeqID_231285
atgagccgcaacatgaacaatttcacacctttgccagggtcatggcaaagaggttttagatcctttgatgaccacactttcaatcatcgtgaatccaatgaggtgcctgtgttttacagatctcactctactcatgccaccgatggcagaagttcgggtgtattagctcgagaacgattttcggacttcagaaatcctttaggattccacagtataccaaattttcctgcaccaccacctagaagacaacaaattcatgctcacaatgaagatatcggaaggctaagagagattttccttcacccccctcaaagatccacattccaaacaagcacacaagctctcccggtggtagaaattaccaaatcagcagctttgagcaagctcaagaaagtagtctatgaccctcccccaaagaggtatgctaggagggtgagcttatactacagaaacaatgccgcaaagcctttgaaagagaagcagggagaaaatgatgaagatagaaagagttgtgctatttgtctagaagattttgatcccagtgaagaggtgatgctcactccatgcaaccacatgtttcatgaggattgtatagtaccatggctaacaagtaagggccagtgcccagtttgtaggtttgtgatttgtgagattggaagggggaatcattcatccttcaataacaatgacattgcaaatttggaacctagcaacttgattaatggagagcttttgtcaattttgagggccatggaagaagcttttcaattgggaagaatgacttactaa

SEQ ID NO: 114508 - DNA, 1011 bp, Glycine max
  Peptide Sequence Number=SeqID_231286
atggctttcacatgccaaaagcagcacatgctagctctattcctcctccttgcagttgcgatttcacaggtgatgtgtcgcaagctgcacgagacatcgatgcgagaaagacacgaacaatggatgaccgaatatggaaaagtgtataaggatgctgcagagaaggacaaacgttttcagatattcaaggacaatgtggagttcatagaatcattcaatgctgatggcaacaaaccttacaagcttggtgttaatcaccttgctgaccttacagttgaggaattcaaggcttcccgtaatggattcaagaggccccatgagtttagcacaacaacatttaagtatgaaaatgtgactgctattcctgcagccatagactggaggacaaaaggagctgttactccaatcaaagaccaaggtcaatgtgggagctgctgggcattttcaactatagctgcaaccgagggtatccatcaaataactacaggaaaactagtttcactctcagagcaagagctagtggattgtgacacaaaaggtgtagaccaaggatgtgaaggtggttacatggaagatgggtttgaattcattataaaaaatggtggaatcaccagtgagactaactacccctacaaggcagttgatggaaaatgtaacaaagcaacctctccagtggcacaaattaagggatatgagaaggttcctcccaatagcgagacggcacttcaaaaagccgtggctaaccaaccagtgtcagtttctattgatgcagacggtgcaggtttcatgttttactctagtggaatttacaacggagaatgtgggactgagctagaccatggtgttactgcagttggttatggcacagctaatggaacagactattggattgtgaagaattcatggggcacacaatggggtgagaaaggatacgtaaggatgcaacgaggtatagctgccaagcatggtttatgtggaattgccttggattcatcttatccaacttcttaa

SEQ ID NO: 114509 - DNA, 1524 bp, Glycine max
  Peptide Sequence Number=SeqID_231287
atgatgaatccattacctagcatatcacaggtcttctcatatgttgttcaacaagaaaggcagatcaatcgcagtgatatgatgggaaacactagtctcatcaatgcagcaggctcactttcatcgaaatcatgtacctactatggctctggcagagagagttctgatgggaaaggaagcaaggtttgtacacatagtggattcacaaatcacattgttgatgaatgttacagaaaacatggatatccacctggacataagcttcatgggcctcaaggatcaaatgttaacaatgtaaatgttgtgaaagaagaaggtgatggccttgttctggaaagaagtcaagaagtacaaaatgatgaactaaagctgtcttctcaatattataaggccttgatgacactgttgcaacaacaacataacttagctcacaacaattcacatgtgaatcaaattggtacaatcactggttctgttggttccaacaatatacaaaaagctaaacctcagtcatacaatcaagtctctaaagatcctaattggattgaagccatgaatgcaaaaatcaaagcattagagctaaaaaatacttggattcttactaatatttccaagcataagattgctattggatgcagatggggtaggattatttggacactatctcctgtggccaagctaactatagttaaacttttattggctttaactgctatcaatcagtggcatctaaagcaattggatgtgaataataatgccttcttacatggtgacttaaatgaggaagtgtacatggtttttctcgaaggtttgcaagtagataagccaggacagtatgcatctgattactccttgttcatcaaacatggttccaagaccattattgctttactagtctatgtagatgacattgttttgtctggaaatgacttgattgagattcaaagcattactcatttattggatagtgccttcagaataaaagatttaggtgacttaaggctctttctaggttttgagatcttcttacctactgatagtaatatccatctgaaaggtttcaatgattcaaattgggctggttgccttgacactagaatatctcccattggttatgccatttacattggtaattcgttgatctcatggaaatctaagaaacaagcaacggtttcaagaagttcgtcagaggctgagtatagagcattggcaagtgccacttgtgagctgcaatggcttactttcttgctggaagagtttaaggtacatttccaacaacctgctaccttgtattgtgacaataagtctgctctccacatagctgcaaatcccatttttcatgagagaacaaaacacattgaaattgactgccatatagttcaagagaaggtgatgactaggcttgtgaaattgcttcctatttcctctgcaaatcagcttgcagatatttacactaaagctctgctgcctggtgtttttcaatttttgtattccaagctaggcacgtctaacattcattcctag

SEQ ID NO: 114510 - DNA, 381 bp, Glycine max
  Peptide Sequence Number=SeqID_231288
atgagttcagttagccaaaatcactatgttttagttctgttcctcattctcactgtgtggatatcccgtgtaatgtctcgtgggctcattagatctgagagacatgagaaatggattgcacaatatggtaaggtttacaaggatgctgttgaggagaaacgtttccaagtattcaaaaacaatgtgcagttcattgagtcattcaatgctgctggggacaaacctttcaaccttagcattaaccaatttgtggaccttcatgatgaagaatttaaggctttactaattaatgttcagaaaaaggcaagtggggtggagacagtaaaagaacctgccatggatatacaaaagcttacagaggaagcttgcagagaaaactaa

SEQ ID NO: 114511 - DNA, 552 bp, Glycine max
  Peptide Sequence Number=SeqID_231289
atgagggagataaaggtgcagaagctcgtcctcaatatctccgttggcgagagtggagatcgtcttaccagagccgctaaggttgaaaccccttcacacctcgcagcttccacaaatgtgttggaacagcttagtggccaagcccctgtgttttccaaagcaaggtacacggttcgttcctttgggattagaagaaatgagaagattgcatgctatgtcactgtcagaggtgacaaggcaatgcaacttttggagagtggtttgaaggtgaaggaatatgaacttctcagaaggaacttcagtgatactggttgctttggctttggcattcaggagcatatcgatttgggaatcaagtatgatccttcaactggtatttatggaatggacttctttgttgttctggagcgtcctggctatcgtgtgggacgtcgccgaaggtgcaagtcccgtgttggaatccagcaccgtgtcacaaaggaggatgctatgaagtggttccaggtgaaatatgagggagtgatccttaacaagtctcaggcgattgtttag

SEQ ID NO: 114512 - DNA, 597 bp, Glycine max
  Peptide Sequence Number=SeqID_231290
atgtgggacttgggtttttttctaattgctacaatcgagagtctccatcaaataactataggtgaattggtgttcctatcagagcaagaactagtagattgtgttagaggtgacagtgaagcttgccatggtggttttgtggaaaatgcctttgaatttattgccaataaaggtggaataacaagtgaagcatactatccttacaaaggaaaagatagaagttgtaaggttaagaaggagactcatggtgtggcacggaatatagggtatgagaaagttccttctaataatagtgaaaaggcactcctaaaagctgtggcaaatcaaccagtatcagtttatattgatgctggagcacctgcttacaaattttactcaagtgggatttttaatgcaagaaattgtggaactcatctagaccatgctgctacagttgttggttatggtaaacttcatgatggtactaagtattggctagtaaaaaattcatggagcactgcatggggtgagaaagggtacataaggatgaagcgagacatacattccaagaaaggcttatgtggaattgcttcaaatgcctcttatccaatcgcttaa

SEQ ID NO: 114513 - DNA, 714 bp, Glycine max
  Peptide Sequence Number=SeqID_231291
atgaaggttaaggttggagatcccacccccagaataacttcaacaaggatcaaggaggtctctatgtcaaatcataagaacattgagtcggccatcaataatttggaggtattggtgggccaattagccaagcaattggctgaaaaatccatagggaactttgtggccaatactaagaagaagcccaaagaggagttaggcaaagctctcattgatttgggggcaagcatcaatttgatgcctctctctatgtgttggagaattgggaacctgaagattgccccaacctggatgacttttcaactagcagatcgctccattaccatgccatatggtgtagttaaaaacgtcctggttaaggtttgccagttcatctttccgatggactttgtgatcatggacatagaggaggattctgatattcccttaatattgggtcatccattcatgcttactaccaaatgtgttgtggacatggggaatgacaatttagaaatgagtgtggaggaccaaaaggacttaggcaaattgaaggagattcccctaggagaatatgtctttaaagaattgaagaaagatagtgcaacagagaagcctaaagtagaattgaaggcgcagttaatggaggtgctaaaaaagtataaggcaaccattggttggcacatcccgatcttaagggaattagcacttcctactgcatccacaagatcatga

SEQ ID NO: 114514 - DNA, 992 bp, Glycine max
  Peptide Sequence Number=SeqID_231292
ctgaggtagatggcggccaggatgatgccgcccttcaccacgttctggatatacggcgacacgttcatcagattgaggccgttgttgagcaccccgagcatcatcgcccccaccagcgtgccgacgatggcgccgcgcccgccggagatcgccgccccgcccagcaccaccgcggcgatggcgtccagctcgaagccttcgccggcgttgggctgcccgctcatcaggcgcgaggtcagcaccagcccggccagcgcggcggtcaggccgctgatcacgtacaccagcatcttgtagcgcggcacgcggatgccgctcagccgcgccgcctcttcgttgccgcccatcgcgtagacgtagcggccgaacggcagttggttgagcatcagccaggccagcacgtacacgccgagcatgatcaggatcggcacctggatgcccagcaccgtgccgcggccaaagaacgcgaagacgtcgggcaggccggagatcgggtagccgccggtatagagcagcgccaggccgcgggcgatgcccatcgacgccagggtgacgatgatcggcggcatgcgcaggtaggcgatgcaggcgccgttggccaggccgaacagcgccccgaccgccagtgccgccaccatcgccagcgggatcggcaccgccgccagcatcagcccggcggcgaccgagccggccagcgccatcaccggccccaccgagagatcgatgccgccggtcaggatggcgcaggtcatgcccaccgcgatgatggcattgatagacacctggcgcgccacgttggtcaggttgttgacgctgaggaagctgtcgttcagcaggctcatcaatacgaacaggacagcgaagccgataaacggcaagaccgccgggtgatgcagcagtttttcccagcgcttgccgaggctggggccggcggcgcggcgcgccacggcgggttgttcaattccgatcataaggcactcccggtcgcgtga

SEQ ID NO: 114515 - DNA, 921 bp, Glycine max
  Peptide Sequence Number=SeqID_231293
ttggaactcttacgtgccgatcaacgtctcatttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatcttaatgctaaggaagtccaagtagcaggaggagctgctggtgaagatagagttcaagcagtttgttctgaagaaaatgggtggctcttctgtgcaatatatgacggctttaatggaagagatgcagctgactttctggctggtaccctgtatgacaccatcatatcttactttaacaagttaatttgggaattggagccgggttccgtcatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccagaagatacttaa

SEQ ID NO: 114516 - DNA, 318 bp, Glycine max
  Peptide Sequence Number=SeqID_231294
atgagggaggcacatgaaataccccaccacaatctagccgacttcaatccttgcctcggatacgccactaaggggcaagcagttggtggtgtacccctgccaaacactttggaggaccctccatttcgcccacaaccacaacccttgcatttcgtagtagggagagtccctactgctatggtggaaaagggaaagttggatcatatagaggaaaggctcaaggccattgaaggaggcggagattatgcttttgctgacatcgtagagttatgcctagtgcctgatgtagtcatccctctgaagttcaaggtgtcgtag

SEQ ID NO: 114517 - DNA, 297 bp, Glycine max
  Peptide Sequence Number=SeqID_231295
atgttggatcaatttgagccacttatacaagatttcattgacaacattgtggatgtgaaagtagacggtaactgtggatatcggtccattgccgctttattaggtatgggtgaagattcttggcagttggatgactatatcaacctcttcggtggcacaaagagatttgaagaattaaggatgtctctacttgttgatggattttccaaggttagtgtggataagtggatggatataatgaagatggaatatgtcattgcatcaaggtacattgaagatagttattctaatttttag

SEQ ID NO: 114518 - DNA, 508 bp, Glycine max
  Peptide Sequence Number=SeqID_231296
ggtacatctacttgggtttgactgagaacaagagagggtacatctcttgtggatcagttctagtggagggtacatccactaggttcaaaaagaacaagggagggcatgggttgttgccgaattttcttcttttcttgcattcatcttcttcttccgcaacttcttcttccgcaacttcttcttttcatcttcttctttcgcaacttcttcgcattcatcttcttccattcggctttctattcttcctcaaggtgcttggcattcctcttctctttcgcaagatgcttggcattcctcttcttttccgcaaggtgcttggcattcctcttctcttccgcaaggtgcttggcattcctcctcttccgcaaggtgcctcgtgttcgtcttcagcgccactgtgcctgttcatcttcttccttggccattttcacctgcgtttcgttcgttcttctctggcgtcgagggtagaggacttagagcttaggtgcttccatggaatggcgttaag

SEQ ID NO: 114519 - DNA, 255 bp, Glycine max
  Peptide Sequence Number=SeqID_231297
atgatagtgggtccaaggaagccagggaatgatattgaggtatatctcactccgttgattgaagacttaagaaaattgtgggaagatagggttgatgtatgggatgggaatcgccagcacactttcaatgtcaaaggtcattacatgtgtcctatatgtgagaaaaagacgagtttcatccaactcaaacacggaaagaagacagtatatgctaggcaccaaagatttcccaaaccttatcaccggtatcagtga

SEQ ID NO: 114520 - DNA, 414 bp, Glycine max
  Peptide Sequence Number=SeqID_231298
atgccttttttggctaaaataggcatgggaaggctgaagcaaagggtccctgagttcccagaggtccagaaagaagaagaaaaaagagaaaacaaggccaaaacgcttccgaattgcatccgtgatcgattcctacaccgtttgtcattcgttcatcgatcgttcttcgttcttcatccgcaatcaggcccacttgggccctccagaagattcctccagaaggctgttgcttctggaggaagcaaccttgctcgcctgggcgagctgggcggcaagcttctcccctattttgctataaataggggaagaagtgaagaagaaaaaggttcagcccctttggcacttctctctctttcgaatttgctgaggaaaattatttccgtgaagaaaatccaagccgaggtgcttccgtaa

SEQ ID NO: 114521 - DNA, 381 bp, Glycine max
  Peptide Sequence Number=SeqID_231299
atgaatttcttgatgaaacacgataaagggtgggaacaggagttaagtccttacaatcaatatgaagaagaaagaactcctaatcttgaaagtgtgtttgaagaattcagggcataccatgctagctcaaaaactaatcaaaatgaaatagaaagaggtctcaatctggataaattgttgatgcaattcatggaaacaactaaatccactcaacgagcactccaaagtgtagaaatccaagttggtgagctggcagaagcagtgactaaatttatgtccaggcgagaaaaatcctttgtagaggctgaagctcaagagaaaagccttgtaaaagagcatgagtcaagagaaaaagatgaggaacaagcacaacaacaatga

SEQ ID NO: 114522 - DNA, 669 bp, Glycine max
  Peptide Sequence Number=SeqID_231300
ggtgaaatctcggaaacactacattttatggtgtcgcctgctgggagaagggtttgtactttggacgatttactgccatgtatcgagaagatcactcttctatatgaagaagaggataggatacttgaggcacatcaagatgctcccccttctcagccacaatttgaacatcaacagtttaatatactacagcgaagtgtggagactcgaggcttagggcgacgtcggcaaactgtggatgcagcaccgtacagtttgcctccgatgccagaacgagaacatggaatgtattacacaccgccagtattcacccaagaaccatcgcagatggcgccgatgtattcatacccacatgatttccaaccagggtacagtatgacaggcatatttggatcctctcctccttcaggggggactccttcattcacccaaaataatgaactaccgaccccaaatgccccacttggtggtccgtggaatgtacctggaaatatacttgacatgaatgacttattggggtcgatttacgtcatgatttctctatcgaggctgacgaagtggatgaaagggggaatcttagaagaagaaaccttgatagggcaactaggaattgggatcggccatgtgagacatcgtcgcggcatcacagacatagtcatgattgattaa

SEQ ID NO: 114523 - DNA, 942 bp, Glycine max
  Peptide Sequence Number=SeqID_231301
atggattatcaagctctcaacttcgtcactgttcgcgacaagtttccgatgcccaccatcgacaaacttctcgatgagcttggttgtgcttgttggttctcgaaacttgacctttgccagggatttcaccaaatccgcgtggaaaaggaagacattcctaagacgacgttccggacccaccacgggcactatgaattctgtgttatgccttttggtttgtgtaatgcaccctctaccttccggacaaccatgaacgagctccttaagcctttcttccgcaagtttgctacggtgttcttcgacgatatactagggtatagcacgtcgttgcctggtcacttagaccatttggagctcattctgcaagccctgaccaacggagagttctatctctgtcattctaaatgcctctttgctcgccgtcaactacaatacctgggtcatattgtatccacagatggcgttgcccccgacctgaaaaagattcagaccatggtcaactggcctcgtccatcatccaccacaaaattgcgcgagtttttgggcctcactgggttctataggagatttatcaaaacctatgcctcgatagcgggtccattgaatgccttgctctgcaaagaccaatttcactggaattatgaggcccagaacgccttcgaacacttgaaaactctaatgacacaggtgtcaattttagccacgcccgacttcaatcttccattcattttggaaaccgatgcatctgggatcgccatgggagtcgtgttgctgcagcagctccatccaattgcttactacaataagccactctgtcccagacttcaaaaggcatcaatcgatacgaaaatggtgccattacctcctgggacactagttcattgtccgcatagaccaccaaagcttgaaggaattaatggcgccagttattcagacccttga

SEQ ID NO: 114524 - DNA, 429 bp, Glycine max
  Peptide Sequence Number=SeqID_231302
atgtttgttaaatttctcattttcttctgcaaagcttcaatttgtagcctcaaatcagtcactaccattgtttctcttgagacagaagacgaattagaaattcgaatagctgcacgtcttccatggtggcattgccgtatgaaactaccagaaaatgcacaacaactgccacttgcagacatggacaaatcaagtgaacaagcagcagggaatgagcctcagagtagaagaagaagaagcaactcagcgtgggaagaagaagaagaagatgaagaagaagaagaagaagaagaagcaaccagcagcttcgtaaaccctaatttttttggggaagaagaagcaaccttgcatggactaatatgcaaagtggttacaatctcagggactaaattgcctattcactcaaccaacaagtatggaaaagaataa

SEQ ID NO: 114525 - DNA, 204 bp, Glycine max
  Peptide Sequence Number=SeqID_231303
ttaagcttagcttatcaatgggctaagcgtgcatctaccgctaagtgcagattcagcatgcttaacgcggcagaagaatgtggcaaggcatcaatatcaaggccacgcgctaagcgcgagatcagtgcgctaagcacaacagttgtcttcagccaggctcaccgcatgactagcgctaagctcaaatccacttactcgcgctaa

SEQ ID NO: 114526 - DNA, 726 bp, Glycine max
  Peptide Sequence Number=SeqID_231304
atgggatcaagtcaaaagccttcgcttaaaaagaggttctatcaagtcaaaatcaagagcttagaggtcactagtttacgagagttagggcaattaatgggtcaacttcaacggcaagccttctgcaaagcctatggtaagatttgggacctagctagggtagaagtctccatggaaccgattgcatccctttcccagtattatgaccagcccctaaggtgcttcacattcgaggacttccagctagtgccgactgtgaaagagtttgaagaaatcctgggatgcccactgggaggaaggaagccatatcttttctctaggttctatccttccacgacaagagttgccaaggtagtgaaaatctcagcacaagagttggaccgggtaaagcaaaacaggaatagggtagtcggagtaccaaggaagtgtttggaggaaagggcaaaggccttggaaaatcaaggcaaatgggctttcttttatagacatcttcgcactgttgattttcgagggagtcctctttccaaatgtggatggccgacctatatgacaccttcgaccgaagatgtgaagaaagcaatgcaaggattgtttgttgtactccagctctctatgtggggctggtttcacacctttttctccaagaaggtaggcccgtctatctgctacaaggtcaccgctcgtgcgtcgaaaaagaaagacgaattgggaccaactcttggctag

SEQ ID NO: 114527 - DNA, 156 bp, Glycine max
  Peptide Sequence Number=SeqID_231305
atggatacttcagagccctacactggggcaatgaaaggcaccatgcataaacctcaagcaaacctaggggtcatgatgatagacaacaattttgtacctcaaagccttatactggggcaatcaggggcaccgtgcatgagcctcaagcgaacctag

SEQ ID NO: 114528 - DNA, 438 bp, Glycine max
  Peptide Sequence Number=SeqID_231306
atggtggtcacaattcgatactcaaaggctgctccagatcagtcaagaactgagacatctctgttcctgaatcagaagtcgcaactggcagcattcttagcaagctcaaaatctaaagagagtcttgctcagaatctcaaagaagttctccaactagttcaacaggaagtggaagaagaaccttccaaaaaggaagctgaatcatcagagactaatgatgaccaagaagacgatccattctaccagaatgaagatgattgtttcgatgaatggcagcgaaatggagaaagggagagagagaggagacgccacttcaaggagaagatgagtctagaagaagctcaccaccataggaggccatggataagagcttggaggaagaaggagatgaatgaagggagagggagagaagagcacgaaattttgtgctctaaatga

SEQ ID NO: 114529 - DNA, 626 bp, Glycine max
  Peptide Sequence Number=SeqID_231307
gtatgctctcactcgaacccttcacagaagatcagggtcggtcggcggtgcaacccacagggggatcccaccaatcagcttccttgcgccttacgggtttactcgcccgttgactcgcacacatgtcagactccttggtccgtgtttcaagacgggccgaatggggagcccacaggccgacgccaggagcgcgcaggtgccgaggcacgccaagggcgcgcgctgccatccacaatcgcgatgatgacgtctccacgagcatatcaacagcccgggcttgggccaccatcgcaatccgcgtcggtcaatgtcccgagtcgatcggcggaccggctctcaccgttccacatccgaccgggacacatcgccggcccccatccgcttccctcccgacaatttcaagcactctttgactctcttttcaaagtccttttcatctttccctcgcggtacttgttcgctatcggtctctcgccagtatttagccttggacggaatttaccgcccgattggggctgcattcccaaacaacccgactcgccgacagcgcctcgtggtgcgacagggtccgggcacgacggggctctcaccctctctggcgcccccttccaggggacttgggcccg

SEQ ID NO: 114530 - DNA, 540 bp, Glycine max
  Peptide Sequence Number=SeqID_231308
atgggagcctctggtaatcgattaccagcctgtgtaatcgattacacagaggaatgggtcactggtaatcgattaccaggcatgtgtaatcgattacacagtatcgtgatggtggcgcagctaatccgtgatcgagtagagatggagtgcctagagggagcttgggagaccctcgaaggcaacacgaggtgccgatttcggggcaccattcgattcacggctacttctttggtgcatccagatgaacctgcacggacgcttcagcgcactgtggagtggatactacccacgcctacaccatatcgtctagtggagcccgttcaagtgatcgaggtaacgtcatccgaggaagaccctgaggaggacctggaggagctacctcctgagcctgctgtggatgcccttgaccttctagagggtgatgaggatccacttcttgaggtggattctcccgaggaagtcatgtcggcatctgaggcagactctacggaggatagcggcccgagggagatggcgatcagcggaggctcttcatcctag

SEQ ID NO: 114531 - DNA, 330 bp, Glycine max
  Peptide Sequence Number=SeqID_231309
atgccggaaaaccaaaaaaatatattgatgcacaatctgggccacggtttcctttcaacggttcctgggttaccccctgatattggagggcgaccaactgtgagagcacatccagagaggaaggctatcacgcatcaactatgcataccggggcaagatttcacccatgccgctgcaaaaagactagtgtggatcatgcgcaccaacatgaccacttttacatggatatggatgatgttgctatttagtaacattctgcctggcgaccacaatgccaatctccccctgcagatgtatcggttgggatcgcgcccacaagacgccaagtag

SEQ ID NO: 114532 - DNA, 724 bp, Glycine max
  Peptide Sequence Number=SeqID_231310
ggacgcggcgatcctgcgcaaccagctgcagtcggaaatctggaacgccgaagtgctgcagtccggcaagtgggacccgcagctgtacaacggcatcgccggcagcgcgatctacggcctgatggcccgcgagttcgcgccgctgccggagcgcctgaagtcggccaccgcgcgcatggaaaagctgccggcgatcttcgcccaggcccgcgagaacctggatccggcccgcgtgccgaagatccatgccgagaccgtggccaagcagaacaagggcatcctcagcatcgtcgataccttcatcacgccgcacatcggtgaactgccgcaggccgaccagcagcgcctgcaggcggccatcgacggcctgaagaaggcggtggacgagcagcagacctggctggacaagaccctggtgccgaacgcaaagggcgatttccgcatcggtgcggaaaagtacgaccagaagctgaagttcgcgctgagctcgtcgctgtcgcgccaggagatcggtgagcgtgcacgtgccgaactcaagcgcgtgcgccaagatatgtacggcatcgcgcaaaccgtgctgaaggacaagccggtgcgtcggaatgccggcgcagcgaccgacgagcatcagcacatggcgatcgaggccgcgctggaattggctacgacgactatccggcactcgacaaggtggctcgacgatgccacggccccactcatagca

SEQ ID NO: 114533 - DNA, 741 bp, Glycine max
  Peptide Sequence Number=SeqID_231311
tattatgaccagcccctaaggtgcttcacatttgaggacttccagctagtgccgactgtgaaagagtttgaagaaatcctgggatgcccaatgggaggaaggaagccatatcttttctctaggttctatccttcgacgacaagagttgccaaggtagtgaaaatctcagcacaagagttggaccgggcgaatgggctttcttttattgacatcttggcgcttttgatctttggagttgtcctatttccgaatatggaagggttagtggacctagcagcgattgacgctttcctcgcctttcatcatggcaaggaaagcccgatcgtcgccattttggccatgtatgacacgttcgaccggggatgtgaaaagagcggtgcaaggattgtttgctgtactccagctctctatgtgggggctggtttcacacctttttctccaagaaggaaggaagaatcaagatctatcttcatgcgaaggatgtccaaatgttcccttgatgggaacaagggtgaccacaacgcaagggtactccaaggagttcgcaaggcatgggatgcgactgtgagggacgatgaggttaaagcttcggaagaaagtgatgaggtacaagccctaaaggcagagcttgaaagagcccgagtagtcgaagagaagttcaagtccatagccatcaaaggcagcaatagtaagctcaagctccgaagaggtgaaaggaatcatcacgggtcaaaggcatga

SEQ ID NO: 114534 - DNA, 434 bp, Glycine max
  Peptide Sequence Number=SeqID_231312
cagctagtgatgttggagagattattgtgagttgtggtgaatatcccaacgtacctcttttgggtatgcgtggcggaattagctacaacccactcctcgctcgacgacaatttgggtacccgataaagacaaaaccaaacaaccttgccttgactaatgaattctatcttaaccatggtgatcactcgaacaaaagggaaagattcgcacaagcttggagcgctatccgcagactcaacagaagtcagttgggaaagaaatcagactatgtgcacgaatcttatacccaaaaccagaggatgattgagaaggacgacttcttcgtcggaaagacgttttgctccccccaagatgctagaaggaagaggaagtttatggacttgttctcccgtgcacattcagattccgaggacccatctactccgggagtttga

SEQ ID NO: 114535 - DNA, 519 bp, Glycine max
  Peptide Sequence Number=SeqID_231313
atggctgaaactggtacagctggagtagaatgtgttaaagatgcatcaacttcactcctggaggagacagcttgtggttcttttggaagaacattctgtaagtgttgggcatgcaatcctagtcatagagccctattgttgactgtagtgaggtctgtggttgattatgcatgcacaccagaagaagtgcagcaacactttcagtcctgtggtactgtaaacagggtcactatcctgacagacaagtttggccagcctaaaggttttgcttatgtggaatttgttgaagctgaggctgttcaagaggctctcctgttgaatgaatctgaattgcatggccgtcaattgaaggttttgcctaagaggaccaatgttcctggaatgaaacaatatcgtcctaggtgctttaatccttacatggcgtatggcttcaggaggccatatactccttacttgtattccccttatgggaaggttcctaggtttagaaggccaaatcgttacatgccgtactactag

SEQ ID NO: 114536 - DNA, 2346 bp, Glycine max
  Peptide Sequence Number=SeqID_231314
atgatcaagtcctgcacctccccgcacgacgccaccttcctcctcaacctcctccgccgaatgaacaccgccgccgccgccgctgatcaccaacaccagctcgcgttcaagctctccctcacttcctacaacaggctcctcatgtgcctctcgcgtttctccatggttgatgaaatgataagcttgtataaggagatgttaactgataatggtaatagtgttttccctaacctgataacgttgaataccatgttgaattcttattgcaagctggggaacatggctgtggcgaggcttttcttcgttaggatactgagatgtgaacctggtcctgatttgtttacgtacacttcgttggttttgggttattgtagaaacgatgatgttgagagagcttgtggagttttttgtgttatgccgcggaggaatgcggtttcgtatactaatcttatacacgggctctgtgaggctgggaagcttcacgaggctcttgagttctgggcgcggatgagggaggatggttgtttccccacggtcaggacttataccgttcttgtttgcgcgttgtgtgagtcggggagggagctagaggctttgagtctctttggggagatgagggaaagaggctgtgagcctaatgtttatacttataccgtgttgattgattacttgtgtaaggagggtaggatggacgaggcgttgaagatgttgaatgagatggtggagaaaggcgtggctcctagtgttgtcccgttcaatgccttgattggtagttattgcaaacgggggatgatggaggatgccgtgggggttttgggtttgatggagtcgaagaaagtttgcccgaatgtgcgcacatataatgagttgatttgtgggttttgtcggggtaaaagtatggatagggcaatggcgctgctaaataaaatggttgaaagtaagctctcgcctgatgttgttacatataacacattaatccatgggctgtgtgaagtgggtgtagtagatagtgcttctcgcctgtttcgtttgatgattagagatggcttcagtccagatcagtggacttttaatgcttttatggtttgcctctgcagaatgggcagagttggagaagctcatcagatcttggagtccctcaaggaaaaacatgtcaaagcaaatgaacatgcatatacagccttgattgatggatactgcaaagctgggaaaattgaacatgctgcttcattgttcaaaaggatgcttgctgaggaatgtttgcccaactcaatcacattcaatgtaatgattgatggcttacgcaaagagggtaaagtgcaagatgcaatgttgttggtggaagacatggcaaagtttgatgtgaagcccactcttcatacttataatattcttgttgaggaagtgttgaaggaatatgactttgaccgtgctaatgagattctcaaccgactcatttcatctggttatcagcctaatgtggtcacgtatactgcatttattaaggcatattgcagccaaggaagattagaggaggctgaagagatggttatcaagattaaaaatgaaggcgtattgctcgattcctttatctataatttattaattaatgcatatggatgtatgggactacttgatagtgcatttggtgttctcaggcgcatgtttggtactggttgtgagccttcttatctaacatactccatcctaatgaagcatctagtgattgaaaaacataagaaggaaggaagcaatcccgtggggcttgatgtaagtttaacaaatatctctgttgataatacagatatatggagtaaaattgattttggaatcacaactgtgctctttgagaaaatggcagaatgtggctgtgtgcctaatcttaacacttacagcaagcttattaatggactttgcaaagtgggacgcttgaatgtagccttcagtttgtaccatcatatgagggaagggggaatctctccctctgaaattattcataattctcttctaagtagttgttgcaagttgggaatgtttggggaagcagtgacattgttagattctatgatggagtgtagtcatttagcacatctagaatcctataagcttcttatttgtggtctgtttgaacaaatgaacaaagagaaggctgaagctgttttttgtagtttactacgatgtgggtataattatgatgaagtggcttggaaagttctgattgatggcttagctaagactggatatgttgatcaatgctcagaattgctgaatctaatggagaagaatggctgtcgtttacatcctgagacatactctatgttaatgcaggaactgaatagagcttaa

SEQ ID NO: 114537 - DNA, 558 bp, Glycine max
  Peptide Sequence Number=SeqID_231315
atggggtggttcatgatgaacaaaaagaaccagccaccgatggagtgtccttgtcggcaaggaggaagttcagcgaggatttctgacaccgttgtgcttctttatgaaggaaaggatggtggtgttggaaggggagtacagtgcgagggagcggatcgagatgatgccagattgggagtcctgggcgaggttcacaaagttgaagttgtcggtggcacaaccggtgctttgaaggagcgtggtggtgagcttgctagaggaggagaggacgtggtagtgaaggacgtctgcgagggcgaccaaggagaggtgatggcaagagaggtgatcgtcggtggtgaggtaggcgttggggagggtaagaatggagagggaggagtgcttctagagattcgcaacgagagacgtgaaggaggcgatgagagaggattctcccaaacacaaaggaagttgcctctctgcagacacaattacagaaaggctaacaaaaatatcttcagccgccaagaaataaaagaacccgtagttgaagatatattccccatgtcgaatgtttaa

SEQ ID NO: 114538 - DNA, 369 bp, Glycine max
  Peptide Sequence Number=SeqID_231316
atgcatgtgatcaagtcaccaccccttgaagtcactgcccatctaaaagagaaaactaggtggccaaaatttaataagaacccaaccaaaaggaagaaggctttttattctatttattttccagtgtcgagtagtgcttttcttctcatggcgtatagcctgaagaaagaggagaagagagaaaaatgtgttgtaaatctaagaagcatcaatactaacacggataccggacatgacacggacatggatacgtggacacctgtcaaatacatcaaattcaacccgaacacaggcatcggtgttgtgtcggtatcggtgtcggtgtcatatccggatacggcaaggaactgtggtgtccgtgcttcatag

SEQ ID NO: 114539 - DNA, 1086 bp, Glycine max
  Peptide Sequence Number=SeqID_231317
atgctactcacgtgttaccaccatcccttccctcattcactttcttcaacctcaacccactcgctcttcaccacaaacagaaactgcaacctctctctctctttctccatcgtaacctcgcgccctctccacctcacaacgcacaccgctcaccgcttcaattccctcacagttcgagccgactcatttcgcctccgatccgaacatgccgccgccgattccaatttcgactcgctcctttcgctgctcgagttctcgtgtctgctctcttccgccatatcctccgctgccgccgctgtgctcgcgggttccaagaacgagctcatcgccgggatcggtgccagagctgctccgttcggcggcgcgttgcttgtggtcggggttctggctgggaagggcgggttggaggtgaacttgctggagaggattgagaagttggaggaggatttgaggagttccgcgacggttgttagggttttgtcgagacagctcgagaaattgggggttaggtttagggttacgaggaagggcttgaaggatcccatagctgagactgcggctttggcccagaagaattctgaggctgctagagcattagcagtgcaatcagacattttggagaaggaacttggtgaaattcaacaggttttactagcaatgcaggaacaacagcgaaaacagcttgatctgattcttgcagttgggaaagctagtaagctatgggaaagcaagcaagaaaccaatgaacgacatgatacgttagaattgtctaattcagctgaggatggggtaaaacaggagcatttcaacgaatgttttctgccaagcctatcgggccctgctactgctaaacagattggtcctatccgaaaagttctccatgaactctggactataaagaaaccagtttgtttatctgctatgttcaaattggcatcccctcgtgaagaatttgtgaaactcaactctaataggactttgaatttgcaaactaagaaggctgttgcaggttgcatcctaaaggatcaccttggccatcttatagtaggcctcatctttgggatcgtgtaccgtcataaaggctga

SEQ ID NO: 114540 - DNA, 273 bp, Glycine max
  Peptide Sequence Number=SeqID_231318
atggcaggtgcaggaggagggtatggggacgcgaaccagaggatagactacgtgttcaaggtggtgctgataggggactcggcggtggggaagtcgcagatactagctcggtttgcgaggaacgagttcagcttggactccaagtccaccatcggtgttgaatttcagacaaggaccttggtcatagatcacaagaccgttaaggctcagatctgggacactgctggccaagaacggtactccataacttctttcgttttccatagttcttaa

SEQ ID NO: 114541 - DNA, 549 bp, Glycine max
  Peptide Sequence Number=SeqID_231319
atggaaagacaaacagcgcgagaaggtagctctgcatcatgtgctttccggatatcatccgaaggattgccccttattctcccatacataaccaaacagattctgcatgcatctcctgcagacttcaagcatattctgcagaacaaagaagtaaaatttgaagattttaatgatgctgagtttggtgaaaaggcagcaaacctattgccaggctgttgtgtggtaattctgcatatagggaacacacttgctgcagagtctctccaagtggatgagtcaacgatagccattggatgctggaagggtagggcgagattgtcagtgatggttactgcaatggactgccaagaactacttgaaaggcttttaatacggtttgacactgaaaagggttcctctgggcatgcagacaaatcctctaatgatgtgcaagagttgaacagtataaatgatggcgtgaaagttacttttgagatgcttaaaatgtctattgcggtagttaacattgacaatactctacgtgcaatatttgacgtacttttccgttga

SEQ ID NO: 114542 - DNA, 927 bp, Glycine max
  Peptide Sequence Number=SeqID_231320
atggaacggtatgagataattaaagatattgggtcaggaaactttggtgtggcaaagctggtcaaggaaaaatggagtggtgaattatatgctatcaagttcattgagagaggcttcaagattgatgaacacgtgcaaagagagattataaatcataggtccttgaagcatcccaatatcattagatttaaagagttgttgcttactccaactcatcttgcaatagtcatggaatatgcttccgggggagaactgtttgaaagaatatgcagtgctgggagattcagtgaggacgagttaattactcaactttacgttcggatctttcttcagtcatctgttttgcactcccagccaaaatcaacggtaggaacccctgcctatattgcaccagaggttttgtcaagaagagaatatgatgggaaggtcgcggatgtttggtcttgtggggtgaccttatatgtgatgttggttggagcatatccttttgaagacccagaagacccaagaaacttcagaaaaacacttcagcgaattcttagtgtccactattcaattccagactatgtacgaatcagtaaagagtgtaggcaccttttgtctagaatatttgtggccaacccggaaaagagaattaccataccagagattaaaatgcacccttggttcctaaagaatttgccactagaatttatggacgagggcgaaggggtgttgcagaatgatgatcatgtgaatgaagagtcatctgaaatcactcaaagcattgaagaaatactggccatagttcaagaggctaggaaaccgggtgagggcccaaaagttggtgagcaatttgttgggggcagcatggacctcgatgatattgatgcggatgctgacatcgatgacattgagacaagcggtgattttgtctgtgcattgtga

SEQ ID NO: 114543 - DNA, 1394 bp, Glycine max
  Peptide Sequence Number=SeqID_231321
atggcgagtgctgccaccccggcgcagctgcaggacctggatgcgaccgtcgagcgcgtgcgcgcgcagttcgacgtgcccggcattgccgtggcggtggtcaaggatggcgaggtggtgctggagcgcggctggggcgtgcgcgagcagggcaagccggaaccggtgcaggccgatacgctgttcgccattgcttccaacaccaaggcgttcaccgccacctcgctgaacctgttggccgaggacggcaagctgaagatggacgacaaggtgatcgaccacctgccgtcgttccgcatgtccgacccgttcgtgaccgggcagatgacgatccgtgacctgctgtcccaccgcagtggcctgagcctgggcgctggtgacctgctgttctggccgaccacgtcctacagcattgccgaagtggtggagcggttgggcagagtgccgctgaagggcggtttccgcgaaagctatgcctacgacaacatcctgtacgcggtcgcccagcaggtgatcgagcatgtctctggcatgagttaccagcagttcctgcagacccgcatcttcgacaaggtgggcatggccggcacgcgctacaacgccgatcacctgaagcccggcgacaaggccgcggtcggccacgccaagtacgatttcaaggacctgcgcaccgttgcgccgctgacctggtcgaacaacgccggcgccggtggcatctattccagcgcgcatgacatggcgcgctggatgaaggtgcagctggccgaaggcaaactggccgatggcacgccgctgttcagtgaaaagagccagcagcagatgtggcggatgatcaccccgcagtcgatcccggcgccgagcgtgccggagctggcaccggcgcgagccaatttcgccggctatggcgaaggctggagcctgagcgattaccgtgggcagaagctggtctggcacaccggtggctggccgggcatggtctcgcggctgaccctggtgccgggcgagaagctgggcgtggtgttgctgaccaaccaggaagtgggcgcggcgttcaatgcgatcaccctgagcgtgctcgatgcctatctgggcggcgggaagcacgactgggtggacgcctatgccaaggccgtggccaagggtcaggacaaggccgacgaagcctgggccaagcaccagagcgcgcgcgacaagggcagcaagccgtcgctggcactggccggctacaccggcaccttccgtgaccgctggtatggcgacatgcagatcagtgccgagggcaagggcctgcgcctgtgtttcatgaagaccgcacagctgagcggggcgcctggagcactggcagcacgacaccttcatcgtgcgctgggacgaccgttcgctcaacgcgacgc

SEQ ID NO: 114544 - DNA, 312 bp, Glycine max
  Peptide Sequence Number=SeqID_231322
atgctgtctaatatatatgctgctgctggcaaatggaaggatgtccatagaatcagggttctgatgaaagagcaaggagttaagaaacaaacagcttatagttggttgcagattggaaacaaaacccattatttcgttggaggggatccatcacatcctaatattaatgatattcatgttgctttaaggagaataacattacatatgaaggtaaaagggagctgggaagatctaagggatgacaacattggtaaattgatgtcgtccatacttagctatagggttctctctcaccaaaatatcggaagttaa

SEQ ID NO: 114545 - DNA, 531 bp, Glycine max
  Peptide Sequence Number=SeqID_231323
atggctcaagtgaccgggcgggcagatatttggtggaggactaaagagtgggagaacatgaatacttttactcatgtcccccccggtttcaggttccatcctacggatgaagaacttgttgattactaccttaggaagaaaattacttcagggaggattgacctagatgtcataaaagatgttgacctctacaaaattgagccatgggatcttcaagagatttgcagaataggaacagaagaacaaaatgaatggtacttctttagccataaagataagaagtatccaactggaactcgcacgaatagagcgactgcagcagggttttggaaagcaacaggaagagacaaggcaatctattccaagcatgagctgataggcatgaggaagaccttagtcttttataaaggtcgagctccaaatggacaaaagtcagattggataatgcacgagtatcggcttgaaacagatgaaaatggcactccacaggcaaagagatataaaaatagttttatagtgagtaaaaattga

SEQ ID NO: 114546 - DNA, 627 bp, Glycine max
  Peptide Sequence Number=SeqID_231324
atggaagccatttctcctaagcatcttatgacatcccttgtaataattatagcttctagtttgaccgcacactgtggctgtgccaagagagggggtgaaagaccatacaaagaagccaacacactgttcataagaacatcttgcagctccacaacatatccaagactctgctacagctccttagtgaagcatgcagacttgatccaaacaaatcgtgtggttctgacaggcgcagccctgaatgtgactcttgcgtcagtgaaatcgacatcggcaatgatgtcaacgctggcaaagaagcaggggctgaagccaagagaggttgcagcgatgcaggactgtgtggagcagctgagtgacactgtggatgaactgagaaggtctattgcagagatgagtgatctaagagcttccaattttgagatgataatgagtgatgtacaaacatgggtgagtgccgctttgacggatgaaaccacctgcaacgatggcttccaagagatcactgctgccactgatattaaaagcaccgtcagaagactcgttattcagttgagattgttgtcaccgctggctagtgttaatgtctcgggcctactagcgggtggacagattttagtgatgtga

SEQ ID NO: 114547 - DNA, 1458 bp, Glycine max
  Peptide Sequence Number=SeqID_231325
atgggtttcccgcaaaggttgctgtttatattggcagcaggtaccatattgagtgtaacgggtttggagcataactatggagaagctttgtcaaagagcatattgttctttgaaggacagaggtctgggaaattgccaccaacacagagaatgacttggaggaaggattctgcgcttcaagatgtctatatagtccctgctgatactactgtcttacctttccttcgtaataaagttgacttggttggtggttactacgatgctggcgacaacgtgaaattcaactttccaatggcattttcaacaaccatgcttgcctggagtgtgatagagttcggaaaattcatgggtccagaccttaaacatgcgttagacgctattcgttgggccacagagtatttcctcaaagccacaagcatccccggttttgtgtttgcacaagtcggtgacccatatgctgatcacaattgctgggagagacctgaagacatggacacccccagaacagcctttgccgttagcagagacttccctggctctgaagtttcagcagagatagcagctgcacttgcagcctcctcaattgtatataggaagtatcatttaggttactctacaagacttctccaaagggctataaaggtttttgattttgcagataagtacagaggatcatacaatgacagcctcggaccgtgggacgaattggtgtggggagcagcatggttgttcaaggctactaaacgcccttactacgcagattacattgacaaaaacgttcataatctgaaaaactttgctgaatttggatgggactcaaaggatgctggcatcaacgtgctcgtgtctaagcttctaattaatagtagctctaattctaagcctttcatcctcaacaatgctgacaagtttgtctgttctgtgctacctgaatcaccttcagtattggtctcatactcttcaggtgggcttctattcaagcctggagggagtaacttgcagcatgcaacagcaatctcatttctgtttctggtttatgctggctatttgaaacagacaaataaagagattgactgtgggggtaaagtttttgcttctccaaagcgactcaaacaaatagcaagaggccaggtggattacatactaggaagcaatccagcgaatatgtcatacatggtaggatacggagcaaaatatcctgaaagaatacatcatcgtgcgtcgtcattgccatccgtggatgagcaccgcggccacattggttgcaaaggaggatcattttattttgacaaccaaaatgcaaaccccaacttgcttgtcggagctgttgtgggaggaccagatatgaaggattcatacgcagattctcgagcagattttgtacactctgaacctacaacatacatcaatgcaccccttgtgggtgttttggcatacttcaattcacatccatcctag

SEQ ID NO: 114548 - DNA, 1428 bp, Glycine max
  Peptide Sequence Number=SeqID_231326
atgtcaatgatggtgattgtcacaatgacaatggcagcttcaattaactacgcagaagcattagcaaagagcatcttgttttttgaaggtcagaggtctggcaagttaccaccttctcaacgcatcaaatggcggaaagactctgcacttcatgatggctcagatattcatatggatatggtaggtggatactatgacgctggcgacaatgtgaaattcaattttcccatggcattcacaatgagcatgctaggttggagtgtcttagaatttggagatctgatgggttcagagttgcaaaatgcattggaagcaatccggtggggaagtgattattttctcaaagccacaaaatatcctaatatagttgtggcacaagttggcaatcccattgccgatcacggttgttgggagaggccagaagatatggacactcctcgaacctcctactttgtttctcagaaaaggccaggttcagaactctctgctgagattgctgccgcacttgcagcatcttccatggcttttaggaaaactgatcctcactattccaacttgcttctcattaaggctatgcaggtatttgactttgcaaataaatatcgtggatcttataataacagcgtcggtgcgggagcatgccccttctactgtgatattagtggctacatggatgagttgatttggggagcagcatggttgtataaagccagtaataggcccaattatcgggattttgtgaaagcaaacatccaatccattggcaatcttgatgaatttggatgggactgcaagcatgctggcataaatgtgcttgtttcgcagtgggcgatggctgatgcatccagtagagatcttttcattcctaatgcagataaatttatatgctcgttgttgccgagttcgcccaccaaatctgtctcgtactctaaaggtggacttctattcaaacctggaggatgtaacctacaacacacaacagctctgtcatttcttttaattgtttatgcacgttacatgcaatctgcgaagaaaacagtaacatgtgggaatgaagttgccgacccagctaggctcataaatcttgcaaaaagtcaggtggattacatattgggaaagaacccactaggaatgtcatacatggtagggtatgggggcaagtaccctgagaagatacaccaccgaggttcaactttaccatctgtggatatgcacccacaacatatccagtgtcgtgagggagaccaatatttcaaatcagaaaaacccaatcctaacatcctaacaggggctgtggttggaggacctgcggaagatgattcttttcaggattcgcgctataatgctggtcaatcagagccaacaacatacgtcaatgctccttttgttggtcttttggcttacttcaacaagcctactattagttag

SEQ ID NO: 114549 - DNA, 1332 bp, Glycine max
  Peptide Sequence Number=SeqID_231327
atgtttcttaataatcatgatgacaacaatcctattgactatatttgtttgagtccttgcttgatcatctctgccaaagactgcattgttctgcttcaggaaactaactttaaggaatggaggcaagtggtgacagaaattaaccgtttcacgaaagttgataagggctttagtttcaggcccatgcgttattgtgccacatttgatactcatcgagcttctcttccttatgtggctcgttttcatgcaaagagggtattgaaatttcaagatgcactgttgacaagctatcatcgaaatgagatcaagtttgctgagcttacattggacatctatagaatgatacaatgtttagaatgggagcctagtgaaacattctaccaaaagcatacagttaaacctaaggagaatggtgacataattgatcattcaggagcttctgggataatagacatgaatcttactgcagatatgactgatccaactatacctcctaatcctagaaaggctaccctgtaccgtccatctgtgacacatgtgatagcagttttggctacaatttgtgaggagctgccaccagactgtgttgtgctagtatatctttcagcctcagggaaggctggtcttaataatgtctctcaggtggaaaattctggcggttcatccaaatattcaagacacaaagtcctttctcagacttccctaggacagaattctggaccttctgaaactcaaagtaatggcaagagagaactgagctattatgacaattatctgtggtttggtcccaagggaaatagtgtgataacagccatgcattcaaggcaggttttacatggggctgaaaggggtgaaacggctgctctatttctttcacctttaagaccgattttcaagaatccatctgatgtaaattcaaatagtggaagccaatttacctattttttgactgctcctttgtcagcattttgccaaatgattggtctcacccccaatgaggctgatacagatgtctacaatgaagcagagaacattatcgctaatgctttcacggagtgggaaataattctttgctcatcaactaccatggatttagtatgggcgcaggttataagtgatccatttctaaggcggcttattctaagatttattttctgccgatccgtgatatcttttttctgcacacctgaggaaagtgaacagtaccttccactttgtttaccctatctaccctcttctgttgcaccaacgtctgaagccgtgcgttctgctgttgtgcaacttgccatgcactttgacgttgctgactcctttcactttactgaaacataa

SEQ ID NO: 114550 - DNA, 1038 bp, Glycine max
  Peptide Sequence Number=SeqID_231328
atggttcttctgcagctagatccgtttctcaatgagcttaccagcatgtttgagcgcagcaccaagcttggctctgtttgggttactcttaaacgatgtgggataatgttgtctactttgttagcatctttgaaatctaaggtgcagaggaataaattggccactgctggtgaagcaattgagtatagatgccttatacgtgccactgatgggaaaaagacaatttctacttcgggaaataaaggatatcagaaaaaggacttatcttccagctttatctctgctcttcttcttcttagcttaggatcgtatcaactggtccgacctgcctcgttcctctccgccatgccggagcaccacactcgtcaagtcaccaccgacaagctggaagaggcagtcaaatccctctcccaagacaattccaccttgaacaccaaaatcgataccatccatgcttctcttaccgccaaaatcgaagctctatttgaccgatttgcttcctttaccatcaactctccgccacctcccccgccaacaccactccatgcgtcctttgctccccaccgccaccatatgaaattggaggtaccacgcttcgacggccacgatcccctcgggtggatcttcaaaatatcgcaattttttgattatcagggcatacctgatcatgaaaggctcacggtcgcctccttctatatggaaggacccgcgttgtcgtggtaccaatggatgtgccgaaacagattcttcccgtcatggccggctatgttacaagccttagaatcccgcttcgccccgtgcttttacgacgacccgcagggagccttgttcaagcttcagcaaaccggtagcgtcagcgagtacctcacggacttcgagcgtttggcaaatcgcacattgggccttcctccgtcatgcctgttgagctgttttgtctcaggcttgatcccggagcttcgccgggaggtccaagcactccgaccaatgtcccttcgccgggtcgtcgtatcaaagttgcacttatgttttctcttataa

SEQ ID NO: 114551 - DNA, 114 bp, Glycine max
  Peptide Sequence Number=SeqID_231329
atgttaagtggcgaggcggatgatgctgtggaattgggcattgttgaatgtgttggatatggagtttggggtcaaatgccagccaaagtgaaatccggaaattgcgttaattga

SEQ ID NO: 114552 - DNA, 1347 bp, Glycine max
  Peptide Sequence Number=SeqID_231330
atgcagattggagcagaaccagatatggtacttttttttgattgtcctgaagaagaaatggtgaaacgtgtgctgagccgtaatcagggtcgaattgatgacaacatagatacaatcaagaaccgtcttaaagtatttgagtcattaaatcttcctgtgattgactattatgctaagaaagggaaactttacaggatcaatgcagtgggaacagtagatgaaatatttgagcatgttcggccagtttttgaggcatgtgagagacggttggaaagccaagaaagaagaaacgctctttccttcccaaaacccaaatcaaccccattccttatccatcaccgacctcatcccaaaactaaattggaagcacttgaacaagtcatcaaagaccttgaagcctctgttgaaaagggcatcaaaattgaccctgaaatctatgcctctctgttagaaacctgctaccgctcccacgccgttcgtcacggtatccgagttcatcgcctcatcccaacatccctgttgcataaaaatttcggcatttcctccaagcttcttaggttgtatgcttcgtgtgggtatctcgatgatgcccacgacctgtttgatcaaatggctaagagggatacgtctgcatttccctggaattcactcatctcaggatatgcccaagtgggccactacgatgatgccattgcactctacttccaaatggtggaagagggtgttgaccctgacttgttcaccttcccgcggattctcaaagtttgtgccagaattgggtccgttcaagtgggggaagaggggcatcgccatgctgttcgtgctggctttgccactgatggttttgtcctcaatgcacgtgttgaaagatctttgataagatgcctcatagagaccccgcctcatagagaccccgttccgtggaattcaatgctcacagcttatgttcatcatggtcttgaggttgaggcaatgaaaattttccgccaaatgattttatgggtaatccggcgaggacatgaacggaacttgtccattggtaattcgttgatcatgatgtactccaataatggtagagcaggactgattaaaaaggcttatagcatcatagtcgatggaatgggctctgaggctgctggtccaactctgtggggagctttattatatgcctgctttatgcacggtgatgctactataggggagattgctgcaaacaggctttttgatttagagccagacaatgaacataattttgtacttcttatgaggatttatgaaaatgcaggcagattagaagacatggagagagttagaatgatgctggttgacagaggattggattattag

SEQ ID NO: 114553 - DNA, 1596 bp, Glycine max
  Peptide Sequence Number=SeqID_231331
atgacaatgatgggaaagacattgttaacattgttattactgtcctcagttttctcaattgcctcatcaagaagaagacattccaacaacagcaacatagattggtggtgcaaccaaaccccataccccgagacatgcaaatactacgtgaaacacagccactaccattacaaactcaaacacaaatccgaattccgaacaattctagttcacttggccttggagagagcagtgatcatgcgaaggaaagcacgcgagttggggcgaaacggtgtcaccaagaagcagaagtcagtgttccgtgattgtttgaagctctatgacaacaccgttttccatctaaaccgtacccttgaaggccttcacgtgaagagaagctgttcaccctttgatgcacaaacgtggctcagcacggctcgcacaaacattgaaacatgtcaaaacggggccttagaacttggcgttcgagattccatggttcccactgagagatgcaatttgactgagattataagcaatggcttattcgtgaattgggctttcctgaagtacaaagaggctcattacacagcagatgcagaagatggttttccaagatggttttcgatgcatgagaggaagctgttgcagtcttcttcttcaataagggcacatctagtggtggccaaagatggttcggggcatttcaggagtatccaagctgctatcaatgccgcggcaagaagaaggttcaagagcaggttcattatacatgttaagagaggagtttatagagagaatattgaggttgacaagaccaatgacaacgttatgttggtcggtgatggcatgagaaataccataataacaagtggcaggagcgttcgagctggttataccacctatagctccgcaacagcaggaattgatggtcttcacttcattgcacgagacattaccttcagaaacacggcaggtcctctgaagggtcaggcagtggcacttcgatcagcctctgacctctccgtgttctatcgctgtgccattgagggctaccaagacaccctcatggtccatgcacaacgacaattttacagaggatgttacatatatggaaccgttgacttcatatttggcaatgctgctgtcgttttccaaaactgtgtgattcttgtaagaagacccttaaatgggcaagcaaacatgatcacggcccaaggtcgagatgacccatttcagaacacggggttttcaattcacaattctcagatcagggctgcaccagacctcaggcccgttgttggcaagttcaacacgttcttgggccgcccttggcaacgatactcaagagttgtggtcatgaaatcgttcttggatagcttggtgagcccaaggggttggtctccatggggggactctaattttgcattgaatactctgtattatggagagtaccggaactttgggcccggttcatccacaagaaaccgggtacgatggcccggttttcatagaataagtagcccagctgaggcatcacgattcaccgttgctaacatccttgctggccgcacatggttgcctgccactggtgtgccattcacttctggcctttga

SEQ ID NO: 114554 - DNA, 471 bp, Glycine max
  Peptide Sequence Number=SeqID_231332
atggcaggcaagtttgatcccaaagattatcctaatgctatagacaggatgttgggtaagaagttggctttcaggtttaaggctataccaaatttatcaaccctcaccatactaactgattctagggctatggtcgcgggcattaaaaacagagcaagagacaaagcatcggctagaaggcgtccaatatttggaacagatcatgtaaagaaagtagcagaagctgatgtgaagggtacagaactgacattcccctccaacagcgttgcgtcggagggtaacatgacctggttttggtctgatgggcataagaaggggtgggttaagttgatgaacagggcaacgggcaataggtgggttcggaccacacttgtttcatttgcggtccccattcccttcattttcccgcgcaaaggatcagatgaggacaaccacttccttgggccccacacccctcctccttcactttaa

SEQ ID NO: 114555 - DNA, 297 bp, Glycine max
  Peptide Sequence Number=SeqID_231333
atgggggtggctgatgcaacacaaatttgtgctcgaaaccactctgtggcggtgttgaccgttgtcatcgcgtggggatttaggtttgaaaacccttccatgatctctctttgcctttccaagattaaatctagaaaacacgagacaacaacgaatgcaaaaggaggtgatgacaacaaagacgaccttaatggacatgccaatatcaattcccatcaagtagttgcacgcaagcttccatataggttgtcacctaatgttatggattcgcattgctctttaattattgttccatag

SEQ ID NO: 114556 - DNA, 255 bp, Glycine max
  Peptide Sequence Number=SeqID_231334
atggcttatgctgcaatgaaacccactaagcccggcttggaggagtcacaggagcaaatccataagattagaatcaccctttcctctaagaacgtcaagaatctcgagaagggcaccaacacatgggacagatttgagctgcgtgtacacaaaagagtcattgacctctacagttcccctgatgtggttaagcagataacctcgatcacaattgaacctggtgtcgaggttgaggtgactattgcagatgcttga

SEQ ID NO: 114557 - DNA, 1194 bp, Glycine max
  Peptide Sequence Number=SeqID_231335
atggatagaactgttgatgccgatattgtgatcgtgggaggtggtatttgtggccttgcaacagcccttgcccttcacaggaagagaattaaaagtctggtgttagaaagatcagagaatttgcgagccacaggagcagctataatagtgcaggcaaatggctggcgtgcacttgatcagcttggcattggctcaacacttagacaaactgctattcaaatagaagggggaagatttatatctctcaacgaggctgagccaatggaatttccatttggggttaatcaggaacttcgttgtttaaagcgtactgatctggtgaaagccatggccgataatttaccggtggggactatacgtacgaactgtcaagtggtttccattgaattagatcctttaacacactctccacagcttctgcttagcaacggaagcatccttcaagctaaggttgttattggatgtgatggcgtgaattctgccattgcaaatatgtttgggttacaccgaacgaagctcttgcttttctctacatgtgttgcacgaggcttcacaaattttccaaatggtcatcaatttgccagtgagtttgttgtgatgagcagaggtcaagtccaactcggaagaatcccagtgtctgaccagctcgtttattggtttgtcacaaggccaaggacttctaaagattcaacaatttggaaagagccagttcttattaggcagtcattaatagaatcaatgaaaggtttcccagaaggggctgtggagatgatacaaaactgcaagttgagcttcttgcatctgactgagttgaagtatcgagcaccgtgggacttggtcttgaacaagttcaggaaaggtacagtgacaattgctggtgacgcaatgcatgccacaggcccattcattgcacagggtggctcagcttccatagaagatgccctggttctggctagatgcctggcccaaaagaaatttgcggaagggatgaacatcgcagacgcagaagaagcatttgatcaatatctcaaagaaaggaagatgagaatcttttggctctctttgcattctttccttgttgggaagaagcttgacaccaaatcatccatagtcagattcattatccttgcaatcatggccattctgtttagagaccccgattggcattcccgctatcattgtggacttctatag

SEQ ID NO: 114558 - DNA, 1199 bp, Glycine max
  Peptide Sequence Number=SeqID_231336
atggaagttctgattgccattttcttcctattatacttggtttcgcattgttcttgtagcagactacgcgaagctgctataaacctgaacactttcaatgtgatggattatggagctatcggagatggcctcacagatgattctcaagcttttctaaaagcttggagtatggtttgtgcaatgaaaaatggtgctgcaaccctcaaggtgcctcccgggaaaacattcatgttgaaacctcttcaattcagtggtccctgcagtttctcttcggttcattttcagcttgaaggagatgttgttgcaccaaagagcactgaagcatggaagggtcaggactctagcaagtggattgatttttctaacgtcgatggccttataatcgatggaggtggacaaatcgacggcagtggttctgtctggtggaattcttgtaaagtgaaaagctgctcaagaccaactgccctgtctattcacaactgcaacaacctccagctaactgggactcgtcatctcaatagtgcaagaaaccatatatctataaataattctaatcacacacacatattcaatgtcactatcactgcacctcaagatagcccaaacactgatggaattgacgtttctcaatcaagctacattctaattcagcgctcaaccattgcaacgggagatgactgcatcgccatgaacagtggcacgtcatatgttaacattactggtataacttgtggacccggccacggtataagtgttggaagccttgggaaaaaaggaacttgtcaaacagtggagcatgttcatgtaagcaactgcaacttcaagggagcagataatggaatgaggataaagacatggccgggtggatgcgggtatgcaagaaatatcaagttcgagcatatcgtacttacaaataccaaaaatcctataattattgaccaggattatgaaaatgtacagaatgaagacaaaaaacagacatctgaagttcaaataagtggcgtgacgtatcgttatgtcaatggaacttgtaatagtgagacagccattattttgaattgtggcgcgggtgcagggtgcactgatatcttcatggatctagtcaacataacctcaacttcatcaggatcaaacgttcttgcatcctgcaacaatgctcatggagttgctgcttctacttcacctcctgtgtcttgctt

SEQ ID NO: 114559 - DNA, 323 bp, Glycine max
  Peptide Sequence Number=SeqID_231337
atgactttagaatcagaccagtttccactgttgaatgaccctaacaaagcatgcatctacgtgatcaaggaagcctccctttacaacaaagagaagaacaagatgaaagattgcaaaaatacaagtggtgaagatgtctccttcacctctaggatcccacaaccactcacaaactcatctcaagctctcagaacagcttcctcttcaagctctggtggtcttgttcgtgctcatgcgcttagcacaattctggaccgattagcgcacattagtgaatttcggcttagcgcgtgtttttctcgcttagcggatggactgaagcg

SEQ ID NO: 114560 - DNA, 1944 bp, Glycine max
  Peptide Sequence Number=SeqID_231338
atgacgtggcagatcttgttccgtgtcggagacatcgtcagtgggcccgatctctcgccggctatggtcactctcgatattgttgaggaggacgtcactcgttgccgtacttccgtctattgtgaccagtgccgagtcgttgggtggagtgggcatccggtgtgtcgaaaacgataccatttcataataagggctgcgagtgatgccgtcgaagcatatcaaagaccatgttcaagatgtggaaatcttctccaattatctgaaacaaggtgtagatcgtgtaactttgccatcaccgttgatgaccttgaggattgggtgtatcttcagattgaagataacacccatcttctgcatggtgtcgtgcatgccaatggttatgggcacctgctcactctcaatggaagagaaggtggctcgaagcttctctctggatttgatatcatgaatttctgggataggctatgtgctgcaatttctgttaggaaggttagtgtgatggatttgtccaagaaatttgggctggaataccgattgcttcatgcaatcaccaacgggcattcctggtatggcaattggggttatcaatttggaactggcagctatgctcttacccaaaatgcttacaagaatgcagtgaataccctgtcgagcatgctcttgtcctcattttcattccatggtcggggaccaagaagccgcctggagtgtgtcatttctctttaccagtctttggcagaaactgaacttttgacgattaaagatctattttcctttttgttgacattgattcttgaatgtcgtaagccagtggccatgaggacatctaagcagaccagtaacttattgtgtgcttggacgggaaatgatgttgaagacgtgcaacatgctttgatcaaggttttgcttgcatcgggtgtctgtactgaggccaaatgggtgacaaggcgtactctcaagggtgcagtatgcaggggtgtttcatctccagaacttctagactactgtcttaagcacttgccgggaaaattagctgccaatggaatgatagtttgttcacgatgcaatccaatttccagtgccatcgaattcaggttagaaccttggtgtaatggattaagcacaaattcaggctatccaacagatgctcaactgatctctgatttgacatttttatttgattcaattattcaccctgacaaaatggtgtgctacagacccaagaatatgaggaaaagggtggcggattcagccaggaagctccttgactgtaaacagttcatgaaggattacaagccatatgaaatggctgttgaactgccttcagtcattaggctgttgtgtcatgtggagctttctgatcagcccaaggatgatccatccccaccgccagagctaattgtgcttcctttgaatgctactgttgctgacctcaagagtgaagccactagtgcttttcaagaggtatatgcaatgtataagaggtttcaagctgaggaactcctagggtatggatcaatcagtgattcgctcaccataaagttcttgcttggaacaagtggatcaattcaaattcaaggtagatgtccagctaaacatgggctaagccgattccgaatggaacgaggaacagaggtgtggaaggtggattgcatttgcggggctaaggatgacgatggagagaaaatgttagcatgtgatacctgtggtgtttggcagcacacaagatgtgctggaattgataataatactgatggaatgccgtctaagtttgtttgtatgagatgtgtcaactcgtaccgtgaggagactaaaaaattaccaacacctggtgaggaagctaacgagacctgtaaattcaccacatcttgcagagatgaggcagtagcaagggagtgtgcaacggtttcatgtaacatagctgtgaattttggtgtacgttga

SEQ ID NO: 114561 - DNA, 133 bp, Glycine max
  Peptide Sequence Number=SeqID_231339
atgaaggtagcattatcagcactagtcactggtgagatcatcatgatactgaaagaggttgtagacaacgttgaaggaagtagggacaatgaagttgttgtggttgatgaaggtgacaaagttgatgaggaag

SEQ ID NO: 114562 - DNA, 1474 bp, Glycine max
  Peptide Sequence Number=SeqID_231340
atgaatggaaacggtggatttaacactcacttaccagtgtttgatggtaggaactggagtcgttggtcaatacagatgcgtgtgttgttcggagcacaagatgtgctcgaatttgtgaatgacggagttccggttttggcggaaaatacgacggaagcgcagaggaatttgcatcgcgaaaagaagaagaaggatcagaaagccttgttctacattcaccagtgtgttgatgcaaagatctttgagaagattgcggaatcgacgacggcgaaagctgcttgggacacgcttgtgcgttgctatggtggtaatgcaactgtgaagaaagtcaagcttcaatcactgaggaagcagtatgagaacctgaatatgaagcacaatgagaaggtagttgattatgtgtctcgcataattactgttacgaacgaaatgaagacctgtggtgagacaatttctgagcagatgattgttgaaaaggtactgcgttccttaactgctcaatttgatcatatagttgttgctatagaacagtctaaggacactagtacaatgaagattgatgaattgcaaggtagtttagaagcacttgaattaagagtaattgaaagaggaaatggaaaagaaacagatcaggctttgcaagcagcatctaaggaaaattggcgtgaaattaagaagaaacagtggttagataagaaggctaaacagaatcccaatagtagtgataaggataaaggaaaatcactggctgataaggcagaatcatcaaataaaggaggttataactcaaagtttaataagaaaaagaactttgataaaaggaaaatacagtgttataattgtgacagatttggtcactttgctgatgaatgttggtctggtgctggtaagtggaagaaaccagagaaaggtacagagcaagctaatcttgctcaagatagttctgatacagaacctgttatgttaatggtgacaaccaatgatgcaggcgtagtagtagattggtggtatttggacacaggttgttctaaccatctaactgggaataggcagtggttgattaactatgattccagcaaagaaagtagaatcaggtgtgctgatgatgagtacttggttgctgaaggaatgggagatgtgctggtagaattgaaggatggtggaactgtctggattgaaaatgtgtggtatgtgcctggcatgaagagtaatttgatgagtgtaggccaattattggagaaaggttactcagtaactatgagaggtgcagtgctgcagctgtttgataattctgataaactggttttgaagtcaaaactgagcaggaacaggacttttaaatgcaatgtaaaagattctggtgtgaaagtattgagtacagtgattgaatcacagagctggctatggcataggagatttggacacttgaatttcaagagtctaactcagttgagtgagaaggagctagtgacag

SEQ ID NO: 114563 - DNA, 999 bp, Glycine max
  Peptide Sequence Number=SeqID_231341
gtcaccgacgcgtcgatgctggtcgtgctgtgcggcgatctgtcgagctgggagtcacaggtaaaaaacgtctgggcccaggcggcggagccggtacagcagttcatgatcccggccgtcgatcagtattatcgcggtaagccgcaggtgcagcgcgacgaagtgatgcgcagcagcggtatcttcgcccagacgctgatgctggcggccaaggcgcagggctacgactcttgcccgatggacgggtttgatttcgacgccgtgggcgagatcatcaacaaaccggcgcactatcagatcgcgctgatggtcgccatcggcaaggcggcggggcagccttatccgcgcatcggcaaactgccgttcgacgagttcgttccagtagctgaaacggatgcgccgttgcaggcggtgatgccacatggccaactccttctaccctacacggctgaggcggtggccgaacgcggcccagtccaccacgatcgccaccgccgggtagatgaacgacagggcgccgaccagagaggtggggatcttctgaatggcgccgtacagcagcgtggacatcaagccggtatgcaccaggccgagggtcgccagcagcagccagtcgatcggggccgcaggcggcgtggccaggccggcgaacggcgccatcaccagcgcgccgacggtcagctgaatcaacacgatcagctgcggcggcagcgcggccagctgtttgacgatcgccgccgcaatggcgtacatcagggccgcacccagcgccagcgccacgccgagcagatagtcatcgccgccgccgccgttttgccggccggtgacgatcaacaccattcccgcgaacgccagcagaagccagcccagccgattagccgtcagcttttcgccgaacagcagcgcccccagcgccaccaacatgaacggctgaacgtggtaggtaacggtggcgaccgcgatcgaggcatgtgcataggcggcaaacagcagcgtcca

SEQ ID NO: 114564 - DNA, 201 bp, Glycine max
  Peptide Sequence Number=SeqID_231342
atggcggggcgaaagagctacctggaagctagttacggttgtgcaaagaatatgaaggaaactggtaccctattagttcagtcaaatctcggaaccaagctcaacgcggcatgttccggtattgccaatacagtcttgtccagtaacccgctagaacgattaagccagtgtcctgatgaatcccgtggaaacctagtatag

SEQ ID NO: 114565 - DNA, 357 bp, Glycine max
  Peptide Sequence Number=SeqID_231343
atgcaggtgaaagtgggaggtcacatagtgaagtttgatgaggatactttaaacacatttctgaagacccctgtagtgctggaagggggtgagaatttgtgtacttattccatatgtgcactcctgaggcttgatcctcaggagttggctactaagctttgtatcccagggaggggattcgagcttaatgctgatgggcagcctttgaagattctgaggaagaacatgactactctagctcagacatggagtgtcctttccttttctaacctcattcccacctcccacacatttgatatgaccctagacagagccaaattgatttatgggattattatgaagatggacatgaactag

SEQ ID NO: 114566 - DNA, 381 bp, Glycine max
  Peptide Sequence Number=SeqID_231344
atgtcagatatatgcctaccgacttcagctgcagtccctcaactaccggcctactatttcaagaatgatgatgttgagttcaatatggttgatggtggagcggccgctggtaatccggaatatgatctggatccttccgtggacgatcctactgatgcttcaaaagaaaacatggacaatcttgaagaggcagggaaaaaaatgttgcaagaaaatgttaaaaggataaatgtggatacttttgatcttgaagaaacaaacgatggtacgtatgccgaggctcttgacaggctggctaatattttgtacgaagagaaagagctgcgccttaaaaggaaatctatggagaaaagaggaagaccatttattgaaactatttga

SEQ ID NO: 114567 - DNA, 309 bp, Glycine max
  Peptide Sequence Number=SeqID_231345
atgtctgcaagtggcagttgttgtgcattttatggtagtttcattcggcaatgccatcatagaagacgtgcagctattcgaactgcaagaacaaggaggaacccaggaaggctattctatacttgtgcattgccccaaacagacccagataactgtcaattttttcaatgggttgaaaaagaaaaccaagtttctaattcgtcttctgtctcaagagaagcaatggtagtgcctgatttgaggctacaaattgaagctttgcagaagaaaatgagaaatttaacaaacattgtgttgttagtttattaa

SEQ ID NO: 114568 - DNA, 2871 bp, Glycine max
  Peptide Sequence Number=SeqID_231346
atggagtatgccatgcatttcttgatgggactcaatgaatcctatggttcaattcgaggtcagattctttctatggaccctttcccccctattacttgcattttttctctagtggttcaagaagaaaaacagagagaaattggtgcttttgtttctgctttcaactccacaaatgatgcttcacagcctcatgcctttgctgtcaaggactccaaatatcagtttgatcacaagtttaattccaattccaagaatcagcccctctgtgcacattgtggtcgacttggccatactcaaggcaactgcttcaagttacatgggtttcccccaaattacaagaagaataagccttcttcttctaatactgaaagaaaaacagtgaatcaagtcttagcacccaattttgttcctgattttcatctcactgtccaacaatatggtcaactcatgagtttgcttcaagcacaaacttcaaatgctgttattcccaatattgagtcttttaacactggtatggtcttgtctgcttctttaactaagtttcctcaaaattgttggattgttgattcgggtgcgagcacttacattgaaatgcctcattacaagaagattggtagaggggatctccttcaaggactctatgtcttgaacttcaaggatactcattccacttacaatactcaatttgcagcttcaatcaaatgtctaagatcagataatgccaaggagttagctcttagaaacttcctagcatctcaagggaccttacatcaattcacatgtgttgaaagacctcaacaaaattctgtcattgaaaggaaacatcaacatttacttaatgttgctagagcattatttttccagtccaaggtgcctattacttttttggggagattgtgttattactgctactttccttatcagcagattgccttcaccattgctgaaaaaagtactctatatcaggttcttcatggttttgcacatgattattccattttaagatcttttggttgccttgcctttggagctactttagcttctgagaggaacaaattctctccaagagaagttccctctgtgtttgttggtcatccacaaggagtcaaggggtacaagttgtataacttgcatactatgaagttttatgtttcaagggatttagtctttcatgagagcattttcccttttcaaactttacccaactcatctcaagaacctgattttcttagtgaattagctatttccttacccattcctgaacctataacctcaaacattcaacctagagccattgaacccaatacttctaaacttgatcaccctattccccctgacacaagtgattttcctattcagttatctgattctatagttgatactaccattggtgcatcatctacattgtcttctcctcccttaagaagatcaattagaacatcaaaccctcaaccttatctttctgactatattagaccgcaacctagacaaagatctcatcctatccaggaccattgctctctagtccatctcaaccctctttataaggacttcattgctcaagtgaaattcaaacttgatgacattgtggatcgccacaaagccagattggtagctaagggctacacacaacaggctggcataaacttttctgatactttctccccagttgctaaacttacatcagttagagttcttttggctattgtagttgctaaaaattggtccatcttacaacttgatgtggataatgctttccttaatggcaatctatttgaggaagcatatatggaacttccaaaagggtacaattcagttgataaaactcttgtttgcagactcaacaaatccctttatggccttagacaagcttctagacaatggttttgtaaattctcaacaacattaattgctaatggtttctctcagtcaaagaatgactattctctctttaccattggcaaaggtgctttcttggttatcttgttagtatatgtagacgatattctacttgttggcccaagtgttgcatgtgttcattctattctggccaaacttcaagctctgttcaaactaaagatccttggtcccttaaagtactttctgggactagaaattgcaaagtccagcaagggcattgtactgactcagaaaaaatatgctctttccctgttagaagatactggcttccttggctacaagccatcttctcttccaatggatccaaatttaaagcttagtatgcttaatggtgagttactgactgatccctcaatgtataggcgtttacttggtcgcctaatgtacctaactatttcaaggccatatattacttttcctgttaacaaactgagtcagtacatgcagaatccaaggacaactcatctagatgttgtgcatcatctcctccaatacatcaaaggtacttcaggtcagggtcttcattttccaacaagcaattccttcaatttgtctgcctatgcatatgctgattggggaggatgcttggacacatgcagaacaacatctggtcctgcagaatatcgggcactttcctcagtatccagtgaagtgatttggctaagaagacttttactgcactttgagattattgttccttctgtcatgcttttctatgatagcaaatctgccatagatctagcatctaatctaactcaccatgaacaatcaaaacacattgatatcgattatcacttcattcgtgagttagtgcagtccaacatcctcaagcttgttcatgtgaaatctcagcatcaagttgtagatgtcttcacaaagcctttactgcttctagctttctcttcttttattcgcaagttgggaattattaacatttactctccaacttga

SEQ ID NO: 114569 - DNA, 651 bp, Glycine max
  Peptide Sequence Number=SeqID_231347
atggctctgcaggaagaagggtggcctttgggtttgagactattcaatgaaagaattgggttagcaagaaatggtgatttctctggatcagtctccttcagcactatgctcactgcttctcccacccgttcaactgattcttcctcagatcttgacacacaggcaaaaaaaggaagaaacaaattaaagtccactggatcattcttccgcgataagagcatcactcttggcagccttattggtatttctagcttcctagaactatcaaggagatcaaccaggggaagaatattggtggaaccctcaaaggacaacaaaaagattaacaagctgaggccttggttgttctcactttgttcaatgctatctactgatgcagtgagtgtgaatgttgctccctctcttggtcactatcttgtggcagagagaagagctgcaagtactcacagaaggaataatcaatgttcaaccatttatggacctaatgatttctcccaagttcaggagtccaactcgctatttgttggtggccaaggtgctgctcatagttcatcaacttcactaggtgaagattgtggaagagagtcaaataaagcattggagcaaagcaatgaatatgcagcaccaataatttgttgtttgtgcagataa

SEQ ID NO: 114570 - DNA, 204 bp, Glycine max
  Peptide Sequence Number=SeqID_231348
atgcaacggtgttatcatttcgctgccataaagcatgactggagtgctccaatggagataaaggatgagtcacaagactcaatccaggatttcattggtttgtatgagaaaaggattggaatcatccatggcacccatgggggaacttcgaagaatcgaagaataggagaagaagtgctagaaagggatcagagaaagcggtaa

SEQ ID NO: 114571 - DNA, 210 bp, Glycine max
  Peptide Sequence Number=SeqID_231349
atgactcttgaacctgacatatccccaagactaggtagttttgttgtggctgagtttttgtcaaggaatgagcatggtaatcatagtctaagtggacttaaggatgtggattttaggcaacctgaggtgctattggtaaacaaggttcatcaatttgaggtgagaaaaaggccacttgaggcattagcagatatgggactaaatggatag

SEQ ID NO: 114572 - DNA, 315 bp, Glycine max
  Peptide Sequence Number=SeqID_231350
atgtcatctgcaaaaagcatgcatctcggcgctatctcttggatttgttccgtgaggacatctagaattaaggtaaaaagggatctaaattgcattgagcatacaagtaatactggttggaaagagtatgcatattatcttttcattgatatcaggcatcaaagagccaggcctatcattatagatcctggcttatatcattcaaagaaatttggtgtttactgggctaaagagaagagatctgttccgtcttcgttcaagttattcacagggtctttctacaaaaaccactggagtgctcagccatttcattga

SEQ ID NO: 114573 - DNA, 444 bp, Glycine max
  Peptide Sequence Number=SeqID_231351
atggtgatccccatcgtcacaataagcatccttttcctctccctactccttcccctcaccaaaccctcaccttcatcattatcatcatcatcttcttcttcttctgcaacatggtcttctctgaattcaacagaagaactagaagcaagtcttccgaaattggcatacatattatcggggagcaaaggggagggggcgcagctgaagagggcttctaatgcggagaggctggtgctggccaaatacgtcaagtcccaaactatgtttacgacatttgggaacgtcttggttgtgggtaagcctgatttggtcacctacaagggtcccaccattattgcttctactcttcacgggattgcccttttgctcaagaaggcccctcattgggactggctaattaatctcaatgcctctgattatcctctcctctctcatgacagttag

SEQ ID NO: 114574 - DNA, 264 bp, Glycine max
  Peptide Sequence Number=SeqID_231352
atgaaccaatatacttccaccagagccccttcccctatcagacccccatctcctccttttgcagtaataggtgcaaggattcgggctacactacggaggaaagcacgccgatggagaatgagcaaacaacgatggacgtttaggctatgtgctttgtcgatggtgagactgacaaagcagctgacgggggtggtggaagcattgtgggcggttgtcactacggtttcagtgggagaaactctttggaaggggaaggggaagtaa

SEQ ID NO: 114575 - DNA, 408 bp, Glycine max
  Peptide Sequence Number=SeqID_231353
atggcggactcgccggatgattcttcgaggtatcccggaaacggcaaggacatggaggacattacatcctctgttgccaatgcaagtagctcttcaggctcaggttactgtaattctctctccatcctgagctcctgttttgctagggtgagccctggtgcagtggtaaagttgtgccttggtgacttgttggtcatgggctcgaatccggaaacagcctctttgcatatgcaaggtcttggaactgtcaccaattcagtgccttttgcttccattattcacttatgccacttggaacttctcatcatcttctatcctgtgtatcctgaaactatgctcaaccctgttgatccacccatatcatcttccctaacaaagactggaagctccaatctttcttgccagtga

SEQ ID NO: 114576 - DNA, 417 bp, Glycine max
  Peptide Sequence Number=SeqID_231354
atgagtcaggacgtaggaatcagtggtggctcaattttagaagcgacttgcgggatggaaaggcaaaaacctgtcaataggagtgagattggtccttatcaactcagttttaagcagcctccgttctccttcgatcagcatggagatctatcatcatcctcattatggtggcgcgacatggccaaaatagaatcgtccccaggtgatggcttacaaacgtggttctggaagtcaagatggttgggtaattttagcctgaaagatactttccctgggctattctccatagcagaaaataaaaatgccctagttcaagagatggtaaggccatttgagaagaattcggtgtgggattggaagtggagacgaaggctttttgaatgggaacaacaacaagtgcagggtctggagagctga

SEQ ID NO: 114577 - DNA, 201 bp, Glycine max
  Peptide Sequence Number=SeqID_231355
atgatgatagctgaggaaattataaatgggatgagcattgcactagaacttgtacctttatggagagcaatgggaaggtcatctgagaactcaagaggattcgaagtagaatgggaagtgattggtctaggagatgagtcacatgggaaggagcaaaacgtggtcggcgacactgataaacttgaaatggctgaggactag

SEQ ID NO: 114578 - DNA, 345 bp, Glycine max
  Peptide Sequence Number=SeqID_231356
atgcacaacaagccaactaaaagtggcaagaaaacagcgaaactatggtggcggttggaactagctccactaaaattctcatcaacgggatacaagttccccggtggacccgtcatgtacaaatatgctgatgatggtggtggagggcaatacttcgttggtggtttcttgggtgaagggggtggtggtgatggatacacaattggtggtggcggtgaaaaatactctattggtggtggtggtgataaatactctattggtggtgatggggtggctaggacttctggagagaggaatggaaaggaagaggtgggggtagtaatgatggatttcttacgttgttag

SEQ ID NO: 114579 - DNA, 207 bp, Glycine max
  Peptide Sequence Number=SeqID_231357
atggctaataatggaataatacatcaatcttcatgtcctcatactcctcagcaaaatgatatcgcagagcgcaagcatcatcatatcattgagactgcacacaccttactcatccatgccaatgttcctatgatgttttggggtaatgttgttctcactcccgtatacttaatcaacaggatgccatcttcttcaacacagaacaag

SEQ ID NO: 114580 - DNA, 930 bp, Glycine max
  Peptide Sequence Number=SeqID_231358
atggtgaaaggtttaagtatttctgctgctggttcctcttcatttgtgtctcctaatgactctcaaatcacttttaaacttcacaaattattgcatgggaccaataaagtccttctccagggagttgttggtgctgatggtctttactcctttcataatctcaagcttcaagactattcatctctgttgttgtccacttcagcttcacctgttagctcagttacagatgttaaggaaaatgctgatggctctattaacaagtttaaagcaaggttggtagcaaagggttttcatcaagttcatggtttcgattttcatgagaccttttcccctgtgctggatgtaaacaatgcctttttaaatggggttcttgaggaatcagtgtttatgacacagcttcctggctttgaagttggggataggtctcttgtttgcaaacttaacaaggccctctatggcttaaaacaagccccaaggcagtggtttgatgggttaaagtctactcttcttcagtttggttttgtgttcagcaagtatgattcttccctgtttatctacaggcatcagaatcacattgtctatcttctgtatgctactttaactagacctgaaatcagctttgctgtcaataaagtctgccagtttatggctaaacctcttgaatctcattgggcagcagttaaaatgattttgaggtatctcaaagcgtttgacgtggatgacaggcgttccacctcaggggcagccatctttcttggtccaaatctaatatcttggtggtcttgcaaacaaaaggtcactgccaggtccagcactgaagctgaataccgtagtttggctcaaacctttgctgagttgacatggattcatgccttgctaacagagttgcaagtctcttttaccactcctgttctctactgtgataattag

SEQ ID NO: 114581 - DNA, 222 bp, Glycine max
  Peptide Sequence Number=SeqID_231359
atgtacatgacttcctattccatggccgcaatgggtcctctccaactgtacaacatcccctctggcatctcctcccagggagccgagggcgcaccagcgacgcggggtggagagggtggggctgaaggactaggttttggtgaggaccggggagaggttgtgggtggtggcggtaaggaggatgaggcggttggaggaggagatggactgtgcaaggattga

SEQ ID NO: 114582 - DNA, 192 bp, Glycine max
  Peptide Sequence Number=SeqID_231360
atggataaaaattggggaccaaaaattgatgtagtagggttttgctttcttgatcttgcgtcaaactatgaaccaccagagtcccttgtaaaatggcttgaagaaggtgacaaacctatttacattggatttggtagcctggcttttaaggctatgatattaaggatgatggaagtatactcctttggttaa

SEQ ID NO: 114583 - DNA, 651 bp, Glycine max
  Peptide Sequence Number=SeqID_231361
atggcacctgcgcctactcctatagttgagactgagaccatgatcgactcttccttggctccactcattaccttacgagatcccgaccctccatctatacttgacctacccattgctcttcgaaaagtggcaaagggctacactcaggtgtttgaattggactactttgacacattctcacttgtggccaagatggactctgtcaaattgttattctctattgcagccattcctcatctgcctctcttccaactcaatattaaaaatgcttttttgcatggagatcttgaggaggaagtatacatggagcaatcacctggttttgttgctcagggggagtcctctaccatggtttgccgacttcacagacccctctatggacttaaatggtttccgagagcatggaagtatgcttgtgacatcgtggaagaaactggccttatgaatgctaagcccgtggacactcctatggaccctagtgtcaaattggtacccgatcagggggagccctttgctgacaggaagatatcaaaggatcattggattgtagttatacggatcttgaaatacatcaaaggtgctcttggaaaaggacttatctatgaggacagaggtcatgtacggattgttggatattcagatgctgattag

SEQ ID NO: 114584 - DNA, 831 bp, Glycine max
  Peptide Sequence Number=SeqID_231362
atggcgtcttctagagctactaaaacatctaaacttgaggccttgctttcaaacttcacactttccacagagaagttggacagttccaattactctacatgggcttctgacattctcctttggattagtggtcaagggtacaaagaacacctcacttctattgttgattctataccgaaaactgagtgtgctaagtggctaaagcttgatgcccagttatgcagtgtcatcaaatccaccatttacccttctatcaaaccgttgatgactctcgttgctccacaatggtttgatggctcaatgtcaatctatcttggcagactccatcctgcactccatgactgcaatgaatttttccctcctgctgttgcgaaacctgaagaagccaagaaggaacttgaaaatcgcagtaccttctttatgacgtttgccctttttggcttgcctccggagtactctgctacctgtgaccagattttggggtggtgtgagcattgccataaggataatcacactactgatcgttgctggaaaataaatggcaagcctcctgattacaggcttgctcattcagctaataactctggtgccgctgctttggtagcacaatctggtaattcatttgcctgtatctcacagtttcctactccaggtccttgggtgcttgattccagtgcatctggtcacatatttgcctcaccaaaggcgtgttctaccgcaacatctccacttaccatacatgctcagttgggacatcctgatctcgttcttcagaagttggctgtgtccccttttgctttagtccattctgatgtctggggttcgtcttga

SEQ ID NO: 114585 - DNA, 1116 bp, Glycine max
  Peptide Sequence Number=SeqID_231363
atgagtccccacctcccagaacagaaaatacacatccaatacaaaccagatcgaagtctggagtatgatgctcgtctaaagaattctacttgggatttagtaccgctcccacctgatagaaaggctattggttgcaagtggatctttcgggtaaaacagaatgctgatgggcctgttaataaatttaaagctagattggttgcaaagggggacaatcaagtccaagtttacatgtctcaacctccaggtttcaaagcttctgatccttccttggtttgcaagttaaagaaagagacctttgtatggtctcaagcaggccccaaggcagtggtctatgtggatgatatcatcatcacaggaagttctgttgacttaattcagcaactgacctctcaactaaatgccagattctctctcaaacagcagggtcttcttaactattttcttggaatagaggtttgtgagttcatggcaaaccctttggaaactcactggacagcagtgaaacgtattctaatatatctcaagggcacactcttgtatggacttcatctgagacctgcgactttggggccaccctactgcataagagctctttgtgatgctgattgggcatctgacattgatgatagaagatcaacatcaggtgctgcagtttattttggtccaaacttaatctcttggtggtcttgcaaacaaaaggtagttgctagatcaagtactgaagccgaacatagaagcctagcccaaactacagctgaaatttcatggatcaagacattgctgactgaaataaaagtcccattcagaactcatgtgatcttcagtgataatctgagtgctggggctctcactcataatccggttcttcatgctcggacaaaacacagggagattgacatcttttttgttagggaaaatgtcctcaccaagcagctagttgctcattacattcttgcattagatcagtgggctgatgcactgacaaaagctctttctgccacaaggtttatgtttctcgggcaaactcaatgctgtgagaacagcatcgggccaaaaacgggaagggacattgccatggagaagcacatgaagtttggtgaagaatacccttag

SEQ ID NO: 114586 - DNA, 195 bp, Glycine max
  Peptide Sequence Number=SeqID_231364
atgacactccaccctatttcacctaacattaagaatagtgataaagctatttgtggtctccattctgatccgaacacggttttgacttgggacttcaatagagaccataatcgcggcgacgaagaggaagagagcatcgacactaaagttgatttgaagaaaatgggaacaaggaagcataagaaattgctttga

SEQ ID NO: 114587 - DNA, 324 bp, Glycine max
  Peptide Sequence Number=SeqID_231365
atggataagcagctggaagagtgccacgaagcacctttttatacattagggccgttaacaacagatattgcaccgggctatgatcatataacttcaggaatcggagctgccatgatcggatggtttggatgtgcaatgctttgttacgttacccctaaagaacatctaggactacccaataaaaaagatgtgaaagacggggttattacctacaagctggcagcacatgctgcggatttggcaaaaggacatccaggtgctcagtacagagataatgctctgagtaaagcaaggaaatacgggaatccgctgaaatggggatga

SEQ ID NO: 114588 - DNA, 1546 bp, Glycine max
  Peptide Sequence Number=SeqID_231366
atgaaggtgagcgagaactgttttcattgtggtcaaggcatagaaaaagaacgaattctttttgatgaaaaaattttttgttgcaacggttgcaagtcagtttacgaaattctgaataccaacaatctaagtaatttttatgaactgaataaaagagcaggaattcgtccggacgaaaattcctctcagttcgattatttggataccccggaaatttttgaaaaagtcaccgatttttcagaaggcaatacaagtcttgtgacttttaaaatccctgtaatccactgctcatcttgcatctggcttttggaaagccttcataccctgaacgacggcattaaatattcacaggtcaattttaccagaaagaccctacaggtttctttcaaccataacgatctaaaactaagcgaactcgctaaatttttaaccaacctcggatacaaaccggtcattagcctggaaacggcagagaaaaacgtggatcatcttgataagtcccttcttgttaaacttgccattgccggttttgcgtttgggaatggaatgttccttgcttttcctgaatatattggaggtgaagattattggatgcagcactacaaaggactttttagaacattaatgtttctgcttgccattcctgtagttttctattcagcttcagattattacaaatcggcctggtatggtttaaagaacaagatcgttaatattgacgttcctattgttttgggtattttcgttctgttcggaagaagtatttatgaggtagcaacagactacggacctggctatttcgatacactttgtgggctattattcttcatgctgttaggaaaaaccttccagaaaagaacttatagtgctctttcatatgaccgtgattacaaatctttttatccaattgcagttaccaaagtcgattttgatggaaagcaggacaatatcttactttcagaagttaaagtaggagaccggattctggttagaaaccaggaaatcatccccgtagatgctattcttattaacggggaaggaaatatcgataacagtttcatcactggtgaaagtgaaagcataagtaaacaaccgggagataaaatttttgccggtggaaaacagataggttcttctcttgaacttgaagtgatcaaaaatgtggaccaaagttatcttactcaactttggaataaggaagcatttaagaaatacgaaacaggacttgacactctcaccaataacatcagcaagtatttcacatttatcatcttaggcatagctttgatttcaggaatttactggtcattcattgatctggaaaaaatgttccaggtggtatctgccatattgatcattgcctgtccttgcgcgctggcgctttccgctccttttactttcgggcacattatgaggattttaggacgaaataaattctatgtgaaggataccctgaccattgagaaaattgcaaaaatcgacacacttgtatttgataaaaccggaaccattacccaccgcaaaaaaacaaatatcaagtatgaag

SEQ ID NO: 114589 - DNA, 246 bp, Glycine max
  Peptide Sequence Number=SeqID_231367
atggagattggtggactcgggaaggttgtgcttattgagctgatatcatccatgccagtagttttagcagccagggaaaaagatgaagttaacttggcaaatattgtgataaaaaagattcaaacaggaaagcttagtgagcttgtagactcatcctttgggtttgagtcagaccaaccagcttcatccagcaaagtacatccaccccaagcagctgcacatgactcgggtgaacttggaatttga

SEQ ID NO: 114590 - DNA, 675 bp, Glycine max
  Peptide Sequence Number=SeqID_231368
atgatctcgatctctgggaacattcctttagagataggtaacttgaggaagttgcaagttcttagaataggagacaacatgctgacaggtgaaattccacctagtgttgccaatatgagtgaattcaaagtgttggctctaggctactgccatttaaatggaagcataccctttggaattggtaaattgaagcatctaatatctcttaatgtacaaatgaacaacattaatggtcacatacctgaagagattgaaggttgtgaagagctccaaaacttttcagcatcaaacaacatgcttgaaggagacttgccttcctttatgggatctcttaaatctttgaaatttttgaatttggccaataacaatttatctggatcaatccctacagctttgagtcatctttctaacttgacatacctaaatttggtagcattccaagtaacttctgcctcaaaggttcaaagcttcagtaacttttcttggctagaaacatgctctctagcaagtttccctcggagctactcaactgctcctcaatccaacagttggacctttctgataacagctttgaaggaaaacttttttccatcttggacaaactgcagaacctcacagatcttgtgctcaacaacaacagctttgttggacaactgcgtaacattggaactgtga

SEQ ID NO: 114591 - DNA, 645 bp, Glycine max
  Peptide Sequence Number=SeqID_231369
atggcatctccaatcttaactgcattcattgcaggacaagctgctacctttaagatgtttgaaacgattaagaggcagccagatattgatgcttatgacactgatataaagcttaagaaggtctgctttagttatacttctagacctgatgagcaaatattcaatggattttcaatttcaataccaagtgacactactgcagctttggtagggcaaagtggaagtgagaaatcaacaattattagtttaattgagagattttatgatccacaagctggtgaagttctcattgacgatgggccaatagatgaagaaatcagagttgcagctgaacttgctaatgctgctaagttcatagataaatttcttcgtggacttgacacgatggttggcaagcatattagaacaagcactaatttaagaggggcaatgggatacattgcacctaaatggctagggaatgcaccaataactgccaaagttgacaaatacagttttggggctaaggaatgcaccctgcttctggtgtatgtttgtgataacactacgctacccttaggggagttgctatcaaagcaattacataaaaatattcaaacaatgcagcaacaccagcaatcaatgcattgcaattcacacacctaa

SEQ ID NO: 114592 - DNA, 276 bp, Glycine max
  Peptide Sequence Number=SeqID_231370
atgcgatatatggagcataatgaggttttaaaaagtcgaagtcaagatgcgtctcgccgacgccaacgcccaccgctatgtcaccactctactctcgccctttcacgtcatcatccaccgccagtagaacctcttcttcaatggcaccgcctcagagctctccgtgcgccgcattgtcctctgcctccgcttctacggctacgacgagtgctgcgtcgctttgctgaaggcgcgagcggtgctagtggacgacgtgagccgcgtggaggaaattga

SEQ ID NO: 114593 - DNA, 510 bp, Glycine max
  Peptide Sequence Number=SeqID_231371
atggcatttggtggacttgtagctcgcccagtcgagctagagctcgcccaggcggacgagactgagacagattaccactgcgtccacgacgagcttgcggcagacttcgaaggtcacgatggaggttgtggtagattgcaaaggtcatggcagggtctgattgcaacggaatggagaagaagaagagttgagaggagacgccacttcaaggagaagatgagtctagaagaagctcaccaccataggaagcaatggataagagcttggagggagaggaagagaagagcacgaaatttagttggagatgatggggagctaattaaggttgacaaagaggcattgcttccaagagaaacctcctcaagcttttggaatggtttcattaatggtttggttatagggattgagtttgagtttgcttgggggcttaagagattcttaaggccgaaggcacagctagaagccattgcaaggagtttcaaggagaaaagttcaacttggataagtgag

SEQ ID NO: 114594 - DNA, 378 bp, Glycine max
  Peptide Sequence Number=SeqID_231372
atgggtgaagaactttcgggattgggcattaaagagttaggtaatctggaaaatcgactggagatgaatttaaaggatgttcacatgaaaaaggatcaaattctgattgatgagctcaaagaactacaccaaaagggaagcctctttcatcaagaaaatgtagaacttaatagaaagataaacttcatccgcaaggaaaatgaaaaacttcaaaagaagacaagccagccatggactatggaaactggaaatgcaaacttgttattggtacttactgcgcaatgcctagaggcaactggaagcaatagagagaataggctagttgtgacggtgggattgccgcaacctacccttcgaaggtacggtgaggcgagatag

SEQ ID NO: 114595 - DNA, 816 bp, Glycine max
  Peptide Sequence Number=SeqID_231373
atggacaaaagtgttactgaaagtgaagcagaacttgtgatttgtcacaaagagactagttacaacattattaaggatacctgggtggatgaaggataccctactaaggataagatttttataaggacaaaagtagatgaaaagatctacaaaatctattcttggaattgtgaaaataaagaaacagtgaaagacaatattgggatcaatgtgttaaatccacttgcaaaagaggaacctgatcagtccaaggatttgatgcagcaagatgaagatgcaactagaaaacttgctgataatgtgtataatgagattgttgtgcctgaagataagattttgttacaaaagttagacattaagagatccaggacatcaggttttgagggtgatgaaatcaaacagaaccatgccaaggttgctagtgagcccgagtttcactctcagtctgagaagtccaaaaatgagattgaggatgcagtgttatctagtcctgcttcagaatcaaacattgatatccatgacactagtagttttctgcaggagaatggaagcatcacacatcggtttgatcattcggcttctggaactagtggcaaagaggaaagtagtcaagttagtgactgtaattgtggtcaaactcaaaatgcagatgtgaagtctgatgactatggtgtaacaaatcaagttcatcaaagattatgcgagttgagtttctcctctataggttactcagggcctctacctttttctggtagcatctctcttagatcagatcgcagcatagatagcacttggtcctttgcctttcccatgtaa

SEQ ID NO: 114596 - DNA, 222 bp, Glycine max
  Peptide Sequence Number=SeqID_231374
atgcttacgaacccagacacttcctaccaagaacaagctcaagaggtttctcttgtgtgtataaagaacaagctcaagaggttggcattaacagatccacttaaactgttacaagaacacaataagggattagaccaaacatacctacgtgaggtggcaaaggagaagaagcacaaacttctgacgatcctcgagtgcgacgaacacgatgctcaatcttag

SEQ ID NO: 114597 - DNA, 210 bp, Glycine max
  Peptide Sequence Number=SeqID_231375
atggagaagaagacagagagaaggagaagacagtgcgaaggagacaaaacatacctaggtatggtggcgaagaagaagaagcagagacttgtgacgatgctcgagtgtgacgaacacgatgctcgagtgcgacgaatacgatgctcagatgcagacagggaccttgaaggtagacgaagattagaagaagaagagagcgcgaaagcttag

SEQ ID NO: 114598 - DNA, 357 bp, Glycine max
  Peptide Sequence Number=SeqID_231376
atgaaaaggggctgggggatgagttttcttcacccaaaactcccccccccccctcgccctcactcaagaaccccattgctcacggaaacagcaggaatagcaacccccaagcttccattgttggttttttgcttcccattttgcactttaattcactccctgcagtgccttagttgttcaatttttgccaatttcatgagacaatgtatgcttgaatttacgcttgtttgtctgaattggagggttgtgtgggatggcctcaggcctaatgtgggttctgaaatggttgggaacatcacattgcccccatcccccctttccctcatacctatggtgtgcccaccaagtgctcagtga

SEQ ID NO: 114599 - DNA, 285 bp, Glycine max
  Peptide Sequence Number=SeqID_231377
atgaaccacaaaggaatcctctcctttttgttcagtgattacaaccaagaagttatgcccacttcttgcaatgaacccaaaagcgctttgagtccagtgataacaaccaagaagttgtacccacttcttgcaatgaacccaaaagcggttagtcttttggatctagtgatcaaccaagaagcaaatccgcttcttgcaatgaacccaaaagcgaaagggctatctactgatggttctgatcggtggatggttctgaccaatgagaagttgaatgaagtgtcatag

SEQ ID NO: 114600 - DNA, 198 bp, Glycine max
  Peptide Sequence Number=SeqID_231378
atgctcataagcgtgtgggtagacttggacaacacattgtcctatgaagaaacacaagaagaagcaaacttttgcttaatggctgacaccacttcagaagaatctgtgttagactcaaacgaggagtttctgaatgataagcttgagaagaatgataatctcaagggacaacctcaagatgtggtaaaacttcattaa

SEQ ID NO: 114601 - DNA, 270 bp, Glycine max
  Peptide Sequence Number=SeqID_231379
atgggtgatgaggttggacagggatgggatgggaccatcgaaacggttgcatttaaggctgaggctgtggagctgggtgagggaggtgaggtggagaatggagttggtgaggttgaggtcttcaaggatgaggcaggaaacatggtggtggttgtggttgtagaagtgggagacattgtgtcggggttattggcggtgcagcggacaacatgtttcatctcccttaaggtgttggtgttggctaatggtactgtgttgtttgtgatttaa

SEQ ID NO: 114602 - DNA, 966 bp, Glycine max
  Peptide Sequence Number=SeqID_231380
atgcacgggagtcgcaaccaatgtttattcgaggaaaaagctagaaaaaccaaaaagagatatgcgaattttgaaaataagagttcgggagttgtttacgcatggggaagctcgcccagccaagctagagctcgccaaggcgagctgagacttagccatgaagcaactggctcgcccaggcgagctggttacttaacatggaagtcttatggtggctcaggcaagccaaaggctagcttgggcgagctaggatccaaaaaattccctaaaatgatccttttgcccctcccttttggtatctttcacacttctgatcaaaacccaactagcaaggatcaaagatcaatgaatgatagtcatcggattaaattagggtatgacagggacgaaactgagacagattaccactacgtccacgaggagcttgcggctgacttcgaaggtcacgatggaggttgtggcagattgcaaaggtcatggcagggtctgattgcagcagaatggagaagaagaagagttgagaggagacgccacttcaaggagaatatgagtctagaagaagctcaccaccataggaagcaatggataagagcttggagggagaggaagagaagagcacgaaatttagttggagatgatggggagctaattaaggttgacaaagaggcattgcttccaagagaaacctcctcaagcttttggaatagtttcattattggtttggtgatagggattgagtttgagtttgcttgggggcttaagagattcttaaggccgaaggcacagctagaagccattggaaggagtttcaaggagaaaagttcaactaggagaagtgagctaaaataccttggtaaacatctctgcaattgcatactgtatgctctcaataacccaactcttttcttggtcctctggatagctcacactcttcctatgagggatgaaaccagaaaaacttattag

SEQ ID NO: 114603 - DNA, 318 bp, Glycine max
  Peptide Sequence Number=SeqID_231381
atggaggtcgaagtcaagatgcatctcgccaacgccaacgcccactgctatgtcaccactctactctcgccctttcatgtcatcatccaccgccaacagaacctcttcttcaatggcaccgcctcagagctcttcatgcgccgcattgtcctctgcctccgcttctacgactacgacaagcgctgcgtcgctttgctgaaggcgcgagcggaactagtggatagcgtgagccgcgtggaagaggacccatgctgtcctccgccagagagagagagagaaagtgagaaaagcgagagaaagagagaaatgcaaggataa

SEQ ID NO: 114604 - DNA, 633 bp, Glycine max
  Peptide Sequence Number=SeqID_231382
atggcttctagcagtgcctctagccttaaggatctcttaagccctcaagcagactcaaactcaatggctatcaccaaaccaataatgaaaccattccaaaagcttgaggaggtttctcttggaagcaatacctctttgtcaaccttaattagccccccatcatctccatctttgcaattctcattgtctattgcttccaatatagatatgcctttgaaccatgagggaaattgccttggggaaaaaaaggaaaagcttgaaataagaaaggacaatgaagagagaaaacttgggaaggagcttgagattataaggatggactatgagagctaccttgagataaaggttgggaagaaggaaatgaaagacaacaaaaacaatgaatttactcctggaaaatgttttcctccaccaatttcttgcctcaaaaaggttaaggttggcaagcccttcaagtatgtagcatatgataaggaaagtgaaacctatgttgttgaagagataaaaattcctgaagggagtcttttccatgctactagggaggaagagaggttgaagttgtttgccgattttctagacaagagtcacaagagaagtagaaaagatatacaaatgatgcagattggagggtag

SEQ ID NO: 114605 - DNA, 379 bp, Glycine max
  Peptide Sequence Number=SeqID_231383
tgtagtttacaaaagcaaaggtgaaacgaaagatattgagctggtagaggaggaacaggcacggattggtgctgattcttctaattgctctatgcattctgaagctgaaccactagaacatatgaagaaaagagatacaggccatcaaagtgtgtcattggagaataagacaggagattcaactgtgttgaagataggaaatttggctaaagttgtgataaaacaagacatgaagggaagaaggcataaatatgggtttaacaacaataaacgtgagaagacagagaagaaaagggtggtggatgatgaaactggcgacaaacatcagctggatgaagtcctaaggatgccatgtacatgtgtatttctgaagatatag

SEQ ID NO: 114606 - DNA, 381 bp, Glycine max
  Peptide Sequence Number=SeqID_231384
atgctctcatctttgacaaacaaaaaacttaattccattttctcttcccacttgagatcttggaatgttgaaaccctgggcaacatcagagcctgggccgtcggttctgagcaggccaaggtcgaggaggctgaggcccaggctatgaccgcaaccatggtggttaagccccaaaggtttcccagcctcaaggaggccgtgaattccaagcccaacaagaagaaaggaacaaccatcacgctttctgagttcaatcatggcggttttgaccagggccatatgcgccccgagatgcacacccttcccaccggtcccaaggagctttccacagaggaaatgcagttcaaccgccttggtggcgatttctcctcctatgactga

SEQ ID NO: 114607 - DNA, 423 bp, Glycine max
  Peptide Sequence Number=SeqID_231385
atgactgatctggtggtcgcgactgcgaccgcgacaccgacaacaacgaaggttcatgggtcagaggaggtggaagatcctacggtggattcaacaaggagcccagggatccgaatcctaaggtggtgggtgatggggtctctacatattcagtttttgggctctgttgtcaagctatttgatggacacaatggattttctgctgctatttattctaaggagaatcttctaaacaatgttttaagtgcgattcctccatatcttaacagagatgagtggatagcaacattgcccagggctttggttgatggccttgtaaaaactgataaagattttcaagagaaaggtttggataattcattccttttggtgtttgctctgtcaattttttgtttacgagggaattcatgtacatcaacttaa

SEQ ID NO: 114608 - DNA, 1365 bp, Glycine max
  Peptide Sequence Number=SeqID_231386
atgaataatgcttttctgaatgggtttctcaatgaaatagtttacatgtctcaacctccaggtttcaaagcttctgatccttccttggtttgcaagttaaagagagctttgtatggtctcaagcaggctcctaggcagtggggagccttactatacttaacaatcaccaggccagaaatcagctttgctgtggcaaaccctttggagactcactgggcagcagtgaaacacattctgagatatctcaggggcacagtcttgtatgatcttcatctgagacctgctactttggggcaaccctactgcagaagagctctctatgatgctgactgggtgtcagacattgatgatagaagatcaacatcagtactgatgcagatatcgaagcctaacccaactacagctgaaatttcatggattaagaccttgctgactgaattaaaagttccattcagaactccggtaatcttctgtgataatcagagtgatgtggctcccactcataatctggttcttcatgctcgaactgaacacatggagattgacatcttttttgttagagaaaatgtcttcaccaagcagctagttgttcatcccattcctgcactagatcagtgggctaatgcactgactaaacctctttctcccacaaggtttatctttcttaggggaaaactcaatgtagttgacactttgatagtctcaaccttcctgagtttgaggagggttcatcacggaggtgctggaacaacagctgccgggctcaaagctgcttgcccaacaaccatagttccttttttcggcgatcaaccattttggggtgagagagtacatgttagaggagttggtcctccacctatcccagttgatgagttttcgcttcccaagttagttgatgcattaaaacttatgctggatcccaaggtaaaggaacgtgcaattgaacttgctaaggccatggaaaatgaggatggagtgacaggagctgaagatgttttggttgttcctgattcaaatgcagtgggtttgggttggaaccgggtcagggcgacccggcctaacccgcatttaggcatcagggttgaaacaaccctagatgacctaaattctaaaacgacacaagacttggggaacccccgctggtgcgccttcccctggcgccattggccgatgatgcgagaccgccataggggtggtggtgacgcaaccaaaacaagaagaaaggagaatcgtaggaaactcgctaacggccctgcccgccgacgagatagcatggaacgaagcaacatcacgaaagggaaaaaaacgaagacagaaggaagaaagaataggagaagagaagaaggggagaggaaaggagaatag

SEQ ID NO: 114609 - DNA, 681 bp, Glycine max
  Peptide Sequence Number=SeqID_231387
atgcttggccaaaatcttctctctcacaaaacaacacatcaatccccacaggtagcgaaaactaaggagcaggaagcacaaatgatatgggaaatagcaactaatttgggagtaacaggaatagaaaaacagggaaggatagtggagaaactcatgcaaatggaggatagagaccaaaaagaggaaaccaagaaagaaagtattgggagatcaatgtgtcaggcaatgtggggggacacaacagtctcttgggaggtgcagccagcaattaattctgcagggggcatgctgtgtatgtggactgaaaacacattcacattacaaaggaaagtagcggggaatggtttcatttgcttgacaggcctatggattaaggaggcactgcagagtaagagagtactatgggaaacaatcaaacaactgaaaacagccaatcagggaggacaatggtgcatcatgggggattttaacaacatcagagatccggtggaaaggatgggagtcaaaggttgtagactggggaccaaagccattccgggtcctggattgctggcttctagacaaatctttcaagtcaatagtgaaggaatgttggctgtcccaacagcagagtgggtggggtggattcgtgttgaaagaaaaaataaagaagttgaaggaaaggctgaagacatggaatag

SEQ ID NO: 114610 - DNA, 234 bp, Glycine max
  Peptide Sequence Number=SeqID_231388
atggcaatgaacatgacggaagggaataagtcgaggtcggagaggaggatgtggtggctggggaaggacgtctggggcttgctatcaacagggagctggacgacaccaatggtaagtggagccggtaaagcgtgggagactgagttggctggagcggcggatgtggcaccagaaatggcggaggtagcggtggagtcaatggcggagtctacagcaaaggcagtaatggtgtga

SEQ ID NO: 114611 - DNA, 555 bp, Glycine max
  Peptide Sequence Number=SeqID_231389
atgtccacggatgaagtgctagagcaggaaatgaagaaagccaaaaaggaagagttgagtagaaaaaggttccaaggggctttgctagacagtagtaatgagctcaagcttagaaaggctgagagagacaaatcaatgatggagaacgtaatgttaaaggatgagttaaggaattatcgggagtcaaaggaaagcttgaaagagcaattgaccaagacagaaaaggatatgttgataacaatctatcagtataaagagaaggagaacctagctgctattaatgggcaggtgctgagagatgaacaagcgaaggtgtcagccttgcgggttgaaaaagaggcaagggaagaggtgatagagttattgcatgaagaaagcatgaagtggatggacaagtttgctctcactctaaatgaaagtcaagagtttctaaagctactagctaaagcgcaggtgatggctgatgtatactccactcccgatgaagttcatagtcttttctacaaataccaacacatgattgagctaatgacttgcataattaagaatcgctga

SEQ ID NO: 114612 - DNA, 348 bp, Glycine max
  Peptide Sequence Number=SeqID_231390
atggagatgcagcggaagacaaaggagaggaggtacaccccaccaccgttcatggaagagctcacagaggaacattgtcgtgagaaggttttgccaaatatgggaaaaacttctccttcgaccacaataccatcaatggtagtgaacgacgataacaccaacgtagccaaccaaggaaaaccaccacagggacaagcatccaacatgtttggaatgcgtaccataagagcccctaaaaacgggagtccaacaactgtggtgaacatcctgtttcaggggcgtgacaatcatgctttgattgtcgcccaacaacaggagatgaacacgctgaagcagaagaacgcctag

SEQ ID NO: 114613 - DNA, 195 bp, Glycine max
  Peptide Sequence Number=SeqID_231391
atggaagcaaacctcccacatggatgcaacaagctgatcatagatctttacgataaactctcagacctagatgagcatgtggacacactcgtcacacagatgaacctattcatgaatgatgatgcggtcatcctatgcaaaaagtcatctacaaccttggacgagctaagagctagggcaaccagattcatctag

SEQ ID NO: 114614 - DNA, 427 bp, Glycine max
  Peptide Sequence Number=SeqID_231392
ggatacttctaatgaaagaagggtgcaatgggttagttgggagagtctatgtttgccaaaggagttaagaggattgggtttgagacaagctcgccatgtcaatgacgcttttattctaaaagtcgcttgggagctatgtacgacggatgatgctttatgggtccaagtcattagatccaaacatggttgtagtggacgtggttttcctgttgggaatttgtcttatgggtgtggcattttgttctggttgcagaattggattccagagttaggtcccttggttgagtttgcaacaagggagcttaatgggaaggatttgaccaagacaattactgagttggtggtgcacgaaggaggttcgaattctgattacttaggaagtagtttgatgagaacattgaaacttaaggatccacacaagaactag

SEQ ID NO: 114615 - DNA, 330 bp, Glycine max
  Peptide Sequence Number=SeqID_231393
atggatgtagagaacatagcctggagtgctagtgatatatttggagttacacaacgcgtacaaacttggtctgctaatggtcccaaagcttgtggagggataatcagagatcacaaagacatgtttcatggtgctttttcgtggagaataaaaacttgccctgttctgaatgttgaactatgggctatctttcatgggattaatatggctaaggagcgtggattcaaggacccgtcggatcatcaaaaggttattgttgatgcaattaaggccagcattttgcctcatacaagagatcattttgctcatgtttatagatactgtaataag

SEQ ID NO: 114616 - DNA, 180 bp, Glycine max
  Peptide Sequence Number=SeqID_231394
atggagtgtgagtccactattagggtttcaaaagaaagttcgaaagaggaggatgatcttctccgtaggagcaatatgaaggtcaaaaggaaagctgatgagggtgagaatcctttggagatggaggaagccttggaaatgttctctcgtggtcagagtgttggggaagagaatagatga

SEQ ID NO: 114617 - DNA, 771 bp, Glycine max
  Peptide Sequence Number=SeqID_231395
atgggtaaaggcggcgtcaagggaaaggttaatggaggcaatgcgagaaattctacgaatgaccatgtaatgcatgatgaggctgatatgaaatgggttgttccagaattgagcaacaaaaatgacacaaaggggaataagaatcagaatggggcctcaacgttaggcccaaaacagggggtggatgaggcgaagaaggattcaagtttgaacaacttagacatgattcatgcactccataataccaagtcagggttcatgtttagtgcaaaatttataaacaacaattcggggaagtcaatgttcattctagatgaagaaacaatgagattgatccaggtgaaaacaaaaattctcttaaaaaggggttcttcgtctttgccacctgatggaaaaggaagtgaagttgttgtcatcaaggagatgagtgtttcttatgctatggaaactaatgttgtgagtgtggctaacgctatgaaaattgaagttgtagttcagaataagaccagggctactagaccagataagtctaggggtctgtggtgtttgcggaatcctaatttgtggcgggtcaaggtgttagaagaagctgctcaaattctgcatttggaagaatcaaagaggattggtggaactgaatctcttaatcacaaaggtaggagggcatttagagaggttatggattattgtcatatgctggatgcagcttggctgacacaaccagagctaagaatggtggtggatggaaactggaaaaaagatgaagagtag

SEQ ID NO: 114618 - DNA, 372 bp, Glycine max
  Peptide Sequence Number=SeqID_231396
atgtatgattcctaccccagctcggagggtaaaagggtcttttccttgtttttcctaggccccagctcgcacaggccagcatttggctcgcctgggccaccaaataacttcaaggctaagggactagctcgcctaggcgagctcattgcttcaaggttaagtttcagaggtggccttttgcctataaataggcatcctaggggttttttaaggggttccaagggtcagaggtggagagaattgagagaagagagaaagaaaaacaagaaagaagaggaaacgaaactgaggcgctaccaaatcgcctccgcgatcattccctgcgtcgttttcttgttccgtgctcttcgtgccacagtcgattggttttga

SEQ ID NO: 114619 - DNA, 141 bp, Glycine max
  Peptide Sequence Number=SeqID_231397
atggataagaacataatatcagacttggataattttcctgaagaagataagcaaagaatgtccaccatggcagaccagctccaaatccgggacagttgtattgaaatgttcatgttcattggagctttcttagtcagatga

SEQ ID NO: 114620 - DNA, 243 bp, Glycine max
  Peptide Sequence Number=SeqID_231398
atgccggagccaggagcaccatcgacatctgcgaggcctgctgtggaggagcctagacatgcagtggaagtttgccataggattgctaagaggttggagcgccatctgagcctaggggtggtcacgccaggcttatcgacacatgaggtgattgaagaatgcctcaggatggccaggagtgtcacacaggaccagctattatatgttaggtctcgacgcaggcagcgcacggatcaggcgtag

SEQ ID NO: 114621 - DNA, 411 bp, Glycine max
  Peptide Sequence Number=SeqID_231399
atggcgccctcgttcgatcaaagtgcaagcacagtttgcgtgatggatgcttcggggaacgagcaactcaatgggatttctgctgaccccaataggctcaagattttccatttagacccatttgattaccatagcataaccgatgctctaagaggctgctctggcttgttttatgtatttgaaccacctcaggaccaaccctactatgatgaatacatagcagacgtagaggtcagagcagcacacaatgtgattgaagcttgcgctcaaacagaaacaatagataaagtggttttcacttcatctgcaacagctgtcgtttggagggaggatcgcaaagccatggaatcgaacatggatgagaaacattggagtgatatcaatttctgtcggaagttcaagagcaaataa

SEQ ID NO: 114622 - DNA, 324 bp, Glycine max
  Peptide Sequence Number=SeqID_231400
atggaggccttggaggttggtggtgtggtggtggtggttgtcgccagcgaggaggcggaaaagaagcagtcgtcgttgccgccggagaagaagtcattatcgtggtcgtcagtgaagaagttgcggttggtgaagaagtgggatgcacatgtttaccacaatcatgtgaggcctttgcaggagaagctccataaccagccaaaaccttttccaactttggagataaatccaaaaatgaaagatatagattcttttgtggctgttgatttcaagctcataggctatgatcctcaccagaagattgacatgaagctggctgtctaa

SEQ ID NO: 114623 - DNA, 201 bp, Glycine max
  Peptide Sequence Number=SeqID_231401
atggataaccatcagaatggaaatcatactgatccagcacaagccaggatgaacagaaaacgtatcaggcagtacaaagttgatgatctggctcagaatattcattctaatgtttctgattcattagaggatgagggttctaaatcaacacaaggttttgcttcagtttctttacctgaaaatcaaaattgtatgtcctaa

SEQ ID NO: 114624 - DNA, 1393 bp, Glycine max
  Peptide Sequence Number=SeqID_231402
atgaaagtgaagaaaaaaacagggcagggcagcagtataaataatagaagtttgatgatttatatgcagaaccaacaactacacttgttttctatatattcttgtgtgatcatgaattcctcctccatttatattcttgtctttgtccagctttggttgttgagcttaccatgcagagagagtgtgtgcatcccaagtgagcgtgagacacttttcaagtttaagaataatctcaatgatccttccaataggctttggtcttggaatcataataattccaactgttgccactggtatggagtcctctgccacaacgtcacttcccatcttcttcagcttcacctcaacactacgttttctgctttcgagtatcactatgattaccactatctcttcgatgaggaagcttataggagatggagctttggtggagagataagtccttgtttggctgatttaaagcatttgaattacttggacttgagcggcaattatttacttggagaaggtacgtcaattccttctttccttgggacaatgacttccttgactcacctcaacctctctcatactggattcaatgggaagattcctcctcagattgggaatctctctaagcttcgatatcttgacttgagcggcaattatttacttggaggaggtatgtcaattccttctttcctcgggacaatgacttccttgactcacctcgacctctcttatactcgattcatggggaagattccatctcagatttggaatctctccaatttggtgtatcttgacctggcgtatgccgccaatcaaacaattccatctcagattgggaatctctccaatttggtgtatcttggccttggaggtgattatgttgtcgaacctctgtttgctgaaaatgtagaatggctatcaagtatgtggaagcttgaatatcttcatttgagttatgcaaacctatccaaagcatttcattggctacacactctccaatctcttccttctttgacccacctatatttgtatggatgcacactccctcactataatgaaccatccttgctcaacttctcatctctgcaaactctccatctttccgatactagttattcccctgccatttcttttgtccccaagtggatattcaaattgaagaaacttgtttctcttcaattatcatataatgaaatcaatggtccgattcctggtggtattcgaaacctcacacttcttcaaaatcttgacttgtctggaaattcattctcaacttctatacctgattgcttatacggtcttcatcgtctcaagtctttggacctaagttcctgcgacttgcatgggactatttctgatgccttgggaaatttgacttctcttgttgaacttgatttatcag

SEQ ID NO: 114625 - DNA, 705 bp, Glycine max
  Peptide Sequence Number=SeqID_231403
atggatcctgctgccgctgctggtgctggcgacgctgtttttctatccgctggcgctgatcgtcaaacaggcgtttaccgacgatcaggggctgttcagcgccggcgcgctgcagcaggtgttcgaatcccgacgctttgtcggcgccctgctcaacacgctgcagattgcgctgctggcgacgctgggctgcctggtgctcggcaccctgctgtcgctgctgctggtgttcacgccgttccccggcagccggctgatcgcctgggtgatcgatacctttatcgccatgccgaccttcctgatcaccttggccttcacctttatctacggctccgccggcctgctgaacggtacgctgatggcgaccttcggttttactctgccgccggtagactttctttactccatctggggcgtgatcctggcggaaatcaccgtgtttacgccgctggtaatgcgtccgctgatggcggcgctgtcgcagatcgatcgcagccagctcgaagccgccagcatcctcggcgcccggccggggcgcgtggtgcgccagggcgtcaccacgctgccgatgatggtctactccaaagcgattctggagtcggattatgccgtcgcctgcgcgatcgccgtcgtgatatcgcgctgtcgctcgggctgttctccctttaccgctacgccgcggcgcgcgccgggctgaggaactga

SEQ ID NO: 114626 - DNA, 270 bp, Glycine max
  Peptide Sequence Number=SeqID_231404
atgggtgatgaggttggacagggatgggatgggaccgtcggaacggttgcatttaaggctgaggctgtggagctgggtgagggaggtgaggtggagaatggagttggtgaggttgaggtcttcaaggatgaggcaggaaacatggtggtggttgtggttgtagaagtgggagacattgtgtcggggttgttggcggtgcagcggacaacatgtttcatctcccttaaggtgttggtgttggctaatggtactgtgttgtttgtgatttaa

SEQ ID NO: 114627 - DNA, 810 bp, Glycine max
  Peptide Sequence Number=SeqID_231405
atgcaggaagaagaggagagacctcttataagaaaaagaaagttacctacgacttcaaccaaatctgctgaccaaacagaggcaggcaattcccaggctcaaatgcctaagaagaaaaagaaagtaaagcaggtcgagcctgaaccttctgtggctgctgagggtggtgagccagccaagaagaaaaagaaaaagaccaagtcttcaaaagaacaaggtgacaaccagcctgttgacgtccaaccaccttcgcccgatattgacggcactgaggtagaaactgcccctcctattgctgagatgggcaaccctgtcgatcaaccggactcacctcaagaacaacctgccgtcgaggtgcaacaaaatgtctctgcagaagaaataccctcatgtgcgcgaacatctcccgctcctgaggcggatgcagtgaatgttgaggaatggggtgaaggtcaaggcattggatccagtagtcctcatggttgggcagaggttgatgaccatcatgagccaaaccagtcagataataccattcctcatgaatcaagtcaaaaaagttcatctgaaggaaactttttcgatgaagatgccataaaagaggctgaagctggaggctccgacatttacccggtgtcctcaacatctaaactttccgctagcatagggatcgcagaagatacattcattcaaatgcaaaatgaagaccctgctgcagcccttcgactcctgctgaacacaagtcaagccaacacctcaagtgacaagaatcctggtgcttcggacccatctgatgctgaaataaactcttca

SEQ ID NO: 114628 - DNA, 336 bp, Glycine max
  Peptide Sequence Number=SeqID_231406
atgggtagaaaaatatcgtcccagcaaggtcgcagatcgtcggcaacaaggacgccgtctacaggctccaagtcagcgctcgcgacaacaacattggaaccattaagtacttttttcatttcattcatcgtcttattgcacacgccccccatcctcggcttctgcttctgcttcatggagcactctcactccatcaccgaacacatccaggtcatggatgttccactgctactggataaattggctttagatttgattaataatgagccctcccttgcaaacacgagcaagcacactcaaaagaaggccaaccagaggcagccacttagaggttga

SEQ ID NO: 114629 - DNA, 237 bp, Glycine max
  Peptide Sequence Number=SeqID_231407
atgatcgacggtggagcaaagcctaatgcacgtcctcaatgccatcaaagcaaagctccaaagcacaacgcagggacaaataggggcgtaggggctgaagaagaagacaatggcgcaagaagaagcagagcgacgcaagaagagctaaagaagaacagtcacgtgagagaagagaaatggggaggcgctgggtgtagaagagaaatggggaggcgttgggatatctgtgcggcctag

SEQ ID NO: 114630 - DNA, 549 bp, Glycine max
  Peptide Sequence Number=SeqID_231408
atgaaactaagtttgtttaatcccgtttggagcattatcataaaacggcaacgaagtaaatcgagatgccaagttcaaaagcctaagaaatttcatgaacaaaggcctgaggacagctatgaagaagggctcgaggatgataatttagaggacgagtatttgaaagacttcctagaatcaagacctaagttgaaaggtactgcagaaagacctccaaagcacttggtgatgccaccaaagagtccgggcagagtagagctgaatgaaaaccaccatatcaaaaggccaaagccgattggcacagaaaatataacatttaacagggaagaaaatgaggaaacattgactctgaaattgcaagtgttggctgtagaaatcggaacaattgctagtgaatcagcagcagactataaggggggtgtctcacaaaatttagaggactcccattttgactttacaagatgccaaggggacaagctcatagcaagcctgggaaatttcttcaacacccttaagcatctacgtgatactccccaagagtgtaactga

SEQ ID NO: 114631 - DNA, 234 bp, Glycine max
  Peptide Sequence Number=SeqID_231409
atggattcaaaagccattatccgcaacctccatcgaaaacctcctaatttgacagccaccatcaatccaagcctagctctagatgtgctcaacaatgcaatcatctccgatactgttgaggcatacgtagcatctttcatgcaagggcaaggaccatgcatcacagccttactcgcagactcagtgacccatgcaagaattggtgcaacccgcgagggcaccgtgagacaataa

SEQ ID NO: 114632 - DNA, 274 bp, Glycine max
  Peptide Sequence Number=SeqID_231410
atggacggagatcaatggatgtatgacagtataatgtctgaaaaagttgatatggatgatcaaaatgaacaagaatttggtgtgaatgaaccacatgttgattgttcaaatgcgttcaatacttctcaggtgtttggtacccgagatgatgttttgcaatgggctcaatccattgctcatgaaaatggatttgtggcggtcattataaggtctaacacacacactggtagtaaaggaagaacctcatttgtgttaattggctgtgaaaggagtg

SEQ ID NO: 114633 - DNA, 219 bp, Glycine max
  Peptide Sequence Number=SeqID_231411
atgccttaccaaaagaggaaaactctagatgaggcttcactgttatcaagcgagtcggagacccaacataaccatagattgacctccactccttatgtcttacacagacccgggttaattaggcaagctttgaaaagtgttgtttttcaccttctcgctaagccaattagctggcttagcgagcgtctgctaagcgcaacactcatgggcaaagcgtga

SEQ ID NO: 114634 - DNA, 334 bp, Glycine max
  Peptide Sequence Number=SeqID_231412
atggagaaggtagcctggccaggagcccaaccttctcttatgagggaaggtggaggttgttcaaattcggcaagtgcatcggatcgtgcaagtagtataaaacgcgcgactatggacctctcaacacgcattagtggatttcggcttagcgcgtgcttttctcgctcagcggatggatggaagcgctcatccttcttccagattcttcctcgcgctcagtcgaggagtgttgtgctcagcggatggctcgctaagctagaagattggcttagtgagcagatgaaaatcagcacttcacaaacttgcctaattaacatgaaattgggaggaaatg

SEQ ID NO: 114635 - DNA, 411 bp, Glycine max
  Peptide Sequence Number=SeqID_231413
atggagaatgtatttgttgttgtgtattgcgatggtgacatactttcatcatctgaagggatattgtttgaatgccctagtggtcctaaagtcgttataataagtgaggacatgtcacttgatgctttaaggaaaacaattatggacgccattggtgattgcaaaatttatattgatttttttactgccaacatgtttatgcaagtgatggttgtgttgaatgcgagtgaaagagaaatcaacaaaatccaatttgcattagctagcaagagtagtctccacctggtagatagtctgccagtagctgcccaggctgtggctgtactgggatgggcagtaaacatatatgcaagaccacgtggtggttgtctctcctcaggtggaatgacatggggatgggaaaccttgtaa

SEQ ID NO: 114636 - DNA, 1521 bp, Glycine max
  Peptide Sequence Number=SeqID_231414
atggctgaggagaaatcagagcagcattgttcggagaataagcaaactaatgctaattccagctcttctgtatcagaaggcagtggcagtgctatgcccaagtcatcaacggaacgtaaatcagcattgccatctaatcggagaaccactggccctgttaggcgtgcaaggggtggttggacggaagaggatgatgacacattaacgaatgctgttcaagtttttaatggcaagaattggaagaaaatagctgagtttttaccgggtaaatcagaagttcaatgtctgcacagatggcaaaaagttcttcatccagaactcgttaaaggaccttggactcaggaggaggatgataaaataattgaaatggtgtctacacatggacctaaaaaatggtctttgatatctaagtctttgcctggtcgaataggaaaacagtgccgagaacgatggtgcaatcatcttaatcctgacataaagaaggatccctggactcaggaggaggaattagcccttatggatgctcatcgtatacatggcaacaaatgggctgaaatagctaaggttcttcatggaaggactgataattcaataaagaaccattggaatagttctttgaagaaaaagatgaatttctatttggctacgggaagacttccccccattgtatcatcatccaaaactacagacattaatctgggtaacagtgataagaatcaactagagtcctcagaaacagttagagagttcggtgattcttcaaatgttcctgcaaaagggtctgctgattctgactgcatagaatgcaatagatcatccaacaaaggtttcagctgtagtaacttagaaccagtgtttggagattattttagaataaacagtgagccaaaatttgagaatcctggactcaatgacaacccaagagttgatcattgcatgagtaatggtgaaaataagagttgcagtttaaccagaaatttttattcaaaggaaagtcaaacccttggttctttttgttatgaaccaacacttcctttagattcttattattctaatatctctggcctgcagcaaaatgagttatttgcttcgccaatgatgtcatctgttggttacttaactccacctccggtgaagggaagtgaattatgctcagaatctcctgaatcaatattgaaaaaggcagctaaaactttccccactccttccatcttgagaaagaggagtgtagtcaaaagacctgtcactcctagtgcggttgcaaaaggagttaatgattcacatgcttataatgaacaagagagaacaaatgatattactggttctgaagttgtgcggttacctgtgagtccagtaaacaattgctatgggagtaacattccccataataaggcattcaacacaacttctccataccgatcaagatccaggcaaacagctattaagtgtttggagaaacaacttgattttgcatttgaaaaagagaagcatgctcgtaagatgaaaaaatgtgatgactga

SEQ ID NO: 114637 - DNA, 231 bp, Glycine max
  Peptide Sequence Number=SeqID_231415
atggccttcatcatatggagaacaggggtagcagaaggagtagcagctcatccagatgctgactttgtagagtctttagagataataataataataggtgaagatgcgggagctgcttcgagctcggaagaagatggatccgccactagagatggtggatcagttggcactggttcgacctgtgcaggtgtgggctcaggaggagcagcctcgccgggtctcacctgttga

SEQ ID NO: 114638 - DNA, 1569 bp, Glycine max
  Peptide Sequence Number=SeqID_231416
atggcaagagatgctaattgttcttcaggatctgctcagggtcagaatcagaatgaaatcaaacattttaagaatctgaaacaaaaaatagagcatgttacaggagaaagtagaaaagaaaagcttcgtgttactatggatgctgtcattgacaaacttcctcaaggccatgagatttcaaatgatttgaagaaggaattttttaagaaattgacaaattctaatatgaccagagaaggagaatactgtcctgaaagatgtaatggcaatgatcactctactcctttattcaccaagcatggcaagcacaacataagaagaatattgtctcttcaagaaccactagaaatttattatcaactccatgagaatagctttaatgtagaaccaaatgagctccaatctaagcaactaaaattaagatcagaaaaggcacattcaccattgaggatgttttcattacccttacaaaggatgctttcattacccaatctccaatccttttcctttgcttatcagaatggggagtttcctgacatttcatctgtcactgagccaaagccaatcatggtttctggggatggaactatgaaatcagatattgttgcccctcagacaaagaggcttcaccttaatttacactcaaaaggtcaacttccgttagatacacctgtagaaaatttgattcaaaaacaccttgtcagtgtaggagaaaatggtttagtgattactgatattgtcgaaccaggatcagattgtagctgtgagattaatggcaaggtgatcatgacaactgatgattttggacacagttattcaaaaaatggtggcacttttaatgaccaagatattgagaccataaaagaatacatgactacaataacatcagattcaaaattgaatatgagaccaggagacagactagataacatggctgagcaacaagagtctattatggattctgttaaagtgaaagagaccacagagaatgctaaaaaaatggagattcaaagcaagcagttgaattatggcattcctcttgttgatattaacaataaagacaaagctgagtttaattatgtgaaatatattcttgagatatctggactgattggtaaagatagcatttcagcatggcattctagtgaccacccagttgatccattactatatgaagaaatggaaggtgaccctgatttctgtaattatgggggtagtggtcagtgtaatcaccatgtattgtttgatttaattaatgagacattgttggaactttctgggaggtcttactgctactgttccataccattgtcatcgtctcttccctacactcatccaatttcaaaagggtgccatcctcttcatcaagtgtggactcacatgaggaagtccttgtgcttgagatctgaagttggactaacaattgatgatcatgtgagtcgagatctagcaaggcttgatgggtgggtgaaccctcaattgtttgctcaatgtgttagtttggaacttgaagacttgattcttcatgatcttttggaggaaataacatgtgacttagcttgcatttaa

SEQ ID NO: 114639 - DNA, 321 bp, Glycine max
  Peptide Sequence Number=SeqID_231417
atggttcctaacaaagcctacataaggttgcccatgtgcgatgaaggaaagaagaagggctttaagctatacttcaacaaagaaatgccaagtagagtgaccattttgtcacatggggaatctaagggttgtgcctgtcgcaacctacccttttgcgggcgagcgaggcgaggctcacgggtcgacaaaagcggggctcttgctcctacgtaccctccaccgaagaggaaatcagacctacgtagttctttcaaaaggggcgaatcaagtgattctttttacttggaagggggtcatttaaggcgttggaccttaaaatga

SEQ ID NO: 114640 - DNA, 417 bp, Glycine max
  Peptide Sequence Number=SeqID_231418
atgtctgacctacataaatttgtgctcttccacctgatggacaaaattcctttcgaccttcctcacacaatctatatcaacatcctaagaaacatgaagactctaggaggagtggacgaaatatactatgccgccctcatcaacaaacttctttgggaatatgaggtcttccatgtctttgaaagaatggacgaggattcaaagcaggctattattaacaaaggaaccttcatcgccagacaacaacactttagtgctattaacttgaaggcaatgaagacaaggctctataaacctttggccttgctaaaaaggtacaaaggattcttagggagtagaagggcaaggtccaaaccaggaagcaaacccaacaacaagaggaagaagaagaaattatcaccaaggagcaaccaatga

SEQ ID NO: 114641 - DNA, 477 bp, Glycine max
  Peptide Sequence Number=SeqID_231419
atggatcaaattagttgtcagccattgaggactactacaacacatctgattgatccagaactactaaccgaaaccatgagggagtattttggcattcaattaaggccaatggcgaggcccatgtgcaagaaactgtatctggaatgggtaaaccgtacgatgcctttgccagaaggggtagcttttacctggtattcaaatctaccactaaatttagtacaaaattgggatgacatggaaaggtgttttcatgatagattttacagacctttgcctaaagtaactatagccgatttgatgaacatgaggcaaatagttaaagaatcaacaatagacttcaaagagaggtttaaaaaggctaaaagtcgatgttcagtgcaactaccagaaatagaatgcacagctatggcggttgggaatatgcaccctcaactgaaagagaagctggtagctcaagaatacagtgatcttagctaa

SEQ ID NO: 114642 - DNA, 315 bp, Glycine max
  Peptide Sequence Number=SeqID_231420
atgggtgaccaagaggagatacaggaacagatgaaagccgacatgtcggctttgaaagggcaaatggcttccatgatggatgctatgttaggaatgagacaactcatggagaataacgtggccactgctgtcgctgttagttcggctgccaaagcagacccaactctcccagctaccgcgcaccatcctctcccaaacgtggtggcttacccttatggattaccacctaattacacgccactagtcatgcgtgatgacgcgggtcatgtcccttcccctatccttgaaggggagcctcctcgacagtcggacgag

SEQ ID NO: 114643 - DNA, 1386 bp, Glycine max
  Peptide Sequence Number=SeqID_231421
aggactgcacgtcctcaccatcaaaagtctgcacgccctagtcttcagaggactacacgtcactcgccatcagagggttgcacgccctcaccttcagaggactacacgtcatcgccatcagagggctccaaagtcctcgcctgtagaggactacacgtccaagccatcagagggctgcacgccatcaccttcagaggactacacgtccacgccatcagaggcctgcacgccttcgccataagaggactacacgtcctcgccatcagagggctgcacgccctcaccttcagaggactacacgtcctcgccatcagaggactacacgtccttgccaaaagagaattacacgtcctagccatcaaagggctgcacgccctcaccttcagaggactacacgtcctcgccatcagagggttgcacgccctcaccttcagaggactacacgtcctctccatcaaagggttgcacgccctcaccttcagacgactacatgtcttcaccatcaaaggcttgcaacacctcgcctttagagacctacacgtcctcgccatcagagggttgcacgccctcagctttagaggactacacctgcacaccctcgccattagagaactacacatcctcgccatcacagggctgcaccccctcaccttaagacgaatacacgtcctcgccatcagagaactagacgtcctcgccagcagaaggctgcacgccctcaccttcagaggactgcacgtcctcacaatcaaagggctgcacgccctcagctacagagcactacacgtcctcgccatcggagggctgcaaacactcaccttcagaggactacacgtcctcgccagcagagggctgcacaccctcatctttagaggactacaagtccttgccatgagagggctgcacgccctcacttccagaggactacatgtcctcaccatcagagggctgcacgccttcaccttcagaggactacacgtcatcgccattagagggttgcacacccttgcctttagagggctacacgtccttgccatcagagggctgcaccccctcaccttaagaggactacacgtcctcaccatcagagggctgcacaccctcaccttgacaggactacgcgtcctcgccatcagagagctggacgccctcaccttcagaggactgcacgtcctcatcatcaaaaggctgcacgccctcattttcagaggactacacgtcctcgccatcacagggctgcaggccctcaccttcagaggactacacgtcctcgccatcagagggctgcacaccctcgcctttagaggacttcacgtcctcgccttcaaaggacaacacgtcctcaccatcagagggctgcacgccctcaacttcagaggactacac

SEQ ID NO: 114644 - DNA, 315 bp, Glycine max
  misc_feature (27)..(27): n is a, c, g, or t
  Peptide Sequence Number=SeqID_231422
atggctaccttggggctggagatttgngttgaatctgcctcaagtgttattttgaagatgatattatcatttgaccttgcttttgctttgattccgctcctaaagttcagtagcagcaaagtgactagcagcacaagcattgaagagccttatttaccaacaacgacgggtgctcgagccaccgtcgttgaaacctcaaagaacaatgacggtgtcctcaccaccgacgttgacatactacaggaaacaaaacaaatacgggtgttatgcatacccgacgttgatatggacaacaacaacgacgagtcttgctaa

SEQ ID NO: 114645 - DNA, 281 bp, Glycine max
  Peptide Sequence Number=SeqID_231423
cattctttcagtctcttcttcttctcatacattcaaaggtggagaagttgaagctggtggtggggagggagctagcaattgcaatggcaactcgaaggctgcagcattcaaaggtggatcagttgaagacactgttgcagcattctttcagtctcttcttcttctcatccaggagaatggcgaaagagcttttcctgcaacttcgcttgctgcttcttctcaatccctcggatccatgttcaacaacttgcttctcgcaaccaccgactcactcaactcag

SEQ ID NO: 114646 - DNA, 1074 bp, Glycine max
  Peptide Sequence Number=SeqID_231424
atggaaagcaaaggggttagtccagatgtttattccatgaatagtgtccttcatgcttgtgcttgtagcaactcattggataaaggcagagatgtacacaattacattagaaaggacaacatgaccttgcgctttcctgtgtctaatggtctcatggatatgtatgcaaaatgtggaagcatggaaaaagcttatttagtcttctctcaaattccagttaaggacattgtctcatggaataccatgattggagcttgtggaagcctagctgctctagagataggcagagggatacatgggcgcatattgagaaatgggtactcatcagagttgcatgtagccaatgcacttatcgatatgtatgtaaagtgcgggtcactagttcatgcacgattgctctttgatatgattcctgagaaggatttgatcacttggactgttatgattgctgggtatggaatgcatgggtttggaaatgaagcaatcgccactttccaaatgatgagaattgcaggtattaagcctgatgcaattaccttcccttccatctttatgcttgcagtcattctggattactcaataagggatctccttgcccgcactggaaatcttttgaaggcccacagcttcattgagacaatgccaattaaaccagatgctacaatttggggtgccttattttgtgggtgcaggatccatcatgatgtggagctagcagaaaaagtggcagagcatgtttttgagctagagccagacaacacaggatattataagttagctatggcttttggtatattaaattttccgtctgggaggactattagtgtcaccaagaatctacgagtatgtgatgattgtcacgagatggcaaagttcatgtccaagacaaccagaagggaaattatcgtgagaggttcaaatcggtttcaccatttcaaggatggtttctgttcttgcagagatttctggggatctctgattggagttgagaagcagtatgcttatatggaaaatagattatcggaatattgcaattggggaagacagagaggggaagctctcagtttgccttga

SEQ ID NO: 114647 - DNA, 2507 bp, Glycine max
  Peptide Sequence Number=SeqID_231425
atggaaccggagaatgagttggaggctaaggaaaggtttttgagtgaaattaggtcaccgatggaaggaggcatttctccggcgagggaggggaatgctgcctttgaggcggttgttggagaaatcgatgtgagtgaggttggagtggaggtggccggggagggatccggtgaggttggcgttggagatggtgagggttttgagcttggtcatgcgggcgaggatgacgaaggggccggaggccttgacgttgacgtcggagacggcgaggtcggtgaggttcaggaggttggagagccagacgccggagagtttgcggaggctgttgacgcaggtgaaggaggtgagggagagggcgaggtcgacggggaggcggatgggggcgacggggcagttgaggagggagagggattggagggtggagagggacttgagggcggtgaaggagagggagaggtaggaggagcagttggccaggcggagggagatgaggtggcggaagggcttggcggcgtcgcagagggtggcattgtggaaggaggttgttgggattgggaagtagaagtacacattcccaataaggttaacaaaaaaatccaacaactcagaaagaagagagaagtgagctctgatactcttggatttgctgttcactttcagacttccaaattgcaaaggatgatgaagaagaatcagagcaagcaagttaactcgttgaccacgacacggtacccttttcttgaatcgccaaaagaatatgactttgatggatttggggaggatttttcgtcgcctagttactcacccttgtgccatgggaagcaaggagaaggggattctcatgagagtttgtttcacaagggtaagcatgctgttgatggagtgagtccctgcccagagtctgctggtactagtacaattgtggctgaagaccttccatcgaattctaaaggcttaatgcattcagctaacgaatctatctctgttcctctttctaatttcaaggtttccccactcaaattaccaataaccgaattgccctccgctaaaaacacttctcaaaatcagtcttccaagaatttgggtgaaagtgactctgatgtggattctccttgttggaagggaaccatggctttttgtctaactccaatagaaaattcaggatcaatacaaattagtaatgttgagaaagcaacagaaaaacataatagtttaaaccctttggctcctcagttctttccgggtattggatatgttaaggatgattttgggtcttccatctcttgtacgcctgtagctactaatttgttgtcaggagaggacatgctcattaaaactgttatggctgaatccccagtagagccgaggaaggggattgagcttcagtcttctagtaacacctgtggaagagaaaaggcatttaatatgtttaataatccaaaaaatagctctgtggatcctgtgctaaatttgcattgtatggtgacacaatcttcctctaaagaagactgctcaatatccaatggaaaacttgaaactgttgtggatgttgataactttgtaaagggaactaaagattccagggtttgtaatgctttccctgcaaagggtcattttccatttccaactcaggcagcattgtcatctggggttaatgctgttcctgatcctctgaaaacatttgaaggtctttcaaagaccttaattaaatctccaaaacctgatgttgggacaattgtcagtgcaattcatgttctttcagaattgcttgtgcaaacatccatggatggagtagactcaaatagtgaacatggtcatgatgagattatgatccagcaaataatcaataacctaaatgatttcagcacaaaaagatgtggcctaaggattccaacccttgattcaactcccacagataatccatttggtcctgataggtcattggagggttccaagagtggacagagatttttagcatctagcagtgaacaccaggacaaaggcaatgaaatagctcaggttattaggaggagtctggggaaaactctgcattttgataaacacatgcacccagaggcgtcactgtttttgaacttatggcttgattctgaagcagaacgatgttataggaaatataaaacttatcattgccttatggaagctgggctggatgtaaattgcacaactgttgcggatgttaggctccatgctaggcatatgaaaactgtgtccacagtggatagtgataaagggaagtttcagttttcagcctacaccttctacgcttttagtacaatttctttaggagtgcacactgataatcatgacctgctttttctcgtacaattgaatgatgagtctgggaatccaatatggaaacatagagtagagagctggaaggaaaatgataataagaaaaggaagaaaaaggttgcacctaaggctgaaaatgagactccaattccaccagaacagcaaatggaaggaatgcaattaagttcaatgag

SEQ ID NO: 114648 - DNA, 633 bp, Glycine max
  Peptide Sequence Number=SeqID_231426
atggttgactccctcacacgaccctcttcttcacaccgtcgctcaaaatctcttggaccgcttgcaggtggcgtggaaaagcttattgtcatggatgcctcctatgatatgcttcaagcctgtaaaaatgctcaccacaatgccaccgttgagacccactttcttgttgctgacgaagactctgtggatttggttgttagttgcttgggactacactggactaatgatctgcctggagcaatgatacagtctagattggcattgaagcctgatggcttatttttagcagctattcttggtggagaaacattaaaggagctcagaatagcttgtacgttggcacaaatggagcgtgaaggagggatcagtccccgagtatcacctttggcacaggcatatgctgggaatcttttgactagggcaggtttcacccttccaggtgttgatgttgatgattatgtagttaaatatgaaagtgctctggagcttatagaacatctccgtgcaatgggtgaaacaaatgctctttatcaaatgaacaatatcctaaagagggacacagcgttagcaactgcagctatttatgattcaatgttttctgcagaagacggcactgtacctgcaacattccag

SEQ ID NO: 114649 - DNA, 396 bp, Glycine max
  Peptide Sequence Number=SeqID_231427
atggtgtacttggagcactgtctacttccaagagttaacgcttattcaaggattgtcaatggccttctgaaaaccgctttgggaccacctacagggtcaaccactgctttgtctccagcacaggatattactttccgacatgaatctgtgaaatgcttggtcagcattattaagtctatggaaactgccagccatttttttttttgctcagcaaaaataacatattatattaaagatgagtaccagaggcaaagcagcacagacaagagatgggaggtattatggatagcactgtcattgattatttggaatcacagaaatagcttggttttcaacaaccagccttccaaccctaaaaaagtcatggatgaagccttattccatacttggtcctga

SEQ ID NO: 114650 - DNA, 684 bp, Glycine max
  Peptide Sequence Number=SeqID_231428
atggggaaacaagggtctcataaaagtctgcgtccagagtttcagggttggcattccaaaactttgttgcttcatggcctgaaaagtgattcttcaaaatgcagttactgtagggggctctatgtagggaaaaagcacatcagggccattgttgtgatgtttggattgttgggttgcctttttcttcttgactctcttatcatctcttattttgagttcacaaatcttcaacccagtacagcctcaaataattcaattgtgtttcagggtagagattcctacatctacagcaaacgatcgccagtatatatgtatgaacggcttctaaacttggcttccagtgctcttgcagagaaggagttcaagcaagagtcatccaatttatgggtggaaacatttcggcaggcatctttatggaaaccttgttcagaaagaaaaactcaaaccaatcccaggaagcctgtgcaaaataatggctacatcttagtcagtgcaaatggaggtcttaatcaacaacgagttgctatttgcaatgctgttgctgtggcatctctccttaatgcaaccttagttattccaaagtttctttacagcaacgtatggaaggatccaagtaaaagttttcatctgttcaccagtgttgatttggatgtgaatgctgaaacattaataaatgttatttga

SEQ ID NO: 114651 - DNA, 981 bp, Glycine max
  Peptide Sequence Number=SeqID_231429
atggatgaatcactggttagcgaatatgcagagcacaatgatgccattttgctagttattgtacctgcagctcaagcacctgaaattgcttcatctcgagccctaaaatatgcaaaggaatatgatggagaaggtaccagaaccattggcattattagtaaaatagatcaagctgcatcagaccaaaaagcactggctggagtacaagctctcttgttgaatcagggtcctgcaaaaacatcagacatcccttggattgcattgatcggtcaatctgtttcaatagctacggcacagtctggatctgctggttctgaaaattcattagaaactgcatggagagcagagagtgaaagcctcaagtccatattgacaggagctcctccgagtaaacttggaaggattgctttagtggatgccctggcacaccagattcagaatcgtatgaagcttcggcttcctaaccttctttctgggttacaagggaagtctcagatagttcaggatgaattggccaggcttggtgagtctatggtcaccacttcagagggtacgcgtgctatagccttggaactttgccgtgaatttgaggataagtttctacagcacattaccactggcgagggagctggttggaaaattgtttcctgttttgaggggagatttcctgatagaatgaagcaattacctttagataggcattttgatatcaacaatgtgaagaggattgtgttagaagcagatggttatcagccttatcttatttcccctgaaaagggattgagatctctaatcaaaggtgttctagagcttgcgaaagagccgtcacgtctttgtgttgatgagaccgctattattgaggaaggcagaataggaaataacatgaatgttcatgttatagagcataacagaatacttggctggaaagaaatagtgggagatggaatgcagttgggaagaaatgggcttatgggaatataa

SEQ ID NO: 114652 - DNA, 2223 bp, Glycine max
  Peptide Sequence Number=SeqID_231430
atgacgccgttcttcctacttcactaccactataaccgcgaactatcccacttcaccaacaactatatcccaccctctgtcccttttttttctctcttcgctttctttctttcaattcatactcaccattggggtataatagggacacgacattgtaacggtggagttaagaaaatgaagccctgctgcacattcttcattctcctttcgctagttgttattctcgttgaatcttcatgcaaaaacgaagaccatgagctggtgtcaaaggcgttccaatctgtgtctggattcaactcttcctggttcgaaacaggttctaattgttcaaatgctgtgattaaagggataaatctttcgtccaaaaacctaagtgggaacatctcctggaagtatctgaggaacatgtccaagttggaggttctagatctgtctgggaattttctgcaaggccaagtcccaaattggttctggagaagctcaaccttattggtagtgaacctttccagcaacaggttcggagggagcattaacccggccacttcccaaaacagttccttttcatcgctgcaaaatctcaatctctcacacaacaggttcaccaaccagcttcacctctctggtttctcaaatcttaaaagcctcgacctttcgcacaacaacctcggaaccttgccttccgggttccaaaacctcactaccaatctacaccacctcgatctctccaactgcaacatcaaaggaaacgtaaaacccatctcctccctcaccaaactttcatccttggatttatcaaacaacacgttgaacggtagtttcccctctgacttccctcctctgaacaacatcaaattcttgaacatctcccacaacaacttcaaagcctccaccaccttagacaggttcataaagttcggcaaatcagcgttcattcacgccggcaacaacttcaactactacaacgcatcaaaaacgccaaagcttcgttcaactccaactccaaccccaccgcaccaacagccccaccacattcacgcgaagaagaagaagcggccaaaagaaaaacaaaagtcaaaacacaaaaccagaaccatgatgattgtggcctcggcacttgttgtcgttgtcgcgttgtgcatgtgctgggtgtggtgttgcaggaggaagaggcaattggcgaaaaggagcaagtgggcgatctcgaagccggtcccactgagcatgaagataatggaaaaatcaggaccgttcgcgttcgagaccgagtcagggacatcatgggttgctgacctcaaagaaccctcttccgcagccgtggtcgtgttcgagaagccactcatgaaactcaccttcgtcgaccttctcgctgccacgtcacacttcggaaaagactctctcctcgctcagggcaggtgtgggcccgtttatcgcgctgtcttacccggagacatccacgtggcaatcaaggtcctcgaaaacgccagagacgtccatcatcatgacgctgtcgctctcttcgttgacatttcccaactcaaacaccccaatctcttgcccctctccggttactgtattgcaggtaaggagaagctggtgttgtatgagtttatgtcgaacggggatttaggtaggtggttgcaggagctaccaacaggggagactaacgtggaggattggagtggtgacacgtgggacattattcataacggcgccgtttctcgagcctcaccccccgaaaaaatggggtggttaatacggcaccgtattgcggtgggtgtggcgcgtggattagcgtttctccaccacgcggggtcgaggcccgtcgtgcacggccacctggtgacgtcgaacgtgcttctcggcgacgacttcgagccgcggatcgcggatttcgggtttcggaaactcgggcgagagagcgcggcggcgaattgttccaccgagacggacgtttactgtttcggggtggtgctgatggagcttctgacggggaaggccggcacggcggagacggtggtttgggtgaggaaggcggtgagggagggccacgcggtgaggacgttggatgagaggcttaaactcggcggcgactcggagagtgagatggtggagagtctccgagtcgcctatttgtgtacggccgagtctccggggaagaggcccaccatgcagcaagtgttgggccttctcaaagatattcacccgagtcatggactcgactga

SEQ ID NO: 114653 - DNA, 1539 bp, Glycine max
  Peptide Sequence Number=SeqID_231431
atggccgacgtcgtttccaagtccccaaccccaaccagcaacctcatcagccccaacaagaaggaaacatcgaaccttttactgggtcgtttcgagattgggaagctcctcgggcatggaaccttcgccaaggtgtactacgcgcgtaacatcaaaaccggcgaaggcgtggccatcaaggtaatcgacaaggagaagatcctcaaaggaggtttggtggcgcacatcaagcgtgagatctctatcctgcgccgtgttcgccaccctaacatcgttcagctcttcgaagtcatggccaccaagagcaagatctatttcgtaatggaatacgttcgcggcggcgagcttttcaacaaggtcgccaagggaaggctcaaagaagaggtcgcgagaaagtactttcagcaattaatctctgctgtgggattctgccacgccagaggggtgtaccacagagatctcaagcctgaaaatttgttgcttgatgagaatggcaatctcaaagtctctgattttggattgagtgcggtgtctgatcaaatccgacaggatggtcttttccacactttttgtgggacacctgcgtatgttgctcctgaggttttggcgaggaaagggtacgatggtgctaaggtggatctttggtcttgtggggtggtgttgtttgtgttgatggcggggtatttgccctttcatgaccagaatgtgatggcaatgtataagaagatttatagaggggagtttcggtgtccgaggtggttttctcctgatttgtccaggcttctcacaaggcttcttgataccaagcctgaaacccggattgcgattcctgaaattatggagaataagtggttcaagaaagggtttaagcagatcaagttttatgtggaggatgataggctttgcaatgtggtggatgatgatggccttatggacaatgatgatgacactgcttcgattgtttctgttgcttcgttttcggattactcggtttccgagtctgattctgagattgagactaggaggaggatcaatgctcccttgcctagacctcctagtttgaatgcctttgacattatatcgttctcgccgggctttaatctttcggggttgtttgaggagaaagaggatgagacaaggtttgtgactgctgcaccggttaacaggatcatttccaagctggaggagattgctcagttggttaggttttcggtgaggaagaaggattgcagggtgagtttggagggtaccagagagggggttagagggcctttgactattgctgctgagatatttgagttgacaccttctttggttgtggtggaggtgaagaaaaaaggaggggatagagccgagtatgagaggttttgtaacgatgagttaaagcctggattgcagaatttgatggtggaggagtctgctacttcttcagagttgtctacacctattcaaccttccctactacgtggcctttctgaacctgtgccggatatttcttctgatattgaaaccccgctctgtataccttctgatgattga

SEQ ID NO: 114654 - DNA, 264 bp, Glycine max
  Peptide Sequence Number=SeqID_231432
atggcatgggagctaatgcttaaatgcatgaatttggaagttgtaatgtgccaaagatttttgttaaagaaaagtgcaaaaactaatggttggagcaggcgatggtttgtgctaaatgagaagacaggaaagacaagaaaagggaacaggccaaacagccctgagttgataaaaaaatggcagtcaactgccataagatgtcagcttgtgtacagagagttgcctgaaaacgtgagacagccactgaaagttaaatcagggtga
